United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 45

SEQ ID NO: 205714 - protein, 175 aa, Glycine max
  Coding DNA Sequence Number=SeqID_88936
MGETHEMPHHNLADFEPCLGYATKGQAVGGIPLQNTLEGTQYHPQPHPLHSTAGKNPHAMAEMGNLDHLEERLRAIKGGKDYAFANLEELFLVPNIITPPKFKVPDFDKYKGTTCPKNHLKMYCRKMGAYTKDEELLIHFFQESLIGVAVTWYTNLEPSRVHSWKNLMVAFVRQY

SEQ ID NO: 205715 - protein, 160 aa, Glycine max
  Coding DNA Sequence Number=SeqID_88937
MEEKKKKQLDEAAKSRSTYTVIDPPSSIRRHVKWKMAHTKKIGQMTYEAAKEIANKIVSHIQLIPWRSKPHRVPLSPMDVRIRCHDQAILWTGSKDLPHVFVHGSQRLRATGAKNQGLAGGGLTLPPKHEVDLSAACVSTKESCVDPSGNDPKMGDLDKC

SEQ ID NO: 205716 - protein, 76 aa, Glycine max
  Coding DNA Sequence Number=SeqID_88938
MAVQLIRDRVEMECLEGVWETLEGNTRCRFRGTIRFTATSLVHPDEPARTLQRTAFDDCIHVAEATAMDTFALDDT

SEQ ID NO: 205717 - protein, 232 aa, Glycine max
  Coding DNA Sequence Number=SeqID_88939
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=99%, E-value=2e-17, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPLEDYRSSPLEDYTSSPLECYRPSPSEDYTSSPSYGCTQTFRGLDILALRGLRVLLFRGPHVLAIRGLHTLTFRGLNVITFRGLHVLTFRGRHVLPLRGPHVLTIRGLHALAFRGLHVLSFRALHLLPYKGLYVLAFRVMEVLTIRGLYVLAFRGLHVLTIRGRHVLTIRGFHALAFRGLPVLTFRGLHVLLFRGLHVLLFRGLHTLAFRGMDIFTFRGLHALTFRGLH

SEQ ID NO: 205718 - protein, 155 aa, Glycine max
  Coding DNA Sequence Number=SeqID_88940
  Gene Ontology: Mol. function=pyruvate kinase activity; Biological process=glycolysis
  Homolog annotation: Hit_ID=Q56XD5; Match level="QueryCoverage=38%, HitCoverage=10%, E-value=2e-23, Identity=93%"; Hit description =Pyruvate kinase
  Pfam annotation: Domain name=PK; Domain location=2-127; Score=-254.4; E_value=0.029; Accession=PF00224.11; Description=Pyruvate kinase, barrel domain
  Subcellular localization annotation: CTP_CleavageSite=20; ConfidenceScore=5.06e-01
KRKSAQYANRLSPRVGRFINAAGTTADNNFTQETAMTMITNSSSVPAELPIEEVPLLQEEIINLCRSMGKAVIVATNMLESMIVHPTPTRAEVSDIAIAVREGMQAWHWPSFYNVVTGKTLALPNLIALQHIPLSPAGVIAKRPAPIALPNSCAA

SEQ ID NO: 205719 - protein, 151 aa, Glycine max
  Coding DNA Sequence Number=SeqID_88941
ITTHSSKLEGGGHMNEKAIHGAPKKGEIGELHYAITTHGSKLEGGGHMNENRIQGSPKKGENGELHYAITTHGYELEGGGLMIENAIHGAPKKGGGHMNENAIQGSPKRLRMENCTKQSLRMAPNSKVESSLSIPSISRGRPVPAFVPCTE

SEQ ID NO: 205720 - protein, 193 aa, Glycine max
  Coding DNA Sequence Number=SeqID_88942
MVQSNSSRLGFPALITALCRTRGVDSDSLVFERLSPVINLAYIWKNCWNPDDPTIIIRGARRPRARPAETPSTSVTPPPARIAVAPSTPPPGQIILLQCLQLVAPPDPIPTVEKFNEWVAWPRTQPPPHRDDEDPAAQVPHQPSDESSDSSTPEPLIRKRRVVLTQEVTTTPEKSPEATPEPPTLVADTTSPQ

SEQ ID NO: 205721 - protein, 127 aa, Glycine max
  Coding DNA Sequence Number=SeqID_88943
PFIPTKDLNGELVPKEWDEMKDDEKRKVQDDKKAKDILTFGEKLRRRYGKCLKSLMNVEARLHDECDSKMMTKVMNKKLKDQRTTKVNQRTIQEFKNQEEFKTQGESLESRIKIQDSRSQESRSRFK

SEQ ID NO: 205722 - protein, 125 aa, Glycine max
  Coding DNA Sequence Number=SeqID_88944
MLQSIHQRQIILLQSLYVVAPPGSIPLVEQFREMDESSKATILEPFVIEEEVEETQVTSEPPAPLVNLPSPQRTTDPSTPILEMPEDPTTLVLAMDTSPPATPVLHLTDEQDVQTLDTQDQSQEF

SEQ ID NO: 205723 - protein, 103 aa, Glycine max
  Coding DNA Sequence Number=SeqID_88945
  Gene Ontology: Mol. function=two-component response regulator activity; Biological process=two-component signal transduction system (phosphorelay)
  Homolog annotation: Hit_ID=Q8Z9P2; Match level="QueryCoverage=72%, HitCoverage=74%, E-value=7e-15, Identity=48%"; Hit description =Putative transcriptional regulator
MTKKWIKPFLVQYIHQRQSGCANLKEDVMKTYLINNNCIYNEQKYELRTSSNSQVIRMTAMRSKCLSFIIENAHLEIIERQKITNELWGSRSHFVNDANLTQI

SEQ ID NO: 205724 - protein, 91 aa, Glycine max
  Coding DNA Sequence Number=SeqID_88946
HYEYSDKVIKFEIIELKIDDDMLKVLVQSNYWKQFGPIEILAVFSKQTNLYNAAFYLCTEWATALPENDNVYSTTTPLVVKDNSLVTKPVT

SEQ ID NO: 205725 - protein, 91 aa, Glycine max
  Coding DNA Sequence Number=SeqID_88947
  Gene Ontology: Mol. function=DNA binding; Biological process=DNA integration
  Homolog annotation: Hit_ID=Q1T192; Match level="QueryCoverage=99%, HitCoverage=18%, E-value=1e-11, Identity=50%"; Hit description =Polynucleotidyl transferase, Ribonuclease H fold
MANFLANFAENNQTTLNWWSLYIDSASNVKGSKAGIILKGPNNVTLEQTLKLNFKASNNQVESTTYLGRATQEQTCSPNCPALKRSGTSRL

SEQ ID NO: 205726 - protein, 248 aa, Glycine max
  Coding DNA Sequence Number=SeqID_88948
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-29, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGIVHEPQVDPWVLVPIFFRGLCVLTFRGLYVLTFRGLHVLAFRGLCTLTFRGLHVLASRGLHVFTFRGLHALSFKGLHVLAFRGLHVLAFRGSCTLASRGLHVLTFKGLHALSFRGLHVLDFRGLRALAFVGLHALTFRGLDVLTFRGLYVLTFRGLHVLTFRALHALILRGLHVLTFRGLHVLAFRGLHVLTIRGQHVLVFRGLHALILRGLHVLTFRGLHILAFRGLHILTFRELHSLAFKGLY

SEQ ID NO: 205727 - protein, 323 aa, Glycine max
  Coding DNA Sequence Number=SeqID_88949
MNGRRYRFVRFKGVEDESLLERQLDNVIVEAEDRRKKTGAREPKKTEEQDHIQRGVRAKQTSYAEVVTGKRREAHSGERGLSSVYFEPTEEMLKWLNDAWVARLSNLANFDKVEDQLRWDYGMDISTTYLGDDMILILGLTDERVEQLMNEVGHSTLPLFYSLQKWSPSLRPGYRLAWVHYWGIPILAWEVAVIKKILGVMGEVLEIDEEVEERRRMDRARVLLKTPWKPSIQHTVVVHIGSEVHEVQILEERGPNVDLRQGTTWTGAMSSEEIDSNGSFMESPTSDKSQARIEIATRDEEEQPNGVVRDIGWLGYTVGESQS

SEQ ID NO: 205728 - protein, 64 aa, Glycine max
  Coding DNA Sequence Number=SeqID_88950
  Subcellular localization annotation: CTP_CleavageSite=51; ConfidenceScore=5.21e-01
MNSLSEHAALSEFISTHCVYMHSRKNSLSAPTALSDRALSRAFLGQARFVAASAELSELRSLSS

SEQ ID NO: 205729 - protein, 163 aa, Glycine max
  Coding DNA Sequence Number=SeqID_88951
MENNSQNHHHQHHGFSAKSSSTKERRGLDFDLNEPIIDTSFETSPLVPADNINNCLVEMEGCQPLAPPTQDVAEQVHSSNDAEKVKFRFDLNAKPDEEEEVSAKVGGGSETHAAVSESADNVGPDNGLELTLNNDVHPTHAADDSDYEEDRASIGEGGSDTEN

SEQ ID NO: 205730 - protein, 475 aa, Glycine max
  Coding DNA Sequence Number=SeqID_88952
  Gene Ontology: Mol. function=transcription factor activity; Cellular component=nucleus; Biological process=regulation of transcription, DNA-dependent
  Homolog annotation: Hit_ID=Q1S689; Match level="QueryCoverage=99%, HitCoverage=84%, E-value=1e-107, Identity=53%"; Hit description =Pathogenesis-related transcriptional factor and ERF
  Pfam annotation: Domain name=AP2; Domain location=108-179; Score =93.7; E_value=5.8e-25; Accession=PF00847.10; Description=AP2 domain
  Pfam annotation: Domain name=AP2; Domain location=208-273; Score =122.9; E_value=8.8e-34; Accession=PF00847.10; Description=AP2 domain
  Pfam module annotation: Pfam domain module=AP2::AP2; Domain location =108-179::208-273
MDNNQQHPKLENFLLEKPATGGGGCPKNTNSIGLSMIKTWLRKQMSSQSDAANTSLSMSTTRVSESGTVALPLLTAGEESSSSKSKQSGILNVDTVSRKSADTFGKRTSIYRGVSRHRWTGRYEAHLWDNSSRREGKTSKGKQGGYDKEEKAARAYDLAALKYWGATTTTTNFPIIHYEKELEEMKNLTRQEYVASLRRKSSGFSRGASIYRGVTRHHQHGRWQARIGRVAVNKDLYLGTFNTQEEAAEAYDIAAIKFRGLKAVTNFDMNRYDVKSILESSTLPIGGAAKRLKDADEQVDLTIMDPQTPHVDSNINIFGASHHSLALHQPQPYSHLNYTYGQKFWIDSASVDNNNNSSGSNYVIYGGGDGYAIPMATPTFNIADDDDVVQNSRSNGLEHNDVKMLGYENVLSSSTDPYHARDLCYLSQPASGDTVKGSAYDACNTWVPFVIPSTLALRHTNDLCSGASPFTLLHE

SEQ ID NO: 205731 - protein, 173 aa, Glycine max
  Coding DNA Sequence Number=SeqID_88953
  Gene Ontology: Mol. function=sequence-specific DNA binding; Cellular component=nucleus; Biological process=regulation of transcription
  Homolog annotation: Hit_ID=Q1S442; Match level="QueryCoverage=94%, HitCoverage=18%, E-value=3e-12, Identity=35%"; Hit description=DNA -binding WRKY
  Pfam annotation: Domain name=WRKY; Domain location=1-38; Score=24.9; E_value=6.4e-07; Accession=PF03106.6; Description=WRKY DNA -binding domain
AYYKCISAGCYVRKHVERDSCNRKIVINTYEGKHNHEQPPPRRKRHQIQLVDDEEDEDEDEDDGLMTFQFAATGNFLNNPNPAETDQVHTLQLRNDMNPDQFANGFLSPNNHFGSFNNNINMNIGSSSYTPQMHYYSSLNNTKAMPQSSYGLNFGSDAAPQPGPSGVPGAGDN

SEQ ID NO: 205732 - protein, 178 aa, Glycine max
  Coding DNA Sequence Number=SeqID_88954
  Pfam annotation: Domain name=WRKY; Domain location=130-166; Score= -13.8; E_value=0.035; Accession=PF03106.6; Description=WRKY DNA -binding domain
MDFSNASPSPTQVDQQNDEKKVKVSLSFDLNSKPEEEEEEPISFSEEARAKVGGGCETRGASTSEPDDHIQQVALPTDAAHNHRVNIVDPESHSQNRKRKRSDNRGMGSVFRRETFVLPFETQSETVIFVDDGYQWHQYGLKTMKGNLFPRYCALSLLGAHCIHKMENIDECYALCSV

SEQ ID NO: 205733 - protein, 425 aa, Glycine max
  Coding DNA Sequence Number=SeqID_88955
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q8L868; Match level="QueryCoverage=84%, HitCoverage=84%, E-value=1e-131, Identity=63%"; Hit description =Putative glucan endo-1,3-beta-glucosidase 11 precursor (EC 3.2.1.39) ((1->3)-beta-glucan ...
  Homolog annotation: Hit description=endohydrolase 11) ((1->3)-beta -glucanase 11)
  Pfam annotation: Domain name=Glyco_hydro_17; Domain location=25-348; Score=397.6; E_value=1.8e-116; Accession=PF00332.9; Description =Glycosyl hydrolases family 17
MDHRHWRFFIMLFITAAAIGLVSSLGINYGQIANNLPSQDDAVALVKSIGATKVKLYDADPRVLKAFANTGVELMVGLGNEYLSRMKDPKQAQAWIKANLQPYLPATKITSIFVGNEVLTFNDTSLTSNLLPAMQSVHAALINLGLDKQITVTTTHSLAVLQTSYPPSAGAFRPDLAPCLAPILSFQAKTGSPFLINAYPYFAYKANPKQVPLEYVLFQPNEGMVDPSSNLHYDNMLFAQIDAVYSALDSLGYGKLPVHISETGWPSKGDQDEAGANLENAKKYNGNLIKMAMSSSSSAKKGTPCRPNEDLNIYVFALFNENMKPGPASERNYGLFKPDGTPAYPLGFSLASVPVVAGNNNTGVASTPPQPTSPTSSTGYLSISSASSLKIDFVENDTFDTAIPKTNFKFACHNSYFNSPIYRSN

SEQ ID NO: 205734 - protein, 248 aa, Glycine max
  Coding DNA Sequence Number=SeqID_88956
  Gene Ontology: Mol. function=porin activity; Cellular component =nuclear pore; Biological process=transport
  Homolog annotation: Hit_ID=UPI000016318A; Match level="QueryCoverage =79%, HitCoverage=20%, E-value=3e-45, Identity=47%"; Hit description =transporter
  Pfam annotation: Domain name=Nucleoporin2; Domain location=102-245; Score=39.8; E_value=6.1e-09; Accession=PF04096.4; Description =Nucleoporin autopeptidase
MPLLFFSMPCSGNISSEACVAPPDRTSSKDKDKERNISNEACVTPPVGTSSHDKDKELENGLVKEQARPITTKQTSNGSNEDHSPQKADSGHRAGEDSIVYEHEADAEVLMPKLRRSDYCTLPRMPEPVAKERAEPGFCCHVEDFMLGRQGYGSIRFLGETDVRGQALESLVQFNTRGVIAYMDNSTKPPVGQGLNKLAEGSKIEKYKEMLKRMVEDQGADFVSYDPIKGEWKIRVKHFSVYKLVPGR

SEQ ID NO: 205735 - protein, 1240 aa, Glycine max
  Coding DNA Sequence Number=SeqID_88957
  Gene Ontology: Mol. function=DNA binding; Cellular component=nucleus; Biological process=regulation of transcription
  Homolog annotation: Hit_ID=UPI00000529F6; Match level="QueryCoverage =99%, HitCoverage=99%, E-value=0.0, Identity=49%"; Hit description =transcription factor
  Pfam annotation: Domain name=FYRC; Domain location=1059-1160; Score =44.9; E_value=2.7e-10; Accession=PF05965.4; Description=FY rich C -terminus
  Pfam annotation: Domain name=FYRN; Domain location=1037-1084; Score =29.5; E_value=1.2e-05; Accession=PF05964.4; Description=FY-rich N -terminus
  Pfam annotation: Domain name=JmjC; Domain location=389-511; Score =215.6; E_value=1.1e-61; Accession=PF02373.13; Description=JmjC domain
  Pfam annotation: Domain name=JmjN; Domain location=148-192; Score =96.7; E_value=6.9e-26; Accession=PF02375.7; Description=jmjN domain
  Pfam annotation: Domain name=zf-C5HC2; Domain location=618-671; Score= 71.9; E_value=2.1e-18; Accession=PF02928.6; Description=C5HC2 zinc finger
  Pfam module annotation: Pfam domain module=FYRC::FYRN::JmjC::JmjN::zf- C5HC2; Domain location=1059-1160::1037-1084::389-511::148-192::618-671
MGTELMRICVKEDNDDFPSVPPGFESYTSFSLKRVESNEKQDDKNMTSCSASTSASESPSTQVENDVQGGDTRKVPRSLRRRPWINYGQYENISDEDPDCEQLDQNFSSRPCLPRGVIRGCPDCSHCQKVVARWRPEDARRPNIEDAPVFYPTEEEFQDTLKYISSIRSRAESYGICRIVPPSSWKPPCPLKEKSIWEGSKFSTRVQRIDKLQNRNSMRKMPKIQTNMKRKRRRCTRMGVDNSIRTGPNAGFCEAERFGFEPGPEFTLETFQRYAEDFQLKYFRKNENVSHLGANTTILNGTSEPSVENIEGEYWRMVESPTEEIEVLYGADLETGIFGSGFPSKSSQVGSASHEQYIKSGWNLNNFARLPGSLLSHESCDISGVLVPWLYVGMCFSSFCWEPMHVHHVEDHHLYSLNYMHWGAPKMWYGVPGKDACKLEEAMRKHLPELFEEQPDLLHKLVTQLSPSILKSKGVPVYRCIQNPGDFVLTFPRAYHSGFNCGFNCAEAVNVAPVDWLPHGHIAIELYQEQGRKTSISHDKLLLGAAREAVRAQWELDLLKKNTLDNLRWKDVCGKDGLLAKALKMRVEMEQARREFLCCPSQALKMESTFDATDERECNICFFDLHLSAAGCRCSPDRYACLDHAKQFCSCSWDSKFFLFRYDISELNILVEALEGKLSAIYRWAKSDLGLALSSFVSAGKETIPEELKSNSSNLSHSSRVTVHKEMSMNPSNKYIDDSQLIDVPIENQANSKDQSYFQQRKSVEAISSLSSMKELLTFKGSKPTSEMANHKICVNKEESVICRSNMRAPGCQLSKEDTSYALSVPLAQDGGEKSSLNRHNNSIILLSDDEDDEKMSNSNRRKEFSLMLAGPRDKAIPCNDIENTKLTISVSDSAVMGEKDAITLPRENMSSDSTWLLHVKEECHEQTGTVLTSTLVDLSCHMGLTSTESTRNIPAPSKVEASDHCLESLEVCPPNPQLSGIKVKTEDNHEKLGGCTTSNVADNARAVNGNFSCGPNNYRQKGPRIAKVVRRINCNVEPLEFGVVLSGKSWCSSQAIFPKGFRSRVRYINVLDPSTARCWELVREKVNQEIAKQHKLGRKGLPPLQPPGSLDGFEMFGFSSPAIVQLSVYNEPAFFQQAIEALDRSRLCNEYWDSRPYSRPQGQISQSIQTNVNGGNAQGVVLNKHMPVEVVAVLRSLFKKSNAEELNLLYSILSDNRPEADRNLVAQLLNEEVHKSQPP

SEQ ID NO: 205736 - protein, 149 aa, Glycine max
  Coding DNA Sequence Number=SeqID_88958
  Gene Ontology: Mol. function=metal ion binding; Biological process =metal ion transport
  Homolog annotation: Hit_ID=Q1SEG6; Match level="QueryCoverage=92%, HitCoverage=88%, E-value=4e-22, Identity=41%"; Hit description=Heavy metal transport/detoxification protein
  Pfam annotation: Domain name=HMA; Domain location=20-80; Score=41.9; E_value=2.2e-09; Accession=PF00403.16; Description=Heavy-metal -associated domain
MALLEIYRGFEKESEYETVELKVRMCCTGCERVVKNAIYKLKGIDSVEVDLEMERVTVGGYVDRNKVLKAVRRAGKRAEFWPYPNPPLYFTTADHYFKDTAHEFKESYNYYRHGYNLPERHGTMHVSHRGDDNVSNMFNDDNVNACSIM

SEQ ID NO: 205737 - protein, 105 aa, Glycine max
  Coding DNA Sequence Number=SeqID_88959
  Homolog annotation: Hit_ID=Q26DY7; Match level="QueryCoverage=75%, HitCoverage=35%, E-value=1e-10, Identity=68%"; Hit description =Permease, MFS family
MKAWAVYDWANSVYSLVITSTIFPIYYSILTTAYEKKDITASVGFWGSLVFYNSFLPDIATPDKQDALSAKGYVYGYIGSVVLVVICLVLIQVFAKGAAQQLLPL

SEQ ID NO: 205738 - protein, 121 aa, Glycine max
  Coding DNA Sequence Number=SeqID_88960
  Pfam annotation: Domain name=zf-CCHC; Domain location=70-87; Score =10.4; E_value=0.019; Accession=PF00098.13; Description=Zinc knuckle
  Subcellular localization annotation: CTP_CleavageSite=33; ConfidenceScore=5.04e-01
MTGFLRFFRRFPQINVGGDSTHFPSLEDAPMSLASVARKRRFNKFLRNKGNQRRSNINPKKKGEDSSLVPKCYECNQPRHLRFNCCVFKGRMEKSDKRKRKHTSLGKIMTWILQVIQKMKS

SEQ ID NO: 205739 - protein, 171 aa, Glycine max
  Coding DNA Sequence Number=SeqID_88961
  Gene Ontology: Mol. function=inositol or phosphatidylinositol phosphatase activity; Biological process=vascular tissue development (sensu Tracheophyta)
  Homolog annotation: Hit_ID=Q712D7; Match level="QueryCoverage=100%, HitCoverage=15%, E-value=6e-49, Identity=54%"; Hit description =Inositol polyphosphate 5-phosphatase
  Pfam annotation: Domain name=WD40; Domain location=22-60; Score=5.4; E_value=8.5; Accession=PF00400.22; Description=WD domain, G-beta repeat
  Pfam annotation: Domain name=WD40; Domain location=77-114; Score =11.5; E_value=1.7; Accession=PF00400.22; Description=WD domain, G -beta repeat
  Pfam module annotation: Pfam domain module=WD40::WD40; Domain location=22-60::77-114
DLYASWCGVGGEEVVARSGDEESAPFRESVWTSPALCLVADEGNRLVWSGHKDGKIRCWKMDDDDDNNDNCDWSNRFTESLSWHAHRGPVLSLTFTSYGDLWSGSEGGGIKIWPWEAVEKSIHLTKEERHSAVIFVERSYVDLRSQLSTNGFSNMLTSDVKYLVSDNLRAK

SEQ ID NO: 205740 - protein, 316 aa, Glycine max
  Coding DNA Sequence Number=SeqID_88962
  Gene Ontology: Mol. function=inositol or phosphatidylinositol phosphatase activity; Cellular component=integral to membrane; Biological process=vascular tissue development (sensu Tracheophyta)
  Homolog annotation: Hit_ID=Q84W55; Match level="QueryCoverage=84%, HitCoverage=21%, E-value=1e-92, Identity=63%"; Hit description=Type II inositol-1,4,5-trisphosphate 5-phosphatase 12
  Pfam annotation: Domain name=Exo_endo_phos; Domain location=47-314; Score=1.4; E_value=0.0099; Accession=PF03372.13; Description =EndonucleaseExonucleasephosphatase family
MGWEGGDRVKFFSVRAMAGYCVARVTCNGLEGETQRNPQAMVGLEGSSVGQWWLDMIGKTLDEGSTFERIGSRQLAGLVIAVWVKTNIRFHVGDVEVAAVPCGFGRAIGNKAVARFSTRFYGVLQFQGAVGLRIRVYDRIMCFVNCHFAAHLDAVGRRNADFDHVYRTMSFSRPTNLLNTTADLACHWSLQLALHLLFQRFVVQILLDEALILEIGFQSAEGMPELSEADMVVFLGDFNYRLDDISYDEARDFVSQRCFDWLRERDQLRAEMEAGNVFQGMREAVITFPPTYKFERHQAGLAGWPPAQNKNTQMVS

SEQ ID NO: 205741 - protein, 188 aa, Glycine max
  Coding DNA Sequence Number=SeqID_88963
  Gene Ontology: Mol. function=oxidoreductase activity, acting on the aldehyde or oxo group of donors, disulfide as acceptor; Biological process=metabolic process
  Homolog annotation: Hit_ID=UPI0000669720; Match level="QueryCoverage =99%, HitCoverage=27%, E-value=4e-60, Identity=61%"; Hit description =2-oxoisovalerate dehydrogenase, E1 component, alpha and beta subunit
  Pfam annotation: Domain name=E1_dh; Domain location=1-188; Score= -141.9; E_value=0.062; Accession=PF00676.10; Description =Dehydrogenase E1 component
MADIYEENRNVCKYVHSTSRGHEAIQLATAYQLKKEDWVSPYYRDESILLGIGFEPYQLMLQLLAKAEDPFSGGRSYYSHPSSRDEKMPKIIHQSSATGMQTIPTTGVAQGIKYIQDFNLQNFENNPVVVCSLGDNSVTEGEVSEALQFAALHQLPIIFLVQDNEWGISVTKEEARTCDAYDFVAGFT

SEQ ID NO: 205742 - protein, 224 aa, Glycine max
  Coding DNA Sequence Number=SeqID_88964
  Gene Ontology: Mol. function=DNA-directed DNA polymerase activity; Cellular component=cytoplasm; Biological process=DNA replication
  Homolog annotation: Hit_ID=UPI000068CF89; Match level="QueryCoverage =95%, HitCoverage=14%, E-value=7e-51, Identity=46%"; Hit description =DNA polymerase III alpha subunit
  Pfam annotation: Domain name=Exonuc_X-T; Domain location=2-182; Score= 49.7; E_value=1e-11; Accession=PF00929.14; Description=Exonuclease
MYLVFDTETTGLPKNFNAPLSDSDNWPRMVQIAWQLHDDDGTLIENQDYIIKPEGYDIPFNAARIHGITTKIANEEGRDLEEILKEFSTVLEKVRVVSGHNVEFDYNIVGAELFRKNIKDILQEKPKADTMILGTNFCELGGGRGGRFKPPKLEELYEKLYGNKFDEAHNAAADVNATAQVFFEMMRIGVIPSDVLKISEDQLAYFKTLHPDPIKPFDIVIRRQ

SEQ ID NO: 205743 - protein, 98 aa, Glycine max
  Coding DNA Sequence Number=SeqID_88965
MSEVKKKHCCTIREKFRNISEATKGMITGRRTEQKGSTLLISENHLKLVRKIVSVKKIQGKVLPVTLPRRFRGQFHEDFSPFFIVLRSFFIVLQPLSS

SEQ ID NO: 205744 - protein, 534 aa, Glycine max
  Coding DNA Sequence Number=SeqID_88966
  Gene Ontology: Mol. function=ATP-dependent helicase activity; Cellular component=intracellular; Biological process=response to DNA damage stimulus
  Homolog annotation: Hit_ID=Q6AFJ8; Match level="QueryCoverage=81%, HitCoverage=59%, E-value=1e-122, Identity=55%"; Hit description=ATP -dependent DNA helicase RecG
  Pfam annotation: Domain name=DEAD; Domain location=367-534; Score =108.1; E_value=2.6e-29; Accession=PF00270.19; Description=DEADDEAH box helicase
  Pfam annotation: Domain name=ResIII; Domain location=363-528; Score= -10.5; E_value=0.00035; Accession=PF04851.6; Description=Type III restriction enzyme, res subunit
  Pfam annotation: Domain name=tRNA_anti; Domain location=153-234; Score=32.3; E_value=1.6e-06; Accession=PF01336.15; Description=OB -fold nucleic acid binding domain
  Pfam module annotation: Pfam domain module=DEAD::ResIII::tRNA_anti; Domain location=367-534::363-528::153-234
AGLGHDSRVTTDDRSGLASALHELCGRRAAAERLETEGPRTGVEVEHSSSGDGAQRLERAEEGFADPVARRACPRTRHVEPGTSGAACDDPRHPMPLTLDSSLEDALGAASAKTLGRAFGMQNVGDLLAHYPRRYADPGELTPIRDLPLGETVTIVAEVLSSSFRRMRNRPGAMVDVVIGDGIGRMSLTFFAKNVGAAEWRSKDLAVGRRGVFSGKVGEFNGVTQFAHPEYELFDDEDAARRSADARAAVPIPIYPATSAIQTWQIARLVGRVLDDLASVPDPLTEEIRVREELLSAREALERIHRPRTRNDIDPAVRTLRMHEALTLQTALLQQRDAVRALSATSRPAHPGGLLERFDAGMPYTLTPDQETVGAQIAADLVGAWPMNRLVQGEVGSGKTLVALRAMLQVAESGGQAALIAPTEVLAGQHLRSITKMLGPDLAPLLMPTLLTGQLPAAERRKAALRVASGQALIVVGTHALLGEKTTFADLGLVVVDEQHRFGVEQREALRAKGSSPHALVLTATPIPRTVAMT

SEQ ID NO: 205745 - protein, 156 aa, Glycine max
  Coding DNA Sequence Number=SeqID_88967
  Subcellular localization annotation: CTP_CleavageSite=29; ConfidenceScore=5.06e-01
MLAAQLAQASSARPGELSSPRRAGLLPPEATAFWRNLLEGPNGPGTSRGPKNGRTLSSKGPRTKLGYDTDGKQRPSLVILHPRYAEIPYGYLHPFARQTQLCPMASRDQVWSFCTQDTRRYLTVICTPLLGRHSCVRWQAETKFGHSAPKIRGDTL

SEQ ID NO: 205746 - protein, 398 aa, Glycine max
  Coding DNA Sequence Number=SeqID_88968
  Gene Ontology: Mol. function=hydrolase activity; Cellular component =cytoplasm; Biological process=cell adhesion
  Homolog annotation: Hit_ID=Q8PGZ3; Match level="QueryCoverage=98%, HitCoverage=34%, E-value=1e-157, Identity=68%"; Hit description =Alpha-1,2-mannosidase
  Pfam annotation: Domain name=Glyco_hydro_92; Domain location=1-245; Score=-42.6; E_value=3.5e-19; Accession=PF07971.3; Description =Glycosyl hydrolase family 92
MFDPDAGFFQSRKADGRWRVDAKAYDPRVWGHDYTESNGWTFAFTAAHDGEGLAALYGGREKLAAKLDTFFATPETADPALAGSYGGTIHEMTEARDVRMGMYAHSNQPAHHIPWMYLYAGQPWKTQQHVREILSRLYVGSEIGQGYPGDEDNGETSAWYVLASLGLYPLRMGAPEYVIGSPAFRHARVELQGGAVLTVNATNNSRENVYVQSLKINGTPWTKTWVPHDLIAKGATLDFVMGPRPSRWGSGVDDVPRSLTPRGQRPQLLHDLLGSGTKATLADGRALPALLDDDAGTTVGLGSGATIALTGLAEGTPTMYTLTSGDGRIQGGEWTLEARNGSGSWAVLDQRSGEDFESARQTRPFRIAKPGRYSEYRLRLAAPARLPLAEIELLSAGT

SEQ ID NO: 205747 - protein, 60 aa, Glycine max
  Coding DNA Sequence Number=SeqID_88969
MHHQKGKTLGEASLLSSNRYKDTHQEVTTYQRLYTSMSETTNKGNNIEAKPQTNGNGMEL

SEQ ID NO: 205748 - protein, 111 aa, Glycine max
  Coding DNA Sequence Number=SeqID_88970
  Gene Ontology: Mol. function=nucleic acid binding; Cellular component= nucleus; Biological process=DNA integration
MEGGIGPILDLTPKEEKRIEDNVEAYLDWEMKVEQLFACHHISEERKVPLATLSFQGYALYWWTSLVRERRIHRNPLVDYWNDLKSALRKKHIPSYYERELMDKLQRLRQG

SEQ ID NO: 205749 - protein, 44 aa, Glycine max
  Coding DNA Sequence Number=SeqID_88971
MAKDNDCASKPYTGAMKGTMYKVMTKDNNWYLKALHWGNEGHHA

SEQ ID NO: 205750 - protein, 145 aa, Glycine max
  Coding DNA Sequence Number=SeqID_88972
  Gene Ontology: Mol. function=peptidase activity; Biological process =regulation of DNA repair
  Homolog annotation: Hit_ID=Q8ZMK5; Match level="QueryCoverage=99%, HitCoverage=85%, E-value=2e-33, Identity=48%"; Hit description =Regulatory protein recX
  Pfam annotation: Domain name=RecX; Domain location=22-145; Score =125.4; E_value=1.6e-34; Accession=PF02631.7; Description=RecX family
RDHSRDELKRKLQLNNQRAAWLQQQESQPIPEALLEKVLDWCQENGWLNDQRFTERFIQSRARKGYGPQRVRMELQQKGIDRDEINQALFDSEVDWSQCAAEAAKRKFGEPLPQSWAEKSKVQRFLMSKGFMMEDIQAIFRNIDD

SEQ ID NO: 205751 - protein, 43 aa, Glycine max
  Coding DNA Sequence Number=SeqID_88973
MPRAQNSTAHHSAYFGKRALEATRGVAFAEIPRFLLKFCMLLV

SEQ ID NO: 205752 - protein, 82 aa, Glycine max
  Coding DNA Sequence Number=SeqID_88974
MALLFLFVSKEQVVSLCGKPLWITILKHSSPCLGHITKSQYYCKSLGPSPFKLPFIILTLLMNLVANILSPLGSQFVAFLNE

SEQ ID NO: 205753 - protein, 54 aa, Glycine max
  Coding DNA Sequence Number=SeqID_88975
MLDHPEPLKLPHCTEVLLRACDNHMTVLRRHGPPLQWKVETLNPAIGGKGVIQP

SEQ ID NO: 205754 - protein, 153 aa, Glycine max
  Coding DNA Sequence Number=SeqID_88976
MITLSAFIVADEKYDEPTKCICALSGPSVLDLLMKNMMNPLSASVRSSLLMKNMMNPLSASMASKKRKLFASSSSQIRFDRSRFHSQEAWERYNDIVVPRKLLPERNVVVYHTEFDEFKKELERRKLDEELTSFAEGSIDVAIVKECWTKWPQ

SEQ ID NO: 205755 - protein, 136 aa, Glycine max
  Coding DNA Sequence Number=SeqID_88977
MPTKSWSFVGASMVEEEEENGNLCHMSPFEWSRKGPPSSLDVTHAQSQEEKKNLTFETLKSYLGLRAISLEILHTVEGSSVQTILFLWKKVLPYVLTEELSSVTENHSYGRRFFREFIWKNVLPLFTLEFGKQPLV

SEQ ID NO: 205756 - protein, 304 aa, Glycine max
  Coding DNA Sequence Number=SeqID_88978
  Gene Ontology: Mol. function=transporter activity; Cellular component= 1-2nm peptidoglycan-based cell wall; Biological process=transport
  Homolog annotation: Hit_ID=Q11MD0; Match level="QueryCoverage=91%, HitCoverage=89%, E-value=3e-74, Identity=52%"; Hit description=Polar amino acid ABC transporter, inner membrane subunit
  Pfam annotation: Domain name=BPD_transp_1; Domain location=55-275; Score=85.7; E_value=1.4e-22; Accession=PF00528.12; Description =Binding-protein-dependent transport s
MPQRDVAFARSAPAYGRWVSWIVVLTLAANGLWLVATNPNFEWHVVLQWFTEGSVLKGLQVTLGLTVVSMVLGTLLGLLLAVWRLSENKLLSGVSALYIWFFRGTPLLVQLIFWYNLSTLFPTLSITVPWTDITFASWNTNDLITPLTAAIAGLALNEAAYMAEIIRAGLLSVDHGQVETTQAFGMSRSRALRRIIIPQAMRAIIPPTGNQLISMIKATSLVSVIAMGDLLYSVQAVYNRTFEIIPMLMVAVIWYLLITSILNVGQSGIERYYARGSKRTVVVNKRRASSDTALAAAPRLKEDV

SEQ ID NO: 205757 - protein, 61 aa, Glycine max
  Coding DNA Sequence Number=SeqID_88979
MDTCITQLEEDELNCHHKKGRDCRSKDFDFDVLMMPCDHALLKFNSRQKSKKFKIHHQEDL

SEQ ID NO: 205758 - protein, 135 aa, Glycine max
  Coding DNA Sequence Number=SeqID_88980
  Gene Ontology: Mol. function=RNA-directed DNA polymerase activity; Biological process=RNA-dependent DNA replication
PNVVTPPKFKVLDFDKYKGTTCPKNHLKMYCRKMGAYARDEKLLIHFFQESLTGAAATWYTNLEPSQVHSRKDLMVAFVRQYQYNSDVAPDRMQLHNMGKKGHESFKGYGSPTGAPNDGKGDDNSDSGHVTNVLL

SEQ ID NO: 205759 - protein, 168 aa, Glycine max
  Coding DNA Sequence Number=SeqID_88981
  Gene Ontology: Mol. function=chitin binding; Cellular component =extracellular region; Biological process=chitin metabolic process
  Homolog annotation: Hit_ID=UPI00006A17C9; Match level="QueryCoverage =80%, HitCoverage=100%, E-value=2e-18, Identity=36%"; Hit description= UPI00006A17C9 related cluster
MSKSCGFGMTGPLDESISCFLIRVDPWVLVLIAFRGLHVLTLRGLHVLALRGLQVLALRGLHVLTIRGQHALTSRGLHVLALRGLPALALGLHALAIRGLHVLTFVGLHALTFRGLHVLANRGLHALTLRGLHVLTIRGLHALTSRGLHVLALRGLPALALGTSYPHL

SEQ ID NO: 205760 - protein, 58 aa, Glycine max
  Coding DNA Sequence Number=SeqID_88982
MKGLFVTKLESNEVILSPIALKVVGPFLLDSNSSRDGTNPSSNSLYDNPQTRKQRDKQ

SEQ ID NO: 205761 - protein, 153 aa, Glycine max
  Coding DNA Sequence Number=SeqID_88983
MTCGEPFGPALFHLLSSKGGGPDDMRGTIWFHTFYLLSSRGGGPDDMPEPFSPALFHLLSSRGGGPDDMRRQIMVILLTFCHPDIVVSDGMQRQIMVILRLLSSRGGGADDMRESFGPALFTFCHPKAAGPMTCGNHLVRTFSPFVIQRRQAR

SEQ ID NO: 205762 - protein, 90 aa, Glycine max
  Coding DNA Sequence Number=SeqID_88984
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=99%, HitCoverage=10%, E-value=6e-29, Identity=61%"; Hit description =Phosphoenolpyruvate carboxylase
VRKGGNMVLAAKSCDDIFNNLLQDGVSPDELYKTVFKQEVEIVLTAHPTQINHRTLQYKHLKIAVGEKTSRWETDELMRSKPTPVDEARA

SEQ ID NO: 205763 - protein, 85 aa, Glycine max
  Coding DNA Sequence Number=SeqID_88985
EQQAEWINAQRQILCPLSFRNDKLSGSSEAGDERAETNSAPFVIQKTGDRVRWHVETNYGHSVSCRPGSIVSNKTFRWQGGSLAE

SEQ ID NO: 205764 - protein, 48 aa, Glycine max
  Coding DNA Sequence Number=SeqID_88986
MRINIQGGDAETPKSKKSEGSSNAQSSSVVAPKPKKPVYSYWVDKRRG

SEQ ID NO: 205765 - protein, 136 aa, Glycine max
  Coding DNA Sequence Number=SeqID_88987
  Gene Ontology: Mol. function=transcription factor activity; Biological process=regulation of transcription, DNA-dependent
  Homolog annotation: Hit_ID=P0A9F6; Match level="QueryCoverage=99%, HitCoverage=67%, E-value=4e-51, Identity=96%"; Hit description =Glycine cleavage system transcriptional activator
MSKRLPPLNALRVFDAAARHLSFTRAADELFVTQAAWLVPRLSSFNSAYPGIDVRIQAVDRQEDKLADDVDVAIFYGRGNWPGLRVEKLYAEYLLPVCSPLLLTGDKALKTPADLAQHTLLHDASRRDWQTYTRQL

SEQ ID NO: 205766 - protein, 318 aa, Glycine max
  Coding DNA Sequence Number=SeqID_88988
  Gene Ontology: Mol. function=RNA-directed DNA polymerase activity; Cellular component=exocyst; Biological process=RNA-dependent DNA replication
  Homolog annotation: Hit_ID=Q1S4Z4; Match level="QueryCoverage=54%, HitCoverage=21%, E-value=2e-38, Identity=48%"; Hit description=RNA -directed DNA polymerase
MSCKGIFAIIVLLWFKASLSIGGQNLLEYWIVGFWIGVKFNQISIIDNELFMAKFGVEEVREAVWSCGSSKCQGPDSFNFNFIKSFWETIQGDVLRFLDEFHRYGVFPKGCNSSFITLIPKVEVANKLGDYRSISLVECMYKSVAKVLSFRLMKVSSGMVDKIQSAFLSGRSLLHSVLVANEVVEEAERSGKNCLLFKVDFEKAYDSVCLLGLIRGKMPSLFVRRVVPIQRNFLWGCEEGKKKYLKGGKDLSYEGWEGETGRWNFSWRREWFVWELEVVDKFLNIVKSARMDILFARITSWESGGGNFYSGLEVGNFT

SEQ ID NO: 205767 - protein, 110 aa, Glycine max
  Coding DNA Sequence Number=SeqID_88989
MTASRNSTPIVRQSVKFRDMPEVERKHCCAIRKVPQHSKNQRRDCCAIRGSNWAASSSTFLKNGFRGFRGIRNASVKFSKILGKHIHLNIGEREEKKDENQIRNTSVRLP

SEQ ID NO: 205768 - protein, 74 aa, Glycine max
  Coding DNA Sequence Number=SeqID_88990
MNDLGGATLFCKITRAPNIFMIYVHRDSLGRNNQHENTEKGVPMNPKRIKVIPEWPAPPSVLRKKAQSFKNLGI

SEQ ID NO: 205769 - protein, 87 aa, Glycine max
  Coding DNA Sequence Number=SeqID_88991
  Homolog annotation: Hit_ID=O49856; Match level="QueryCoverage=35%, HitCoverage=21%, E-value=1e-08, Identity=93%"; Hit description =Ferredoxin-thioredoxin reductase catalytic chain, chloroplast precursor
MKCTLGSNNEGIPVAAEGGCDGGNGDGEGGSLGGHCRSEKREWWLLTLRFQVPGNAIILWLSSSSYPHYIPPPHPSTSDLDFGLPQI

SEQ ID NO: 205770 - protein, 145 aa, Glycine max
  Coding DNA Sequence Number=SeqID_88992
  Gene Ontology: Mol. function=metal ion binding; Cellular component =intracellular; Biological process=response to abscisic acid stimulus
  Homolog annotation: Hit_ID=Q9XH76; Match level="QueryCoverage=90%, HitCoverage=80%, E-value=2e-30, Identity=44%"; Hit description =Putative zinc finger protein
MANNANMAAMQFQVFCLEHRSYKSHSCPKSDHNSRKVVVCEACSMSIETTGNVGQDKKAILQKHLKSGICDPTKKKKPTCPVKRCKEVLTFSNTSTCKTCHIKVCLKHRFPADHACSRGASASVANECAKNGATRPPSTPSVKAY

SEQ ID NO: 205771 - protein, 304 aa, Glycine max
  Coding DNA Sequence Number=SeqID_88993
  Homolog annotation: Hit_ID=Q1SIY6; Match level="QueryCoverage=36%, HitCoverage=13%, E-value=2e-22, Identity=42%"; Hit description =Integrase, catalytic region; Zinc finger, CCHC-type
MKEKEVCISSSFSTDWICKEYMLEVPAVGKHLGNFIGSFMEYDDKNNTEDGGRWKSNCSNTHRSYKHPKIDNPSNMRDLRPIALCNVIYKILAKVLANRLGGVIDKIISEEQSGDVALKINISKAYDHMKWDWIIFGELSCLIKDVEAKGALHGIRICKNAPPVTFSKNVNVDLRKEITYELGVIEGSETCETDVESSFSQIAPPIFDEESYDLWKVKMKSYMKFFYLWDAVEKDYEVSPLPENPTTTQIKHHKEEKTKKEEYEGNEHVCGMQVLYLRKFEVQKIKESETIKGYLDRLLDIANK

SEQ ID NO: 205772 - protein, 126 aa, Glycine max
  Coding DNA Sequence Number=SeqID_88994
  Gene Ontology: Mol. function=4 iron, 4 sulfur cluster binding; Cellular component=chloroplast; Biological process=electron transport
  Homolog annotation: Hit_ID=O49856; Match level="QueryCoverage=66%, HitCoverage=59%, E-value=1e-41, Identity=89%"; Hit description =Ferredoxin-thioredoxin reductase catalytic chain, chloroplast precursor
  Pfam annotation: Domain name=FeThRed_B; Domain location=19-123; Score= 177.6; E_value=3.1e-50; Accession=PF02943.6; Description=Ferredoxin thioredoxin reductase catalytic beta chain
RNGSNEQTGLHVEEKGNKEGIAGKVYAAEKRQKKRLLRLLTDRQAGMCCLEGLADHKDTLGAPLCPCRHYDDKAAEVAQGFWNCPCVPMRERKECHCMLFLTPDNDFAGNEQTITLDEIKESTANM

SEQ ID NO: 205773 - protein, 568 aa, Glycine max
  Coding DNA Sequence Number=SeqID_88995
  Gene Ontology: Mol. function=ubiquitin-protein ligase activity; Cellular component=ubiquitin ligase complex; Biological process =protein ubiquitination
  Homolog annotation: Hit_ID=Q9FL17; Match level="QueryCoverage=89%, HitCoverage=91%, E-value=1e-109, Identity=47%"; Hit description =Arabidopsis thaliana genomic DNA, chromosome 5, P1 clone:MSN9
  Pfam annotation: Domain name=Arm; Domain location=281-321; Score =14.7; E_value=0.18; Accession=PF00514.13; Description=Armadillobeta -catenin-like repeat
  Pfam annotation: Domain name=Arm; Domain location=322-362; Score =24.2; E_value=0.00046; Accession=PF00514.13; Description =Armadillobeta-catenin-like repeat
  Pfam annotation: Domain name=Arm; Domain location=363-403; Score =31.5; E_value=3e-06; Accession=PF00514.13; Description=Armadillobeta- catenin-like repeat
  Pfam annotation: Domain name=Arm; Domain location=443-485; Score =12.3; E_value=0.35; Accession=PF00514.13; Description=Armadillobeta -catenin-like repeat
  Pfam annotation: Domain name=U-box; Domain location=57-129; Score =47.0; E_value=6.5e-11; Accession=PF04564.6; Description=U-box domain
  Pfam module annotation: Pfam domain module=Arm::Arm::Arm::Arm::U-box; Domain location=281-321::322-362::363-403::443-485::57-129
MEIQQSLKLTIHKKWPSSPKKPPKETEPITTTPTTPKLKWKKIFFQTKTKTQTQTPPEEFLCPISHSLMFDPVIVSSGHSFERSSVEACINVNFTPQLPDGTTPDFSTLIPNLALKSAILKWCQSTHTPPPPHPNNNNNHLVQTLISSNPSLVPTLNPPNPSLVHTNPTPEKISDQDLILNSLNENPPLTNLRHHAETEVPIRRTHLYTSSDESIATTSASTPPLQLSTRPSCCYYSSPSSSELEPATTPEEEEIMTKLKNPQHSIIEEALISLRKLTRIREETRLQLCTPRLLSALRSLVLSKHVNVQVNALASVVNLSLEKSNKVRIVRSGMVPPLIEVLKFGSSEAQEHGAGALFSLAMDDDNKTAIGVLGGLAPLLHMLRSESERTRHDSALALYHLSLVQSNRSKMVKLGSVPVLLSMVKSGHMMGRVMLILGNLGSGSDGRAAMLDAGVVECLVGLLSGPEPGTGSTRESCVAVMYALSHGGLRFKAVAKAAGVVEVLQKVEKMGSERARRKVRKILEIMRTKEVEEEDVDWEELLDSGLGCRTRSRLGGGLDESSANSAEF

SEQ ID NO: 205774 - protein, 134 aa, Glycine max
  Coding DNA Sequence Number=SeqID_88996
MARCGTTHPPRANLWCINMIFSTKYGSEHKKIIITNAPRQFINTTTNKSHPGSYKCNIHAAFCVDLNCTREAWALRATLNIVVNMGLTNVLFEMDNKSVVDKVKNTKKDESEAGIIISECEEILASNKTFHLGF

SEQ ID NO: 205775 - protein, 101 aa, Glycine max
  Coding DNA Sequence Number=SeqID_88997
  Gene Ontology: Mol. function=oxidoreductase activity; Cellular component=vacuole; Biological process=hydrogen peroxide catabolic process
  Homolog annotation: Hit_ID=Q9FL16; Match level="QueryCoverage=71%, HitCoverage=22%, E-value=2e-25, Identity=73%"; Hit description =Peroxidase 63 precursor
MTPNKFDNAYFQNLPKGLGVLKSDHGLYGDPSTRPFVETFAKDQNRFFQVFARAMHKLSLLNVQTGRKGEIRRSVYEVVREWGHWGIEELLLLFFALLFFG

SEQ ID NO: 205776 - protein, 81 aa, Glycine max
  Coding DNA Sequence Number=SeqID_88998
MQRNVLSNPFKKLNQMKEGPEWYKILQRNRACIFSDKLCSSSSLTMGCYHVPLCRHHYNQGRGNIMESFQRTGFGFDDFSV

SEQ ID NO: 205777 - protein, 223 aa, Glycine max
  Coding DNA Sequence Number=SeqID_88999
  Gene Ontology: Mol. function=oxidoreductase activity; Cellular component=membrane; Biological process=hydrogen peroxide catabolic process
  Homolog annotation: Hit_ID=Q9LHA7; Match level="QueryCoverage=72%, HitCoverage=50%, E-value=9e-62, Identity=70%"; Hit description =Peroxidase 31 precursor
MSLKTDKPLSVARVVGGGSVVGEVRDELGAVRESDGVGPTEGDEFFDGEAAFGEELGDLRDGHGGGGEVGGYGGGEGGSAVAAAEEDGEEGAAEHGEEVAGGGGEDVGAGDGVGAGELEGGLGTDDEVEGVAGEGEVDVGVALGLGEGGGGEEDGGVAAVGEEAVVEEEAEGGGGGGGAGDLLAGYCKSKVSRALAEEKDSSNVVKRKKKKRENEAIVREVEN

SEQ ID NO: 205778 - protein, 246 aa, Glycine max
  Coding DNA Sequence Number=SeqID_89000
  Gene Ontology: Mol. function=triacylglycerol lipase activity; Biological process=lipid metabolic process
MFVEVEWKKPPTEVESLRVRLLYAGTNYMRMVEPLAIAQYYREGGKDYMKERSKHFVWLEELLLKEQKQKDTGNSNDTNKKNVEIILTYDSCFWAHVEEALLLCKQLVNVQYSVTEKEEATRKLLEFEKFSSGFELASSVTSSVLLHRSWNVITSRYAGIVTNVGEGVSWKVYREPGSDLTIIAFEVKLDFSNVQAGLVSSNTLRENNFHHFEFLCTKKDPFFSVNKTAISLFSENYEKLDQLKSE

SEQ ID NO: 205779 - protein, 89 aa, Glycine max
  Coding DNA Sequence Number=SeqID_89001
  Subcellular localization annotation: CTP_CleavageSite=58; ConfidenceScore=5.03e-01
MEATMEAITNNKRDIDLTSMKDKRAAPRGRRSALEGRRSSSLHGRRTTTSHWRSKGARGRMRKEEERVVGERKKRRDSRKKGEEEKLIE

SEQ ID NO: 205780 - protein, 108 aa, Glycine max
  Coding DNA Sequence Number=SeqID_89002
MAEEKDAFYVVRKGDVVGIYKSFSDIRPSLASFDPYSSGGRAFNVSSSSRNLHGAIQFDTRLSCNLHFDGASKGNPGPAGAGAILRDGSKEYNSEADAQANLAINLRG

SEQ ID NO: 205781 - protein, 57 aa, Glycine max
  Coding DNA Sequence Number=SeqID_89003
MKCESAKGSCKRQRREKMKKKKKKKKRKKKRGEQSAETKFQVKRRSFSSALDFPHAI

SEQ ID NO: 205782 - protein, 136 aa, Glycine max
  Coding DNA Sequence Number=SeqID_89004
  Gene Ontology: Mol. function=metal ion binding; Biological process =metal ion transport
MGSNPETASLHMQGYGCVQHPSPIPSHSEEPLGNGAEGTVSETAIPALTKALEEAKSNVSDVYLDPVLYILDSNETDGVTDLKFQLAEGLAILELKKQTTVQATGVASGLLETIQGSGFKLQTLNLSFEDEEVAVA

SEQ ID NO: 205783 - protein, 225 aa, Glycine max
  Coding DNA Sequence Number=SeqID_89005
  Gene Ontology: Mol. function=transferase activity; Biological process= protein metabolic process
  Homolog annotation: Hit_ID=Q9LJP4; Match level="QueryCoverage=93%, HitCoverage=31%, E-value=2e-68, Identity=58%"; Hit description =Glucosyltransferase-like protein
MAPNTEKSNNNDFTLLQVHDSDSPMFPEKQKATSRKQFTWFLLLKLHRVLTCLSWLTNCLKATFALVKKRVSLADMSDEGPKSRGKLYRFIKIFLALSIGGLAIEIIAHFNKWNLHNMIQPWEVQGLLQWCYVAWLSFREDYVAPLVLMVSKFCIVLFLIQSLDRLVLCLGCFWIKYKKLKPTFEADACDVEDPSNFPMVLVQIPMCNEREKCHLEELASPFSNH

SEQ ID NO: 205784 - protein, 1195 aa, Glycine max
  Coding DNA Sequence Number=SeqID_89006
  Gene Ontology: Mol. function=RNA-directed DNA polymerase activity; Cellular component=chromatin; Biological process=chromatin assembly or disassembly
  Pfam annotation: Domain name=Chromo; Domain location=1091-1139; Score= 13.7; E_value=0.023; Accession=PF00385.14; Description='chromo' (CHRromatin Organisation MOdifier
  Pfam annotation: Domain name=rve; Domain location=829-983; Score =81.6; E_value=2.5e-21; Accession=PF00665.16; Description=Integrase core domain
  Pfam annotation: Domain name=zf-H2C2; Domain location=770-811; Score =22.7; E_value=0.00035; Accession=PF09337.1; Description=His(2) -Cys(2) zinc finger
  Pfam module annotation: Pfam domain module=Chromo::RVT_1::rve::zf -H2C2; Domain location=1091-1139::523-745::829-983::770-811
MADHGTRKMTTDRLEDAIVRLTNSQAFINERYADLSSKVDSILDHLCLHDSGQNTTTTANHQNHQRNAVKLDILRFDGHDPLGWIFKITQLFQYQNTPEEDRITVASLYLDGTALRWYQWMFSNGFITSWNGFLQALESWFALTFYDDPKGALFNCFISGLNPNIRREVLALQPISLLQATAFAKLQEEKLRDKQAPIPRNFVPPPPSASHITHTTSKAKPSYVQRTPEEMAFRREKGLCYNCDEKWNANHHCKGRVMLFIADEQLSLPETIEPGPEEEQVAVVSEHTESPSDTGCSHISLHALSGLPSSDTFRIFGTAKHARLTILIDSGIGNGSMLECDQVCPDIQVAMQGHSFAVTFHLLQISGADAILGIDWLKKLGPVTTDYTTFVMHFNHLGQDISLKADVTIGPEPTSVAQLKCLIHTGSTSVFYHLSLVPERRPEQPTAQHPISSIANLLLRYDHLFQPLSQLPPPCNVVHRITLNPSTAPVNVRPYRYPHFQKNEIEKQIFDLFSAGLIRPSTSPYSSPVLLVKKKDGMWRPCMDYRALNSVTVRDRFPIPTIDELLNELGHASWFSKLDLRSYNHSCADSPLCSLMTSWCITTPCHPTFNIWRSSFKLYNKGVAPEPSKVQAIVNWPPPTSVKELRAFLGLTGFYRKFVKSYAAIAAPLTGLLCKDAFTWTPESQTAIGVLLLQNGHPLAYFSKGLGPRLLHASTYIWELHAIVAAVIQTPEQHYYLSKLLGYEYCIQYKGIIWLNNDNPCIPKLLTEYHATPLGGHLGVAKTTHRIESNFFWTSLKQDVKRFVKECSTCQQTKSITRRLAGLLQPLPPPTGVWEDLSMDFITHLPLSNGFTVILIVVDRYSKGVHLGALPTGFTAFKVATLFLDIICKLHGFPKSIVFDRDPIFLSKFWSELFWLSGTRLRLSTAYYPQSDGQTEVMNSNNILRCFVHSQPTAWFRYLALAEWSYNTSLHSSSGLTPFKIIYGKPPPTVLDYVAGTTNNEAAQSLLESHHALHSKLQQRLKKAQETMNHYADAKRDSVSFEVGQWVYVKLRPGRQSSVIGQPHPKLSERFFGPFQIMERVGAFLDQQPLRQPLCFLDVKLDQSTTPPTLLILTQWVGEPPEDTSWESWSELRDTYHLEGKVDFGEGGIVSTTHQIEEEKTRSTSSTLVVQPTRPARTRARPLRLQDYHVDGLPY

SEQ ID NO: 205785 - protein, 178 aa, Glycine max
  Coding DNA Sequence Number=SeqID_89007
  Gene Ontology: Mol. function=protein binding; Cellular component =integral to membrane; Biological process=xylan catabolic process
  Homolog annotation: Hit_ID=Q1SL70; Match level="QueryCoverage=89%, HitCoverage=92%, E-value=2e-30, Identity=47%"; Hit description =Leucine-rich repeat; Leucine-rich repeat, cysteine-containing type
  Pfam annotation: Domain name=LRRNT_2; Domain location=18-56; Score =32.6; E_value=1.3e-06; Accession=PF08263.3; Description=Leucine rich repeat N-terminal domain
  Pfam annotation: Domain name=LRR_1; Domain location=62-84; Score =17.8; E_value=0.039; Accession=PF00560.23; Description=Leucine Rich Repeat
  Pfam module annotation: Pfam domain module=LRRNT_2::LRR_1; Domain location=18-56::62-84
MGAIGPNCAVKNNSFECIEMERKALLKFKQSLNDPFHCLSSWVGSDCCKWVGIPTNIGALHHLESLDLSSNHISGPIPSNMASLTFLGHLNYLSYNNLSGEIPTANQFHTLTDPSIYEGNPHLCGTPLSIKCSEYDDENTTDEDLDSSHDKLWLYLSIGLGFIVGFWAVCGSLVLKEC

SEQ ID NO: 205786 - protein, 1201 aa, Glycine max
  Coding DNA Sequence Number=SeqID_89008
  Gene Ontology: Mol. function=nucleic acid binding; Cellular component= oxygen evolving complex; Biological process=DNA integration
  Homolog annotation: Hit_ID=Q1S0A6; Match level="QueryCoverage=99%, HitCoverage=87%, E-value=0.0, Identity=57%"; Hit description=Zinc finger, CCHC-type; Peptidase aspartic, catalytic; Polynucleotidyl transferase, Ribonuclease H fold
  Pfam annotation: Domain name=rve; Domain location=464-625; Score =169.2; E_value=1e-47; Accession=PF00665.16; Description=Integrase core domain
  Pfam annotation: Domain name=zf-CCHC; Domain location=217-234; Score =7.9; E_value=0.048; Accession=PF00098.13; Description=Zinc knuckle
  Pfam module annotation: Pfam domain module=RVT_2::Retrotrans _gag::rve::zf-CCHC; Domain location=829-1084::36-150::464-625::217-234
MKISLRAQRKWGFIDGTYEQPDDGSPEMEDWWTVQSMLVSWILNAIEPTLRSTVTYAENAKDLWEDIRDRFSVVNGPRIQHLKAELVDCKQQWMTMVSYYGKLKTLWDELANYEQIPRCSCGGCKCDIASKLEKRREEDQVHQFLMGLDDASYGTMRSNILAVDPLPSLNRVYAILVQEERVRTISRTKEERGAVMGLAVQAGHKSKWRGEIKDKSMVCSICRKAGHDDKNCFQVAEYPDWWGDRPRSEGGSSGKNQQRNGTSAGRGRGGMARANATHVEKFELPGLSNEQWQTLVEMLNNRKTDEIEKMIGKHPDNLWIIDTGASNHMTGYLKNLCQQRTIQGCPVGLPDGEKVIATKEGTAILDGGLKLENVLYDRTLKTLIGAGERKDGLYLYHGVRNSKAYHTSTKYDLDILHKRMGHPSFKVVKLIPNVTSSRKHSNKVCEICERAKQTREKFPLSTYRASGIFDLIHCDLWGPYRTLSSCGASYFLTLVDDYSRSVWIYLLSEKREVSRTMINFFALIERQFDKHVKVIRSDNGTEFTCLKQYFLEHGILHQKSCTGTPQQNGRVERKHRHILNVARALRFQGRLPIRFWGECILTAGYLINLTPSPILDGKTPYELVDGTSPSYDHLRVFGSLCYAHNQDRKRDKFDSRSQFSFEESINNPSPTSLVPLINPCMDKECMVENGHDNDTNADVRGGASEASNEPQSFAPPLEKQNCIDVVQCSSEGPETRSNIPPTSPLGKGHRIKRPSVKLIDYVTYTMIKLSSSTCSSASSHDSGARYPIAHYVNCDRFSYQHRQFLAAVSAGREPMHFSEAVQDERWREAMASEIEALQNNGTWAITTLPPKKKALGCKWIYKIKYHSDGTIERFKARLVILGNHQVEGLDYTETFAPVEKMVTVRTVLVVAAAKAWELHQMDVHNAFLHGDLQEDVYMKLPPSFMTEHKGMVCKLRKSLYGLRQAPRCWFAKLSTALKNYGFRQSCSDYSLFTLWTTTVHLVVLVYVDDLIVSGNDSEAILRFKLYLHRCFHMKDLGRLKYFLGVEVARSPKGIYLCQRKYATDIILKTGLLGAKPMSLPLEENHRLALAEGPLFSDPGRYRRLVGRLIYLCFTRPELSYCVHTLSQFMQQPREEHWHAALRVVRYLKGNPGQGILLRSDNDLKLYGWCDSDWAGCPLTRRSFTGWYISLGHLPISWKTKK

SEQ ID NO: 205787 - protein, 87 aa, Glycine max
  Coding DNA Sequence Number=SeqID_89009
MNDFKRHSAATTQCLEDEKILTLGQETKKERNKERLGKEIEGGERSAREESCEYLMKEKGICCCSEKRECLFALKMGVCKEEKVVQQ

SEQ ID NO: 205788 - protein, 212 aa, Glycine max
  Coding DNA Sequence Number=SeqID_89010
  Gene Ontology: Mol. function=transporter activity; Cellular component= outer membrane; Biological process=cobalamin transport
  Homolog annotation: Hit_ID=Q8P6A3; Match level="QueryCoverage=99%, HitCoverage=33%, E-value=8e-54, Identity=51%"; Hit description=Outer membrane receptor for transport of vitamin B
MVLAIGAQCAAFHVPLVVEAVTAAQALGQVAVAVAVVLVGKAARGEHRGRTAAGIDAVGMLVGDVGTEPAALGAATNAAAGFAQPVAAAAELEVRSEIALVAAGEDLDHATDGVGTVQAGLRAANDFDALDLRQGQVLIHGQAEVGTVDAHAVDQHHGVARVGAAQEQRALLAEAASIGQVDAGAAAQQLLQRGGLAGFDLRAVDHLRRRDT

SEQ ID NO: 205789 - protein, 373 aa, Glycine max
  Coding DNA Sequence Number=SeqID_89011
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8PIP1; Match level="QueryCoverage=71%, HitCoverage=55%, E-value=1e-111, Identity=75%"; Hit description=Two -component system sensor protein
MRQRLHVLLDVGLAFQLAAHGFQRLAEIADLVAAAARRRHRFAGADRTRIAAELAQAGGQPHRHQHTDQRRQADQPGPALDDGALAGGDERIDAAVGLRQAEHADEGAPIGRVIYGRRHMHHRVALFAGNLGTGTRAVLTSQGAIDIIPARVVAPQVAAQRVVDDDALGIGDGHPVIQRALREAPDHRLQVALACLGEVAGEAAAADGAGLDVGGGHFGQHVGRIDQGRFHRLAHTGLHLVDEHAHHEERRDAGDQEEAQEQLQYQAHRLDLQRVAKTTVGTDRVVAGTGRAQLGAQRLYMRINGAVGAVGAAVPATVHQLGTADDGARAQHQRFQQRVLVAGQVQCLATEADAPAFAVDGKGAMFLPARIGA

SEQ ID NO: 205790 - protein, 211 aa, Glycine max
  Coding DNA Sequence Number=SeqID_89012
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=3e-25, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTKDNNWYLKALHWAMRGTMYEPQGGPFGTSTLTFRGLHVLTFRGLHALRGLHVLAIRGLHAITFRGLHVLAFRGLRVLAIRGLYVLAIRGLHALSFRGLRVLTFKGLHALAFRGLHALTFRGLHVLTFRGLHILAFMGLHTLSFRGLHALAFRGLHVLAFRGPHALTFRGLHVLTFRGLHVLAFRGLHTLSFSGLHTLAFRGLDALVFKG

SEQ ID NO: 205791 - protein, 217 aa, Glycine max
  Coding DNA Sequence Number=SeqID_89013
  Gene Ontology: Mol. function=ion channel activity; Cellular component= membrane; Biological process=transport
  Homolog annotation: Hit_ID=Q2NQQ0; Match level="QueryCoverage=40%, HitCoverage=61%, E-value=5e-35, Identity=80%"; Hit description=Large- conductance mechanosensitive channel
  Pfam annotation: Domain name=MscL; Domain location=80-202; Score =158.5; E_value=1.8e-44; Accession=PF01741.9; Description=Large -conductance mechanosensitive channel, MscL
  Pfam annotation: Domain name=TrkA_C; Domain location=3-72; Score =40.9; E_value=4.5e-09; Accession=PF02080.11; Description=TrkA-C domain
  Pfam module annotation: Pfam domain module=MscL::TrkA_C; Domain location=80-202::3-72
IEAIAHGDETTSRVVGRLIEDIKLPPGTIIGAVVRGDDVIIANDNVRIEQGDHVIMFLTDKKFVPDVEPTGQGKEITMSLFKEFRDFAMRGNVVDLAVGVIIGAAFGKIVSSLVANIIMPPLGLLIGGVDFKQFKWVLKPAEGDIPAVVMEYGNFIQTVFDFIIVARPEVNTVAYRWPPDSLPSRVYLYAGSCLSPSDCAQLAGDTADRVTGLPGRY

SEQ ID NO: 205792 - protein, 252 aa, Glycine max
  Coding DNA Sequence Number=SeqID_89014
  Homolog annotation: Hit_ID=Q1LB31; Match level="QueryCoverage=40%, HitCoverage=24%, E-value=5e-49, Identity=92%"; Hit description=Beta -lactamase
GADDGQPPARRGRLAAHVALDVQRGVLRGRGLRPGLCHDHRAGQHADPGQRRRHVLGRRGQHVLLGRSQGRPDRTVPDTATAIVGLSGAAAVADAGVQRDHGSGVRRGGMPAAGLLPSPACGRGAGGEGIEALLADLSQFEPPGPLPRPSPAMRERGANKRYVPAPSKMPSITPIPETAMPIRTTLLAFAIALMSPLAHASVSSDAHAFKEGVKEAGKKTGHAVADVARTIGHGAKEAGTAIGHGARDAGHA

SEQ ID NO: 205793 - protein, 653 aa, Glycine max
  Coding DNA Sequence Number=SeqID_89015
  Gene Ontology: Mol. function=type I protein secretor activity; Cellular component=1-2nm peptidoglycan-based cell wall; Biological process=protein transport
  Homolog annotation: Hit_ID=Q57L11; Match level="QueryCoverage=58%, HitCoverage=96%, E-value=1e-151, Identity=69%"; Hit description =Putative HlyD family secretion protein
  Pfam annotation: Domain name=ABC_tran; Domain location=51-235; Score =179.2; E_value=1e-50; Accession=PF00005.17; Description=ABC transporter
  Pfam annotation: Domain name=Dynamin_N; Domain location=54-219; Score= -39.7; E_value=0.028; Accession=PF00350.13; Description=Dynamin family
  Pfam annotation: Domain name=HlyD; Domain location=319-581; Score =52.7; E_value=1.3e-12; Accession=PF00529.10; Description=HlyD family secretion protein
  Pfam annotation: Domain name=SMC_N; Domain location=42-239; Score= -116.4; E_value=0.0043; Accession=PF02463.9; Description=RecFRecNSMC N terminal domain
  Pfam module annotation: Pfam domain module=ABC_tran::Dynamin _N::HlyD::SMC_N; Domain location=51-235::54-219::319-581::42-239
MNLPVENSKDETRIHCPVLFGHYQFTDAMFRYYSDSLTVALRIKTLTIKPGERIAVLGRNGSGKSTLLQAMAGGMDLVGGELRLDNLSLPHIDVADVRRNVGLLTQNARLFHGTLRENLTMGAAHATDEAIFAALTVSGGADFIRRLPLGLDHPVMEGGVGLSGGQRQSLLLARMLLRDPNIVLLDEPTASLDDHTEKDFIERLGAWLNGRTLIVATHRAAILSLVDRILVLKEGQLRSSGGGTGMMKQLPAKLRLVTAAEVDSSDDLLGELKSESHYTGAVRLIVISTALIVVALVWAWFGMLDEVSTGTGKVIPSSREQVLQSLEGGILTELYVHEGDRVQAGQIVAKLDATRSQSSVGESAARYRAALAAASRLRAEVNDDPLTFPAELKGYPDLIAAETRLYNTKRAQLNDATRQFKESLALANRELAITQRLAKTGAASSVEVLRLQRDKSDLELKLTDMRSQYYVQAREELAKASAEADSLAQVIKGREDTVTRLTIRAPMRGIVKNIKVSTVGGVIPPNGELMNIVPMNDRLLIEARLSPRDIAFIHPGQRAVVKISAYDYAIYGGLNGVVESISPDTIQDEVKPEIYYYRVFIRTDNDYVQNKAGRRFAISPGMVSTVDIKTGEKSIMDYLVKPFNKAKEAMRER

SEQ ID NO: 205794 - protein, 139 aa, Glycine max
  Coding DNA Sequence Number=SeqID_89016
  Gene Ontology: Mol. function=metalloendopeptidase activity; Cellular component=membrane; Biological process=proteolysis
  Homolog annotation: Hit_ID=Q5PJH8; Match level="QueryCoverage=58%, HitCoverage=32%, E-value=5e-25, Identity=70%"; Hit description =Hypothetical protein yggG
MQVAFATTAARNAAASVGGVIGSLSQSQLGEMGEKLVNAQFSQTQESQADDYSYDLLKKRGINPLGLATSFEKLAKLDQGRQIAGLPLTPALSRTREREHSVLFSRPARSVPSPGGEGAGRAVLTARSIGSLSWGRGSG

SEQ ID NO: 205795 - protein, 557 aa, Glycine max
  Coding DNA Sequence Number=SeqID_89017
  Gene Ontology: Mol. function=calcium ion binding; Cellular component =integral to membrane; Biological process=cell communication
  Homolog annotation: Hit_ID=Q83SZ3; Match level="QueryCoverage=50%, HitCoverage=7%, E-value=3e-39, Identity=36%"; Hit description=Large repetitive protein
MPAHRALSLQVRRVVAPDCIRSIDCSPVKERKGHLPVPVMLPCVTPTKPCGFDAGNQLRTAVPRAAAVTVNRQHRIAVRGMIHFHKVIDITGGIIPADQQTADVDLVTLRDAEVGPGVVTVAAGGICAAQQVVNQRICAGTAGNGVVVGAAGEAVSRGAARDGRVKLNGKGVAGDGAVGRRQGVGKHLLMRDVLDIHIRVQGIGIATVDGDGQYTKVPGHRRAAHAAHGGEIAVLIEDAQRADVADVAVSPDAAAGIVLAGGGGFRRQTGGGEQRGGRTVMQRHRQRRRGHCTAGIPHRVGEGVCGWQGIDIQPGLQRVGVVTLRINGQRTVGGVDHRIAAGRHRAAAHRRHRRAGRNRPGDGAGVVGQQVTGDRRGGGDRQRGEIRHRAYRGGWQHANVGGGCHHHRIVAGPQSGVGDVCPFQRTDRQQRVNVVGLDTDQLPRAVRLLFIQVSITVVQYAGIEHRTQPHGQQRGVRRVDRTVVHRCLRTGVIHLVAVVGRHDANRTGQRGPRRDVTSAIRLNHRERRTGDLRGGERHRPVAAAADRGGFIFVATYF

SEQ ID NO: 205796 - protein, 172 aa, Glycine max
  Coding DNA Sequence Number=SeqID_89018
  Gene Ontology: Mol. function=transporter activity; Cellular component= outer membrane; Biological process=protein transport
  Homolog annotation: Hit_ID=Q5PFH9; Match level="QueryCoverage=92%, HitCoverage=34%, E-value=4e-51, Identity=62%"; Hit description =Putative type I secretion protein
MAASDAVTQAGRITSAGLAQQQDLPSLTGQVAEPALANVPDTLTLNQAVQRAIQWHPDIAQAIGKMLEQASQVDVAQAKYYPQISAGMNNGYSNAYSEKGFSPSFVLSVSQMLYDFGKVSSSVRSAEAGVAQEQASVLVSIDTVAHDTAAALVQVQGYQQLVKIAQDQLTAL

SEQ ID NO: 205797 - protein, 95 aa, Glycine max
  Coding DNA Sequence Number=SeqID_89019
GRSLPPSSPRRARLLPPEATAFLEEESGRPNFGRSYRNSQIAQRHLLLVSATLRNFTDRVTLLPFDFRCVSGLTYCATKGAKYLEAANQRLHVIR

SEQ ID NO: 205798 - protein, 195 aa, Glycine max
  Coding DNA Sequence Number=SeqID_89020
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-31, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFKGLHVLTFGVLHVLTFNRLHALAFRGLHVLTFKGLHVIALRGLHVLAFSGLQGLAFVGLYVVAVKGLLILPFRGQHDLPFRGLHALALTGLHVLTFRGLHNLAFRGLDALAFRGVHILPFRGLHALAFVGLHTLTFKGVHILNFRGLYIVAIRGLHVLPFRGLHVLPFRGQHDLPFRGLHALALTGLH

SEQ ID NO: 205799 - protein, 47 aa, Glycine max
  Coding DNA Sequence Number=SeqID_89021
MGQATLPLSPCCWYPKVRPPSARLNASMVFAHKFVKVAYRLGTACGS

SEQ ID NO: 205800 - protein, 115 aa, Glycine max
  Coding DNA Sequence Number=SeqID_89022
  Gene Ontology: Mol. function=DNA-directed DNA polymerase activity; Biological process=DNA replication
  Homolog annotation: Hit_ID=Q7CQD0; Match level="QueryCoverage=65%, HitCoverage=100%, E-value=2e-25, Identity=77%"; Hit description=DNA polymerase III, theta subunit
  Pfam annotation: Domain name=DNA_pol3_theta; Domain location=40-114; Score=165.9; E_value=1e-46; Accession=PF06440.2; Description=DNA polymerase III, theta subunit
MWQQDTPLLLGCRDLRCDPIPLIQQGETIIFAPVYQEKSMSQNLALLSQEEKDKVNVDLAAAGVAFKERYNMPVIAEMVEREQPEALRDWFRQRLMAYRQASLSLSRLPYESKQK

SEQ ID NO: 205801 - protein, 211 aa, Glycine max
  Coding DNA Sequence Number=SeqID_89023
  Homolog annotation: Hit_ID=Q8ZNX1; Match level="QueryCoverage=46%, HitCoverage=79%, E-value=2e-14, Identity=46%"; Hit description =Similar Cu resistance protein CopC
  Pfam annotation: Domain name=CopC; Domain location=1-118; Score=35.7; E_value=1.6e-07; Accession=PF04234.3; Description=Copper resistance protein CopC
MKTASRRVIALLLAGATLGFSQLALAHAHLKAPVPADNAVVERAPQQLTLTFTEHIEPAFSGVEMINAQQQPVALEKAQLNPQQHDQLIVPIAQPLASGHYQRVLDRPAGAAFSGAVPADRQCILYRAAGAGALPTGADTALAAADGIQRRAEFTQCAVDAGGADRADERRLAQYRQHRRLAGGAGYALRRGVALGYPVCPAQHAGAAPAW

SEQ ID NO: 205802 - protein, 283 aa, Glycine max
  Coding DNA Sequence Number=SeqID_89024
  Gene Ontology: Mol. function=cation transporter activity; Cellular component=integral to membrane; Biological process=calcium ion transport
  Homolog annotation: Hit_ID=Q8L783; Match level="QueryCoverage=85%, HitCoverage=54%, E-value=7e-79, Identity=64%"; Hit description =H+/Ca2+ antiporter, putative
  Pfam annotation: Domain name=Na_Ca_ex; Domain location=121-262; Score= 89.7; E_value=9e-24; Accession=PF01699.14; Description=Sodiumcalcium exchanger protein
METPVEVKPTSVASGFLDDLSETCKMGSPNGRAMYRTDDEVPFDSEINFHPSESSLMDVHGSHSGESRTVHHETLAGMIYRSIQVVVFSNKLNLLMPFGPLAILVQKLTGHLGWVFGLSLLGIMPLAERQLAFYTGDTVGGLLNATFGNATELIISIYALKSGMTRVVQLSLLGSILSNMLLVLGCAFLCGGIVNHEKEQVFNKAAASVNSGLLLMAVMGILFPAVLHYTHTEVHVGKSELSLSRFSSCIMLVAYVAYLFFQLKSQRNLYVSVNEVLDRMDAL

SEQ ID NO: 205803 - protein, 61 aa, Glycine max
  Coding DNA Sequence Number=SeqID_89025
  Gene Ontology: Mol. function=cation transporter activity; Cellular component=integral to membrane; Biological process=calcium ion transport
  Homolog annotation: Hit_ID=Q8L783; Match level="QueryCoverage=91%, HitCoverage=12%, E-value=3e-13, Identity=61%"; Hit description =H+/Ca2+ antiporter, putative
MAGMIYRSIRVVLLSSKLNLLMPFGPLAILVQILTGHHGWIFGLSLLGIMPMAERLDYVTK

SEQ ID NO: 205804 - protein, 300 aa, Glycine max
  Coding DNA Sequence Number=SeqID_89026
  Gene Ontology: Mol. function=nucleic acid binding
MSFSIVIHNMGSWVNEPQLYYKGGEVHVIHGLDVSKWSYFEAMRVLTELGYKGDGDMKMWWKGKGTDFDSLRDFVLDQDAMDLANYALTHNCEVEIYVQHGVGVLVENDSICKMIVNGEQCHNGSLEQCGNVQESGNLNQLGNVKQSGNVDQSSGGEDLEKSNFNASAEERDLGMEDGFDLPEVGHVKATLNKKVDKMKNKVEGVTRGYGTRQRKNKDIARRDNDHKVNVPDDADSLYKMESSYYSDELDSDIGQDDDIESHATKHVTFKKEDMRNFIKQSLLLSEYSIQTLVKGQLFYI

SEQ ID NO: 205805 - protein, 358 aa, Glycine max
  Coding DNA Sequence Number=SeqID_89027
  Gene Ontology: Mol. function=protein binding; Cellular component=Cul3- RING ubiquitin ligase complex
  Homolog annotation: Hit_ID=Q1S4Q3; Match level="QueryCoverage=99%, HitCoverage=100%, E-value=1e-152, Identity=76%"; Hit description =BTB/POZ; TRAF-like
  Pfam annotation: Domain name=BTB; Domain location=183-291; Score =93.4; E_value=7e-25; Accession=PF00651.21; Description=BTBPOZ domain
MSDSAYRVQTTPRLAQWRIENLASCTYRKSDPFKIGNWNWYFSLSIPIYLSVNKKKKVTMFPLDLRYTLRHLSVEKNRVLFVKLFPEISNLTRDNPPIASFIVRVVSSVGGRQAITHPEIKDKVLKNNEDFVWAIEVPLTGKFIIDVEFLDLKTASPNGGEPCSIWAEGFTQQRSNAKAIESLGRMLTEGIHTDITINASDGSIGAHRAVLAARSPVFRSMFSHNLQEKELSTINISDMSLESCQAFLYYLYGIIKHEEFLTHRLALLQAADKYDISDLRDVCHESLLEDIDTKNVLERLQNASLYQLMKLKMSCIRYLVKFGKIYEIRDDFNTFLRNADRDLISEVFHEVLDAWKGF

SEQ ID NO: 205806 - protein, 675 aa, Glycine max
  Coding DNA Sequence Number=SeqID_89028
  Gene Ontology: Mol. function=transferase activity, transferring phosphorus-containing groups; Cellular component=membrane; Biological process=two-component signal transduction system (phosphorelay)
  Homolog annotation: Hit_ID=Q7CH97; Match level="QueryCoverage=97%, HitCoverage=68%, E-value=0.0, Identity=70%"; Hit description=Sensor for ctr capsule biosynthesis
MLGGELDLSQQRRIQHQRMIAEQHLSRGGLLPVIALDIGAVAAQDRHQVAFQPLIADIQPQPTPLPGIAGLRDRELGVKQWNANAEQAAQARLGLDGDVAVHQVDQFLADRQSQAGALEMTLHAGPHLEERIEQARNLLLRDADAGIAHAELQVAAAGADLQHDTAGIGELDGVVHQVGEHLLQPHRIAEDALRHVLFDKAVQPQTFLDHQRQIVAGDMGDHLQTGELARFNLQLLGLDFGEIEDVADDFQQQAGRVVHRIDQPIDPLRQRLGLQQIKVADNAVQRRAQLMADGGQEHRFRLAGLLRRRRHLLQRLFHLHARADVHQHANRHLFVTVARMDKADLQVVVVAGHHIDEIRLLFANDARYAIAIFVGQQVDVVVRQFVTQDIGAVADAQDTDAHRRRSDDLAVELLVLFQAEGVVLRRQEHLALKQPRQREQHDGRQQVQQQRVEDQHFEAFHHAFHRQRIDDAQRRRRQRFLQDQVAVIVDITEVGMLFGVAVERSGIAFAIRQAQHRLVVLIQQRDADRQVAGGNEIFQPNGLLDAQQRLQLVADIERRQHVQITDVRPLRAGADPIQVVVFVEILGVAVFQNALVQQLQHVFPIGARVAAAEFRHTQAVAANEEHPVEIVGRHEVLFPILDQAAQRIERTAIGALPTTTAKSPVPGTDSGISSA

SEQ ID NO: 205807 - protein, 162 aa, Glycine max
  Coding DNA Sequence Number=SeqID_89029
  Homolog annotation: Hit_ID=Q66CZ7; Match level="QueryCoverage=43%, HitCoverage=83%, E-value=5e-23, Identity=71%"; Hit description =Putative iron-sulphur binding protein
  Pfam annotation: Domain name=Fer2; Domain location=6-81; Score=37.7; E_value=4.1e-08; Accession=PF00111.17; Description=2Fe-2S iron -sulfur cluster binding domain
MATPIVTLRAAGTQLSCPNSESCLLDVLELHDVQVEYQCRSGYCGACRMKLVKGEVAYRQQPLAFINAGEILPCCLFRLAPLSCRCGKITRRRIAKGFAKHGDKITRRGISQRFRDLQHGFAAQALRNYGTELQTRGAAAIRLSRLASERLQQNRDAGNSAP

SEQ ID NO: 205808 - protein, 162 aa, Glycine max
  Coding DNA Sequence Number=SeqID_89030
  Homolog annotation: Hit_ID=Q66D02; Match level="QueryCoverage=99%, HitCoverage=90%, E-value=1e-46, Identity=55%"; Hit description =Putative exported protein precursor
  Pfam annotation: Domain name=YfaZ; Domain location=2-162; Score =236.5; E_value=5.7e-68; Accession=PF07437.2; Description=YfaZ precursor
MMKKTWVACAAGLLLVTGAANAISVSGEAGQHYTNLGVGMSTGSSGLGLTGNWARSDHDGNVGSLGLNFGVPLGPLTATVGAKALYLSPKDGKSGGAVALGGGLEWEINRYFSLHGEGYFAPESFTSGVKAYNEASGGLRWKFRPLSVDVGYRYMQMEGKDG

SEQ ID NO: 205809 - protein, 82 aa, Glycine max
  Coding DNA Sequence Number=SeqID_89031
MGFHPTKLNFVPSDADEAPLDVFHLPACLWYCGVWVLTIGSCVAYLPNGIRVASQTHSIQASLLGTLEDFKVPHVNHVSRPS

SEQ ID NO: 205810 - protein, 373 aa, Glycine max
  Coding DNA Sequence Number=SeqID_89032
  Gene Ontology: Mol. function=DNA binding; Cellular component=nucleus; Biological process=regulation of transcription
  Homolog annotation: Hit_ID=Q1T236; Match level="QueryCoverage=50%, HitCoverage=46%, E-value=8e-16, Identity=30%"; Hit description=IMP dehydrogenase/GMP reductase
  Pfam annotation: Domain name=Myb_DNA-binding; Domain location=108 -155; Score=17.5; E_value=0.048; Accession=PF00249.21; Description =Myb-like DNA-binding domain
MSDYYFDEEEIQELLKENDAPVFDDFFNDFAAQDSSPPADEILPADEVLDPLLVPTSHMVHTSAPDPAPHMVPSEETLRSSHPHHLLPQNMESNHVMLSGDSSHHKKYEHWTIEEHKSFLFGLEIKKEKRWKQISEKYVPSKTAWQVASHAQKYFKRKNTPMKERKRRSIHDTILEDIDIIRIDQQNLVPPTSNFIVQPHAPCTNWVPSTPNFMVQPHAPRTHQHNWVPPPLPNFSVQPRTPRVDQDNWVSPPSNLAVQSRTAHIDQYTWVPPPNLAVQPPTPHVDQHNWVPSPPTFAPHTSLVDQDNWVPTPPDFAVQSHTRHIDQHNWVPPPPNFAVQPHEMQRAQHMQQFNLHSSSPQMDEYRNFNSGHP

SEQ ID NO: 205811 - protein, 476 aa, Glycine max
  Coding DNA Sequence Number=SeqID_89033
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=97%, HitCoverage=83%, E-value=1e-143, Identity=55%"; Hit description =Glucosyltransferase-13
  Pfam annotation: Domain name=UDPGT; Domain location=14-475; Score= -60.2; E_value=1.4e-07; Accession=PF00201.9; Description=UDP -glucoronosyl and UDP-glucosyl transferase
GKHLQSVAMAKTTHIAIVSSPGFGHIVPIIEFSKRLVKLHPNFQVTCIIPSLESSTESCKAYLKTLPSFIDFIFLPPVSIEQLSQGGYIGQLIQLNISHSLPSIHEVLKSLFSKVPLTALVVDVLALQALEFAKEFNALSYFYFPSSAMVLSLLLHMSKLDEEVSSAYKDLTEPIRLPGCVPFMGSDLPDPSHDRSSEFYKHFVEDTKAMVTTDGILINTFLEMESGAVRALEEFGNGKIRLYPVGPITQKGSSSEVDESDKCLKWLDKQPPSSVLYVSFGSGGTLSQNQINELASGLELSGQRFLWVLRAPSESVSAAYLEAANEDPLKFLPSGFLERTKEKGLVVPSWAPQVQVLSHNSVGGFLSHCGWNSTLESVQEGVPIITWPLFAEQRMNAVMLTDGLKVALRPKFNEDGIIEKEEIAKVVKCLMEGEEGKGMRERLRNLKDSAANALKHGSSTQTLSQLANHWENLTKV

SEQ ID NO: 205812 - protein, 468 aa, Glycine max
  Coding DNA Sequence Number=SeqID_89034
  Gene Ontology: Mol. function=transferase activity, transferring glycosyl groups; Cellular component=integral to membrane; Biological process=metabolic process
  Homolog annotation: Hit_ID=Q8S9A3; Match level="QueryCoverage=86%, HitCoverage=99%, E-value=1e-170, Identity=75%"; Hit description =Glucosyltransferase-6
  Pfam annotation: Domain name=UDPGT; Domain location=8-465; Score= -53.8; E_value=6.5e-08; Accession=PF00201.9; Description=UDP -glucoronosyl and UDP-glucosyl transferase
MAKTTHIAVISIPAFSHQASIVEFSKRLVHLHRHFHVYCIFPTIDAPPPATLAMLESLPSNINYNFLPPVHKQDLSHDDAPSMVQIDLAVSQSMPSFRHMLGSLLSTTPLVALIADPFANEALEIAKEFNLLSYIYFPPSAMTLSLFLQLPALHEQVSCEYRDNKEAIQLPGCVPIQGHDLPSHFQDRSNLAYKLILERCKRLSLANGFLVNSFSNIEEGTERALQEHNSSSVYLIGPIIQTGLSSESKGSECVGWLDKQSPNSVLYVSFGSGGTLSQQQLNELAFGLELSDKKFLWVLRAPSDSADGAYVVASKDDPLKFLPDGFLERTKGRGFVVTSWAPQTQILSHVSTGGFLTHCGWNSALESIVLGVPMVTWPLFAEQRMNAVLLTEGLKVALRPKFNENGVAEREEIAKVIKGLMVGEEGNEIRERIEKIKDAAADALKEDGSSTKALYQFGTQMEKFLEQP

SEQ ID NO: 205813 - protein, 465 aa, Glycine max
  Coding DNA Sequence Number=SeqID_89035
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=83%, E-value=1e-152, Identity=57%"; Hit description =Glucosyltransferase-13
  Pfam annotation: Domain name=UDPGT; Domain location=6-464; Score= -54.9; E_value=7.4e-08; Accession=PF00201.9; Description=UDP -glucoronosyl and UDP-glucosyl transferase
MAKTTHIAIVSSPGFGHLVPIIEFSKRLIKNHPNFHVTCIIPSLGSPTESSKAYLKTLPSFIDFIFLPPINKEQLPQGVYVGRKIQLTVSYSLPSIHEVLKSLSSKVPLTALVVDILALQALEFAKEFNALSYFYFPSSAMVLSLLLHLPKLDEEVSGEYKDLIEPIKLPGCVPLLGVDLPDAIRNRPVEYYQHLLKSAKEMLKTDGIIINTFLEMEPGAIRALEEFGNGKSRLYPVGPITQKGSINEADKCLRWLDNHPPCSVLYVSFGSGGTLSQHQINELAAGLEWSGQRFLWVLRAPSNSASAAYLETENEDPLKFLPSGFLERTKEKGLVVASWAPQVQVLSHNSVGGFLSHCGWNSILESVQEGVPLITWPLFAEQKMNAVMLADGLKVALRPKVNEVGIVEKEEIAGVIKCLMEGGEGKGMRERMGNLKDSATNALKDGSSTQTLTQLARQWECLSGI

SEQ ID NO: 205814 - protein, 468 aa, Glycine max
  Coding DNA Sequence Number=SeqID_89036
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=83%, E-value=1e-149, Identity=57%"; Hit description =Glucosyltransferase-13
  Pfam annotation: Domain name=UDPGT; Domain location=6-466; Score= -96.4; E_value=9.1e-06; Accession=PF00201.9; Description=UDP -glucoronosyl and UDP-glucosyl transferase
MANTTHIAIIASPGFGHLVPIIEFSKQLVKHHQNFHVTCIIPSLDSPPESSKAYLKALHSFIDFIFLPPINKEQLPQGVYVGQQIQLTVSLSLPSIHEALKSLSSKVPLTALVADLLAFQALEFAKEFGALSYFYFPLSAMILLLLLHMPKLDEEVSGEYKDLTEPIKLQGCVPIFGVDLPDPIQNRSSEYYQHLLKRSKGMLITDGIIINTFLEMEPGAIRALEELGNGKTRFYPVGPITQKRSIEETDESDKCLRWLGKQPPCSVLYVSFGSGGTLSQHQINHLASGLELSGERFLWVLRAPSNSASAAYLETENEDPLKFLPSGFLERTEEKGLVVASWAPQVQVLSHNSVGGFLSHCGWNSILESVQEGVPLIAWPLFAEQKTNAVMLADGLKVALRLKVNEDDIVEKEEIAKVIKCLMEGEEGKGIAERMRNLKDSAANALKDGSSTQTLSQLASHWEYLSGN

SEQ ID NO: 205815 - protein, 465 aa, Glycine max
  Coding DNA Sequence Number=SeqID_89037
  Gene Ontology: Mol. function=transferase activity, transferring hexosyl groups; Cellular component=integral to membrane; Biological process=metabolic process
  Homolog annotation: Hit_ID=Q1RYE5; Match level="QueryCoverage=99%, HitCoverage=85%, E-value=1e-139, Identity=53%"; Hit description=IMP dehydrogenase/GMP reductase
  Pfam annotation: Domain name=UDPGT; Domain location=6-461; Score= -68.8; E_value=3.7e-07; Accession=PF00201.9; Description=UDP -glucoronosyl and UDP-glucosyl transferase
MEKPTHIVIVPSPGFSHLLSLIEFSKRLIHHSNGLQVTCMIPTLDSPSEPSQAILQTLPSTIHSIFLPSIHFNKETQTPIAVQVQLAVTHSLPFIREALKTISLSSRLVAMFADMFASDALICAKELNLLSFVYFPSSAMTLSFCFYLPKLDQTFPSEFKDLTEPIEIPGCVPIYGKDLPKPVQDRTGQMYEFFLKRCKQLHETDGVLVNSFKGIEEGPIRALVEEGNGYPNVYPIGPIMQTGLGNLRNGSESLRWLENQVPNSVLYVSFGSGGTLSKDQLNELAFGLELSGEKFLWVVRAPSESANSSYLNSQSDDSLRFLPEGFIERTKEEQGLVVPSWAPQVQVLAHKATGGFLTHCGWNSTLESIMNGVPLIVWPLFAEQRMNAVTLTDDLKVALRPKANENGLVGREEVAKVVRKLIKGEEGREIGGRMQKLKNAAAEALEEEGSSTKTLIQFADNLIGN

SEQ ID NO: 205816 - protein, 449 aa, Glycine max
  Coding DNA Sequence Number=SeqID_89038
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=82%, E-value=1e-153, Identity=59%"; Hit description =Glucosyltransferase-13
  Pfam annotation: Domain name=UDPGT; Domain location=6-448; Score= -92.5; E_value=5.8e-06; Accession=PF00201.9; Description=UDP -glucoronosyl and UDP-glucosyl transferase
MAKTTHIAIVSGPGFSHLVPIVEFSKLLIKLHPNFHVNCIIPSFGSPPESSKAYLKTLPSNIDTILLPPINKQQLPQGVNPAVTITLSLPSIHEALKSLSSKFPLTALVADTFAFPTLEFAKEFNALSYFYTPCSAMVLSLALHMPKLDEEVSGEYKDLTEPIKLQGCVPILGVDLPASTQSRSSEAYKSFLERTKAIATADGIIINTFLEMESGAIRALEEYENGKIRLYPVGPITQKGSRDEVDESVLYVSFGSGGTLSQNQINELASGLELSGQRFLWVLRAPSNSVNAAYLEAEKEDPLKFLPSGFLERTKEKGLVVPSWAPQVQVLSHNSVGGFLSHCGWNSTLESVQEGVPIITWPLFVEQRMNAVMLTDGLKVTLRPKFNEDGIVEKEEIAKVIKCLMEGEEGKGIRERMMSLKDFSASALKDGSSTQTLSQLARHWENSSE

SEQ ID NO: 205817 - protein, 475 aa, Glycine max
  Coding DNA Sequence Number=SeqID_89039
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=97%, HitCoverage=82%, E-value=1e-155, Identity=59%"; Hit description =Glucosyltransferase-13
  Pfam annotation: Domain name=UDPGT; Domain location=6-469; Score= -78.9; E_value=1.2e-06; Accession=PF00201.9; Description=UDP -glucoronosyl and UDP-glucosyl transferase
MAKTTHIAIVSSPGFSHLVPIIEFTKRLVKLHPNFHVTCIVPSLGSTPESSKAYLKTLPSNIDSIFLPPISKENVPQGAYAGLLIQLTITLSLPSIYEALKSLSSKFPLTALVADTFAFPTLEFAKEFNALSYFYTPCSAMVLSLALHMSKLDEEVSGEYKDLTEPIKLQGCVPLLGVDLPAPTQNRSSEAYKSFLERAKAIATADGIIINTFLEMESGAIRALEEYENGKIRLYPVGPITQKGSRDEVDESGKCLSWLDKQPPCSVLYVSFGSGGTLSQNQINELASGLELSGQRFLWVLRAPSNSVNAAYLEAEKEDPLKFLPSGFLERTKEKGLVVPSWAPQVQVLSHNSVGGFLSHCGWNSTLESVQEGVPIITWPLFAEQRMNAVMLTDGLKVALRTKFNEDGIVEKEEIARVIKCLMEGEEGKGMRERMMNLKDFSANALKDGSSTQTLSQLARHWENSSQVSGDVGYR

SEQ ID NO: 205818 - protein, 154 aa, Glycine max
  Coding DNA Sequence Number=SeqID_89040
  Homolog annotation: Hit_ID=Q6RKE1; Match level="QueryCoverage=90%, HitCoverage=5%, E-value=9e-20, Identity=40%"; Hit description =Polyketide synthase
MGSFPLLGSDIDGVLPVDYLAGVIARVMTRDQDRIGQDYDFANPQAPGFNSLVRHIRGAGAQVGSLPFEQWREEALAYAQANPRSAIARIAAVLDGLGVQSDLEQMFDCFPVGRQVFGGEVYPCPPVDARHVRPYVERILAAAPAAAQAQELSP

SEQ ID NO: 205819 - protein, 242 aa, Glycine max
  Coding DNA Sequence Number=SeqID_89041
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=47%, E-value=3e-74, Identity=55%"; Hit description =Glucosyltransferase-13
MYSFFLQRSKTLHVADGILVNSFKEIEAGPIRALREEGSGWLEKQVPNSVLYVSFGSGGTLSQDQFNELALGLELSGKKFLWVVRAPSESQNSVHLGCESDNPLRFLPERFIERTKGKEHGLVAPSWAPQVQVLSHNVTGGFLTHFGWNSTLESIVNGVPLIAWPLYAEQGMNAVMLTNDLKVALRPKDNEKGLVEREQVAKVIRRLMEDQEGREIGERMQNSKNAAAETQQEEGSSTKTLI

SEQ ID NO: 205820 - protein, 91 aa, Glycine max
  Coding DNA Sequence Number=SeqID_89042
LGCFHNPACLGELGGNLLPLFPINRLKGAVLWIPDAPENPSRGASVTLPRGFRKQIREGFPPLFTVLHPFFVLQRYSLISVKLNSDRSVVP

SEQ ID NO: 205821 - protein, 141 aa, Glycine max
  Coding DNA Sequence Number=SeqID_89043
MQPNRAVNPVPRLNTGERPIANKEADGGRRCVPVGCGNGEEPVRRSTRDIEPTRIAMVAQARAVDMLVETSSSRLWMAARALGVPRHLRAPGVGLWAPHSARLETRTKESDMCASQRASKPVRRKEADWWDPPVGCTADRP

SEQ ID NO: 205822 - protein, 741 aa, Glycine max
  Coding DNA Sequence Number=SeqID_89044
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=P0A1Q0; Match level="QueryCoverage=64%, HitCoverage=99%, E-value=0.0, Identity=69%"; Hit description=Alpha ,alpha-trehalose-phosphate synthase [UDP-forming]
  Pfam annotation: Domain name=Glyco_transf_20; Domain location=265 -720; Score=619.8; E_value=2.4e-183; Accession=PF00982.11; Description=Glycosyltransferase family 20
  Pfam annotation: Domain name=Hydrolase_3; Domain location=32-255; Score=-63.7; E_value=0.0019; Accession=PF08282.2; Description =haloacid dehalogenase-like hydrolase
  Pfam annotation: Domain name=Trehalose_PPase; Domain location=33-249; Score=201.3; E_value=2.2e-57; Accession=PF02358.7; Description =Trehalose-phosphatase
  Pfam module annotation: Pfam domain module=Glyco_transf_20::Hydrolase_ 3::Trehalose_PPase; Domain location=265-720::32-255::33-249
MIKSARDTGGDVTPAVNENSTLPSLSGGLYAFFFDVDGTLAALQSQPESVSIPASVRQHLQQISNLSHGALALVSGRPISQLDELVAPLQAPAAGVHGAERRDASGHLHRQSLPDEVAQTLQVELQQTLDQWPGTLLEVKGMAFALHYRNAPEYENAIMQLAEEAVTRFPALALQPGKCVVELKPQGIDKGAAVREFMQEAPFTGRIPVFVGDDLTDEKGFLAVNAMHGISVKVGEGPSQARYRLPDVAAVWHWLEQLLLQLEHDNVVVVSNRIAIPDGSKTNAGGLAVGILDALQTTGGLWFGWNGEISEFSGEEDEELTQIEQDGITYASFPLNQNDYDQYYCQFSNTVIWPAFHYRLDLVQYQREAWEGYCRVNTLLAQRLKPLIKPDDILWIHDYHLLPFAAELRKQGINNRIGFFLHIPFPTPEIFNALPPHQELLEMLCEYDLLGFQTESDRVAFLDSLSQLTQLQNKGEKKHRAFGNTFMTEVYPIGIEPDSIKEMAEGPLPPKMAAMKRELGDLQNIIACERLDYSKGLPERFLAYEALLENFPQHRGKIRYSQIAPTSRGDVQAYQDIRHQLETEAGRINGKYGTLGWTPLYYLNQHFDRRLLMKIFRLTDVGLVTPLRDGMNLVAKEYVAAQDPDDPGVLVLSRFAGAANELTSALIVNPYDRDDVAAALDRALTMPRTERISRYNDMMAVLRKQDISHWRESFLNDLNTLPARSASHGSDNKVATFQKLA

SEQ ID NO: 205823 - protein, 343 aa, Glycine max
  Coding DNA Sequence Number=SeqID_89045
  Gene Ontology: Mol. function=porin activity; Cellular component=cell outer membrane; Biological process=ciliary or flagellar motility
  Homolog annotation: Hit_ID=UPI00005F8983; Match level="QueryCoverage =82%, HitCoverage=67%, E-value=1e-108, Identity=68%"; Hit description= COG1360: Flagellar motor protein
  Pfam annotation: Domain name=OmpA; Domain location=160-258; Score =116.0; E_value=1.1e-31; Accession=PF00691.11; Description=OmpA family
MKHGNRPIVLVKRRKHKKHEGSHGSWKIAYADFMTAMMAFFMVMWLISIANPQELVQIAEYFKTPLKVALTGGQRSSDSESPIPGGGDDPTQKKGEVQKQVDMDAQKRQLDDIRLNRLREKLDQLIEADPRLKALRPHLIINMVEEGLRIQIIDSQNRPMFKTGSAEVEPYMRDILRAIAPLLNDIPNKISLSGHTDDFQYASGDRGYSNWELSADRANASRRELVAGGLDGGKMLRVVGMADTMKLKNRGANDAVNRRISLLVLNHDTEAAIEKENAESDAVQVSDPAQILPSITAPAGPAAPTAPTGSTAAPATPAAAANPPAAAPPAASAVTPDQPSQPR

SEQ ID NO: 205824 - protein, 63 aa, Glycine max
  Coding DNA Sequence Number=SeqID_89046
  Gene Ontology: Mol. function=copper ion binding; Cellular component =periplasmic space; Biological process=response to copper ion
  Homolog annotation: Hit_ID=Q8ZNX1; Match level="QueryCoverage=96%, HitCoverage=50%, E-value=2e-10, Identity=58%"; Hit description =Similar Cu resistance protein CopC
  Subcellular localization annotation: CTP_CleavageSite=15; ConfidenceScore=5.01e-01
MGFSASRAACALVFLASTVISPSVLAHAHLQQTIPGADSQVSAPQSLTLNFSEGIEPGFSGVV

SEQ ID NO: 205825 - protein, 186 aa, Glycine max
  Coding DNA Sequence Number=SeqID_89047
  Homolog annotation: Hit_ID=Q8H6Q8; Match level="QueryCoverage=96%, HitCoverage=5%, E-value=1e-22, Identity=34%"; Hit description=CTV.20
YNYWDYIDAWTNVFWHQNSRFKHPWLIYFKNNTVYNFPNWFLQWWNYFGPIPQIFPEEVQQGFQQFSKLFNNKESRIPTDLKYFSSFSLSWIFSWQYRYGKTENSKQYPPLQRHTFVKWWSQFDTSKAAPEQVKNWFQSNPEFLKPADPETSLFLNQKSQLVAFLASSKSKESLTQNLKEVLQLLQ

SEQ ID NO: 205826 - protein, 87 aa, Glycine max
  Coding DNA Sequence Number=SeqID_89048
  Homolog annotation: Hit_ID=Q1SFL1; Match level="QueryCoverage=62%, HitCoverage=4%, E-value=4e-15, Identity=63%"; Hit description =Integrase, catalytic region; Peptidase aspartic, catalytic
MTIDEALANDDWIIAMEKELHQFTRNNVWTLVPKLENESIIGTRWVFRNKLDEQAEWRRRRVERRCHFKEKMSQEEAHHHRKPWIRA

SEQ ID NO: 205827 - protein, 54 aa, Glycine max
  Coding DNA Sequence Number=SeqID_89049
SSKSKESLAQNLKEVLQLLQQEVEEEPSKKEAESSETNDDQEDDSFYQNEDDCF

SEQ ID NO: 205828 - protein, 400 aa, Glycine max
  Coding DNA Sequence Number=SeqID_89050
  Gene Ontology: Mol. function=transporter activity; Cellular component= integral to membrane; Biological process=oligopeptide transport
  Homolog annotation: Hit_ID=Q9FU86; Match level="QueryCoverage=81%, HitCoverage=61%, E-value=1e-73, Identity=42%"; Hit description =Putative peptide transport protein
  Pfam annotation: Domain name=PTR2; Domain location=51-385; Score =108.1; E_value=2.6e-29; Accession=PF00854.12; Description=POT family
MLGMNIDGYVVNDVGDDFADTYFRLQWTRYALINALFRHAKGQAKAKPHSYTVHLPTLLWAPEESSPVCPPSVLTNLTREMRKIVQMKFSFLNWFFFAINMGAILGITPLVYIQDAAGFGWGFGIHAAAAICSIVILLAGLRYYRFKMPMGSPFTRFLQVMVASTMNHLNRVHLENDQTRLYEVETTRKLPHTPQYRTRKTSNRWRICTVTQVEEFKSFIRVLPVWASTIALSVSYAQLSTFFLSQANIMDRTLGTHFKIPAGSVPVFSAITLILVPIYEKFIVPSLRNIIGHHRGVTSLQRMGVGLFVLIFAMASAALVERKRRDHKSLKMSVFWLLPQFFLMGAAEILTAINDVNFLVYLVVAYCHRGKGALVMDEAMVEFTESNSANHEGELPSTFF

SEQ ID NO: 205829 - protein, 595 aa, Glycine max
  Coding DNA Sequence Number=SeqID_89051
  Gene Ontology: Mol. function=transferase activity, transferring phosphorus-containing groups; Biological process=phosphorylation
  Homolog annotation: Hit_ID=UPI00005F72E8; Match level="QueryCoverage =74%, HitCoverage=99%, E-value=1e-133, Identity=51%"; Hit description= COG3522: Uncharacterized protein conserved in bacteria
  Pfam annotation: Domain name=DUF876; Domain location=154-592; Score =538.9; E_value=5.3e-159; Accession=PF05936.2; Description=Bacterial protein of unknown function (DUF876)
MTMISLRRAGLLLLACLLAACSSNSPAPVARYNLDFQAHPQINAGAPLKVRVMLLTSDAEFMSADFYSLQNQPATALGSTLLNNQQFFLMSGQLSKTLSAKSLPEARFIGIMAEYQALDGKVWRLALPFPDGDDSAFWQFWKNNDVRMPMNRAEKVVWTEGMFLRPHHFQQSENFLHSTLREWGQSQRAYTWGFFDLEFDEALLRQGKLALSAASGCLPDGTFFSFSQPQHGPAPLDLPANVDRSKVVLAIPARRNGREAVAFQETQDSLARYLAWEAEVEDDNAQAVGAATVQFGKLRLRLMLEQDLTAEWTAMGVAQVIEKRSDNHVRLDTDYIPPMLTLNASRPLQSMLNDLHGLIQQRSQQLSQRTPGTGRFNSADMVDFMLLTLLNRQLGLHAHLQDLPLLHPETLYSHWLQLAAELSSWMPARTPDALPLYDHDDLYSCFARLTLLLRQGLSQVMEESAIQLPLTQRSHGLNVATVPESSMVREFGFVLAVKASVPAEALKTHFPAQMKVAPVTKIRDLVQLQLPGLALKAMPGAPPQIPWHAGYSYFELDKNSELWQEMERSGAFALHLAGEFPGLNMEFWAIRSQSE

SEQ ID NO: 205830 - protein, 119 aa, Glycine max
  Coding DNA Sequence Number=SeqID_89052
  Gene Ontology: Mol. function=phosphoglycolate phosphatase activity; Cellular component=cellular_component; Biological process=metabolic process
  Homolog annotation: Hit_ID=P0A8Y1; Match level="QueryCoverage=96%, HitCoverage=51%, E-value=1e-36, Identity=63%"; Hit description=5' -nucleotidase yjjG
MLKGKVKIAIITNGFTALQQARLERTGFHDYFDALVISEQVGVPKPDAAIFDHTLQLLGNPDRRRVLMVGDTPESDILGGMNAGVKTCWIDHGTRPLPAHITPTWQVKTLPELQSILTA

SEQ ID NO: 205831 - protein, 184 aa, Glycine max
  Coding DNA Sequence Number=SeqID_89053
  Homolog annotation: Hit_ID=Q1SWQ8; Match level="QueryCoverage=89%, HitCoverage=59%, E-value=2e-26, Identity=38%"; Hit description =Nucleic acid-binding, OB-fold; TonB box, N-terminal
MHNFKVVKNDGQFRVCEHEYKLFFIGVTVVREADLHELPFKEFRFVEFANVVAGNFVSGLLVDIIGVVDQVVFRHVSSKNTRVVFRMKDLSGEILSCTLWENYCTQFLSYLNEPGDDGSMVIILTHARIKDAQGSYPASVSNSFKASKLLINDPILEIQEFKERLLDLGVEVSRVLLPGDQASS

SEQ ID NO: 205832 - protein, 245 aa, Glycine max
  Coding DNA Sequence Number=SeqID_89054
  Gene Ontology: Mol. function=transcription factor activity; Cellular component=nucleus; Biological process=regulation of transcription, DNA-dependent
  Homolog annotation: Hit_ID=Q9LQZ2; Match level="QueryCoverage=92%, HitCoverage=91%, E-value=1e-35, Identity=40%"; Hit description =Dehydration-responsive element-binding protein 2D
  Pfam annotation: Domain name=AP2; Domain location=37-101; Score =116.9; E_value=5.7e-32; Accession=PF00847.10; Description=AP2 domain
MLKSGIGIEERKQLKKPAQASSRKGCMRGKGGPENASCTYKGVRQRTWGKWVAEIREPNRGARLWLGTFETSHEAALAYDAAARKLYGSDAKLNLPELSIKSQSQCPPPSPPPPSSVTNNTQMENLQQIQNNYIDMATCSNFNNINNPEVSMASQQVGVGPIYTSDSIVSLPLDTNPKPVENEVEFRPSWATMNEGLPVFDDSIWAEAAMSLDFPHIAAETAIYASGNNLADVGVWDSLQTPWCM

SEQ ID NO: 205833 - protein, 721 aa, Glycine max
  Coding DNA Sequence Number=SeqID_89055
  Gene Ontology: Mol. function=hydrolase activity, acting on glycosyl bonds; Cellular component=beta-galactosidase complex; Biological process=carbohydrate metabolic process
  Homolog annotation: Hit_ID=Q9ZRV9; Match level="QueryCoverage=98%, HitCoverage=97%, E-value=0.0, Identity=80%"; Hit description=Beta -galactosidase
  Pfam annotation: Domain name=Glyco_hydro_2_N; Domain location=423 -558; Score=-30.4; E_value=0.00031; Accession=PF02837.8; Description =Glycosyl hydrolases family 2, sugar binding domain
  Pfam annotation: Domain name=Glyco_hydro_35; Domain location=36-340; Score=633.1; E_value=2.3e-187; Accession=PF01301.10; Description =Glycosyl hydrolases family 35
  Pfam annotation: Domain name=Glyco_hydro_42; Domain location=58-410; Score=-240.9; E_value=0.012; Accession=PF02449.6; Description=Beta -galactosidase
  Pfam module annotation: Pfam domain module=Glyco_hydro_2_N::Glyco _hydro_35::Glyco_hydro_42; Domain location=423-558::36-340::58-410
MDTIANSVSKLLTLFLTVLFVGSELTHCNVTYDRKSLLINGQRRILISGSIHYPRSTPEMWEDLIWKAKHGGLDVIDTYVFWDVHEPSPGNYDFEGRYDLVRFIKTVQKVGLYANLRIGPYVCAEWNFGGIPVWLKYVPGVSFRTDNEPFKAAMQGFTQKIVQMMKSEKLFQSQGGPIILSQIENEYGPESRGAAGRAYVNWAASMAVGLGTGVPWVMCKENDAPDPVINSCNGFYCDDFSPNKPYKPSMWTETWSGWFTEFGGPIHQRPVEDLSFAVARFIQKGGSYVNYYMYHGGTNFGRSAGGPFITTSYDYDAPIDEYGLIRQPKYSHLKELHKAIKRCEHALAHVFSSGTGTCAAFLANYNAQSAATVTFNNRHYDLPPWSISILPDCKIDVFNTAKVRVQPSQVKMLPVKPKLFSWESYDEDLSSLAESSRITAPGLLEQLNVTRDTSDYLWYITSVDISSSESFLRGGQKPSINVQSAGHAVHVFVNGQFSGSAFGTREQRSCTYNGPVDLRAGANKIALLSVTVGLQNVGRHYETWEAGITGPVLLHGLDQGQKDLTWNKWSYKVGLRGEAMNLVSPNGVSSVDWVQESQATQSRSQLKWYKAYFDAPGGKEPLALDLESMGKGQVWINGQSIGRYWMAYAKGDCNSCTYSGTFRPVKCQLGCGQPTQRWYHVPRSWLKPTKNLIVVFEELGGNPWKISLVKRVAHTPAVHGQ

SEQ ID NO: 205834 - protein, 46 aa, Glycine max
  Coding DNA Sequence Number=SeqID_89056
MAEEGQVIGVHSVEEWEEHLKKGQESKKLLYASLVPRPFSANYPLC

SEQ ID NO: 205835 - protein, 299 aa, Glycine max
  Coding DNA Sequence Number=SeqID_89057
  Gene Ontology: Mol. function=cysteine-type endopeptidase activity; Cellular component=vacuole; Biological process=proteolysis
  Homolog annotation: Hit_ID=Q93XC2; Match level="QueryCoverage=91%, HitCoverage=63%, E-value=1e-119, Identity=69%"; Hit description =Papain-like cysteine peptidase XBCP3
  Pfam annotation: Domain name=Granulin; Domain location=225-273; Score= 27.5; E_value=7.4e-06; Accession=PF00396.9; Description=Granulin
  Pfam annotation: Domain name=Peptidase_C1; Domain location=1-197; Score=339.1; E_value=7.5e-99; Accession=PF00112.13; Description =Papain family cysteine protease
  Pfam module annotation: Pfam domain module=Granulin::Peptidase_C1; Domain location=225-273::1-197
MCYLGACWAFSATGAIEGINKIVTGSLVSLSEQELIDCDTSYNSGCGGGLMDFAYQFVIDNKGIDTEDDYPYQARQRSCSKDKLKRRAVTIEDYVDVPPSEEEILKAVASQPVSVGICGSEREFQLYSKGIFTGPCSTFLDHAVLIVGYGSENGVDYWIVKNSWGKYWGMNGYIHMIRNSGNSKGICGINTLASYPVKTKPNPPIPPPPGPVRCNLFTHCSEGETCCCAKSFLGICFSWKCCGLTSAVCCKDKRHCCPQDYPICDTRRGQCLKRTANGTTTITSENQDFSHKSRGWKSQ

SEQ ID NO: 205836 - protein, 283 aa, Glycine max
  Coding DNA Sequence Number=SeqID_89058
  Gene Ontology: Mol. function=protein binding; Cellular component =nucleus
  Homolog annotation: Hit_ID=UPI0000519FFE; Match level="QueryCoverage =67%, HitCoverage=66%, E-value=8e-14, Identity=30%"; Hit description =PREDICTED: similar to BWK-1 isoform 2
MNFQAVNDNDIHNIVLSYLIHNCYKESVESFIACTGAKQPTDYLEDMDKRKRQNHRGCWEMLLTPVEFIAFLLDPVISCEDLLDDKFHLSLGIFHFALEGNALKAIELTEQLAKDILENNKDLQFDLLSLHFVELVCSRKCTEALEFAQTKLGPFGKEPKYMEKLEDFMALLAYKEPEKSPMFHLLSLEYRQQVADSLNRAILGCTLESSQLHSNGEANTAGYSCKTMLKSRSWQGWATIFLKGFSQKLMENSKKWRVNWGMKLVYLEPFSSHIGLVYGFIIV

SEQ ID NO: 205837 - protein, 51 aa, Glycine max
  Coding DNA Sequence Number=SeqID_89059
MSLKDLPHFSGSNKSKIISTEVQKGWPTACRNKETDKAPVVGLRDSDYGRG

SEQ ID NO: 205838 - protein, 148 aa, Glycine max
  Coding DNA Sequence Number=SeqID_89060
MAVNNNKLVLLTFAICRLIVTVGLTVVPELLDVGLQGRLSVDTLELEAASVDFGRLSRGEPSEVVTTRKVLFYDALFKSVIWNRLKKWCGGKLVIIKLRIIFYNVNSKAVIKNRLRICQGGIPFRYYLEPSLSTVDRFPPSSPSLRRL

SEQ ID NO: 205839 - protein, 234 aa, Glycine max
  Coding DNA Sequence Number=SeqID_89061
  Homolog annotation: Hit_ID=Q6S591; Match level="QueryCoverage=49%, HitCoverage=44%, E-value=1e-10, Identity=43%"; Hit description=JAGGED
  Subcellular localization annotation: CTP_CleavageSite=50; ConfidenceScore=5.13e-01
MGSLSLFTGNKVEHCRGLLLTSVVAGKRKAAGRMEKTSVGRSTSVDFVPSSSAKRETETLNQARQLVFRSDHIIAPQGAPHLGCCQPIGTGGYHPSGDPTVPLRFPRYFSGSSSTHMPPPPPPPPPPQQSHLYASPSRPVSFGSSHFPHQHAVNDYYVGHVMSGGSHGHYVGGESTSSYTYIGAPVGQAGGFAGGGKEGSAVQEEGLSWGRSYSGGAQHRLDPPSAINRFHDGF

SEQ ID NO: 205840 - protein, 175 aa, Glycine max
  Coding DNA Sequence Number=SeqID_89062
  Gene Ontology: Mol. function=structural constituent of ribosome; Cellular component=ribonucleoprotein complex; Biological process =translation
  Homolog annotation: Hit_ID=P31165; Match level="QueryCoverage=97%, HitCoverage=89%, E-value=7e-56, Identity=57%"; Hit description=50S ribosomal protein L15, chloroplast precursor
  Pfam annotation: Domain name=L15; Domain location=126-157; Score =50.2; E_value=6.7e-12; Accession=PF00256.13; Description=Ribosomal protein L15
  Pfam annotation: Domain name=Ribosomal_L15; Domain location=27-114; Score=97.6; E_value=3.7e-26; Accession=PF01305.8; Description =Ribosomal protein L15 amino terminal region
  Pfam module annotation: Pfam domain module=L15::Ribosomal_L15; Domain location=126-157::27-114
  Subcellular localization annotation: CTP_CleavageSite=45; ConfidenceScore=5.22e-01
MGSASLIPVSWLAFKGTVKSLVAKPWLKVEQARPLVSSVGIRGISAGQGASCGFGMRGQKSRSGPAVTIGFEGGQMPLYRRIPKLRGIAGETEDAKFKEGEEVSLEFLKAKGVINTSGRERRLPLKILGEGELSKKLTLKARAFSTSAKEKLENVGCSLTVLPGRKKWVKPSDNC

SEQ ID NO: 205841 - protein, 175 aa, Glycine max
  Coding DNA Sequence Number=SeqID_89063
MFNKINIGRFINEGGAKQVSAGATLSHTPNRNGSNNPSPRITEPSIKSVHAKQEYKPLEAPSPSNNNSLLNTNEIEHSHENNDVPAGDAKSEIRFQSSDVLEKARAAIASADRASAAARAAAALVQSNFGSLKLGGVVSNNLAWCKYDSFVCDWFVSIKRLKFKANYVVKTIEAS

SEQ ID NO: 205842 - protein, 75 aa, Glycine max
  Coding DNA Sequence Number=SeqID_89064
MVGNRKEQIKDMSKEKMANVVEEAKKTSTLYYYCLPVPEAALQHSDFIYPFLSKISMLILRIKLQTMKVKTLCFV

SEQ ID NO: 205843 - protein, 155 aa, Glycine max
  Coding DNA Sequence Number=SeqID_89065
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEAIRERVGVAPIVEKMVENRLRWFGHVERRPVDSVVRRVDQMERRQTIRGRGRPKKTIREVIKKDLELNDLDRSMRTNNVFSNHESPKGLQSPSWPIQTSVPSYLGFLFDYLLGLISSLDCSHHDHLESLYWCKNLI

SEQ ID NO: 205844 - protein, 165 aa, Glycine max
  Coding DNA Sequence Number=SeqID_89066
MLFAGGKKLLYVCVVVMLVVLHICHTCQVGAIRVFPGNAAANVEFSHGNMDNNKSKEDLFKKYFGGRTHLRPSNTTQKGFDDSKRRGLEEETENGREIEVGKRHVLCGEEEGVLLAFLVAVSLIIVRPIFLAKYTYLFINLSLIFQQSMWVAGWGDMYPTIVNAE

SEQ ID NO: 205845 - protein, 441 aa, Glycine max
  Coding DNA Sequence Number=SeqID_89067
  Gene Ontology: Mol. function=metal ion binding; Cellular component =intracellular; Biological process=regulation of transcription
  Homolog annotation: Hit_ID=Q8RWD0; Match level="QueryCoverage=89%, HitCoverage=94%, E-value=5e-78, Identity=44%"; Hit description=Zinc finger protein CONSTANS-LIKE 16
  Pfam annotation: Domain name=CCT; Domain location=410-441; Score =43.6; E_value=6.9e-10; Accession=PF06203.4; Description=CCT motif
  Pfam annotation: Domain name=zf-B_box; Domain location=55-102; Score =47.0; E_value=6.4e-11; Accession=PF00643.14; Description=B-box zinc finger
  Pfam module annotation: Pfam domain module=CCT::zf-B_box; Domain location=410-441::55-102
GSPREIPWIREAANEKAGIRMNFLSSTNQKPDKAFNLFHSPSSATKNAANAVGAKTARACDSCITKRARWYCAADDAFLCQACDSSVHSANPLARRHERVRLKTASYKSTDEQQQQQQQQPPTWHTKKPRTPRHGKHSRNNNPFHLVPEEGSEEANSHDENEEQLLYRVPIFDPFVAELCGTNSSPSPVTSTDQGVVAAAEVEYKGFQSNGFCSNSSEMENLHGMLPSDAELAEFAADVESLLGRGLENECVGMEELGLVDAKEEECSVGSGKVKMEDQEESPLVEMEMDMVVGRDDQSFELSFDYETCEEVKVCDLGLGNELGAKKENDDEVKKNKISLQLDYEAVIIAWASQKSPWTTADKPNLDPDECWKQCMGSCETAYHHPCGEMGGFGIHPVIIDGGREARVSRYREKRRTRLFSKKIRYEVRKLNAEKRPRMKG

SEQ ID NO: 205846 - protein, 95 aa, Glycine max
  Coding DNA Sequence Number=SeqID_89068
MAFSESWITFSGLSLWLTLFAPHAVIIKYGSRRDCMDPQFFFSQRMQMQVKVFWKLEIKLHRFSCKVPDRYMNVLAVTTNGRKGHNQWRLIVTSK

SEQ ID NO: 205847 - protein, 83 aa, Glycine max
  Coding DNA Sequence Number=SeqID_89069
  Homolog annotation: Hit_ID=Q2QCW7; Match level="QueryCoverage=39%, HitCoverage=6%, E-value=2e-08, Identity=84%"; Hit description=3 -ketoacyl-CoA synthase
MAIIMGMRVRVRMWFTRYWYPSFTYLSFTEWKKSGKMGGILLFFSKGTLGSERGQMRGINETLHVTQRSLNLVLIFITPPFDI

SEQ ID NO: 205848 - protein, 175 aa, Glycine max
  Coding DNA Sequence Number=SeqID_89070
  Gene Ontology: Mol. function=metal ion binding; Cellular component =intracellular; Biological process=regulation of ARF protein signal transduction
  Pfam annotation: Domain name=VWA; Domain location=44-171; Score=6.9; E_value=0.0011; Accession=PF00092.18; Description=von Willebrand factor type A domain
MSECAVISASQAYETYALILKVKAPPPPPPSRISVASSQCAPIDLVKVLDVGGNMTGGKLHMLKRAMRLVISSLGTGDRLSIVTFSTTCKRLLPLRTMTSQGQHMARRIVDRLVIGQGSSVGNALRKATRVLEDRRERNLLANFLECTVYTITLNSLIYNNLINQKIFLQFSAYH

SEQ ID NO: 205849 - protein, 260 aa, Glycine max
  Coding DNA Sequence Number=SeqID_89071
  Gene Ontology: Mol. function=methyltransferase activity; Biological process=metabolic process
  Homolog annotation: Hit_ID=Q338C6; Match level="QueryCoverage=96%, HitCoverage=57%, E-value=4e-61, Identity=52%"; Hit description =Expressed protein
  Pfam annotation: Domain name=TP_methylase; Domain location=23-256; Score=35.6; E_value=1.7e-07; Accession=PF00590.10; Description =Tetrapyrrole (CorrinPorphyrin) Methylases
MPRFISLSGHQKDTPHSHSLKPGLYLVGTPIGNLEDITLRAIRVLNSADVILSEDTRHSGKLLHHYHIKTPLMSYHKFNESQREQVVLRRLKQGEIVALISDAGMPGISDPGMELGIAITPHIICLPSACLVMRFCNDPKASQILMQAKLCVSENILVVPIPGPCALVSALSASGLTTDEFTFGNKLAKLNFGIYGILGSKMAVVMYDFVVGFLPKHSELRRKRLMVSADQTTTQIFYVAPHKLSQFLDESSSIFGDARC

SEQ ID NO: 205850 - protein, 126 aa, Glycine max
  Coding DNA Sequence Number=SeqID_89072
MSPLFRSSTSYMLTRIGIRWFNIQVNGTWTSGPNKKGMVAEGAGAEEGEERRGKLLANANGKSIGSAETEVKCCGKTNRRPRQSSNQHFPYAENSERYRCRHTAHGSFCLSIRPNGLHNPTRDLDQ

SEQ ID NO: 205851 - protein, 370 aa, Glycine max
  Coding DNA Sequence Number=SeqID_89073
  Gene Ontology: Mol. function=cytokinin dehydrogenase activity; Cellular component=vacuole; Biological process=electron transport
  Homolog annotation: Hit_ID=Q67YU0; Match level="QueryCoverage=94%, HitCoverage=58%, E-value=1e-134, Identity=68%"; Hit description =Cytokinin dehydrogenase 5 precursor
  Pfam annotation: Domain name=Cytokin-bind; Domain location=137-365; Score=246.4; E_value=6.1e-71; Accession=PF09265.1; Description =Cytokinin dehydrogenase 1, FAD and cyto
  Pfam annotation: Domain name=FAD_binding_4; Domain location=5-105; Score=-8.9; E_value=0.011; Accession=PF01565.13; Description=FAD binding domain
  Pfam module annotation: Pfam domain module=Cytokin-bind::FAD_binding _4; Domain location=137-365::5-105
MIKEKKGVVIEMGKSDSGEDGSSIRVSEKGMYVDVWGGKLWIDVLSATLEYGLAPMSWTDYLYLSVGGTLSNAGISGQTFNHGPQITNVYELDVVTGKGELVTCSEDRNSELFHAVLGGLGQFGIITRARIALEPAPHRVRWIRVLYSNFARFCKDQEYLISLHGKAARERFDYVEGFVIVDEGLINNWRSSFFSASNPVKITSLNADGGVLYCLEITKNYDQGNADSVDESDLILLMVSLSNWSNNSINKKNDIRCPEEIQALLKKLNFIPTSVFTTDLPYVDFLDRVHKAELKLRSKGLWDVPHPWLNLFVPKSRIGDFDKGVFKGILGNKTSGPILIYPMNKNKHAHISSYINHMSAADSLISTVSV

SEQ ID NO: 205852 - protein, 647 aa, Glycine max
  Coding DNA Sequence Number=SeqID_89074
  Gene Ontology: Mol. function=sequence-specific DNA binding; Cellular component=nucleus; Biological process=regulation of transcription, DNA-dependent
  Homolog annotation: Hit_ID=Q8LLD8; Match level="QueryCoverage=97%, HitCoverage=91%, E-value=2e-87, Identity=37%"; Hit description=BEL1 -related homeotic protein 30
  Pfam annotation: Domain name=Homeobox; Domain location=391-449; Score= 6.4; E_value=0.0011; Accession=PF00046.19; Description=Homeobox domain
  Pfam annotation: Domain name=POX; Domain location=193-349; Score =218.2; E_value=1.8e-62; Accession=PF07526.2; Description=Associated with HOX
  Pfam module annotation: Pfam domain module=Homeobox::POX; Domain location=391-449::193-349
MYPNQAFSLGSYAEMMSGTSLFPHDYSETVGGGQNEVKFITAMGETVTMHSINGHSNAASGDPACNSFAGDSHVVSRTQMGMVDSEQNINCQGLSLSLGTLMPSNASVSPFQYQYHDTGLLPLMNDFPNIKGTMSLKDDEANNLHGEFRSVECMASVSSGGFHDMIKKEGFYNPNHPSMCLKEVPSDLPGYSNSILNSQYLKAAQELLDEIVSVQKALKQSGMEKQENNRDIGLDGSKDADGKSTSQSMQMSSAPNGSSANASSDLSSAERQTLLDKKTKLLSMLDERFQLPKTVNEVDKRYRQYCHQMQIVVSSFDMVAGCGAAEPYTTLALRTISRHFRCLRDAISGQIQVTQRSLGEQEGIPRLRYVDQQLRQQKALQQLGVMRQAWRPQRGLPESSVSILRAWLFEHFLHPYPKDSEKIMLARQTGLTRNQVANWFINARVRLWKPMVEEMYKEEFGDSEMNCNLSSENNTVKGKRDDVQESDNINNNNNKWEESQDNLVTVDSVQVQPQAEMDRVVNVENVVMNSGTGKLQGDQNQQRLGLNNNNNSSSNFYSISTNENGGDGGLMGTSTHATYDLSELGNFTVGSHVSLALELRNCENDGFAMSDDAIQKRRKQTLSSSPETDLLDYHFTDSGKQQHRQFL

SEQ ID NO: 205853 - protein, 442 aa, Glycine max
  Coding DNA Sequence Number=SeqID_89075
  Gene Ontology: Mol. function=metal ion binding
  Homolog annotation: Hit_ID=Q5NAS8; Match level="QueryCoverage=98%, HitCoverage=100%, E-value=3e-67, Identity=41%"; Hit description =C3H2C3 RING-finger protein-like
  Pfam annotation: Domain name=zf-C3HC4; Domain location=281-339; Score= 7.1; E_value=0.029; Accession=PF00097.15; Description=Zinc finger, C3HC4 type (RING finger)
  Subcellular localization annotation: CTP_CleavageSite=10; ConfidenceScore=5.06e-01
MSAVIMGSACCVAAKDHTIPSTSRTGGESLNRNAVCSPSWSFRWDSWGRVAGEIEDPSFHTSRRVSRNVSMELKGSLSSERGNLSDWGSTLDNSVTPLSLKSPVREHLVTSQMTPSSDLSMSSNCSAVVKNLIESPEIAESSIPNRSVPSVFSIPTTDPMTNHNYHNLPNSTPSRWAHCSPGHPLLTQISDSRILGLKSPDNSISEGRPSFVLSNCSNDMATGSQCGSSDGWSMRTFSEMVAPSQKERWSFDSEYSGSGRHKISGTSSRFSYSPSMDLQSCGACSKLLTERSAWGSQKFIASSDLSVVAVLVCGHVYHAECLETITPEADSYDPACPICMVGEKHMSKLSKKGFRTESETKAKNYKISRNRVVDSYVDGGIDVFDRLKDIVSKMEPSSSSTTSSFGKPFLRRHFSLGSKWSRSLLENDSARKKGFWARYRKD

SEQ ID NO: 205854 - protein, 190 aa, Glycine max
  Coding DNA Sequence Number=SeqID_89076
  Gene Ontology: Biological process=biosynthetic process
  Subcellular localization annotation: CTP_CleavageSite=32; ConfidenceScore=5.40e-01
MAKHSVAMAKKRWLIMLAAFLSVSTVTVLLMRSNNSDSCNTNHFTIAQDNNQIRSPVQLTNAASSPLNFMKSKLVLMVSHELSLSGALLHAKSNLSFSFFQFDDMKTYGLDSHSLAGGPLLLMELAFLLRGVGSDVVWITNQKPSEHDQVIYSLESKMLDRGVQFSNIDFDSFLLKGMGGGVLLAAETKA

SEQ ID NO: 205855 - protein, 420 aa, Glycine max
  Coding DNA Sequence Number=SeqID_89077
  Gene Ontology: Mol. function=nucleoside-triphosphatase activity; Cellular component=protein complex; Biological process=protein catabolic process
  Homolog annotation: Hit_ID=Q9SEI3; Match level="QueryCoverage=99%, HitCoverage=100%, E-value=0.0, Identity=88%"; Hit description=26S proteasome AAA-ATPase subunit RPT4a
  Pfam annotation: Domain name=AAA; Domain location=174-383; Score =297.6; E_value=2.4e-86; Accession=PF00004.19; Description=ATPase family associated with various cellular activities (AAA)
  Pfam annotation: Domain name=AAA_2; Domain location=170-324; Score= -38.2; E_value=0.0073; Accession=PF07724.4; Description=ATPase family associated with various
  Pfam annotation: Domain name=AAA_5; Domain location=174-294; Score= -4.5; E_value=0.0039; Accession=PF07728.4; Description=ATPase family associated with various
  Pfam annotation: Domain name=Sigma54_activat; Domain location=140 -270; Score=-179.7; E_value=0.015; Accession=PF00158.16; Description =Sigma-54 interaction domain
  Pfam module annotation: Pfam domain module=AAA::AAA_2::AAA_5::Sigma54_ activat; Domain location=174-383::170-324::174-294::140-270
MAEAEDAVRRRNAVAEYRKKLLQHKELESRVRSVRENLRASKKEFNKTEDDLKSLQSVGQIIGEVLRPLDNERLIVKASSGPRYVVGCRSKVDKEKLTSGTRVVLDMTTLTIMRALPREVDPVVYNMLHEDPGNISYSAVGGLSDQIRELRESIELPLMNPELFLRVGIKPPKGVLLYGPPGTGKTLLARAIASNIDANFLKVVSSAIIDKYIGESARLIREMFGYARDHQPCIIFMDEIDAIGGRRFSEGTSADREIQRTLMELLNQLDGFDQLGKQIPRLRNFCLFIFVEVVGGRSVVKMIMATNRPDVLDPALLRPGRLDRKIEIPLPNEQSRMEILKIHAAGIAKHGEIDYEAVVKLAEGFNGADLRNVCTEAGMAAIRAERDYVIHEDFMKAVRKLNEAKKLESSAHYSADFGKD

SEQ ID NO: 205856 - protein, 440 aa, Glycine max
  Coding DNA Sequence Number=SeqID_89078
  Gene Ontology: Mol. function=sequence-specific DNA binding; Cellular component=nucleus; Biological process=regulation of transcription, DNA-dependent
  Homolog annotation: Hit_ID=Q7Y0Z8; Match level="QueryCoverage=89%, HitCoverage=91%, E-value=1e-110, Identity=54%"; Hit description=Bell- like homeodomain protein 1
  Pfam annotation: Domain name=Homeobox; Domain location=345-403; Score= 6.0; E_value=0.0012; Accession=PF00046.19; Description=Homeobox domain
  Pfam annotation: Domain name=POX; Domain location=160-294; Score =193.2; E_value=6.2e-55; Accession=PF07526.2; Description=Associated with HOX
  Pfam module annotation: Pfam domain module=Homeobox::POX; Domain location=345-403::160-294
MSNSITYHQNQFENQELDAYGSSMRLNNAFPEALGAFPTSIGVVAEGSEISHTRHLMDLLGAANESNHHQTAQGLSLSLGSHMLVPSDEYRHPHQRPLNPGLINPNYFMSGQEAREPCNNPPVEQHNITSDYFYNTGSGTFASSSPLNNRSPNSTSSYAAVIGNSRYLKPVQSLLEDLVDVGGNVVDRINEKYAEKLFRGSRGSARTLSSELKAELGNNGHLLADKHEHQIKIARLITLLDEVEGRCEKYYHQMEEVVSSFEMIAGLGAAKCYTALALQAMSRHFCSLRDAILSQINAEKRKLFQDLPKISSGLSQLSLFDRDSRQSRMSLQQLGVIRSQRQVWRPIRGLPETSVAILRSWLFEHFLHPYPNDSEKLMLASQTGLTKNQVSNWFINARVRLWKPMIEEMYKEEFGEFSEDSNPAGNNYLTREDTTDCVED

SEQ ID NO: 205857 - protein, 153 aa, Glycine max
  Coding DNA Sequence Number=SeqID_89079
  Pfam annotation: Domain name=zf-CCHC; Domain location=81-98; Score =31.1; E_value=3.8e-06; Accession=PF00098.13; Description=Zinc knuckle
QEHEMELQRLNQNEEINKKKRSIALKASSSMHSENEEEESEDEEDFSLFVQKFQKFVKKRRIEKRQNFNNGRRSQEDYQILRCYKCNQLGHIKANCPSNEEWPEKSDRKRYEERRTKKSYIAWDDNDSSNGLEKEINLLTKDYESNENISLED

SEQ ID NO: 205858 - protein, 332 aa, Glycine max
  Coding DNA Sequence Number=SeqID_89080
  Homolog annotation: Hit_ID=Q9XGX0; Match level="QueryCoverage=90%, HitCoverage=98%, E-value=2e-46, Identity=38%"; Hit description =Putative zinc finger protein SHI
  Pfam annotation: Domain name=DUF702; Domain location=94-246; Score =303.4; E_value=4.3e-88; Accession=PF05142.3; Description=Domain of unknown function (DUF702)
MAGFFSLGGTQNKEEEEVEKGDKNNLLLLRNEEIYNNKGGFEIWPQSSSSYHLSNYFAFGVGPSRRNRSEDVSLCVSEDESTRFGLSVMRTGGSSSSSMSMNCQDCGNQAKKDCAHLRCRTCCKSRGFQCQTHVKSTWVPAAKRRERHQQLAELQLQQQFRGVGDNIPKRHHPDTTTSTQLASAPQPVTGLELGQFPAEVSTSALFRCVRVSAVDASDEQYAYQTSVNIGGHVFKGFLYDQGPESSYTGAAAEGSSGGEPQQLGFITAAATTATTSGNSPFDPSLYPAPLNAFMAVFFFFWVNVEGAFWLVLNSKPLFPVYPFACQIEIERK

SEQ ID NO: 205859 - protein, 97 aa, Glycine max
  Coding DNA Sequence Number=SeqID_89081
MIELFGPKPKDPTRVAFVTALRAETEKERRMDEENGYSGSSSSNLETTKAERSVWLMKCPLVVAKSWQAHPPSQPLAKVVLSLDPLHPEEDDPSAVQ

SEQ ID NO: 205860 - protein, 501 aa, Glycine max
  Coding DNA Sequence Number=SeqID_89082
  Gene Ontology: Mol. function=hydrolase activity; Cellular component =membrane; Biological process=proton transport
  Homolog annotation: Hit_ID=Q1S045; Match level="QueryCoverage=99%, HitCoverage=91%, E-value=1e-63, Identity=41%"; Hit description=V -type ATPase, 116 kDa subunit
  Pfam annotation: Domain name=V_ATPase_I; Domain location=1-493; Score= -101.4; E_value=3.3e-10; Accession=PF01496.9; Description=V-type ATPase 116kDa subunit family
MARRLRLFKEQMTKAGVSPSMWSTRDDHFDLEHLEVKLEELEAELLEINANNEKLQHTYNELLEYKLVLEKVGELFSSAKNKAVAHQKELEFQTTVEGSIDSPLLLEQEETTTKQIKLGFIGGLVHREKSIPFERIIFRAARGNLFLKQGVIEHPVLDPLSGEMRATMDCSSQVVAIFQVLETTESPPTYFCTNKFTSSFQEIVDAYGDASTTGFIKVRSTYPFGVDPKCHGTRSELPFLNSLKMKMSILLGADLYHLMIYTFLSPTDDLGENQLFVGQKLLQLVLLLLAVVAVPWMLLPKPFLLKKQHQERHQGQSYDLLCGTDDTLESESQSIAHDHDEFDFSEEYNLGFLINLQLVDGKNLGHARCSQQHCWCTQQLEKPSSGEVTGRSSSEPSSGNFSEEGSSGKRFFRLAHSELSSVFYDKVLLLAWGYNNTIVLIIGIFVFICATVGVLLLMESPSAFLHALRLHWVEYQNKFYEGDGYKFFPFSFTLLTDEDEL

SEQ ID NO: 205861 - protein, 58 aa, Glycine max
  Coding DNA Sequence Number=SeqID_89083
MRIEKESHIFELNGAEIAKKKTQKKKSFTIILPNHIFAATSNPRFKMLFFRPKARAHE

SEQ ID NO: 205862 - protein, 60 aa, Glycine max
  Coding DNA Sequence Number=SeqID_89084
MDRGTYESGTVIGETHRLGTEVRIKISSRMGMGIIFSIPVSSAILIGRTTYETSYIVLKN

SEQ ID NO: 205863 - protein, 176 aa, Glycine max
  Coding DNA Sequence Number=SeqID_89085
  Gene Ontology: Cellular component=spliceosome; Biological process =mRNA processing
  Homolog annotation: Hit_ID=Q6K5F4; Match level="QueryCoverage=62%, HitCoverage=36%, E-value=3e-27, Identity=56%"; Hit description=2 coiled coil domains of eukaryotic origin (31.3 kD)-like protein
MGTPLSKLWGVYKELLDVKELFDNPKVAVSRATAVWVRDVDDVSVEVRHLCRVLRVIRLAELHDVVFPVGFFIDELVDLVVEIAEVVLAKTLVLDLSNFSADLLRSCYEPSSDKETLTTRCSGIAPPCAAAGWVVGVCVGIFLLDVVIDGGNTGWTAVVVVSNGGREEGDDVVITC

SEQ ID NO: 205864 - protein, 71 aa, Glycine max
  Coding DNA Sequence Number=SeqID_89086
MTKLGLCLPSGPPRLDDKGVRITIRMTKLGLCLPSGPPPLNDKGVRITVRGADNRKNDQTWSLRAIGHDRV

SEQ ID NO: 205865 - protein, 430 aa, Glycine max
  Coding DNA Sequence Number=SeqID_89087
  Gene Ontology: Mol. function=molecular_function; Cellular component =membrane; Biological process=auxin mediated signaling pathway
  Homolog annotation: Hit_ID=Q94AP3; Match level="QueryCoverage=93%, HitCoverage=92%, E-value=1e-109, Identity=55%"; Hit description =Putative nodulin protein
  Pfam annotation: Domain name=DUF6; Domain location=255-384; Score =60.5; E_value=5.4e-15; Accession=PF00892.11; Description=Integral membrane protein DUF6
  Pfam annotation: Domain name=TPT; Domain location=246-384; Score= -33.2; E_value=0.049; Accession=PF03151.7; Description=Triose -phosphate Transporter family
  Pfam module annotation: Pfam domain module=DUF6::TPT; Domain location= 255-384::246-384
MADSGSASSSRMWCSIPERVQLHAAMLALQFGYAGFHVVSRAALNMGISKLVFPVYRNIIAFLLLLPFAYFLEKKERPAITLNFLLQFFLLALVGKKKKGRSKAAETIDWMDYSEPRFLLAWLGQHIPNLCISDSELCPSHYISHGSHTQASPYKLIVVIHLLHQQEACTTLNRIWIEQVRLNRKDGIAKVAGTIFCVAGATVITLYKGPTIYSPSPPLQSESSVVVEFGTLSSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASLALGEEFYLGGIIGAVLIVVGLYFVLWGKSEERKFAKEHAAITSTPEHSGIRSSSHAKTLLTQPLLPSSTENV

SEQ ID NO: 205866 - protein, 76 aa, Glycine max
  Coding DNA Sequence Number=SeqID_89088
MVAIMMVVMVLTTVGWNNGGDGDGSSGEMWLSQRALLRASEGEAHGCAFQRRKDARSRHQRLFVENVGKTEGNRSK

SEQ ID NO: 205867 - protein, 195 aa, Glycine max
  Coding DNA Sequence Number=SeqID_89089
  Homolog annotation: Hit_ID=O04892; Match level="QueryCoverage=48%, HitCoverage=17%, E-value=2e-27, Identity=79%"; Hit description =Cytochrome P450 like_TBP
MESRAPSGPFLRSVRVLRKGIGLKIPEPGRGGLTANVRESRRPSAGAPGKSYLFCFNSLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 205868 - protein, 277 aa, Glycine max
  Coding DNA Sequence Number=SeqID_89090
  Gene Ontology: Mol. function=oxidoreductase activity; Cellular component=cytoplasm; Biological process=cell redox homeostasis
  Homolog annotation: Hit_ID=Q5PCC9; Match level="QueryCoverage=98%, HitCoverage=61%, E-value=2e-78, Identity=55%"; Hit description =Probable pyridine nucleotide-disulfide oxidoreductase
  Pfam annotation: Domain name=3HCDH_N; Domain location=162-274; Score=- 98.9; E_value=0.0047; Accession=PF02737.8; Description=3-hydroxyacyl -CoA dehydrogenase, NAD binding domain
  Pfam annotation: Domain name=Pyr_redox; Domain location=164-255; Score=106.4; E_value=8.6e-29; Accession=PF00070.17; Description =Pyridine nucleotide-disulphide oxidor
  Pfam annotation: Domain name=Pyr_redox_2; Domain location=9-277; Score=87.2; E_value=5.2e-23; Accession=PF07992.4; Description =Pyridine nucleotide-disulphide oxidor
  Pfam annotation: Domain name=Thi4; Domain location=1-156; Score= -141.3; E_value=0.1; Accession=PF01946.7; Description=Thi4 family
  Pfam module annotation: Pfam domain module=3HCDH_N::Pyr_redox::Pyr _redox_2::Thi4; Domain location=162-274::164-255::9-277::1-156
MENIMNHYQAAIIGFGKAGKTLAAALGRAGWRVAIIEKSRVMYGGTCINVGCIPTKALVHDVQHHASFSDAMQRKAAVVELLREKNYLNLAAIAQIDIIDGEAEFVDAHTLKITSSQQVSQIHAERIFINSGAEAVFPALEGLVAGPRVVDSSGILNLTQLPQRLGILGGGYIGVEFASMFAGFGSEVTLFESAPQFLAREDDDISAAIARILQEQGVKLELNTALQRVTSGRDSVTLHTAQGDREVDVLLVATGRRPATKALKLENAGVVTDARGA

SEQ ID NO: 205869 - protein, 85 aa, Glycine max
  Coding DNA Sequence Number=SeqID_89091
STCTSSKGIRPPTDRAIIKKYCVPRQARGETPQQHWDGRQRETDAPPSPLEFTSAHPRKGLSIAYTTWPTHRRPSPKPKDAPSCS

SEQ ID NO: 205870 - protein, 926 aa, Glycine max
  Coding DNA Sequence Number=SeqID_89092
  Homolog annotation: Hit_ID=Q2XIW0; Match level="QueryCoverage=44%, HitCoverage=80%, E-value=1e-139, Identity=62%"; Hit description =Transporter, putative
  Pfam annotation: Domain name=HlyD; Domain location=534-817; Score =93.7; E_value=5.4e-25; Accession=PF00529.10; Description=HlyD family secretion protein
  Pfam annotation: Domain name=MFS_1; Domain location=37-334; Score= -0.6; E_value=0.00034; Accession=PF07690.6; Description=Major Facilitator Superfamily
  Pfam module annotation: Pfam domain module=HlyD::MFS_1; Domain location=534-817::37-334
MAAARKADAAGIALDTAACAIETHRVWSDRPADLHTGALSNALVTANLTNLQGTFAAYSNEIAWLPAVYVMGNISINLLLVKFRQQFGLRLFTEAFLVLYVIVAFFHILANDLSSAIIVRTAHGMVGAALSSLGIYYQIQAWPAKHRLKALVIGITASQLAIPLARLFSSELLQLEEWRGLYLFELGLAMIALGCVLVVKLPPGDRIKAFEKLDFVTFMLLAPGMALLCGVLSLGRIEWWFSTPWLGVCLALALVLIVAAVVLEHNRANPLINTRWLSNGMIVRLGIVMIMMRIVLAEQNTGARADHQTQPSELANRGLAGRNDCRLADGCAIQPGNARQQSLLQPVSARFQQCFFPWASDAAWHRRRGDSAEKSGEFCRAVWHEPESWRADWLRHSRHLPDVARKISLQPAGRSAVAARSQCGGSPQPVQRAVSQPAGGQRPAQRAEQQSAANRGHAAGQPAGCASKPNGDPMSQQDDLQAAERERTNRRRILSIAAGSGIAIVGVLVILYAWQLWPFTSTIQSTENAYVRGQVTFISPQVSGYLTNVEVVDLQPVRKGQLLMTIDDRIYRQRVHQAQAQLAMKIAAQNNNQQQQKSAEATIVSNKAALENAKAQALKSSLDLKRVENLAADGSLSVRERDAARAANAQAQAQLRQAAAQVAVSQQNLQTTIVNRAALAGDVASAQAALELANIDLDNTRIIAPDSGQLGQLSVRKGTYVTAGTRLTSVVPDNKWVIANLKETQLARVRPGLPVSIRVDALDGKRFDGRVEFISPAAGSEFSAISPDNATAAAARHVGGGQHRYRRRTPPGDTMMRPLSVALLALLLTGCAREVERAPSSLPIPPGWRQQVGPAAAPEAQWWRSFGDDRLNWLVNQALQHNSDILIARSRVDQYRAELRAAQGDNFPTLSAGVAATHQRALSAAT

SEQ ID NO: 205871 - protein, 185 aa, Glycine max
  Coding DNA Sequence Number=SeqID_89093
  Homolog annotation: Hit_ID=Q6CYK4; Match level="QueryCoverage=43%, HitCoverage=97%, E-value=1e-26, Identity=70%"; Hit description =Putative acyl carrier protein
MARRSAPARSAAATACAWRLSGLVAHQLVDGVNHVLYGAHRAEGFWLDLTPGAFLQMHHHVNRINTVEFEIFIQASVRADLVRINFEQRSQQRRHFLVNILFIHVDAASVATEKKCARSVSLSAESCTPKRFFTASPSSSASIESSPSPSPNSGASLSISSGLISSRFSVSIIMGFNVVNQCLHN

SEQ ID NO: 205872 - protein, 94 aa, Glycine max
  Coding DNA Sequence Number=SeqID_89094
MAGADSPAVARRAGAAGAGVCGAHLEPASGAGRAEPHAAAAGADRLPAVSRQYRVAGAASAAVVSGGGEWPVASAVRRVAVQPDAAGRAPGAPA

SEQ ID NO: 205873 - protein, 68 aa, Glycine max
  Coding DNA Sequence Number=SeqID_89095
DSTSDSPQISASPYQLDFTLYASGSYNAQWNAPGLLHDKHTLRSSRILRKMEVEVVFVIGSAVDRLCG

SEQ ID NO: 205874 - protein, 212 aa, Glycine max
  Coding DNA Sequence Number=SeqID_89096
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=23%, E-value=1e-111, Identity=82%"; Hit description=DNA -directed RNA polymerase beta chain
  Pfam annotation: Domain name=RNA_pol_Rpb2_6; Domain location=1-212; Score=183.0; E_value=7.1e-52; Accession=PF00562.18; Description=RNA polymerase Rpb2, domain 6
MHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLPDGRPVDMVFNPLGVPSRMNVGQIFECSLGLAG

SEQ ID NO: 205875 - protein, 154 aa, Glycine max
  Coding DNA Sequence Number=SeqID_89097
MRRSSVGELVPLDLEIEATFRRNNAERKRKLLHNITVASILEEAHFYESSSSNSPTSKESQTTEFEAEVMAEEQPRRVTLEDYSSTSVPQYFSSATWPKSKQLLDTSAGGKIKLKTPEEAMVNLYLLDTKLQVAHFVVELMGQACVFPLKKHLM

SEQ ID NO: 205876 - protein, 75 aa, Glycine max
  Coding DNA Sequence Number=SeqID_89098
  Subcellular localization annotation: CTP_CleavageSite=66; ConfidenceScore=5.09e-01
MAMDLNFSSTTRALSSSAFRAYSQPLMIAADDPITASPKLSVLSSRRIPCLANSLEYPRVVVTKTSCDERRDAFV

SEQ ID NO: 205877 - protein, 83 aa, Glycine max
  Coding DNA Sequence Number=SeqID_89099
MEIRSHWEGWRCENNITWPKSSLKLLCHHGPHVSKANTNGNDADVAPGFSPLKTVQFGNPSQDTVEPRDGGFGGRLWRWKWEK

SEQ ID NO: 205878 - protein, 79 aa, Glycine max
  Coding DNA Sequence Number=SeqID_89100
  Homolog annotation: Hit_ID=Q5W7C9; Match level="QueryCoverage=68%, HitCoverage=20%, E-value=7e-19, Identity=78%"; Hit description =Unknow protein
MEENSESAWSTNKEAISNATRNLMESSILAQDERWRHALHMQVGREVVFPVADGWKRLLIPRRLRSKRRNPPEEGLASD

SEQ ID NO: 205879 - protein, 44 aa, Glycine max
  Coding DNA Sequence Number=SeqID_89101
MCQILKKRAKGSILGHFSALESPRQLHDEVTSSPGHGKAEVKGP

SEQ ID NO: 205880 - protein, 48 aa, Glycine max
  Coding DNA Sequence Number=SeqID_89102
TDHLIQATKIWMTPLPVKEDKYGDAPHPVKGENSGETPLFDIRCCFEA

SEQ ID NO: 205881 - protein, 252 aa, Glycine max
  Coding DNA Sequence Number=SeqID_89103
  Homolog annotation: Hit_ID=Q47522; Match level="QueryCoverage=20%, HitCoverage=70%, E-value=4e-14, Identity=70%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRSRNGYSSCSIVERCDIPLIDLSRLSLEREECMREIAEAAREWVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 205882 - protein, 40 aa, Glycine max
  Coding DNA Sequence Number=SeqID_89104
VVDYVSKWVEAVATPHNDAKTVVKVFEEEHFLKIWGALEF

SEQ ID NO: 205883 - protein, 73 aa, Glycine max
  Coding DNA Sequence Number=SeqID_89105
MNLIIVMKRKERALRHPYQTRARARVMGEVEEVQEQIKADMEAMKEKMATMMEAIMRMKEIMEVNAVALLRWT

SEQ ID NO: 205884 - protein, 57 aa, Glycine max
  Coding DNA Sequence Number=SeqID_89106
MHEYGAQCPMCAVKKVIWTFRLPVTKDETNIQHMRDDMMQMRNSATGGCTQHGNILK

SEQ ID NO: 205885 - protein, 208 aa, Glycine max
  Coding DNA Sequence Number=SeqID_89107
MMEAMLSMRKMMEVNTVTVIAVSIATKVDPTHLYGLNQVNCPASDMVGQGSEALRSVGGPHFVQEQVPQPMGETHEVTRDHTLANSEPCLGYATEGQAFGGPSVSPTTITLTFCGGKTASCHGDGNYAFADMKELCLVPNVVIPPKFKVSDFDKYKGTTCPKNHLKMYCKKMGAYAKDETLLMHFFQESLTGAAITWYTNLESSRVRS

SEQ ID NO: 205886 - protein, 76 aa, Glycine max
  Coding DNA Sequence Number=SeqID_89108
  Gene Ontology: Mol. function=DNA binding; Biological process=DNA integration
  Homolog annotation: Hit_ID=Q1SKC8; Match level="QueryCoverage=94%, HitCoverage=25%, E-value=1e-08, Identity=33%"; Hit description =Integrase, catalytic region
MRLTAYESSKLYKERLKWKWFGPFTIKKVRPYGAVELCDPQSKDLDRTWVVSGQRLKQYHGRAIEKLNTVLCFEPG

SEQ ID NO: 205887 - protein, 89 aa, Glycine max
  Coding DNA Sequence Number=SeqID_89109
MGPLSARRDNILAGGLAACWASTNMDLASNNFMLPLKASGEGLHRHRKHGAWGSGPRARVEGWWFLLLVCGECVDRHVWEMCTCCDSNP

SEQ ID NO: 205888 - protein, 75 aa, Glycine max
  Coding DNA Sequence Number=SeqID_89110
  Subcellular localization annotation: CTP_CleavageSite=60; ConfidenceScore=5.55e-01
MVRTRIPLTARVCKPLKARTCSPLKVRTCTPLNGRTCSPLMARTCNPLEVRACSPLKTRMCSPLKGRTRSPLKAR

SEQ ID NO: 205889 - protein, 173 aa, Glycine max
  Coding DNA Sequence Number=SeqID_89111
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=1e-18, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSYPFRGLHVLAFRGLNVLLFRGLHVLAIIGFHVLSFRGLHVLPIIGLHVLAFKGLHVLAIRGLHVLAFIGLHVLAFRGLHLLPLKGLLILTFRGLHDLTFRGLYILAFRVLHVLPFKGLHAVAIRGLHVLAFRGLHSLTFRRLHVLSFRGLHVLAFEGLHVLAFRGLHVLSF

SEQ ID NO: 205890 - protein, 46 aa, Glycine max
  Coding DNA Sequence Number=SeqID_89112
SIASAANVYAQVNSILMLNVTNFKVCKEAIEIVLGCMDLDLALRTE

SEQ ID NO: 205891 - protein, 80 aa, Glycine max
  Coding DNA Sequence Number=SeqID_89113
  Gene Ontology: Mol. function=hydrolase activity; Biological process =aromatic compound metabolic process
  Homolog annotation: Hit_ID=Q1XRR4; Match level="QueryCoverage=97%, HitCoverage=25%, E-value=2e-21, Identity=63%"; Hit description =Alpha/beta hydrolase fold precursor
MEQALIALRDEDLRGDLPKIKIPTLIMQAKQDRIVAYALAEQMNKAIKGSKLIPFENSGHALFLEEKDKFNEELLKFLKQ

SEQ ID NO: 205892 - protein, 120 aa, Glycine max
  Coding DNA Sequence Number=SeqID_89114
  Gene Ontology: Mol. function=hydrolase activity; Cellular component =membrane fraction; Biological process=metabolic process
  Homolog annotation: Hit_ID=Q1XPH8; Match level="QueryCoverage=100%, HitCoverage=52%, E-value=4e-44, Identity=72%"; Hit description =Isochorismatase hydrolase precursor
MAFATKSISMNELRNNVAVLCGASKIFNVPTIVTTVAEQSFSGPVFPEIEEAYPMATSGYIDRTTMNTWEDEAAYKAITGTKKQKLVLAGLWTGVCIVGPALSALEEGYDVYVITDACGD

SEQ ID NO: 205893 - protein, 88 aa, Glycine max
  Coding DNA Sequence Number=SeqID_89115
MEEFHHSLMTEFIKLCDCRVNDETHSPSFSAKSVSEYKMATKKWTRTADIHHRLNHRLSGLDNNSPPPPEHSPTHNCALQRATLLQSF

SEQ ID NO: 205894 - protein, 49 aa, Glycine max
  Coding DNA Sequence Number=SeqID_89116
  Gene Ontology: Mol. function=structural constituent of ribosome; Cellular component=mitochondrion; Biological process=translation
  Homolog annotation: Hit_ID=Q9FKZ4; Match level="QueryCoverage=88%, HitCoverage=17%, E-value=3e-15, Identity=84%"; Hit description =Arabidopsis thaliana genomic DNA, chromosome 5, P1 clone:MUD21
MKKIIHRDEESGKILNLVFVWAEDGMKLKVDVPVVFKGEDACPGVQKGI

SEQ ID NO: 205895 - protein, 115 aa, Glycine max
  Coding DNA Sequence Number=SeqID_89117
MASITWQAKLKESELEVEREKEANKELEDELLMQAGLFVEGLNLNLLDPFKDMKDGQLLDNDDIAAMEAFDGEKGDGADHIFILDLYNVWTWPCRGTMSVVLCVEYQTTMLDRSV

SEQ ID NO: 205896 - protein, 56 aa, Glycine max
  Coding DNA Sequence Number=SeqID_89118
MALYKKLPHFGSKVDEQGLHVYFSAVSLATSFVALGQAKECMLGVQFMDATTDKTC

SEQ ID NO: 205897 - protein, 470 aa, Glycine max
  Coding DNA Sequence Number=SeqID_89119
  Gene Ontology: Mol. function=RNA-directed DNA polymerase activity; Biological process=RNA-dependent DNA replication
  Pfam annotation: Domain name=RnaseH; Domain location=315-431; Score= -28.1; E_value=0.024; Accession=PF00075.14; Description=RNase H
MVVSIVIANFMVSKVLFDQGMQTRGYVDLMTTFGQGKFSWSFTVRYLIVYANTSYFSLIGRKTLNELGAIVSTSHLKMKFPTLTEEIVIIKVDYKQARQCYVENLKVALYPPIRELRKPHSPFGGSSSQVMSIIEEFPIRTLVIYEITKGNPGDTFDVDPRDDHLEEVFGEIHKYDMCLNPEKCTFGVGSGKFSRFMITHRGIEANPDKCMMILKIHILTNVKEVQKLNGLEQDFLAFKKTIATPPYQKKPLAQPSSKKMASTRYLSTLLVVSFMMLRRGHQIIVKIDHPIKQVLRKLELADILAEFAGHVQATPDWWNLYVDGTSNVKGSRVGIILEGPNNITLEQALQFEFKGSNNQVEYEALIVDLKLAKEVGAMKLMCCNDSQLVQRGRSLATKVVHSGYYWPTLKADVFNFTRKDGHTGAIAKSSRTSQVLAGCRRLFYRMDQSKTIARDFSQRGRKVYLETPHM

SEQ ID NO: 205898 - protein, 137 aa, Glycine max
  Coding DNA Sequence Number=SeqID_89120
MKLAMTIERTIGSSWLMGLMPLKSLSMKVRLPVHVEVSAHIFVTPRSPPILCSFSPSILFLLSYPTMALIVPSGSFSGLGSTIFGVVTMVAEVPIMLSSIQTMSERNGERKRERRHHFKEKMSLEEAHHHRRPWIRA

SEQ ID NO: 205899 - protein, 93 aa, Glycine max
  Coding DNA Sequence Number=SeqID_89121
  Subcellular localization annotation: CTP_CleavageSite=12; ConfidenceScore=5.34e-01
MSSSHPPFVSVCVTRVFVVYGTAGLLGLPLSLGMLINRVSESCRSGSLSVTVAVGVGRSDVRVDSGDLHGGEFVGILHLMNGKKVPTKGTLML

SEQ ID NO: 205900 - protein, 204 aa, Glycine max
  Coding DNA Sequence Number=SeqID_89122
  Gene Ontology: Mol. function=RNA-directed DNA polymerase activity; Cellular component=intracellular; Biological process=RNA-dependent DNA replication
MEEVFEEIHKYDMCLNPEKFTFRVGGRKYLGFMITHQGIEVNLDKCVAILEMQSPTNIREVQKLNGRLMSLSRFLPKLVEKIKLFYKLLGKTEPFSWDEACEQAFLSFKKLIAAPPILTRPKIGAPLLIYLLMAEEVISSALVQEDGKHQTRIYFVSQIFHDVEKRYQMIKKVALALITSARRLRPYFRATGSSSRRTTLSSKC

SEQ ID NO: 205901 - protein, 792 aa, Glycine max
  Coding DNA Sequence Number=SeqID_89123
  Gene Ontology: Mol. function=RNA-directed DNA polymerase activity; Cellular component=mitochondrion; Biological process=RNA-dependent DNA replication
  Pfam annotation: Domain name=rve; Domain location=534-652; Score= -14.0; E_value=0.088; Accession=PF00665.16; Description=Integrase core domain
MDAHDDTIDKGPKPIEELIKLQLGPKPEQCMQLSRDLTNKKYRHIAEVLQRNMDLFAWQPSNMPSIHPNIICHKLVISPQAKPVSQKKRKMVEELRKMIREEIDKLLKGQFIRKVKYSTWLANVVMVKKANRKWRMCTNYTNLNKACPKDAYSLPSINKLVDGGFDFQLLSFLGAYSGVMPFGLKNAGAMYLRLMNREVFEEIHKYDMRLIPKKCTFAVGDKKLLGFMITHHGIKPNPNKCTTILENAQSYQCQRSSKTDGRLASLFGFLLKLLEKARPFYRLLKKTKPFLWDEDSKEAISSTLVQEDGKHQILIYFVSRVLYDAKKRYQMIEKTLKFDFRASNNQEKYEALIAGLKLAKEFGARILRCYNNSQLVQGHVANIYQAKEAVLLRYYHVVKTPVSTKKTGHLKNIIQETLQAPIVDTKEVMMGKEVEPNCMTPYKNFLIQVVLPPNKNKARRLKRKPSYYVILNGELFKRGLTTPLLKCLNNQQADYVMRVLHEGICFLHTGGCSQATKKFANVPCTPPDNLHNLSSPWPFAMWGMDILGPLPKSPRQVKFLLVAIDYFTKWIKARPLGEISASEASCKHLMTSIEHPQTNDQVEVVNKVIFKALYMRLDKSKGLWKKELPSIHCVNHLNTRDGLSLCGSDFVKDFTKILEISSGLLEYWTPQGLTLWAHHCSSQMDAMIPIEVGEPSTRKLFFQAHQNEENIRVELEMARIKKEATKLQALTRYNTKDLSGKAYLGSRMNMSLVESPKAHQTQGLPLVSLAKPKTNALVVESPKARQPKVCPW

SEQ ID NO: 205902 - protein, 104 aa, Glycine max
  Coding DNA Sequence Number=SeqID_89124
MPALLVSLSYGPSTLLAQQQVIEPESAYQSITSYQQSCYATITTPTIKDPRLPSNVINNQSPFFKYPPFVLPIEDTCESNARNRRAIPMTVHLDVSPLQISGIN

SEQ ID NO: 205903 - protein, 192 aa, Glycine max
  Coding DNA Sequence Number=SeqID_89125
  Subcellular localization annotation: CTP_CleavageSite=53; ConfidenceScore=5.10e-01
MPIDFVSPFDKTLIQSVGVQNSSNVVKVFLHRSLTTLEENRQRHKEALTRITSLEYKVAKLRATARTIWVDDVFAKLVSIRLDGDEVFECCIDLLKEKNDLMSKVECFAEEKEELNATMAEPTKALNFKKKVVQHHEKGFFKANKQVRFFIEGLDLSFFDPFKDVKDGQLLNEDEIAAWEEDDGEKDDGANV

SEQ ID NO: 205904 - protein, 180 aa, Glycine max
  Coding DNA Sequence Number=SeqID_89126
MVKAFEILRPFFNIRPNIPVFPYFFQMKLTGKIGWVSLNNESKKMFEFDSNVFRKFRDRFLKVKATSIITDRGSPHGINANFTSISATFVSLSLDHALNEYHLLSETSARLASKRNLEGNLPRKHEVSASSARPTSHLSLWALNGPGLLSQRSLTRAKRAFEDRMPFLKPGVKEKRELGR

SEQ ID NO: 205905 - protein, 133 aa, Glycine max
  Coding DNA Sequence Number=SeqID_89127
  Homolog annotation: Hit_ID=Q15KJ0; Match level="QueryCoverage=82%, HitCoverage=50%, E-value=4e-10, Identity=31%"; Hit description =Truncated PHYLLO protein
ESLVLYPLALEEALEKLKEALQILNSPSPSSPAGFLRFQVALPPSPKTFTLFCSQPHSSSVFPLIYVSKNDADSKSLYVNLDDNVSHQKESRSQIELDELESVSILSMTLAWDEFSFSTFQEAHYSLQDSLDQ

SEQ ID NO: 205906 - protein, 135 aa, Glycine max
  Coding DNA Sequence Number=SeqID_89128
MHINLPRFNRNSVIEEQQRPLEEEKGKFQEHKENQLRVQRLIHTQEEEKEQQQSLQKSNTKGEDGWKGKRINVEVGYNKWLEDYWVGILSNWKMFDKVKYIYIMDGLEEVKMRYLAGDLIFISSRKGTRINRNRR

SEQ ID NO: 205907 - protein, 173 aa, Glycine max
  Coding DNA Sequence Number=SeqID_89129
MDPEVLNEKSRFDVFWRNGPGMSTVSKGSHKSRPLNNNVLMKGDCETLNEGNQNECTEKDKFLDFNANVGCKGPILFVRSNKSFRKSTIKETSQQSNNITRNKSKTLLEEGGSLSNSIQDDHIRTCNKNFWLQNDEEDMGKMLKMGLSMEVSIGANGEDMIQRITKMEKRDVE

SEQ ID NO: 205908 - protein, 95 aa, Glycine max
  Coding DNA Sequence Number=SeqID_89130
MGAWDKLGNFVSKIVSHSEEKEKAICKMGFWKEDNWVWDVRWRREAFKWEKVCKHTTDTWFWKFCSIEEYSTNSAYGILSQDGGLDSSNEIFSLV

SEQ ID NO: 205909 - protein, 121 aa, Glycine max
  Coding DNA Sequence Number=SeqID_89131
  Homolog annotation: Hit_ID=Q1SWP7; Match level="QueryCoverage=47%, HitCoverage=9%, E-value=7e-07, Identity=40%"; Hit description =Ribonuclease H
MVDGMRDVWALIQPRVLTIGFGRENMCWRTRARGHGSRNNSYQPTLNSFYGKCFTVQFRNEIYLINKLMEKDWICTLEHTLREPNHEASLARPLVVIHEASQLLMPKLHCYALGTMFPRGF

SEQ ID NO: 205910 - protein, 176 aa, Glycine max
  Coding DNA Sequence Number=SeqID_89132
MSNEETSERIMYKEKVEGNQIIIPEAAKAELAKAKEKPNRAKESSVQSWLDSEPLIDELEKQKKPILLMLNRQEIIHKSIKSKREDQLKTELMIQDIQNAFDHTHNGMERLKLEGKKAMQILAKLRQTLHQRKQTVQTLQLTLQAVLLESDAVEKSSAKALQQIKLSENQRCCAAY

SEQ ID NO: 205911 - protein, 290 aa, Glycine max
  Coding DNA Sequence Number=SeqID_89133
  Gene Ontology: Mol. function=binding; Cellular component=cytoplasm; Biological process=protein folding
  Homolog annotation: Hit_ID=Q69TG8; Match level="QueryCoverage=96%, HitCoverage=83%, E-value=1e-115, Identity=62%"; Hit description =Putative cyclophilin-40
  Pfam annotation: Domain name=Pro_isomerase; Domain location=5-173; Score=368.9; E_value=8.3e-108; Accession=PF00160.11; Description =Cyclophilin type peptidyl-prolyl cis-
  Pfam annotation: Domain name=TPR_1; Domain location=250-283; Score =48.8; E_value=1.8e-11; Accession=PF00515.18; Description =Tetratricopeptide repeat
  Pfam annotation: Domain name=TPR_2; Domain location=250-283; Score =42.2; E_value=1.8e-09; Accession=PF07719.7; Description =Tetratricopeptide repeat
  Pfam module annotation: Pfam domain module=Pro_isomerase::TPR_1::TPR _2; Domain location=5-173::250-283::250-283
MVNPRCFLDITIGGELEGRIVVELFHDVVPKTAENFRALCTGEKGIGPNTGVPLHYKGMCFHRVIKGFMIQGGDISAGDGTGGESIYGAKFEDENLEMKHERKGTLSMANAGPNTNGSQFFITTTRTPHLDGKHVVFGKVLKGMGIVRSVEHVVTGENDRPTQDVVVVDCGEIAEGEDDGVVNFFKDGDTYPDWPADLDVKPDELSWWMSAVDAIKTLGNEQYKACKLKLGDLQGALLDSDFAMHDGDNAKALFRKGQAYMLLNDLDAAVESFKKALELEPNDGSCLLKF

SEQ ID NO: 205912 - protein, 106 aa, Glycine max
  Coding DNA Sequence Number=SeqID_89134
MKKIEDLLENSTLLSERRVNGRNSPNRLVNERLKTRSEEEEHPEFLIQEKMIRESSRYHYLVGMLSDGSKEWKGTLTSSHKGRPSAGFKGGTYTPTLNLGKLSRLW

SEQ ID NO: 205913 - protein, 157 aa, Glycine max
  Coding DNA Sequence Number=SeqID_89135
MYKNCDILMSESENSGDLRIHHDGAFLVLYLKAKKNLSSFTPHHKGANALDGGENIVARVTEGASIDKSEGVRGGDGRKSTAVGEGEGVFTAGSGGENDGDLTEGVTVGDGDLYGVATTGVLFGGKVVEVIVVRSSDKAKIKEESMDPNLQISPPKS

SEQ ID NO: 205914 - protein, 305 aa, Glycine max
  Coding DNA Sequence Number=SeqID_89136
  Gene Ontology: Mol. function=oxidoreductase activity; Cellular component=vacuole; Biological process=hydrogen peroxide catabolic process
  Homolog annotation: Hit_ID=Q9FX85; Match level="QueryCoverage=53%, HitCoverage=42%, E-value=2e-34, Identity=50%"; Hit description =Peroxidase 10 precursor
  Pfam annotation: Domain name=peroxidase; Domain location=1-171; Score= 50.3; E_value=3.6e-12; Accession=PF00141.13; Description=Peroxidase
SIGTYYWRPALLGRRDGTTASESEASWLPSPSDTLQNITNKFLSKGLDIKDLVVLSGVLNFSGPLDLNGDMHGAHTIGYARCFTLKQRFFNYKDTGKPDPSLDASLLQHLQKLCPDNSSDTNLAPLDPVTTYTFDNMYYKNLVKNLGLLPTDEALMSDSTTASLVNKSLTPEEGSKKNSQKVGSRTRFNPASSNFEDEVKGTVAFLLANALVLLSKSSSSSKASLAIVVDSLAILVMWLHVEFCVVVLRVAENREVEKSKLLQKNREFNRERELGLRVTELIRRTNKWRRLWGKIKIKKDGNNKV

SEQ ID NO: 205915 - protein, 523 aa, Glycine max
  Coding DNA Sequence Number=SeqID_89137
  Gene Ontology: Mol. function=protein serine/threonine kinase activity; Cellular component=cell cortex; Biological process=protein amino acid phosphorylation
  Homolog annotation: Hit_ID=Q10EQ9; Match level="QueryCoverage=85%, HitCoverage=55%, E-value=1e-106, Identity=48%"; Hit description =Protein kinase domain containing protein, expressed
  Pfam annotation: Domain name=Pkinase; Domain location=184-453; Score =207.1; E_value=4.2e-59; Accession=PF00069.15; Description=Protein kinase domain
  Pfam annotation: Domain name=Pkinase_Tyr; Domain location=184-453; Score=47.4; E_value=2.2e-15; Accession=PF07714.7; Description =Protein tyrosine kinase
  Pfam module annotation: Pfam domain module=Pkinase::Pkinase_Tyr; Domain location=184-453::184-453
MEQAETRSSRMVQQDASGCRESARDNSNNNLVNVPHRRSISGSPSMSPQKTRNGDFVPYYYACPKGNQFWSTPEMPTCDAGLLPPAFFDLSALSTETSLSPNSHQSPQRKSPQKHTRTFSGPPSPIHPMLSLEIPTVRHENNAPPVAVHPLPLPPRAGLTSPPAAATFSHAMVKSESLPMKSQWKKGKLIGRGTFGSVYVATNRETGALCAMKEVELFPDDPKSAECIKQLEQYISYLLIGLLQKSVCQIINFFGIEIKVLSNLKHSNIVQYYGSEIVEDRFYIYLEYVHPGSINKYVRDHCGAITESVIRNFTRHILSGDIKGANLLVDSAGVVKLADFGMAKHLTGFEANLSLRGSPYWMAPEAVIQKDNSPDLAFAIDIWSLGCTIIEMFTGKPPWSEYEGAAALFKVMKETPPIPETLSSEGKDFLRCCFKRNPAERPTAAVLLEHRFLKNSQQPDAISPTQLYNGTSFMDKPHTPSGQSENRYGQFSTPCAKIAKGKAAERRGFLISSLDILPAYFDQ

SEQ ID NO: 205916 - protein, 113 aa, Glycine max
  Coding DNA Sequence Number=SeqID_89138
ASIINFERLDILRDTVRQPSKKLLSFEFSQSFEPQHSISSVPIYYGTQWDSRVKSYCRLNLLRASIINSERLDILRDSIRHPSKTLLSFEFAKSFGIHIRASRYTTGLNQTSE

SEQ ID NO: 205917 - protein, 395 aa, Glycine max
  Coding DNA Sequence Number=SeqID_89139
  Gene Ontology: Mol. function=DNA-directed DNA polymerase activity; Cellular component=DNA polymerase III complex; Biological process =DNA replication
  Homolog annotation: Hit_ID=P06710; Match level="QueryCoverage=99%, HitCoverage=58%, E-value=1e-60, Identity=64%"; Hit description=DNA polymerase III subunit tau (EC 2.7.7.7) [Contains: DNA polymerase III subunit gamma]
MALLNQAASRGVEWEALLVEMLRLLHRIAMVQLLPSSLGEDDASQAQRLRELARVLPPADVQLYYQTLLMGRKDLPLAPDRRLGVEMTLLRALAFHPQATIAEPVARPLLTPQAAPAVAAPAPQTKAAPAVAAQPQMAPPMDESPPPADDYPDMAPAPDNLPDATSQLLQARTQLLRQGAGKAKKSEPAARSARPANPALERLASVTERVQQRASEPAVKAPAKPEAYRWKAQQQEEIKPEPVATPKALRSALEHEKTPELALKLAEEALQRDAWAAEIATLTLPKLVQQVALNAWKEVNEQGVTLHLRSSQRHLNSAPARQAIQEALSQAAGQPVELTIVEDDNPAVLTPLEWRQAIYEEKLAQARQSIESDTHIQTLRRFFDADLDEESIRPV

SEQ ID NO: 205918 - protein, 36 aa, Glycine max
  Coding DNA Sequence Number=SeqID_89140
MTATQMIRNFIHPVGRELNDIEPQKRQVQDSESEEE

SEQ ID NO: 205919 - protein, 65 aa, Glycine max
  Coding DNA Sequence Number=SeqID_89141
  Homolog annotation: Hit_ID=Q1SAS4; Match level="QueryCoverage=86%, HitCoverage=2%, E-value=4e-11, Identity=43%"; Hit description=RNase H, putative
MSPVKEDREVKPHQEEMEIENLGVGEERKEVKVGTGISIHIRDELVALLRDYQDIFTWSYQICSA

SEQ ID NO: 205920 - protein, 134 aa, Glycine max
  Coding DNA Sequence Number=SeqID_89142
MRGYLMVIRTYCQPEARETVDTRRFTSSSTQTTSVKHKPVWLGGRRKYPSDSMPDSMQRLTSSFAPFCQPEASEPVDTQRLVLSSAPLSSRDGESDDMRGYLMVIRTFCQPEASEPVDMRRFTSSSVQTTFVKH

SEQ ID NO: 205921 - protein, 136 aa, Glycine max
  Coding DNA Sequence Number=SeqID_89143
  Gene Ontology: Mol. function=RNA binding; Cellular component=cytosol; Biological process=regulation of translation
  Homolog annotation: Hit_ID=Q2QQH7; Match level="QueryCoverage=86%, HitCoverage=23%, E-value=1e-30, Identity=55%"; Hit description =Pumilio-family RNA binding repeat containing protein, expressed
  Pfam annotation: Domain name=PUF; Domain location=39-72; Score=21.5; E_value=0.003; Accession=PF00806.9; Description=Pumilio-family RNA binding repeat
  Pfam annotation: Domain name=PUF; Domain location=76-106; Score=20.1; E_value=0.008; Accession=PF00806.9; Description=Pumilio-family RNA binding repeat
  Pfam module annotation: Pfam domain module=PUF::PUF; Domain location =39-72::76-106
MCKERQINHKILPADKRNYVVQYIIEMENPSASLKLHSQFKGNYANLSMQKFSSHVVEKCLVHIVEIRSRIVQELSSFPHLERLLQDPYANYVVQRALGVTKGSLHASLAEAVRPYKTLRSSPYCKRIFSRSLLNK

SEQ ID NO: 205922 - protein, 78 aa, Glycine max
  Coding DNA Sequence Number=SeqID_89144
MVFLWTGGSTGQLGLKQSSSVVSVNQFCEDLLHIWEKGWERETQGYRKRENQHYHYHTATALAVFFSQKGHFSESSRA

SEQ ID NO: 205923 - protein, 399 aa, Glycine max
  Coding DNA Sequence Number=SeqID_89145
  Gene Ontology: Mol. function=RNA binding; Cellular component =extracellular space; Biological process=transport
  Homolog annotation: Hit_ID=Q9C9R6; Match level="QueryCoverage=36%, HitCoverage=23%, E-value=1e-49, Identity=63%"; Hit description =Putative RNA-binding protein; 42664-44784
  Pfam annotation: Domain name=PUF; Domain location=255-289; Score =31.9; E_value=2.3e-06; Accession=PF00806.9; Description=Pumilio -family RNA binding repeat
  Pfam annotation: Domain name=PUF; Domain location=291-325; Score =38.1; E_value=3.1e-08; Accession=PF00806.9; Description=Pumilio -family RNA binding repeat
  Pfam annotation: Domain name=PUF; Domain location=330-364; Score =17.2; E_value=0.036; Accession=PF00806.9; Description=Pumilio-family RNA binding repeat
  Pfam annotation: Domain name=PUF; Domain location=367-399; Score =15.8; E_value=0.055; Accession=PF00806.9; Description=Pumilio-family RNA binding repeat
  Pfam module annotation: Pfam domain module=PUF::PUF::PUF::PUF; Domain location=255-289::291-325::330-364::367-399
MRNEELGGMWLNRFSNLNTLNNTPLHRGHVTSQPQSSSSVFSMIHDDCVDVDVTLSNDFARMSVFNELGNVGVKARGNGYGYGANVMDSSYPHAFSHSLCSFDAHVHEETATPLPIWGVSVSSDLKGHTFGPPMEFSSHTQRSNPCYGQVPLQNPFHATRPFAMDCDVKSPFLMQQQPKVAMNQKKEERQGGCNSLWGCNESLSLPVQEVGVGEELPQHIPSRVAPTKHEKNGVLASDVSPSSQPLLYNFSPLAKFQGYIYYLAKDQNGCRFLQRMIDEGTSEDVLVLFNGVIDDVVELMIDPFGNYLVQKLLDVCGEDERLQVVSMLTEEPGQLVKTSLNLHGTRVVQKLITTVDSRKQIAMLRSAIQSGFLALIKDLNGNHVIQRCLQYFSCKDNEV

SEQ ID NO: 205924 - protein, 85 aa, Glycine max
  Coding DNA Sequence Number=SeqID_89146
MEKCAKSEAAASLRRCAKAALLLHSLNSTISQDQEKWKREIHDLKRELLKERFMRKKMKLCAFTELFAELLLLLSVWTFVLFYFL

SEQ ID NO: 205925 - protein, 510 aa, Glycine max
  Coding DNA Sequence Number=SeqID_89147
  Gene Ontology: Mol. function=sugar porter activity; Cellular component=integral to membrane; Biological process=carbohydrate transport
  Homolog annotation: Hit_ID=Q84N02; Match level="QueryCoverage=65%, HitCoverage=67%, E-value=1e-124, Identity=62%"; Hit description =Putative monosaccharide-H+ symporter
  Pfam annotation: Domain name=MFS_1; Domain location=1-330; Score=1.1; E_value=0.00028; Accession=PF07690.6; Description=Major Facilitator Superfamily
  Pfam annotation: Domain name=Sugar_tr; Domain location=1-369; Score =283.1; E_value=5.4e-82; Accession=PF00083.14; Description=Sugar (and other) transporter
  Pfam module annotation: Pfam domain module=MFS_1::Sugar_tr; Domain location=1-330::1-369
MALGRRNTMIFGGCIFFAGGAINAAAENIAMLILGRILLGIGVGFTNQATPVYLSEMAPAKWRGAFNTGFQLFNNMGVVAANCINFGTAPHPWGWRMSLGLATVPAAIMTIGALLIPDSPSSLVERNHINQARNALRKVRGPTADVESELQYMIQSSQRRYRPQLVMALAIPLSQQLSGISIVAFYAPNLFQSVVIGNNSALLSAVVLGLVNLGSTLVSTVVVDRLGRRVLFIVGGIQMLVCMISAAVVLAMGSGVNGTEQISKGNAIAVLVLLCFYTAGFAWSWGPLCWLIPSEIFPMKIRSTGQSIAIAVQFLATFVLSQTFLTMLCHFKFGAFLFYAGWLALSTIFVILFLPETRGISLDSMYAIWGKHWYWRRIKRCKKQLPLWDLQGLLNLVQAGEDDGLVLVLGMVTVWIPRKLGYVDLCWDLFPPLLDEVVVVGNHTRGSMIVDNNEWKDLRHWRCNGGVMTRDVESAMKPRKVEASGGGVLRRRVKRRFKENWRCTKKNGMS

SEQ ID NO: 205926 - protein, 89 aa, Glycine max
  Coding DNA Sequence Number=SeqID_89148
MEFDGYRFRSEEHQRRFEAIKGWSFLKERRVQLRDGEYTKFQEEIARRLFSFRQVHRIAQIPNPDQASSTDSSCKTKLNQDRIKTRILN

SEQ ID NO: 205927 - protein, 34 aa, Glycine max
  Coding DNA Sequence Number=SeqID_89149
  Homolog annotation: Hit_ID=P61430; Match level="QueryCoverage=77%, HitCoverage=3%, E-value=1e-07, Identity=88%"; Hit description =Synaptonemal complex protein 2
MSIKGGGHPHPLNIGDLFSEGSLNPYAEDPYAFD

SEQ ID NO: 205928 - protein, 68 aa, Glycine max
  Coding DNA Sequence Number=SeqID_89150
MQSPSRPPGCARNCPPIGDQPGPKGAPYQVTSPLSTKYTLPQLLYFLCHMSYEHDQKPSDKVSALHPP

SEQ ID NO: 205929 - protein, 645 aa, Glycine max
  Coding DNA Sequence Number=SeqID_89151
  Gene Ontology: Mol. function=protein transporter activity; Cellular component=nucleus; Biological process=cell division
  Homolog annotation: Hit_ID=Q9LME2; Match level="QueryCoverage=97%, HitCoverage=73%, E-value=1e-161, Identity=50%"; Hit description =Synaptonemal complex protein 1
  Subcellular localization annotation: CTP_CleavageSite=42; ConfidenceScore=5.53e-01
GSISIFAMQKKLGFPISKSLDQFKSLYGSISATPKPLSSRPSADSVSSGSFANLKLTAEKLVKEQASVKTDLENANAKLKKSQEYVHALEEKLQNALNENAKLKVKQKEDEKMWKGLESKFSSTKTLCDQLTETLQQLAGLVQDAEKDKETLEYKLSASSEALDSLNKQMDGLSLKIDSAQEAIRSRDNELEKLKFGTEEREKFHRDEQCRVANVIQEKDTMIRNLEEMLTSSRLATENLNSKLEEVHLQLKVKEDEIMHHLTSQEKLEKENNDLQLCNAGLAEKLDMSLQEIKNLEESLQSLAAHLSNLDKESLNLLTKFDEMNLLYASCFQLVQQERQTFSKHAQYQYSELNNKFVVLELEKNATQMKNHELSKTVDELQKVHESTLAQLTEGSRLAAEKIRSLESEAETLISKKKDAEVLIFKLEEKAEFLLESSRSSENQVQGLLLKVSALETESKENTERLHAEISKKSEEIDTLQNERMKLEQHADSLDKEVIQLQNALEEKEKCILHYKEQEKNLEDQITENLSLLTAAESKLSEAKKQYDQMVENKQLELSRHLKEISQRNDQAINDIKRKYELEKMEIVNKEKEKADKAIAEIEGKCGQKIEECKEEQRQQLMRIQDEHTLLVSIEKVLNLKLLAA

SEQ ID NO: 205930 - protein, 76 aa, Glycine max
  Coding DNA Sequence Number=SeqID_89152
MKETHSSQGWLTEGRVSVAEKEEEESWQRKRNSEKGMNGFEEEKGRVRVTGAVRRVQNNAVPIPYTQSPLNDKFVG

SEQ ID NO: 205931 - protein, 183 aa, Glycine max
  Coding DNA Sequence Number=SeqID_89153
  Gene Ontology: Mol. function=transporter activity; Cellular component= integral to membrane; Biological process=transport
  Homolog annotation: Hit_ID=Q9XGG7; Match level="QueryCoverage=60%, HitCoverage=40%, E-value=1e-25, Identity=54%"; Hit description =Nodulin26-like major intrinsic protein
  Pfam annotation: Domain name=MIP; Domain location=9-153; Score=-25.1; E_value=3.5e-08; Accession=PF00230.10; Description=Major intrinsic protein
MVGIFLQNSITLSDLPMILPSESDLTYQCVKVSYPLTLKVLHHDKVDVGVTVTKYLSSTSHLEAIVWEFITAYILMLTICGVATDHRGSKDLTGVAIGISVLINVIIAGPITGASMNPARSLGPAIVSGDYKNIWVYIVSPILGAVSARNFRHKHYKDRANKNKVFGTVFLVCHIEKFWRCEH

SEQ ID NO: 205932 - protein, 527 aa, Glycine max
  Coding DNA Sequence Number=SeqID_89154
  Gene Ontology: Mol. function=DNA binding; Cellular component=beta -galactosidase complex; Biological process=DNA integration
  Homolog annotation: Hit_ID=Q1T2A5; Match level="QueryCoverage=99%, HitCoverage=56%, E-value=0.0, Identity=60%"; Hit description =Integrase, catalytic region
MTISSAIEPVTYVEASRHDCWIKAMTAELQALQMNNTWRLMPLPPHKTAIGCRWIYKIKYRADGSIERYKARLVAKGYTQTEGLDHLDTFSPVAKLTSVRVLLALAALNKWHLRQLDVNNAFLHGDLEEEVYMQVPPGLPVDNPQLVCRLQRSLYGLKQASRQWFTKLSSFLTSHGFQRSDSDHSLFLRITGSTITILLVYVDDIILTGNSLTEIQAITTLLDQEFRIKDLGNLKFFLGLEIARTSKGIHLCQRKYVLDILSESGMLGCKPHSTPMDYSVKLQKSSGNPLPNESSSSYRRLIGKLIYLTNTRPDIAYAVQQLSQYMSAPTTAHLQAAFRVLRYLKGTPGSGLFFAATGTPQLRAFSDSDWAGCKDSRKSTTGFLVYLGSSLVSWQSKKQSTVSRSSSEAEYRALASTTCELQWLTYLLQDLRVTFVQPATLYCDNQSAIQIATNPVFHERTKHIEIDCHLVRNKVTSGFIKLLPVSSSLQLADIFTKPLTPVVFQHLCNKLGMINIHSQLEGGVLTV

SEQ ID NO: 205933 - protein, 218 aa, Glycine max
  Coding DNA Sequence Number=SeqID_89155
  Gene Ontology: Mol. function=hydrolase activity; Biological process =aromatic compound metabolic process
  Homolog annotation: Hit_ID=Q4PSG2; Match level="QueryCoverage=89%, HitCoverage=67%, E-value=2e-42, Identity=44%"; Hit description =Hydrolase
MTQCFFSFTETRNRCYRSMFAGSGLRSTVTDLKDGTVMHCWEPKARAESKPSLLLIHGLGANALWQWGDLIRHVAPHYNVYVPDLVFFGGSYTARPERGERFQAECVARVMEAKGVRRVSFSGAELWRVCWVLHGSDGGGWWLWWRERDVKEGLFPVMDLDEAANILVPRTPERLRELVGYTFFKPPPLWWLPSCFLLDFIEHVFELQFKACQTENTF

SEQ ID NO: 205934 - protein, 108 aa, Glycine max
  Coding DNA Sequence Number=SeqID_89156
  Gene Ontology: Mol. function=hydrolase activity; Biological process =aromatic compound metabolic process
  Homolog annotation: Hit_ID=Q4PSG2; Match level="QueryCoverage=82%, HitCoverage=28%, E-value=1e-29, Identity=64%"; Hit description =Hydrolase
MCRDYEQEKRELIKALAKDRKISDLPKISQPTLIIWGEHDQVFPLELAHRLKRHLGDNAQLVVIKNAGHAFNVEKSKEFFSILKSYLVDSQLPVESSPSKLQNNNNPE

SEQ ID NO: 205935 - protein, 248 aa, Glycine max
  Coding DNA Sequence Number=SeqID_89157
  Gene Ontology: Mol. function=DNA binding; Cellular component=beta -galactosidase complex; Biological process=DNA integration
  Homolog annotation: Hit_ID=Q1SS72; Match level="QueryCoverage=89%, HitCoverage=15%, E-value=2e-59, Identity=46%"; Hit description =Integrase, catalytic region
MNEASINSAESYLYLHPSENPAIALVSPVLDSTNYHSWSRSMVTALSAKNKVEFIDGSAPEPLKTDRTYGAWRRCNNMVVSWLVHSVATSIRQSILWMDKAEEIWRDLKSRYSQGDLLRISDLQQEASTMKQGTLSVTEYFTHLRIIWDEIENFRPDSICSCNIRCSCSAFTIIAQRKLEDRAMQFLRGLNDQYTNIRSHVLLMDPIPAISKIFSYVVQQERQLLGNTGPKMPPSTRRKPSATSADVL

SEQ ID NO: 205936 - protein, 631 aa, Glycine max
  Coding DNA Sequence Number=SeqID_89158
  Gene Ontology: Mol. function=protein binding
  Homolog annotation: Hit_ID=Q7XAK8; Match level="QueryCoverage=54%, HitCoverage=43%, E-value=2e-60, Identity=43%"; Hit description =Protein phosphatase regulatory subunit-like protein
  Pfam annotation: Domain name=LRR_1; Domain location=417-436; Score =8.7; E_value=6.7; Accession=PF00560.23; Description=Leucine Rich Repeat
  Pfam annotation: Domain name=LRR_1; Domain location=439-459; Score =10.9; E_value=2.6; Accession=PF00560.23; Description=Leucine Rich Repeat
  Pfam annotation: Domain name=LRR_1; Domain location=461-482; Score =15.9; E_value=0.14; Accession=PF00560.23; Description=Leucine Rich Repeat
  Pfam annotation: Domain name=LRR_1; Domain location=484-504; Score =7.6; E_value=11; Accession=PF00560.23; Description=Leucine Rich Repeat
  Pfam annotation: Domain name=LRR_1; Domain location=506-526; Score =11.9; E_value=1.7; Accession=PF00560.23; Description=Leucine Rich Repeat
  Pfam annotation: Domain name=LRR_1; Domain location=532-555; Score =6.5; E_value=17; Accession=PF00560.23; Description=Leucine Rich Repeat
  Pfam module annotation: Pfam domain module=LRR_1::LRR_1::LRR_1::LRR _1::LRR_1::LRR_1; Domain location=417-436::439-459::461-482::484 -504::506-526::532-555
MAMVWCFSLLPVRKEKLKGNERSSKEDFNTLLAKLQSTKKISSEPATFDALFNARITTLESPVKAEAQETYKDEDSTLIKRELSDFYLQDHEAVASKGYDTTDKEVEYPILYENQVNNELEDKSDRFSRKSVDTTESGHTSDPGIGMADSWASPKFKRYLSNLEKFDEHGKITRHLPAASKSKSFKNFQELSSMVSLESPRSVMSHHSADRVLLKRHSSSQVLPSRSKKLWWKMILWSHRNIQRTLSSNSTLVPTSAALNSGYSSDTLEPKQGKALRPVKSSDSITMESFNKRSRTGKNIDNQRGSRFQSDQWISFSTESSSFTRVDAWVKGLEIQQPLPEDDFDVDNARSIVFPPSPNAGGSMIRTTSQLTYPDANLSKEALTAISVVLSLNPTSTIAHISGIGIKAIPSISHLSSLRAVNLSNNFIVHISPGVLPKGIQTLNLSKNKISTLEGLRELAKLRILDLSYNRISRIGQGLSSCTLIKELYLVGNKISDVEGLHRLLKLTVLDLSFNKITTAKALGQLVANFNSLKALNLLGNSIQSNISDDQLSKAVCGLLPKMVYLNKQPVKAHRTRGILSDSVARAALGSSTRSCNRRSIRRVGHGGSNLSRGNRRSTSVSQKSTNRTRK

SEQ ID NO: 205937 - protein, 99 aa, Glycine max
  Coding DNA Sequence Number=SeqID_89159
MDIMRLGWDHSGAALTVSVDKKSDASARDGGGEVLRVAGDGINILHFLLGLVVCEVLLFSDYDCVVLWWCQRGIEIRERQWTIGFTGKNLGLGAKAGYF

SEQ ID NO: 205938 - protein, 874 aa, Glycine max
  Coding DNA Sequence Number=SeqID_89160
  Gene Ontology: Mol. function=nucleic acid binding; Cellular component= chromatin; Biological process=DNA integration
  Homolog annotation: Hit_ID=Q1T4S3; Match level="QueryCoverage=54%, HitCoverage=30%, E-value=1e-112, Identity=46%"; Hit description=Zinc finger, CCHC-type
MAMKVQLQTLTKGYLSMLEYIEHKHSIADSLAENLHPISDEDLIGYILSGLDSSYSAFSTAFMMKSDDVFVDDLAGLLLQEEARLEQEHVHQAVVVSQPTNPSPLLSTPAIYTTNRFSNRSSSTNNPNNSSSSFPRRNIDNPRRHPICQLRANPRFSSRQANVAQTRTSPTVMDPSWYFDTGATNHVTPDISKLTIANDYTGDDKIYISRHVVFNEDVFPYSLHACHTVPTLSTSSQPTTPHILQHAADLLCPPPSPPHSTNQSSSFIPKTSSTTPSYLQPTISSHAKHTHPSTSHFRPADKSTHPMVTRAQTDSLKPKTFSISISSTPTTEPHTFKQVIQHPCWQQAMQHEYDALMRNCTWFLVPCPTNVNLVGCKWIFRIKRRSDGSIERYKARLVAQGFSQEAGIDYFDTFSPVIKPTTIRLVLSIALSNGWCIRQLDINNAFLNGDLIEIVYMKQPRGFEDSSRPSHVCRLLKALYGLKQAPCAWFNKLKHYLVTHGFKACHSDTSLFVHLSSISIIYILVYVDDLIITGTHAGKIQQFITQLHTTFALKDLGDLHYFLGLQICRSPAGLTLSQEKYIHDILCRSNMTEASSISTPADPTSRLTSRGDPFHDPKLFRQIVGSLQYVIITRPDIAYAVNRVCQFMHSPTSLHWQATKRIIRYLKGTSHHYLHFTPTRAQSLLAYSDVGWLSDTEDSKSQYGYAIFMDPILSAGLLENNELLHDLAPKLMSERKKAILDATGGIRQPILFLIKHDSLISRFSLYDIIGTPNIDVDGVALLEVVAIEVEDDKQGKSLPWVWGSIDRRVQLVSDVVGLKRMCPLVLAQNSHSNKGNPWWKMMVHRVVGGSIVVAEFVGYTSWPVLNTKHCTINH

SEQ ID NO: 205939 - protein, 167 aa, Glycine max
  Coding DNA Sequence Number=SeqID_89161
MSITVVGSMKLNIDDIEPKKLCSKWPNCNHDLLSTFENKKLVHMLGGYFSVGNFDGLYKSILGLNEKYFMSKEEKDMLAYPCIASKFMSSISKMMLPIYEQALYFTSVKDGTKNWLNLVDPKSSNGYAKGPTMFMATDDLVVAPIPISALSLLKQSKISLDDSKEKS

SEQ ID NO: 205940 - protein, 270 aa, Glycine max
  Coding DNA Sequence Number=SeqID_89162
MANTSPSLLALANTTNSNLNLQIPSINIKLERDNYSLWRSTIISALETFELESFILNPAPPMQTHIINTSDALSLVVRATSSHMAWTAIEKTFQAQTRARRMAMKVQLQTLTKRSLSMLEYIERKRFIADSLAENLHPISDEDLIGYILSSLDSSYSAFSTAFIMKSDDVSVDDLVGLLLQEEARLEQEHVHQAVVVSQPTNPTPLLSTSVVYTTNRFSNRSSSTNNPNNNSGSFPRRNVDNPRRRPICQLCSKPGHETIDYWQRTNQTN

SEQ ID NO: 205941 - protein, 54 aa, Glycine max
  Coding DNA Sequence Number=SeqID_89163
MCVQEEGRLAQEIGEGALTMTQDKGKKERKEKNHIPPIAKIKKESRILKPEGAK

SEQ ID NO: 205942 - protein, 118 aa, Glycine max
  Coding DNA Sequence Number=SeqID_89164
MTKNEMHIIGIVIIIMIVMDFSQANYNPSFGQIERNHVSNLACEDKCRLKCAFLLIPPFTPGYLICLYKCMATNCKANPIVQDCKSGCGLTKSVSVNDDAHGVAAADLVDSCLPECQK

SEQ ID NO: 205943 - protein, 91 aa, Glycine max
  Coding DNA Sequence Number=SeqID_89165
MAKQGKANEQCVFTSMHVYPRCLHRISQAQPHINKTSKEHIIYNHHELQSGNQHHQSITKHHHHESINRTHQVHQTQPPKTYFTTWRFDVI

SEQ ID NO: 205944 - protein, 72 aa, Glycine max
  Coding DNA Sequence Number=SeqID_89166
MKMKANKTRNELKVSNSNTYRLKTEEQTKNGEEQRKIFTDLLMETSRKRYGSTSTWIFFTETYFFTQNSRNA

SEQ ID NO: 205945 - protein, 97 aa, Glycine max
  Coding DNA Sequence Number=SeqID_89167
  Subcellular localization annotation: CTP_CleavageSite=30; ConfidenceScore=5.21e-01
MIHEAAFKKMHWGSQRSSPGSTPSRLSLALCFMARERCDYFSGSPERKIAESYFSMICREGLRLQPRVDPRGGWLTKHELKVKESVSKYGAWVGNNF

SEQ ID NO: 205946 - protein, 75 aa, Glycine max
  Coding DNA Sequence Number=SeqID_89168
  Gene Ontology: Mol. function=DNA binding; Biological process=DNA integration
MEHNGVWDLEELPKDCKRVGYLLLRDLLRKMTLIIKRRFDQSHKRILSGLSWHKLPIMTWSYIRWMWKLSFLMEI

SEQ ID NO: 205947 - protein, 272 aa, Glycine max
  Coding DNA Sequence Number=SeqID_89169
  Gene Ontology: Mol. function=tetracycline:hydrogen antiporter activity; Cellular component=integral to membrane; Biological process=tetracycline transport
  Homolog annotation: Hit_ID=Q396T8; Match level="QueryCoverage=79%, HitCoverage=47%, E-value=6e-96, Identity=82%"; Hit description=Major facilitator superfamily (MFS_1) transporter
  Pfam annotation: Domain name=MFS_1; Domain location=48-271; Score =72.5; E_value=1.3e-18; Accession=PF07690.6; Description=Major Facilitator Superfamily
  Subcellular localization annotation: CTP_CleavageSite=16; ConfidenceScore=5.10e-01
MTSGIGTIERSTSGTRRATAQRRRPPDFRPTDFAMSREPTHSAMLWIVAAAFFMQSLDTTIVNTALPSIAQSLQASPLAMQPVVVVYTLTMAMLTPASGWLADRFGTRRVFSVAILVFVLASIGCAASHTLGQLVVARAVQGIGGSKLLPIGRLAVLRRVPGEQYVAAIAFVSITGQLGPIVGPTLGGWLTQAISWHWVFIVNVPVGVVGFIAVQRYLPHDQATQPPPFDFVGCALLSAAMLALSLAIDPPMSAHRAAWAAGLAAHALASAL

SEQ ID NO: 205948 - protein, 375 aa, Glycine max
  Coding DNA Sequence Number=SeqID_89170
  Homolog annotation: Hit_ID=Q7N3C9; Match level="QueryCoverage=39%, HitCoverage=98%, E-value=3e-60, Identity=70%"; Hit description =Similar to putative membrane protein
STLEDPRSPVAGNLPDDGLAVADRDLSAGYAAGGRRRHAAGDRRGGLYPRRDFLRLQAHSLWPRHLARLRARRQRLPFHGDLPLRLNVIATTHHNDRSLIQSAAGLRYRFVRVAGGLRQYHRLRLQLRLRAPRLYDGHHFPRRHHRLPFDTNAVAASRRLYLHHCAGEPDRAAVLDRRPALAEKAGGSGADAGLPHLAGRLYVDWGRVVWHVDVETVERRARCVSLLRHHHSGADLSGAARRGVGRVTKTAAGRAPAADGLFLFGQRIRQRFDRQLAGGILAHPQLAVGVQIVVHHHLHPQPAVGQLARRQHGAGAAPVFTQLQLQVFRRLRGAGRLTFQPVERTLVGAAEFGARHHLLTGITAFAEADAFQRLQ

SEQ ID NO: 205949 - protein, 150 aa, Glycine max
  Coding DNA Sequence Number=SeqID_89171
  Homolog annotation: Hit_ID=Q1SPB9; Match level="QueryCoverage=93%, HitCoverage=25%, E-value=7e-14, Identity=35%"; Hit description =Transposase
MCPPPEKVNTKGAQKKLMTKYQRSTKRDLSYWEYVDVLHSVQNSNSSIKCSTSLSDQAILRRIMLMLDQFHPFIHDFIENIVDVKVDGNYGYRAIAALLGMGEDSWSLVRNHLLKELAKWSDEYINLLGGIDKFEELKRSLLVDGLSMFK

SEQ ID NO: 205950 - protein, 141 aa, Glycine max
  Coding DNA Sequence Number=SeqID_89172
ISAYHGCRMTKLGLCLSSGPPPLDDKRGANNHKGISAYHGCRMTKLSLCVPSDTTVSEWQRGADNRKGISAYHGCRMTKLGLCLSSGPPPLDDKRGANNHKVSSRIMGISAYHGCRMTKLGLCVPSDTTVSEWQRGADNRK

SEQ ID NO: 205951 - protein, 67 aa, Glycine max
  Coding DNA Sequence Number=SeqID_89173
MRTLRVHRMNRKSWFEQNRGGGCRPARPGELSSPRRAGLLPPEATAFWRNIPEGPSGPGCYLHPHFY

SEQ ID NO: 205952 - protein, 277 aa, Glycine max
  Coding DNA Sequence Number=SeqID_89174
  Gene Ontology: Mol. function=catalytic activity; Biological process =fructose 2,6-bisphosphate metabolic process
  Homolog annotation: Hit_ID=Q8LE79; Match level="QueryCoverage=88%, HitCoverage=90%, E-value=2e-72, Identity=55%"; Hit description=PRIB5 protein
  Pfam annotation: Domain name=PGAM; Domain location=15-207; Score =83.1; E_value=8.7e-22; Accession=PF00300.12; Description =Phosphoglycerate mutase family
MSSGGKQGGFVSYQNVFVMRHGERLDNFEPSWVMTAARPWDPPLAEAGRKRAFETGRRLRESVGLPIGRVFVSPFLRCLQTAGELVASFSDEGRGGTVAGDGVAVKPFEVKVSVEYGLCEMMNSKAIRPNVAPKDGNMGFDVAVCEAMLPAEIVDKNVERVYKELPQWEESVLQAGARYQQLIKDLADKYPTENLLLVTHGEGVQVAVSSFKKDAEVNEVDYCGYVELRRPIFKKDHTFITGEFDLLTPSGQTGELFKWKKEKMKVKIYVPEWDVIT

SEQ ID NO: 205953 - protein, 175 aa, Glycine max
  Coding DNA Sequence Number=SeqID_89175
  Gene Ontology: Mol. function=DNA binding; Biological process =regulation of transcription, DNA-dependent
  Homolog annotation: Hit_ID=Q1S9D7; Match level="QueryCoverage=79%, HitCoverage=42%, E-value=3e-35, Identity=48%"; Hit description =Transcriptional factor B3; Cupredoxin
  Pfam annotation: Domain name=B3; Domain location=22-117; Score=79.1; E_value=1.4e-20; Accession=PF02362.12; Description=B3 DNA binding domain
MTSKLNHRDDGSNGDSASKPIHFLRIMHPDNLLQGKLRLPAEFVNKYGKHLSNTMFLKLPNGAEWRVNLEKRDGRVWFQEGWKKFVEHHSLAHGHLLVFKYDGTFHFHVLIFDPSANEIDYPVNKANHKRVRISSEEIQPPTTCKTSGNKRSNSNLQDNAFHQKVRDHKGMVLDS

SEQ ID NO: 205954 - protein, 68 aa, Glycine max
  Coding DNA Sequence Number=SeqID_89176
MEGSSISNCGNHEAAGNTSFTVIMKSSYVSKRIMSCNVHFPEPLEEASGGWQAELQGEHIGPLVEESE

SEQ ID NO: 205955 - protein, 246 aa, Glycine max
  Coding DNA Sequence Number=SeqID_89177
  Homolog annotation: Hit_ID=Q9LTT9; Match level="QueryCoverage=39%, HitCoverage=7%, E-value=8e-32, Identity=69%"; Hit description =Arabidopsis thaliana genomic DNA, chromosome 3, P1 clone: MDC11
  Subcellular localization annotation: CTP_CleavageSite=43; ConfidenceScore=5.47e-01
MASPNNHNPPPPTIPFDMHSFFNPQPPPPPSSNPNPNPNHNPSSSYPPPFHFPNFDLPLPPHPHHRSISFPTQPIPPPSNPNAGARLMALLGNPSPAPPQPPPPEFVPVSSSAVLAAASAAAAALTRLPSSKVPKGRHLAGELVTYDVDVRLPGEVQPQLEVAPITKYGSDPNPVLGRQIAVNKSYICYGLKQGNIRVLNIHTAVRSLLRGHTQTHLSAFCHNIKEHEETSTATAVKTLEINFRNG

SEQ ID NO: 205956 - protein, 180 aa, Glycine max
  Coding DNA Sequence Number=SeqID_89178
  Homolog annotation: Hit_ID=Q9LTT9; Match level="QueryCoverage=29%, HitCoverage=5%, E-value=3e-11, Identity=78%"; Hit description =Arabidopsis thaliana genomic DNA, chromosome 3, P1 clone: MDC11
MLVGKSNIELFPWPMLLSAIFASYELELSLNKHNKNAPNTLKTNSESKENLSVASEQGPDSSHIYDLFTAICLPRTGLGSDPYFVIGAASSWGWTSPGRLTSTSRVRAGEAAEAAARTAEEEKGTNSSGGGCGGAGEVLPRRVMRRAPALGLEGGGMGWVGKEMERWWGWGGRGRSKLGK

SEQ ID NO: 205957 - protein, 225 aa, Glycine max
  Coding DNA Sequence Number=SeqID_89179
  Pfam annotation: Domain name=RRM_1; Domain location=1-62; Score=3.5; E_value=0.068; Accession=PF00076.12; Description=RNA recognition motif. (a.k.a. RRM, R
MNEIELWYVFKKWGDVREVFIARNRNKWGKRYGFVRFKGVKDAMTLERKLDSLVVGGLKMHVNVSKHGRERIIRGEDSRGPQQEKLKPPQYMNEAASYAHVLMMESKKPDTRRTQPTLSSVGPVSHSSVQLNIPVDENTWLNRTWVGRLRKLTLFDRIEDDLMWIGYDGITPKYIGDDMVLLMGLTETNATQMAEERVKEAVRLFFLQRFQEFEQCRPKLDGIRF

SEQ ID NO: 205958 - protein, 132 aa, Glycine max
  Coding DNA Sequence Number=SeqID_89180
  Gene Ontology: Mol. function=RNA-directed DNA polymerase activity; Cellular component=exocyst; Biological process=RNA-dependent DNA replication
MVFKVDYKKAYDLVSWDFLIYMLWWLGFCPKWIQWVEGCLRSASISVLVNGSPSAEFIPQRGLRQGNLLTPLLFNIVAEVLNGLMRKLVEKNLFRGFSVGTNNVEISISQYANDTIFLVRHQWKTSRQSKPF

SEQ ID NO: 205959 - protein, 369 aa, Glycine max
  Coding DNA Sequence Number=SeqID_89181
  Gene Ontology: Mol. function=RNA-directed DNA polymerase activity; Cellular component=nucleus; Biological process=RNA-dependent DNA replication
MEQRKITWVNWDTVCLPKDKRGLGIKDLKTFNTALLGRWRWDLVQQHGALWTRVLTSKYGGWRSLDGEISGSHQSPWWKDLMRIQQQGTSKLKKQTTWKVGCGDKIRFWEYCWTSEDVPLMLKYPRLYQISSQQQQLIMQMGRHFDEGWEWNYSWRRPLFDNEVATADEFLRETANLLIHPNKADLWVGKADPSGSYSTKSAYKLLRGDSRGEHQDGAFVELWKIKISAKAAVFAWRLIRDRLPTKSNLRRRQVESSPPFMVSWVNITGAFPQSPKDRFLQHGSGIVHGIKATRWKCGWVALTWTIWQHRNRIVFSNQTFNGSKLSEDAILLIWTWLKTTEKDFGVHFNQWSTNPQKYNIIYIEKYQRY

SEQ ID NO: 205960 - protein, 79 aa, Glycine max
  Coding DNA Sequence Number=SeqID_89182
MDIQSLKKQPEVTSHCFCAIGNYDEQSRAIQNGTQAQALQERKIDQSETEKLMLPNAAAMTVRRGGRRFDAVSLSQGFL

SEQ ID NO: 205961 - protein, 84 aa, Glycine max
  Coding DNA Sequence Number=SeqID_89183
MCFMVPLLKRGGARADEGRYGGHERADDQNDESHDEYEINNGDQHGYNCCRKYHHCGGPDSPIWPQPNKSPNLGYCRLRRGSIE

SEQ ID NO: 205962 - protein, 241 aa, Glycine max
  Coding DNA Sequence Number=SeqID_89184
  Gene Ontology: Mol. function=transporter activity; Cellular component= integral to membrane; Biological process=iron ion transport
  Homolog annotation: Hit_ID=O87656; Match level="QueryCoverage=99%, HitCoverage=46%, E-value=1e-37, Identity=60%"; Hit description =Ferrichrome transport system permease protein fhuB
WPDRRHSVAAAGRGADAAVCRDGRGGAGRRAGVWHRLGQASVAGDADPGRSGTEPVCRRARRPQRGAAVAAPAAGVRTGAGAVASADLVNVAGIIGFIGLFAPLLAKMLGARRLLSRLLLAPLIGALLLVNRDGYRADWRADSAVAAAASAHGLAAAGDECRRHSAAGAAGRAALVSGGRDDSGAVQSGGHCVWARRTRLDVGQRRYAATAAAVARPARAGGAGGRHDAGRRRGADSAPDR

SEQ ID NO: 205963 - protein, 2175 aa, Glycine max
  Coding DNA Sequence Number=SeqID_89185
  Homolog annotation: Hit_ID=Q6D1Y4; Match level="QueryCoverage=35%, HitCoverage=91%, E-value=0.0, Identity=73%"; Hit description =Penicillin-binding protein 1b
  Pfam annotation: Domain name=ABC_tran; Domain location=1678-1865; Score=197.6; E_value=2.9e-56; Accession=PF00005.17; Description=ABC transporter
  Pfam annotation: Domain name=HrpB_C; Domain location=1-45; Score= -19.4; E_value=7.4e-08; Accession=PF08482.1; Description=ATP -dependent helicase C-terminal
  Pfam annotation: Domain name=Peripla_BP_2; Domain location=1916-2155; Score=40.7; E_value=5.1e-09; Accession=PF01497.9; Description =Periplasmic binding protein
  Pfam annotation: Domain name=Plug; Domain location=988-1092; Score =87.8; E_value=3.3e-23; Accession=PF07715.5; Description=TonB -dependent Receptor Plug Domain
  Pfam annotation: Domain name=SMC_N; Domain location=1658-1869; Score=- 108.6; E_value=0.0011; Accession=PF02463.9; Description=RecFRecNSMC N terminal domain
  Pfam annotation: Domain name=TonB_dep_Rec; Domain location=1401-1646; Score=75.0; E_value=2.3e-19; Accession=PF00593.14; Description=TonB dependent receptor
  Pfam annotation: Domain name=Transgly; Domain location=234-405; Score= 292.3; E_value=9.4e-85; Accession=PF00912.12; Description =Transglycosylase
  Pfam annotation: Domain name=Transpeptidase; Domain location=511-785; Score=73.1; E_value=9e-19; Accession=PF00905.13; Description =Penicillin binding protein transpeptidase domain
  Pfam module annotation: Pfam domain module=ABC_tran::HrpB_C::Peripla _BP_2::Plug::SMC_N::TonB_dep_Rec::Transgly::Transpeptidase; Domain location=1678-1865::1-45::1916-2155::988-1092::1658-1869::1401 -1646::234-405::511-785
MFGEAQNPAVADGRVPLVLELLSPAHRPLQITRDLAAFWRGAYPEWIEFRGFCHARHEKAVRVAALPEPEDDIDQDDFDEDDEESAPVPPKGKGKRPARGKRRWLGWLIKLFLVFVVVMAAWGVYLDSEIRSRIDGKVWQLPAAVYGRMVSLEPGMAYDKKEMIALLEGTQYREVSRITRPGEFSVKGNTIDLLRRPFDFPDSKEGQINARLTFSNNELSEIKNLDTGRDFGFFRLDPRLITMLQSPNGEQRLFVPRAGFPDLLVDTLIATEDRHFYEHDGISPYSIGRAFLANITAGKAVQGGSTLTQQLVKNLFLTNERSLWRKAREAYMAVIMDARYSKDRILELYLNEVYLGQAGNDQIRGFPLASLYYFGRPVDELSLDQQAMLVGMVKGASLYNPWRNPQLALERRNLVLRLLQQQKVIDQELYDMLSARPLGVQPKGGVITPQPAFMQMVRNELQAKLGDKVKDLSGVKIFTTLDPISQDAAEKAVEDGIPTLKKQRGLKDLETAMVVVDRFSGEVRAMVGGADPQFAGYNRALQARRSIGSLAKPATYLTALSQPNSYRLNSWIADEPIALKQPNGSVWKPMNDDRRFSGKVMLVDALTNSMNVPTVNLGMTLGLDAVVDTWTKLGVPKDQLHPVPAMLLGALNLTPIEVAQAFQSIASGGNRAALSAVRSVIAEDGTVLYQSFPQAQRVEPAQAAYLTLYTMQQVADHGTARALGARFPGAHLAAKTGTTNDLIDSWFAGIDGKEVAITWVGRDNNQTSKLYGASGAMQIYRRYLDNQAPMPLVLTPPEDITQMNIDSAGNFVCGSGSSTWRSLPVWALDPNTLCQQQQQQIQQQQQQEQQQQQQQQPQGEQKDSDGVAGWIKDIACAVPAFYHHVAVPDTWRRSSLSLTYKLNLTPSGAAAPFSLPAIFLAAIMDMCDPLANSPPSGITSCGACRALAEDTVVVTADGGSGVAQESAWGPSPTIAAKHSATGTKTDTPIEKNPQSVSVVTQEEMSMHAVTSVKGAFNYTPGVLTGNRGSSDVIDALSIRGFSETNTNQYLDGLKLQGDNYSEFAIDPYFLERAELLRGPVSVLYGKSNPGGVVSLVSKRPTQETLREVQFQMGTDNLFSTGFDFGGSLDDDGVYSYRLTGLARSADAQQEMNKEKRYTLAPSFSWRPDANTRFDLLTYFQNEPETGYYGWLPREGTVVGITRPDGSSYKLPTNFDEGEDSNKISRNTKMVGYNFEHSFNDTWTVRQNLRYAEMQTDYRSIYGFGYNPENQLITRNAAFSKEKLNQFAVDTQAQAKFATGDLAHTLLLGVDFQRTRNDIDGQFGTATGLSPFNPQYGNDSYTPYDDPYQRLNQQRQTGLYAQDQMEWNRWVLTLGGRYDYAMNSVTDRVAQSVDRQNDQAFTWRGGVNYVFDNGIAPYFSYSEAFIPNAGATWGGEAFDPSRAKQYEAGVKYVPKDRPIVMTAAVYQLTKTKNLTADPDASHQFASVQSGEIRSRGVELEAKAALNANINLTAAYSYTDAEYTEDTLLKGRTPVQVPKHMASLWGDYTFHETALSGFTVGAGVRYVGESKGLYASGANANHNFDVPAYTTVHAALNYDLGRFGLPGSTVGVNINNLFDREYVASCYRDYACYWGAQRQIVGIIMHHPHHAETTFSLENVSFRVPGRTLLHPLSLTFAPGKVTALIGHNGSGKSTLLKMLGRHHAASEGRVMLNGEAVDTWSSKAFARQVAYLPQQLPAAEGMTVRELVAIGRYPWHGALGRYGQEDRDRVDEAIALVGLKPFAGRLVDSLSGGERQRAWLAMLVAQNSRCLLLDEPTSALDIAHQVDVLALIQRLSHERGLTVIAVLHDLNMAARYCDQLVALRAGEVIAEGGPEAIMQAGVLGLVMFDISRRRLLTALALSPLMNLAPLRAAPPDSQRILALEWLPVELLMALGVAPLGVADLHNYAIWVGDPVLPAGTLDLGLRTEPNLELMTQLAPSLILHSNGYGPAVDKLERIAPTMGFDLNSGDGKPFTTARTSLHALAARLGLEAQAQAHLQWVDGEVAAARERLRPWAQRPLLLMSLMDPRHAITFGKGSLFLEVMEQLGLRNAWQGETNFWGSAVVGLERLAEVGDVEVICFDHDNERDMQQVTQSALWQALPFVRSGRFRRVPARAQFTGAGAHVYQPAPGAAAGA

SEQ ID NO: 205964 - protein, 113 aa, Glycine max
  Coding DNA Sequence Number=SeqID_89186
RIMLSSNVIHICVRVVMLVRMIRTPSPCGIQAKLMQSDPPRVLDRRIQEDWARATKEGPRVLMNLGWISEPMGQALASHLKEVNLAISELLKEVFSKKLLKEVFSRKLLKEAT

SEQ ID NO: 205965 - protein, 325 aa, Glycine max
  Coding DNA Sequence Number=SeqID_89187
  Gene Ontology: Mol. function=calcium ion binding; Cellular component =cytoplasm; Biological process=glycine catabolic process
  Homolog annotation: Hit_ID=Q2W7U6; Match level="QueryCoverage=99%, HitCoverage=80%, E-value=5e-58, Identity=41%"; Hit description=Type V secretory pathway
LDVTDKDAGEATFNPQTDAKGDHGKFSIDANGNWKYELDNDDPKVQALAVGEKLVETFTVTTADGTKSTITVTIDGTNDDPKLSGKTDGAVAEDGTTSATGKLDVTDVDTSDTHTWTVSNNGDGQYGKFTVDANGNWKYELDNTSDKVQALKDGEKVTDTITVTVDDGHGGTATKTITVDITGTNDAAVITPSKPGDDKGTVQEDTTLTANGKLDIVDKDAGEATFKPQTDFHGQYGTFSIDANGNWSFKLDNDAEAIQQLGAKESLTETFTVTSADGTMGQVVITIKGTNDAPTIRGAATGDVTEDGAKAVSGQLTQNDVDVDD

SEQ ID NO: 205966 - protein, 81 aa, Glycine max
  Coding DNA Sequence Number=SeqID_89188
MKKKKLLLLKEVTESTQQAFKSLEIQVGKLAEEVTKFVAKREENFVEVEAHEESIVEEHDSKEKYEEKVRRKHNNGRSTHK

SEQ ID NO: 205967 - protein, 67 aa, Glycine max
  Coding DNA Sequence Number=SeqID_89189
MEVGQFGVLLSPIALKVVGPLLLGSNSSRDGTNPSSQFPIWQLTNKETKRQVITKEKNEMKAKPIEF

SEQ ID NO: 205968 - protein, 195 aa, Glycine max
  Coding DNA Sequence Number=SeqID_89190
  Homolog annotation: Hit_ID=Q8TGM5; Match level="QueryCoverage=19%, HitCoverage=58%, E-value=1e-07, Identity=74%"; Hit description =Uncharacterized protein ART3
PRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESH

SEQ ID NO: 205969 - protein, 94 aa, Glycine max
  Coding DNA Sequence Number=SeqID_89191
VTYRNDKVVLVKVYVEKPRKKSSSSIQHHHLHYHIHHTIRQEVVHGSGSKGSYGRRAGLLMYSHLLRESARGASSTPSFSKWVANNNFQPPTQM

SEQ ID NO: 205970 - protein, 69 aa, Glycine max
  Coding DNA Sequence Number=SeqID_89192
MAAKKYFVTVFKPEEHSESMLIPDAFVKSTRLQGWRIPEDVILTNVGRRVWNVKTRLVGNKIYFEEGWK

SEQ ID NO: 205971 - protein, 122 aa, Glycine max
  Coding DNA Sequence Number=SeqID_89193
  Gene Ontology: Mol. function=metal ion binding; Biological process =metal ion transport
  Homolog annotation: Hit_ID=Q1SBG7; Match level="QueryCoverage=56%, HitCoverage=31%, E-value=2e-16, Identity=61%"; Hit description=Heavy metal-associated domain, putative
  Pfam annotation: Domain name=HMA; Domain location=5-72; Score=13.9; E_ value=0.051; Accession=PF00403.16; Description=Heavy-metal-associated domain
MKQKIVLQMQLHSDKSRSKALKIAAQEIGVSSVALEGDNKDKLVVTGDVDAVCLGRVLRKKFRCVTLVSVEEVKKKEEKQCINEDNKVCCYYPPYCAPPPCGPSPYCYKVVYDSCDNSCSIM

SEQ ID NO: 205972 - protein, 72 aa, Glycine max
  Coding DNA Sequence Number=SeqID_89194
  Subcellular localization annotation: CTP_CleavageSite=10; ConfidenceScore=5.06e-01
MMHAPDSTLRCNVVRTNNNQISGNSLSVSIRHSHLGNCAEFVETTQVVHVTAPLPQMISMGAQRCSISATTP

SEQ ID NO: 205973 - protein, 100 aa, Glycine max
  Coding DNA Sequence Number=SeqID_89195
  Subcellular localization annotation: CTP_CleavageSite=80; ConfidenceScore=5.24e-01
MGVQIATRPTWALQKIPPEGCCFWRKQPGSPGRAGRQASPLFCYNRGGKNLSRALLKRFRNVFREGFRKGFDRSSTFFIRSSSFFDLQRAKINSPSQARP

SEQ ID NO: 205974 - protein, 69 aa, Glycine max
  Coding DNA Sequence Number=SeqID_89196
MLLKEEILEPGGQVQVHILKWKLKMLRELAKASFSGDTRVDEASTSYTLGEQQHSSGEIYLGNPKRRYY

SEQ ID NO: 205975 - protein, 83 aa, Glycine max
  Coding DNA Sequence Number=SeqID_89197
  Gene Ontology: Mol. function=transporter activity; Biological process= transport
  Homolog annotation: Hit_ID=Q2AUF4; Match level="QueryCoverage=96%, HitCoverage=14%, E-value=1e-15, Identity=45%"; Hit description =Extracellular solute-binding protein, family 5 precursor
EAKESGYHNAEVDKLINAGNAVLDVEQRKPIYHQLYQVLAEDPPVILLGYREILSASSARVTGFKPDIYNGLTGSLPGVKIVK

SEQ ID NO: 205976 - protein, 228 aa, Glycine max
  Coding DNA Sequence Number=SeqID_89198
  Gene Ontology: Mol. function=transporter activity; Cellular component= integral to membrane; Biological process=transport
  Homolog annotation: Hit_ID=Q81VH2; Match level="QueryCoverage=97%, HitCoverage=70%, E-value=2e-67, Identity=57%"; Hit description =Oligopeptide ABC transporter, permease protein
  Pfam annotation: Domain name=BPD_transp_1; Domain location=79-228; Score=37.3; E_value=5.4e-08; Accession=PF00528.12; Description =Binding-protein-dependent transport s
MLLLASFIIFMLFAKTPGDFIDGNITLTAARAAELKAIYGLDQPLFTRYFHWLGQLLRGDLGFSLQYQIPVSQLLNQYIWNSFLLASVALVFYWGIGLTVGVVSALRPNSWFDHLVSIAVFAAMSFPTFFLCLLLIKWFAVDLHWLPVGGMTNTGSDDSGWRYVLQVAAHLVLPVLALVMLQAGSLTRYFRASMLDVVKMDFIRTARAKGLRERTVIMKHALRNALLP

SEQ ID NO: 205977 - protein, 118 aa, Glycine max
  Coding DNA Sequence Number=SeqID_89199
MDKFDIFVPHPFAMTSLLPLECGCKPLVCLLKRHVLLSLDFQDRLIKNYSCYTFGEDVVVKNKTTMVTSEPYTGAMKGTMHKPQANQGQIRSSHPIGSLLQGHDKRQRLVPQSLTLGQ

SEQ ID NO: 205978 - protein, 161 aa, Glycine max
  Coding DNA Sequence Number=SeqID_89200
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=99%, HitCoverage=16%, E-value=3e-74, Identity=69%"; Hit description=DNA -directed RNA polymerase beta'' chain
MDSVGIRSANPYLATPGATVHGHYGEILSEGDILVTFIYEKSRSVDTWNGRITKILGIPWGFLIGAELTIAQSHGMSNVFLPGELIGLLRAERAGRSLEEAICYRVLLLGITKTSLNTQSFISEASFQETARVLSKAALRGRIDWLKGLKENVVSGGMIPV

SEQ ID NO: 205979 - protein, 115 aa, Glycine max
  Coding DNA Sequence Number=SeqID_89201
  Homolog annotation: Hit_ID=Q1T283; Match level="QueryCoverage=94%, HitCoverage=52%, E-value=2e-08, Identity=31%"; Hit description =Nucleic acid-binding, OB-fold
MAPFTCACDKYNKEVVLRYRLEVMINQGNESTKFLLWDRECSELIGQSADAVNKLKIEDGDVDLNVSPQALDKLLGHELAFKIKVQPKFRNFVVLKCSADSSLINAVMDMLANAE

SEQ ID NO: 205980 - protein, 93 aa, Glycine max
  Coding DNA Sequence Number=SeqID_89202
LDDFEAELERHNFHKHLTNLADGSIDLALGETLPAYSRYCRLPTNFREIKAALCIPSRGFILNSKGQPGKILRKDLTTLAQGALISDQMTSIA

SEQ ID NO: 205981 - protein, 86 aa, Glycine max
  Coding DNA Sequence Number=SeqID_89203
MESRAPKWAIFGKQNWRCGMNRKLGYGAQLRANLDPTKGVGRLRQQDGGHGSRNPLRRTGEARLIALCARTPKGNRVKIPEPGRGG

SEQ ID NO: 205982 - protein, 162 aa, Glycine max
  Coding DNA Sequence Number=SeqID_89204
AGKGVLVEAGNYGRCGVEVDGAEGSGKVVEEGAEESGAAKVGGASDLLPLAFLGPLNVTVGSSRLQQFFFIYAKLMAGLRLYKDLESDVTPLALHKVVIKAGNPSLEESCWAMIEIWWEMRSVGGRDQVGVRKNTLSLNECGHVLPKDLQWQAVSIKLKSPP

SEQ ID NO: 205983 - protein, 51 aa, Glycine max
  Coding DNA Sequence Number=SeqID_89205
PLIELVRNNVPSWEDVHEMGVEGRGPEYEETRDLRSNPFQCGGDDAILPPK

SEQ ID NO: 205984 - protein, 74 aa, Glycine max
  Coding DNA Sequence Number=SeqID_89206
PSPSGRGGASAAQEPEPEKPAATVAKGEDELTPHEPFYFDAGVHMAEEEETDSPAAQMLDLNEHAKKQPQEKDI

SEQ ID NO: 205985 - protein, 324 aa, Glycine max
  Coding DNA Sequence Number=SeqID_89207
  Gene Ontology: Cellular component=outer membrane
  Homolog annotation: Hit_ID=Q0T0H3; Match level="QueryCoverage=90%, HitCoverage=31%, E-value=8e-43, Identity=33%"; Hit description=Outer membrane fimbrial user protein
MARIKADSSAYTSVGATWQQQKHEKNQLNYNVAHNWYTDARGENEYGLNASGINSDSLNTSAYTRQGGRFGNGSLTVSDSWDRQDHRHRFSSSGNYSSTLALSRSGLWFGRWGDGRPASAIAVNVATPEASPDSRIAVSLDNSGSADIPANARALFALPGYQQTTLTINESTDISHGANSEITQGSGSRTVFMVPGKMLHREVQTTTRYTWLGQLTDEQHTPFIGGMPLNVSGWSDLGNGGFSAESDSLIQSLYLVKQQQFYQCALKVKTMRDVVRYVGTVTCEELTYSALPETVQQQAQLLLAGRTPAVSPTAMNNSTLSTGK

SEQ ID NO: 205986 - protein, 296 aa, Glycine max
  Coding DNA Sequence Number=SeqID_89208
  Gene Ontology: Cellular component=integral to membrane
  Homolog annotation: Hit_ID=Q669S4; Match level="QueryCoverage=43%, HitCoverage=14%, E-value=3e-67, Identity=93%"; Hit description =Mg(2+) transport protein B, P-type ATPase
MDKEFLRKPRKWDSKNIGRFMLWIGPTSSIFDITTYALMWYVFAANSVEHQALFQSGWFIEGLLSQTLVVHMLRTQKIPFIQSTAALPVLLTTGLVMALGIYIPFSPLGALVGLQPLPWEYFPWLAATLFVDQQAEHDGQREGKQRAEQHILGAHLIVALAQIAETEDRFSRQQKADRRDLPQQHKGQDQRSLQIANLFARAQQRVVVGLGRRRHLRRPVRQQLPDQQAHRQINQAVGHQHQAGLPTPQLPPQRGEQFTGIRRQPQPQQGDYRQMQSLIEQETAGRAQAVHRGDLQ

SEQ ID NO: 205987 - protein, 122 aa, Glycine max
  Coding DNA Sequence Number=SeqID_89209
  Subcellular localization annotation: CTP_CleavageSite=32; ConfidenceScore=5.32e-01
MATFSCSPWRLTPASTPCSGSQWMCVRCTECTASRVAAAARDPMGMRHPKCGATCSQMCQLSTDCHMFENCSMFRNFYGTVRDQNQLTCIVAEIGGTISRLGVEAAALGKGGEAIGQGKKAL

SEQ ID NO: 205988 - protein, 49 aa, Glycine max
  Coding DNA Sequence Number=SeqID_89210
RLFFLYSDGPATSAHYRTGLTPQEKGTEIPRKRRLPVANRIDLGSKIHL

SEQ ID NO: 205989 - protein, 154 aa, Glycine max
  Coding DNA Sequence Number=SeqID_89211
TVRDDEVKALEESDEVQALKAELERAWVVEEKFKSIAIKGSNSEEVKGIITGQRHDLEGRAKGNMWAIIDKCKEKLNLAATHEQRLEDEYAKISAEREARERVIESLHQEATMWTDRFALTLNRSQELPPLLAKAKAVADTYSTPEEIHGLLSY

SEQ ID NO: 205990 - protein, 186 aa, Glycine max
  Coding DNA Sequence Number=SeqID_89212
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=Q0X3V8; Match level="QueryCoverage=91%, HitCoverage=27%, E-value=5e-87, Identity=92%"; Hit description =Glucosamine--fructose-6-phosphate aminotransferase, isomerizing
IPAPRPPPPPHSHRHALGQVARLVHIGAACAGRVVGQQLQRDHVQDGAERAVVLGHADDMHAFAAFDVGLGIGQHIEHAAARAHFLHVALELFQQFVIGRHRDHGHGAVHQGQRAVLELAGRIGLGVDVADFLELERAFQRNRVVDATAQEERVLALGEILGPADDLGLQRQHGLQGHGQVAHGGQ

SEQ ID NO: 205991 - protein, 81 aa, Glycine max
  Coding DNA Sequence Number=SeqID_89213
MDAEKREELEPEKRHANRGRILAFQSSKQSFNLWPSFLPQIAKGGHFRGREVRGYEWDFENSGLGGLLSPLIFVGMGFGEI

SEQ ID NO: 205992 - protein, 82 aa, Glycine max
  Coding DNA Sequence Number=SeqID_89214
  Subcellular localization annotation: CTP_CleavageSite=63; ConfidenceScore=5.64e-01
MARKPRQDFSVSKPPHFFRQLSLSLTLPFSSPSFSIEAPNKASTFGHHFCPKSRKEGIFGVVKCKATSGTSKFQVWVDFFLL

SEQ ID NO: 205993 - protein, 49 aa, Glycine max; identical to SEQ ID NO: 140356
  Coding DNA Sequence Number=SeqID_89215

SEQ ID NO: 205994 - protein, 249 aa, Glycine max
  Coding DNA Sequence Number=SeqID_89216
  Homolog annotation: Hit_ID=Q1SKD7; Match level="QueryCoverage=88%, HitCoverage=56%, E-value=6e-07, Identity=25%"; Hit description =Ankyrin
MASKKRRSIGARPTAQYDTRRFHSLDSWNHYTDNILGRSILPKRKVEIYHTEFDDFKTELERHNLHKRLTNLADGTIDVALVKEFYANLYNSEDPSPKQARVRGHLVKIDADSLNTFLETPVVLEEGETLPTYSRYCRLPIDHREIETALCIPGRGFILNAEGHSRRILRKDLTTLAQVWSILSYSNLAPTSHTSDLTVDRARFIFGLVSHMDMNIDALISGQITSIAQSNSCILGFDYRLMPSLRGCL

SEQ ID NO: 205995 - protein, 72 aa, Glycine max
  Coding DNA Sequence Number=SeqID_89217
MDKWQKENESEENFVGRAVQGVVECEKEEEKKLIEWKNNEEGYVASMSMCSLTEHARWARVQCNEEGLGKKE

SEQ ID NO: 205996 - protein, 154 aa, Glycine max
  Coding DNA Sequence Number=SeqID_89218
MTSINVVLLGWSFRVLFIWLSSSSFVASAVQGKRIVKPSKVAKDIHTDHVASVLNILDDELIKNVGDYILRLLIIFLNKLNWQALCEELTRTAATLVAENENLKREKELALKEYESLETTNKNLKTQIAKSTNTEVEKTPVEPVSSVAEITLHP

SEQ ID NO: 205997 - protein, 73 aa, Glycine max
  Coding DNA Sequence Number=SeqID_89219
MKNLEMGGGLRAGRRGPGWRAVSGGCHDGGLFHAIPNSERVEHAWSESIWPVGLYGLGKKGSFLFGLHFISLA

SEQ ID NO: 205998 - protein, 141 aa, Glycine max
  Coding DNA Sequence Number=SeqID_89220
  Gene Ontology: Mol. function=protein serine/threonine kinase activity; Cellular component=integral to membrane; Biological process=protein amino acid phosphorylation
  Homolog annotation: Hit_ID=Q9LFS4; Match level="QueryCoverage=84%, HitCoverage=18%, E-value=4e-41, Identity=70%"; Hit description =Receptor protein kinase-like protein
  Pfam annotation: Domain name=LRRNT_2; Domain location=30-70; Score =58.6; E_value=2e-14; Accession=PF08263.3; Description=Leucine rich repeat N-terminal domain
  Pfam annotation: Domain name=LRR_1; Domain location=122-141; Score =14.6; E_value=0.37; Accession=PF00560.23; Description=Leucine Rich Repeat
  Pfam annotation: Domain name=LRR_1; Domain location=98-120; Score =15.4; E_value=0.21; Accession=PF00560.23; Description=Leucine Rich Repeat
  Pfam module annotation: Pfam domain module=LRRNT_2::LRR_1::LRR_1; Domain location=30-70::122-141::98-120
MGTPRGIALLSFTSFLFWSSANALLSPKGVNFEVQALMGIKYSLEDPHGVLDNWDGDAVDPCSWTMVTCSSENLVIGLGTPSQSLSGTLSPSIGNLTNLQIVLLQNNNISGPIPSELGKLPKLQTLDLSNNFFKGEIPPSL

SEQ ID NO: 205999 - protein, 76 aa, Glycine max
  Coding DNA Sequence Number=SeqID_89221
MEKSDKMNFKEKKEKKGYITWEDNVINYSSDSEKKIISLNIMMKDYENGEEKSRYIDSNFSKHMACIKVYSFFSPR

SEQ ID NO: 206000 - protein, 113 aa, Glycine max
  Coding DNA Sequence Number=SeqID_89222
  Subcellular localization annotation: CTP_CleavageSite=21; ConfidenceScore=5.10e-01
MRGLVRLATGGVDGKWPAAGRSEAFNQHVTRHFTAVFQQVLKRSLAAFQLLQKFLRRQIVFFAAHVSQRQFFCLIAGEVVHGVLDTVNVSAHDCSERAHNEQRLWRMESIAET

SEQ ID NO: 206001 - protein, 193 aa, Glycine max
  Coding DNA Sequence Number=SeqID_89223
  Gene Ontology: Mol. function=calcium ion binding; Cellular component =cytosol; Biological process=pathogenesis
  Homolog annotation: Hit_ID=Q7FZ95; Match level="QueryCoverage=84%, HitCoverage=93%, E-value=2e-67, Identity=79%"; Hit description =Calcineurin-like protein
  Pfam annotation: Domain name=efhand; Domain location=136-164; Score =0.3; E_value=14; Accession=PF00036.22; Description=EF hand
  Pfam annotation: Domain name=efhand; Domain location=31-59; Score =12.0; E_value=0.64; Accession=PF00036.22; Description=EF hand
  Pfam annotation: Domain name=efhand; Domain location=95-123; Score =29.4; E_value=1.2e-05; Accession=PF00036.22; Description=EF hand
  Pfam module annotation: Pfam domain module=efhand::efhand::efhand; Domain location=136-164::31-59::95-123
MGTASSMLTQYDIEEVQEHCNNLFSQQEIVSLYQRFCQLDRNAKGFISADEFLSVPEFAMNPLSQRLLKMADGLNFKDFVAFLSAFSAKASAQQKIELIFKVYDSDRNGKVSFKDMLEVLKDLSGSFMSDDQREEVLSQVLREAGYTKDSYLTLDDFIKTCGSRNEIYFVSIDFIYLDTLLATVGGLMGNGSY

SEQ ID NO: 206002 - protein, 199 aa, Glycine max
  Coding DNA Sequence Number=SeqID_89224
  Gene Ontology: Mol. function=NADH dehydrogenase (ubiquinone) activity; Cellular component=mitochondrion; Biological process =electron transport
  Homolog annotation: Hit_ID=O22769; Match level="QueryCoverage=83%, HitCoverage=54%, E-value=9e-62, Identity=72%"; Hit description=NADH -ubiquinone oxidoreductase 24 kDa subunit, mitochondrial precursor
  Pfam annotation: Domain name=Complex1_24kDa; Domain location=13-184; Score=137.8; E_value=3e-38; Accession=PF01257.9; Description =Respiratory-chain NADH dehydrogenase 2
HLDTPDNNPKLPWEFTEANQAKVKEILSHYPSNYKQSATIPLLDLAQQQHGGWLPVSAMDAVAKIVEVPPIRVYEVATFYSMFNRAKVKAYYAFMLSMLLIHINTGQSLSGPTCFQVGKYHLLVCGTTPCMIRGSRGIEEALLKHLGVKRNEVTPDGLFSVGEMECMLRASPGAAVKLCLGDLLVMGSNPETTSLHMQG

SEQ ID NO: 206003 - protein, 209 aa, Glycine max
  Coding DNA Sequence Number=SeqID_89225
  Gene Ontology: Mol. function=RNA-directed DNA polymerase activity; Biological process=RNA-dependent DNA replication
MSSKIQRTNRLRILCPNTLEGISFVVQVEGTSTWGLFTENKRGYISCGSVQVEGTSTWVFKENKGGHIPCGSLACKGFYKVEKNLKNRRPLDPTNDSVEAYLDWEIKVEQPFAYHHTCEERKKSALRKRHIPSYYEKELMDKLQRLRQGSMSVEEYRKQMELLLLRAGLREEERTSIARFLSGLNLEVRDKVEVLPYRDLDDLVQLFIR

SEQ ID NO: 206004 - protein, 106 aa, Glycine max
  Coding DNA Sequence Number=SeqID_89226
MEKLMDFKGPSDGTQKNSESERGKSVEQHYIIVQRWRPFFLNNAESVKIDKMRARICVEIASHIISWFEEFPYSSNMRAYTQSAFAVVDMARQENSVSLVEAKRGG

SEQ ID NO: 206005 - protein, 121 aa, Glycine max
  Coding DNA Sequence Number=SeqID_89227
  Gene Ontology: Mol. function=protein binding
  Homolog annotation: Hit_ID=Q1S361; Match level="QueryCoverage=82%, HitCoverage=17%, E-value=9e-20, Identity=53%"; Hit description =Leucine-rich repeat; Leucine-rich repeat, cysteine-containing subtype
MVYSSYLTPASLQPFRDSALQDICLGEYEYANGGGAAAAIVDDAWMDVISSQGSSLLHLDLSASDVTDHGLTFLGHCTNIISLNLNHCHQISDHGLECISGWYSFQYIIHLAYIMNSAKCC

SEQ ID NO: 206006 - protein, 676 aa, Glycine max
  Coding DNA Sequence Number=SeqID_89228
  Gene Ontology: Mol. function=RNA-directed DNA polymerase activity; Biological process=RNA-dependent DNA replication
  Homolog annotation: Hit_ID=Q2HVE2; Match level="QueryCoverage=39%, HitCoverage=40%, E-value=6e-56, Identity=37%"; Hit description =Ribonuclease H
MPNFDSNFIIESDDKGGVQWFLTAVYGSPSRVGRDAQGGPKRDSEFEGFVRRIRLIDAGRILFPQPVVEHLPQFQSDRDPYWSILILVLRLTEDDDLSALKTWNIDVFGSFQTRKKHVLGRLKGLTKPYPKLIEGMVTDFYKTLFHYDGLYDQYCLTGAFPMVDADRLAKLGVPITDDEVRHVVFDIGSFKSAGEDGFQPTEQREHSHPPRGDPFNEEEEREVREFKPSRGITQGDPISPYLFVLCMERLSQMIELIVEQGLWKPIQLGRGGPKLSHLVFADDLILFSEAFLDQVEVINSCLGAFCSSSREKISNEKMKVYFSRNVSWNARNQLSSELDFNCTSNLGKYLGSKNLSMATRLTLTKSVLFALLAYTMQSAYIPRSIYDSLDKICHPFLWGDDDGKRKLRMDMCMNREKLWVKIIRGKYRCGGSVWPHICRNILGSNAWRGICLVWEDFSKKISWHIGDGKDARFWLDQWVPNTGMLIKKDTMPLHESDLTKLVGEVVDDLGAGTSKIRLSYDSKASFSCFGGFSRLPSLGQFQGWELFFKKILSVKLFGDGTVLKELEFSFGGLANKLSSPIRKDGRGTWLMTTFNDNLLSVECVLQWETPRLGNEWEPDAAIIAKATKLAKKVLVVCCKMNWLPPSEHWVKVNCNGAFSETTRRVACGGVIWDDRG

SEQ ID NO: 206007 - protein, 295 aa, Glycine max
  Coding DNA Sequence Number=SeqID_89229
  Gene Ontology: Mol. function=protein binding
  Homolog annotation: Hit_ID=Q6K620; Match level="QueryCoverage=87%, HitCoverage=43%, E-value=5e-65, Identity=54%"; Hit description =Leucine-rich repeat-like protein
  Pfam annotation: Domain name=LRR_1; Domain location=10-32; Score=6.9; E_value=15; Accession=PF00560.23; Description=Leucine Rich Repeat
  Pfam annotation: Domain name=LRR_1; Domain location=106-128; Score =6.9; E_value=15; Accession=PF00560.23; Description=Leucine Rich Repeat
  Pfam annotation: Domain name=LRR_1; Domain location=130-152; Score =3.2; E_value=73; Accession=PF00560.23; Description=Leucine Rich Repeat
  Pfam annotation: Domain name=LRR_1; Domain location=183-205; Score =2.4; E_value=1e+02; Accession=PF00560.23; Description=Leucine Rich Repeat
  Pfam annotation: Domain name=LRR_1; Domain location=207-230; Score =11.2; E_value=2.3; Accession=PF00560.23; Description=Leucine Rich Repeat
  Pfam annotation: Domain name=LRR_1; Domain location=232-254; Score =6.6; E_value=16; Accession=PF00560.23; Description=Leucine Rich Repeat
  Pfam annotation: Domain name=LRR_1; Domain location=256-283; Score =8.6; E_value=7.1; Accession=PF00560.23; Description=Leucine Rich Repeat
  Pfam annotation: Domain name=LRR_1; Domain location=34-56; Score =12.5; E_value=1.3; Accession=PF00560.23; Description=Leucine Rich Repeat
  Pfam annotation: Domain name=LRR_1; Domain location=58-80; Score=6.0; E_value=22; Accession=PF00560.23; Description=Leucine Rich Repeat
  Pfam annotation: Domain name=LRR_1; Domain location=82-104; Score =6.9; E_value=15; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=10 -32::106-128::130-152::183-205::207-230::232-254::256-283::34-56::58 -80::82-104
MSCFLPELPALSNLNLSRCNLSNDGCEKFSRLENLKVLNLGFNDITDACLAHLKGLTKLKSLNLDSCRIEDEGLVHLAGHQQLNCLELSDTGIGSNGLHHLSGLSNLEKINLSFTFVNDSGLSKLCGLSSLKSLNLDARQVTDTGLASLTSMCSVFLCKFTVRTMVWNITTNNITNTDAGFKNLRLLEICGGELTDDGVKNIKELSSLKSLNLSQNCNLTDTTLELISGLTDLISLNVSNSGITNAGLQHLKTLKNLRSLSLESCKVTANGIKKLQSTDLPNLKCIERKSACTIP

SEQ ID NO: 206008 - protein, 43 aa, Glycine max
  Coding DNA Sequence Number=SeqID_89230
MDVLCLVGTSVKPTKHRGRARKASIAARPTKPSTFWKEDDPKN

SEQ ID NO: 206009 - protein, 962 aa, Glycine max
  Coding DNA Sequence Number=SeqID_89231
  Gene Ontology: Mol. function=protein binding; Cellular component =intracellular; Biological process=primary shoot apical meristem specification
  Homolog annotation: Hit_ID=Q1S365; Match level="QueryCoverage=99%, HitCoverage=84%, E-value=0.0, Identity=85%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=WD40; Domain location=280-320; Score =34.2; E_value=4.6e-07; Accession=PF00400.22; Description=WD domain, G-beta repeat
  Pfam annotation: Domain name=WD40; Domain location=324-364; Score =24.0; E_value=0.00054; Accession=PF00400.22; Description=WD domain, G-beta repeat
  Pfam annotation: Domain name=WD40; Domain location=414-453; Score =4.7; E_value=10; Accession=PF00400.22; Description=WD domain, G-beta repeat
  Pfam annotation: Domain name=WD40; Domain location=659-696; Score =6.5; E_value=6.4; Accession=PF00400.22; Description=WD domain, G -beta repeat
  Pfam annotation: Domain name=WD40; Domain location=700-739; Score =9.7; E_value=2.7; Accession=PF00400.22; Description=WD domain, G -beta repeat
  Pfam annotation: Domain name=WD40; Domain location=743-781; Score =36.8; E_value=7.3e-08; Accession=PF00400.22; Description=WD domain, G-beta repeat
  Pfam annotation: Domain name=WD40; Domain location=835-874; Score =4.1; E_value=12; Accession=PF00400.22; Description=WD domain, G-beta repeat
  Pfam module annotation: Pfam domain module=WD40::WD40::WD40::WD40::WD4 0::WD40::WD40; Domain location=280-320::324-364::414-453::659 -696::700-739::743-781::835-874
MELLHVEGLNWQHQLCKNPRPNPDIKTLFVDHSCGQPNGARAPSPANNPLLGSLPKAGGFPPLGAHGPFQPTPAPVPTPLAGWMSNPTTVAHPAVSGGAIGLGAPSIPAALKHPRTPPTNPSVDYPSGDSDHVSKRTRPIGMSDEVNLPVNVLSATFPGHGHGQAFNAPDDLPKTAMRSLNQGSSPMSMDFHPVQQTLLLVGTNVGDIALWEVGSRERLLMRNFKVWDLSACSMPFQAALVKDPGVSVNRVIWSPDGALFGVAYSRHIVQIYSYHGGDDVGQHLEIDAHVGGVNDLAFSHPNKQLCVITCGDDKTIKVWDAATGAKQYTFEGHEAPVYSICPHYKENIQFIFSTALDGKIKAWLYDNLGSRVDYEAPGRWCTTMAYSADGTRLFSCGTSKEGESSIVEWNESEGAVKRTYQGFRKRSLGVVQFDTTKNRYLAAGDDFSIKFWDMDNIQLLTTVDADGGLPASPRIRFNKDGALLAVSANENGIKILANADGIRLLRTLENSLYDTSRTSEAMTKPTINPISAAAAAATSAALAERASSVVAITAMNGDARNLGDVKPRISEESNDKSKIWKLTEINEPSQCRSLKLPENVRVNKISRLIYTNSGNAILALASNAIHLLWKWQRNDRNSTGKATASVQPQLWQPSSGILMTNDITDNNTEDAVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKSRFLQLPAGRTPPAQADTRVQFHQDQIRFLVVHETQLAIYEATKLECLKQWFPRDSSAPISHATFSCDSQLIYASFLDATVCVLSVSNLRLRCRINPSAYLSASVSSNVQPLVIAAHPQEPNQFAVGLSDGGVHVFEPHESEGKWGVPPPIENGSTSNMAATSVGASSDEAQR

SEQ ID NO: 206010 - protein, 65 aa, Glycine max
  Coding DNA Sequence Number=SeqID_89232
MRVARHSKEEGGERCDSGRVRMTSSWHNKAERREEKSCSWGEVEIKRGIGIVKGKSFGKSCQLRK

SEQ ID NO: 206011 - protein, 485 aa, Glycine max
  Coding DNA Sequence Number=SeqID_89233
  Gene Ontology: Mol. function=amino acid-polyamine transporter activity; Cellular component=integral to membrane; Biological process=amino acid transport
  Homolog annotation: Hit_ID=Q8H6S4; Match level="QueryCoverage=98%, HitCoverage=99%, E-value=1e-148, Identity=60%"; Hit description=CTV.3
  Pfam annotation: Domain name=Aa_trans; Domain location=71-479; Score =161.1; E_value=2.9e-45; Accession=PF01490.8; Description =Transmembrane amino acid transporter protein
  Pfam annotation: Domain name=Trp_Tyr_perm; Domain location=71-475; Score=-254.3; E_value=0.0054; Accession=PF03222.4; Description =Tryptophantyrosine permease family
  Pfam module annotation: Pfam domain module=Aa_trans::Trp_Tyr_perm; Domain location=71-479::71-475
MSHRKDNNNYSSLPISSYLELQPQNDSSKSLQRPTFDESEVYLGSKVDDDDDDDLEIDIDNYPLIVMGPNHGSGIPGAVFNLTTTVIGAGIMALPATMKVLGVVLGIVLIVLMGILSEISVELLVRFSVLCKASSYGEVVQHAMGRPARILSEICIIVNNAGVLVVYLIIMGDVMSGSVHHLGVFDQLMGNGVWDQRKLVIFVVMVVFLAPLCSLDKIDSLSLTSAASVALAVLFVIVTFTVAFIKLVEGRIDAPRMAPDFSSKTAILDLLVVIPIMTNAYVCHFNLQPIYNELEQRSPQKMNRVGRYTTILCILVYSSTAISGYLLFGKDTESDVLTNFDKDLGIRFSSALNYIVRVGYILHLILVFPVIHFSLRQTVDALVFEGSPPLSESRKRSLGLTVVLLVLIYIGSTMIPSIWTAFKFTGATTAVSLGFIFPSLVALRLSHQGDLSYGEWILSWLMLVLAVTVSVVGVVGNIYSLESNS

SEQ ID NO: 206012 - protein, 383 aa, Glycine max
  Coding DNA Sequence Number=SeqID_89234
  Gene Ontology: Mol. function=nucleic acid binding; Cellular component= intracellular
  Homolog annotation: Hit_ID=O80897; Match level="QueryCoverage=60%, HitCoverage=83%, E-value=1e-103, Identity=78%"; Hit description =Putative spliceosome associated protein
MDREWGSKPGSGGAASAQNEAIDRRERLRRLALETIDLAKDPYFMRNHLGSYECKLCLTLHNNEGNYLAHTQGKRHQTNLAKRAAREAKDSPAQPQPHKRKVTLRKTVKIGRPGYRVTKQYDPETKQRSLLFQIEYPEIEDLTKPRHRFMSSYEQRVQPFDKSYQYLLFAAEPYEIVAFKVPSTEIDKSTPKFFSHWDPDSKMFTLQLYFKSKPPEANKPQPATTANGTAPSGVPPRPLPPPPQGPLPPPPPPPQGLPPGAPMANPPRAPPPPMPGSMPPPPPMTAANGPRPPPSGGMPSIPPPPPVASGTSGFNMGARPPSMPPPQGFPSQPMQGQGVRLPPPPPNMGHLKREKKTIRSQEYKCYMRKYVWFPKLGSRNSFI

SEQ ID NO: 206013 - protein, 93 aa, Glycine max
  Coding DNA Sequence Number=SeqID_89235
MHLLFEFSRSTSTFGFLKKEKPLTLLIEQMQREKENKLVFFSFQVSYRRLVSGIGYVNSVVASKFYSLDSLFDMINSEKVNRRGGKKERIVRY

SEQ ID NO: 206014 - protein, 287 aa, Glycine max
  Coding DNA Sequence Number=SeqID_89236
  Homolog annotation: Hit_ID=Q8H6Q7; Match level="QueryCoverage=99%, HitCoverage=19%, E-value=1e-120, Identity=78%"; Hit description =CTV.22
  Subcellular localization annotation: CTP_CleavageSite=33; ConfidenceScore=5.21e-01
MSPKALSSAVSDIGSVVSMNDRIAGSAPGNGSRAAVGEDLVAMTNCRLQARNFITQDGANGTRRMKRYTNATPLNVVTSAGSMNDSIKQLAAEASDLDSTATSRFKMPRIEANHSLLEEIREVNQRLIDTVVDISNEEVDPTAAAAAAEGTEGTIVKCSYNAVALSPSLKSQYASAQMVGFKTLKPYAYQSPIQPLRLLVPTNYPNCSPILLDKFPVESSKENEDLSVKAKSRFSISLRSLSQPMSLGEIARTWDVCARTVISEHAQQSGGGSFSSKYGTWENCLTT

SEQ ID NO: 206015 - protein, 199 aa, Glycine max
  Coding DNA Sequence Number=SeqID_89237
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q9M6E8; Match level="QueryCoverage=56%, HitCoverage=17%, E-value=1e-41, Identity=72%"; Hit description=9-cis- epoxycarotenoid dioxygenase
  Subcellular localization annotation: CTP_CleavageSite=29; ConfidenceScore=5.26e-01
MFKDSPLCVVLKYQPTSTTTTTTTTTTTPARETKPVIASPSETKHPLPQKWNFLQKAAASALDMVEIGLVSHERQHPLPKIADLRVQITGNFTPVPEHLAHQFLPVIGKIPKCIECVYICNGANPLYEPVVGHHFFDRDDMEELAFIREAHKVQARRVMLEEVESFGLDWEKGRGEKKKDLSEQQEGSTDVKFVKYERT

SEQ ID NO: 206016 - protein, 86 aa, Glycine max
  Coding DNA Sequence Number=SeqID_89238
MGPIFVKPKESSKTFAYFLYKPSSPLSPSDDPLLQETPFEIVEYHSNVGVGGHVELHPSVRRADAAIHQAMEVLVDTKGLSHTLRC

SEQ ID NO: 206017 - protein, 225 aa, Glycine max
  Coding DNA Sequence Number=SeqID_89239
  Gene Ontology: Mol. function=transferase activity, transferring hexosyl groups; Biological process=metabolic process
  Homolog annotation: Hit_ID=Q94DI0; Match level="QueryCoverage=95%, HitCoverage=37%, E-value=7e-37, Identity=37%"; Hit description =Pentatricopeptide (PPR) repeat-containing protein-like
  Pfam annotation: Domain name=PPR; Domain location=104-138; Score=9.5; E_value=0.56; Accession=PF01535.11; Description=PPR repeat
  Pfam annotation: Domain name=PPR; Domain location=32-66; Score=25.8; E_value=0.00015; Accession=PF01535.11; Description=PPR repeat
  Pfam annotation: Domain name=PPR; Domain location=68-101; Score=8.9; E_value=0.66; Accession=PF01535.11; Description=PPR repeat
  Pfam module annotation: Pfam domain module=PPR::PPR::PPR; Domain location=104-138::32-66::68-101
MEDCGLGAAGNKEQAHEFMNRIEASRSSPDRKTWDSLIEGHCVAGNLDKAFESFKEIVEKEGVASAGYSFDVLMNSYCQMNRAVDASKILCRLVNEKKLKPWHSTYKLLVTKLLVQGGFTDALNILGLMRTLGFPPFTDPFIEHLSKSGSGNAAALFLKAMTSKRFPSTSMFLCMFEAFFKNGRHEEAQNFLSKCPRYIRNHADVLNLFCSMNSKEAASSGMLAA

SEQ ID NO: 206018 - protein, 501 aa, Glycine max
  Coding DNA Sequence Number=SeqID_89240
  Gene Ontology: Mol. function=RNA-directed DNA polymerase activity; Cellular component=chromatin; Biological process=chromatin assembly or disassembly
  Pfam annotation: Domain name=RVP_2; Domain location=354-488; Score= -47.2; E_value=0.0048; Accession=PF08284.2; Description=Retroviral aspartyl protease
  Pfam module annotation: Pfam domain module=RVP_2::Retrotrans_gag; Domain location=354-488::164-251
MEVEQNIEHYAATKDAKEAAKTEHTKEPNKEECKKSKRKMNKPQYLKDYAMKHKLPKSVKKFHPELYKNIYKYERDASNPRIDCAYDPKQLGAFIELMVESTHSKSTMDRLEEALAKLASNVTEKLDDLLLRVTALETNPHHSPSPSSSSVIPTPNPQTVSQSRMKLDGPALAWFQWIMRNHQLTTWPGFLRAIEARFAHSPYEDPIGLLFKLTQKGSVQDYLNQFETLANRIIELPPSFLLNCFVSGLDPNICHEVQEEKLLECRKGPHSRFPLMIKPSTPAPTPVPLATPNLPLLPSPTKTPPLPVRRLTPEELASRCERGLCFYYDEKFMRGHRCALRFFLLVVDEEHENDTLSPKIGTLHALSGHTTPETLRMVGRIIHHRIVILIDEGNTHNFVQEHLVKSFGLIAQPTPTLRVLIGNGNEVQSSTVCHDVVVHVQGRAFTVDLHVLPLCGADVVLRVQWLKSLGLVMTDYSTLSMKFIYEGTLIELKGDSDAPLT

SEQ ID NO: 206019 - protein, 145 aa, Glycine max
  Coding DNA Sequence Number=SeqID_89241
  Gene Ontology: Mol. function=oxidoreductase activity; Biological process=metabolic process
  Homolog annotation: Hit_ID=Q1RY43; Match level="QueryCoverage=96%, HitCoverage=50%, E-value=2e-32, Identity=53%"; Hit description=Short- chain dehydrogenase/reductase SDR
  Pfam annotation: Domain name=adh_short; Domain location=24-142; Score= -32.1; E_value=0.00072; Accession=PF00106.15; Description=short chain dehydrogenase
MEPQHVTDQNIETQKSSTKGLADKVAVITGGARGIGAAAAKLFAEIGAHVVIADVLDDLGTTMAESIGGRYIHCNVSKEDDVESAINLALSWKGNLDIMLSNAGIEGPKGSVTTLDMDQVRHLFSINLHGINHAARAMIKGNNNK

SEQ ID NO: 206020 - protein, 73 aa, Glycine max
  Coding DNA Sequence Number=SeqID_89242
MASSPPPSPFSRPHSQSLSAQADTDNLLVVDIFSKPADSEDFKTLLDSNRVMITHDAVLAVLWKLDSNVEAAR

SEQ ID NO: 206021 - protein, 153 aa, Glycine max
  Coding DNA Sequence Number=SeqID_89243
  Homolog annotation: Hit_ID=Q8S6H8; Match level="QueryCoverage=31%, HitCoverage=9%, E-value=4e-07, Identity=56%"; Hit description =Putative retroelement
MKSRERSSHGLAETGKGQKRPDWRRRSFCELWLTSSLPPHGLLWTIEVSVGIIENALFEAQKLLISCQLVLQHRLRNLHCRLDIECENHNPINAREQPPYWSLCVRLDYKGNEKVRQPQNGCRTKGLLKIAKGLVCRGCPLKGILCQQSSERR

SEQ ID NO: 206022 - protein, 198 aa, Glycine max
  Coding DNA Sequence Number=SeqID_89244
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=47%, E-value=4e-32, Identity=43%"; Hit description =Integrase, catalytic region
  Pfam annotation: Domain name=Chromo; Domain location=120-171; Score =19.0; E_value=0.0057; Accession=PF00385.14; Description='chromo' (CHRromatin Organisation MOdifier
MAKTFMDIAEKIHDLSHSLVEAVDEWLTHRDEVLASLARKLNKAQQRIKEFADQKWCDVNFEVGDMVTQRIGAVAYKLDLPSTSKIHPVFHCSLLKPFQSDTTTIPLKLPALSEDNQPLITPLTILDTKSEKTASGKQLLVMVQWKGLFPEDTSWEKWEELKENYNLEDKVVLDIRGDVMEVEQNIEHYATTNDAEEA

SEQ ID NO: 206023 - protein, 400 aa, Glycine max
  Coding DNA Sequence Number=SeqID_89245
  Gene Ontology: Mol. function=adenosylmethionine decarboxylase activity; Cellular component=cellular_component; Biological process =spermidine biosynthetic process
  Homolog annotation: Hit_ID=Q8LKJ7; Match level="QueryCoverage=88%, HitCoverage=97%, E-value=1e-145, Identity=72%"; Hit description=S -adenosylmethionine decarboxylase
  Pfam annotation: Domain name=AdoMetDC_leader; Domain location=1-51; Score=101.9; E_value=1.8e-27; Accession=PF08132.2; Description=S -adenosyl-l-methionine decarboxylase
  Pfam annotation: Domain name=SAM_decarbox; Domain location=48-378; Score=692.7; E_value=2.8e-205; Accession=PF01536.7; Description =Adenosylmethionine decarboxylase
  Pfam module annotation: Pfam domain module=AdoMetDC_leader::SAM _decarbox; Domain location=1-51::48-378
MESKGGKKKSSSSKSFLYEAPLDYIIEDVRPHGGIKKFRSAAYSNMAGSAIGFEGYEKRLEISFFEHGVFADPEGIGLRALSKDQLDEILKPAECSIVASLSNDYVDSYVLSESSLFIYPYKIIIKTCGTTKLLLSIPVILKLADALDIAVKSVRYTRGSFIFPGAQSFPHRSFSEEVSVLDSYFSNLGSGSKAYVMGDPSKSQIWHIYSASAQTKGSSEVVYGLEMCMTGLEKESASVFFKENTSSAALMTENSGIRKILPQSDISDFEFDPCGYSMNGIEGGAISTIHVTPEDGFSYASFEAVGYDFDEMALGELVERVLACFRPAEFSVALHIDMHGEKLNKFPLDIKGYYCGERSYEELGVGGAVVYQSFVQGCDGSTSPRSILKCCWSEDENEDE

SEQ ID NO: 206024 - protein, 155 aa, Glycine max
  Coding DNA Sequence Number=SeqID_89246
MGFIGLVTWSGARRLRKKGLERLKECLRVILTNSYKPPFNTIGQVSNSIHTTWNSNFRAGTTKGVAIPNMESEPSRKVINPSFNHNRVNTLHTCSTVEHVEVDEVELDVWMKMHEEARLDVIVDEGVGKTTMMQGNSRSGMGVLAKGVLLSARVF

SEQ ID NO: 206025 - protein, 43 aa, Glycine max
  Coding DNA Sequence Number=SeqID_89247
MATPLIFSLGDSRFGLSILPLSSLHENFFDDEKHDWTLHSNWN

SEQ ID NO: 206026 - protein, 135 aa, Glycine max
  Coding DNA Sequence Number=SeqID_89248
  Subcellular localization annotation: CTP_CleavageSite=49; ConfidenceScore=5.16e-01
MVFLLSFLDPSSHRLAFGLPRPSNDFKLKEPARLGEPVTSGVSLSSPEQAAMVPSSLFSIYKCAREDDEGFQGSEGEGIERKEKEEEERRGNEVEALPNHNRDQIPTSFLVRCSSCDRLLKELRRSEFLIAPEDT

SEQ ID NO: 206027 - protein, 87 aa, Glycine max
  Coding DNA Sequence Number=SeqID_89249
  Subcellular localization annotation: CTP_CleavageSite=40; ConfidenceScore=5.41e-01
MGVQIVISNLGPSRGFWAISCLRLKQPSSPGRARKQPSLPGRAGRQPPPLFPINRLKEVVLRIPDAPGEVFQLFWVKKNCFREENPS

SEQ ID NO: 206028 - protein, 83 aa, Glycine max
  Coding DNA Sequence Number=SeqID_89250
MQQQQQQQQQSLIPLCEVGYMDYMTSLTVKNQTFRDIIESKVSLDENLRMHAKQDQRREIECERESEPDRGWQMVVANFPAVA

SEQ ID NO: 206029 - protein, 528 aa, Glycine max
  Coding DNA Sequence Number=SeqID_89251
  Homolog annotation: Hit_ID=Q1S375; Match level="QueryCoverage=99%, HitCoverage=39%, E-value=9e-40, Identity=60%"; Hit description =Globin-like
MDTLKRHLPVTGQEGLHELQKIAQRFEEKIFTAATSQSDYLRKISLKMLTMETKSQGSMAPNLPTNQGGPSNKPPDPGLGIPPQVHNPGQQHPIPMPNQPPNRQQLLPQNIQNSIASQPSNIAQAPIQNVGQNNPNMQNIPGQNSVGSTISQNSNMQNMFPGSQRQIQGRQQVVPQQQQQQSQNSQQYIYQQQMQHQLLRQKLQQQQQQQQQQQQQQQQQQQQQQQNLLQSNQLQSSQQPAIQTSTVMQQPSMMQASLPSIQHNQQSNNQQSTQSVLQQHSQVIRQQQHQQTSIIHQQQTPMTQQSILPTQQQQQQQLMGAQANAPNMHHTQILGSQNNVGDLQQPQRLLTQQNNLSNLQQQQLINQQNNLSNMHQQLGNNVPGLQPQQVLGPQSGNSGMQTSQHSAHVLQQSQQNASNLLPSQVQQSQPQAPQQQLMPQIQSQPAQLQQQLGLQQQPNPLQRDVQQRLQASGPLLQQSNVLDQQKQLYQSQRPLPETSSTSLDSTAQTGQSSGGDWQEEVYQKIFVK

SEQ ID NO: 206030 - protein, 89 aa, Glycine max
  Coding DNA Sequence Number=SeqID_89252
MMIWKQRAKLVMATARWALKHPVYGIVILRLGIYTNKPNISKLCSFIGSMKPSILISVIQENKLLATTFLNEKLYTVPEFQQTLLTTTK

SEQ ID NO: 206031 - protein, 445 aa, Glycine max
  Coding DNA Sequence Number=SeqID_89253
  Gene Ontology: Mol. function=RNA-directed DNA polymerase activity; Cellular component=mitochondrion; Biological process=RNA-dependent DNA replication
  Homolog annotation: Hit_ID=Q5N752; Match level="QueryCoverage=78%, HitCoverage=64%, E-value=3e-37, Identity=30%"; Hit description =Pentatricopeptide (PPR) repeat-containing protein-like
  Pfam annotation: Domain name=PPR; Domain location=180-214; Score =21.9; E_value=0.0023; Accession=PF01535.11; Description=PPR repeat
  Pfam annotation: Domain name=PPR; Domain location=215-249; Score =38.8; E_value=1.8e-08; Accession=PF01535.11; Description=PPR repeat
  Pfam annotation: Domain name=PPR; Domain location=250-284; Score =26.8; E_value=7.9e-05; Accession=PF01535.11; Description=PPR repeat
  Pfam annotation: Domain name=PPR; Domain location=285-319; Score =10.8; E_value=0.39; Accession=PF01535.11; Description=PPR repeat
  Pfam annotation: Domain name=PPR; Domain location=353-387; Score =24.3; E_value=0.00043; Accession=PF01535.11; Description=PPR repeat
  Pfam annotation: Domain name=PPR; Domain location=388-422; Score =20.4; E_value=0.0066; Accession=PF01535.11; Description=PPR repeat
  Pfam annotation: Domain name=PPR; Domain location=70-104; Score=12.0; E_value=0.28; Accession=PF01535.11; Description=PPR repeat
  Pfam module annotation: Pfam domain module=PPR::PPR::PPR::PPR::PPR::PP R::PPR; Domain location=180-214::215-249::250-284::285-319::353 -387::388-422::70-104
MRRGLISISRSSLLRPFQWHLSTATATTTPPPDDATVRQTLLSFNNDWKRALEFFNWVEESHSQFHHSTDTFNLMLDILGKFFEFKLCWDLIRRMNAHPSSPPNHATFRLMFKRYVSAHSVNDAIDTFNRLGEFNLKDHTSFSNLLDALCEYKHVLEAQDLLFGNDNRVTLSVDPIGNTKIHNMVLRGWFKLGWWSKCNEFWEEMDKKGVHKDLHSYSIYMDILCKGGKPWKAVKLFKEIKKKGFKLDVVVYNIVIRAIGLSHGVDFSIRVFREMKELGIKPTVVTYNTLIRLLCDCYRHKEALALLRTIMPSDGCHPTAVSYHCFFASMEKPKQILAMFDEMVESGVRPTMDTYVMLLNKFGRWGFLRPVFMVWNKMKQLGCSPDAAAYNALIDALVDKALIDMARKYDEEMLAKGLSPKPRKELGTKLLAADESQNTIQTQHY

SEQ ID NO: 206032 - protein, 239 aa, Glycine max
  Coding DNA Sequence Number=SeqID_89254
  Gene Ontology: Mol. function=oxidoreductase activity, acting on the CH-OH group of donors, NAD or NADP as acceptor; Cellular component =chloroplast; Biological process=branched chain family amino acid biosynthetic process
  Homolog annotation: Hit_ID=P93832; Match level="QueryCoverage=98%, HitCoverage=51%, E-value=1e-68, Identity=57%"; Hit description=3 -isopropylmalate dehydrogenase 2, chloroplast precursor
  Pfam annotation: Domain name=Iso_dh; Domain location=41-239; Score= -22.4; E_value=1.5e-11; Accession=PF00180.10; Description =Isocitrateisopropylmalate dehydrogenase
  Subcellular localization annotation: CTP_CleavageSite=33; ConfidenceScore=5.25e-01
MAASLQLFQCKLARPFRSFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPKKLHIPALLVVPWNGRRTDQENLRDVFYDMLVDASTLKREVAEGVDIMLIRELTGGIYFGEPRGFGTNENGEEIGFNTEIYATHEINEG

SEQ ID NO: 206033 - protein, 80 aa, Glycine max
  Coding DNA Sequence Number=SeqID_89255
MKIPFYFSVLLLLLLIDSGNQVHMAVVPEHVHCENLILRNDYCDLENDPCNAHCKLFLSSACYVGRAFPSLPRAAFLKCS

SEQ ID NO: 206034 - protein, 59 aa, Glycine max
  Coding DNA Sequence Number=SeqID_89256
MKDGVDLIPISSRNAKPPGVELWAVLDVPIGPVPEIGKCGCLYEMKFYIHHLQNFDMQE

SEQ ID NO: 206035 - protein, 2370 aa, Glycine max
  Coding DNA Sequence Number=SeqID_89257
  Gene Ontology: Mol. function=RNA splicing factor activity, transesterification mechanism; Cellular component=spliceosome; Biological process=nuclear mRNA splicing, via spliceosome
  Homolog annotation: Hit_ID=Q9T0I6; Match level="QueryCoverage=98%, HitCoverage=98%, E-value=0.0, Identity=88%"; Hit description =Splicing factor-like protein
  Pfam annotation: Domain name=Mov34; Domain location=2133-2239; Score =57.3; E_value=4.9e-14; Accession=PF01398.11; Description=Mov34MPNPAD- 1 family
  Pfam annotation: Domain name=PRO8NT; Domain location=78-241; Score =397.6; E_value=1.9e-116; Accession=PF08082.2; Description=PRO8NT (NUC069) domain
  Pfam annotation: Domain name=PROCN; Domain location=426-834; Score =1107.4; E_value=0; Accession=PF08083.2; Description=PROCN (NUC071) domain
  Pfam annotation: Domain name=PROCT; Domain location=2245-2369; Score =303.2; E_value=4.9e-88; Accession=PF08084.2; Description=PROCT (NUC072) domain
  Pfam module annotation: Pfam domain module=Mov34::PRO8NT::PROCN::PROCT ; Domain location=2133-2239::78-241::426-834::2245-2369
  Subcellular localization annotation: CTP_CleavageSite=43; ConfidenceScore=5.17e-01
MWNNGQILPPGTSVPPIPPPPAAQPSYTVLPPPPPTPVPMETEADAEARLEEKARKWQQLNSKRYSDKRKFGFVETQKEDMPPEHVRKIIRQVFFPSESESCSDHGDMSSKKYRHDKRVYLGALKFIPHAVYKLLENMPMPWEQVRDVRVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMFIKAEDPDLPAFYYDPLIHPITSANKERREKRVYEDDDDDDWILPDGVEPLLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETKHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAHEANQVTAVTTKTTNVHGEELIVTTTSPYEQAAFGSKTDWRVRAISATNLYLRVNHIYVNSEDIKETGYTYIMPKNILKKFICVADLRTQISGYMYGISPPDNPQVKEIRCIVMPPQWGTHQQVHLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMVPDNGPWNYNFMGVRHASGMKYGVKLGTPREYYHEDHRPTHFLEFSNMEEVEITAEGDREDTFS

SEQ ID NO: 206036 - protein, 312 aa, Glycine max
  Coding DNA Sequence Number=SeqID_89258
  Gene Ontology: Mol. function=DNA binding; Biological process=electron transport
  Homolog annotation: Hit_ID=Q1S6E0; Match level="QueryCoverage=99%, HitCoverage=100%, E-value=1e-75, Identity=54%"; Hit description =Ubiquitin system component Cue; UBA-like
MSAAVCGSKRSLFEELPPSPPVSKRLRCSSSPIRLSLPSLIDHLRPLFPHMDDQVLERALQECGNDLDAAIKSLHGLCLGSADDNSQPAPQPDHPNLVVDTGALEENGDASASGDQPAAANFPAGGAEWIDLFVREMTCATSVDDARSRAARLLEVLEKSITAHASSGVTTALQRGEELIVCVCDLGGQTDELDGCGCVWEGDYGGWNFEAGFFDSVRVRVGCKYGENLMLKEHIEALTKEKNCFKSAFRIQLERLSDYENRNQELQQLKQLVSQYQEQIRTLEVNNYALRMHLNQAQQYSPFPGCFPPDAF

SEQ ID NO: 206037 - protein, 114 aa, Glycine max
  Coding DNA Sequence Number=SeqID_89259
  Subcellular localization annotation: CTP_CleavageSite=49; ConfidenceScore=5.03e-01
MVSKGWSFDGASMVRKKKGIATLHGAGGLARSPTFHCWGGGGVRLLRLRAQLIQVLRWIRSQLMRQMMLMQVPRILRWMCDVVPCGACRPWIIFINGVLCFLKINDNGMEKEER

SEQ ID NO: 206038 - protein, 177 aa, Glycine max
  Coding DNA Sequence Number=SeqID_89260
MACKKKCASSSRPQESYGSSRFVLEEAWDWYQTNVYLRSILPERNSELAYSHYDKFLQQLERHQCHRNLTRQMENHIDVALVKKFYSNLYDLEDRSPRQCKVRGKLIKFDATTLNTFLEIPVVLKAKERCPEYSRYCHTYPDHRAITAKLCIPGWGFMLNVEGAPSKLLRKDLTTLA

SEQ ID NO: 206039 - protein, 108 aa, Glycine max
  Coding DNA Sequence Number=SeqID_89261
MKVGLAVETKLENHSSHEDNNKTTKPRIERKKWREWGNKSEVGRMVRVGGLGQFMKLPAVMDCALTTAMRLVRSLTTVMALKYQTLSEGISLSDLRTKSFGLPPNVLL

SEQ ID NO: 206040 - protein, 68 aa, Glycine max
  Coding DNA Sequence Number=SeqID_89262
MRLLSFETNVRGANTFLKRTSWSKEVGELEDANGLGGGGATRGASAGALRDPEKVIKGSSRFQQFLWM

SEQ ID NO: 206041 - protein, 80 aa, Glycine max
  Coding DNA Sequence Number=SeqID_89263
MDCSALHGNEGFKYTKGVKDEGIGNKGSLSNFFALSGHSPSKQHSLLSEFDVLSMNYHASTSLSIPCLYICKIKSSNCMN

SEQ ID NO: 206042 - protein, 547 aa, Glycine max
  Coding DNA Sequence Number=SeqID_89264
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=P49972; Match level="QueryCoverage=94%, HitCoverage=97%, E-value=0.0, Identity=86%"; Hit description=Signal recognition particle 54 kDa protein 2
  Pfam annotation: Domain name=CbiA; Domain location=104-284; Score= -30.5; E_value=0.026; Accession=PF01656.13; Description=Cobyrinic acid a,c-diamide synthase
  Pfam annotation: Domain name=MMR_HSR1; Domain location=102-251; Score= -19.8; E_value=0.065; Accession=PF01926.13; Description=GTPase of unknown function
  Pfam annotation: Domain name=MobB; Domain location=102-222; Score= -36.5; E_value=0.039; Accession=PF03205.4; Description=Molybdopterin guanine dinucleotide synthesis protein B
  Pfam annotation: Domain name=SRP54; Domain location=100-296; Score =409.4; E_value=5.2e-120; Accession=PF00448.13; Description=SRP54 -type protein, GTPase domain
  Pfam annotation: Domain name=SRP54_N; Domain location=2-88; Score =100.5; E_value=5.1e-27; Accession=PF02881.9; Description=SRP54-type protein, helical bundle domain
  Pfam annotation: Domain name=SRP_SPB; Domain location=327-460; Score =127.7; E_value=3.3e-35; Accession=PF02978.9; Description=Signal peptide binding domain
  Pfam module annotation: Pfam domain module=CbiA::MMR_HSR1::MobB::SRP54 ::SRP54_N::SRP_SPB; Domain location=104-284::102-251::102-222::100 -296::2-88::327-460
MVLAELGGSISRALQLMSNATVIDEKVLNDCLNDITRALLQSDVQFKLVRDMQTNIKNIVNLDDLAAGHNKRRIIQQAVFNELCKILDPGKPSFTPKKGKTSVVMFVGLQGSGKTTTCTKYAYYHQKKGWKPALVCADTFRAGAFDQLKQNATKAKIPFYGSYMESDPVKIAVEGVERFKKENCDLIIVDTSGRHKQEASLFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQGKAAYNIPPPYLRIAKSLWAMGYEVFSMLPGFSAELMPKGREKESQAKIKRYMTMMDSMTNEGKHYVLIVLDSSNPKLMNESRMMRIARGAGRQIREVMEMLEEYKRLAKIWSKMKGLKIPKKGDMSALSRNMNAQHMSKVLPPQMLKQIGGMGGLQNLMKQMGSAKDMMGMGGMFGGGGGGDYSIGVGVPSAIAAMGA

SEQ ID NO: 206043 - protein, 727 aa, Glycine max
  Coding DNA Sequence Number=SeqID_89265
  Gene Ontology: Mol. function=phosphoinositide binding; Biological process=cell communication
  Homolog annotation: Hit_ID=Q1S2J1; Match level="QueryCoverage=89%, HitCoverage=98%, E-value=1e-143, Identity=42%"; Hit description=Phox- like
  Pfam annotation: Domain name=PX; Domain location=87-199; Score=47.3; E_value=5.3e-11; Accession=PF00787.14; Description=PX domain
MHMHWLGPDVPVFDPNFTYNHHRPYLYDDDLFPNDAVSARRHDAVSAHHHDGTSPLPLGMDWSPPPRLWEGRSTVWPRHPPTGWSFCVTLPSWVTAPQSPPSDPVAFFRVQVGVQSPQAITTSRLLLRRFSDFVNLFSQLKKEFPIKDLPTPPPKKILRIKSHTVLEERRLLLADWMEKLLSDVDVSRSAPVAIFLELEAAARSSFHDVNEHVSDEASANATTPSQMIQDTSPGSVKAHGSSAAIVPGNDEVSELGTPQHGMDNRSDQIMDNSTLEHGLINPTETDVHYATSSENFVYKDNITDKVTGYTADAIALHLDGTEFTPAVRDYNLNAHVKRLSTESIRSDLSSLRNTETSNLTTTTLVQDASHNLAGSHEVSRNSDLFLTFPLDERHKLNKILNTQKQRLVTAKADVEDLIARLNQEMAARQYLVTKVKDLEVELETTRLNCRENMQQAVLTEKERFTQMQWDMEELRRKCLETEMKLKLEEDERLLAESTKESVIQEKQMLQQELDVAREQFKHLQKHHDEFEMKSKTDLKVLIKEVKSLRNSELELKQQLSELMKEKLDLERILQKEKQRMENSHNANTKLLHECAILQKRLRECSVNFLVEEEDKLNIDTLPSDALDLLATSDNRIGLLLAEAQLLAQDVEDTVVAVEETRDITTDNTGKTHDELRKMLAHMFVDNASLRKQINSVIRCALNANINSEEDGEEIHLQKTVLSKFLER

SEQ ID NO: 206044 - protein, 268 aa, Glycine max
  Coding DNA Sequence Number=SeqID_89266
  Gene Ontology: Mol. function=oxidized purine base lesion DNA N -glycosylase activity; Biological process=base-excision repair
  Homolog annotation: Hit_ID=O80358; Match level="QueryCoverage=99%, HitCoverage=67%, E-value=5e-89, Identity=61%"; Hit description=AtMMH- 1 protein
  Pfam annotation: Domain name=Fapy_DNA_glyco; Domain location=2-138; Score=42.8; E_value=1.1e-09; Accession=PF01149.14; Description =Formamidopyrimidine-DNA glycosylase
  Pfam annotation: Domain name=H2TH; Domain location=152-244; Score =135.3; E_value=1.7e-37; Accession=PF06831.4; Description =Formamidopyrimidine-DNA glycosylase H2
  Pfam module annotation: Pfam domain module=Fapy_DNA_glyco::H2TH; Domain location=2-138::152-244
MPELPEVEAARRAVEYNCVGKRITKCVVADDSKVIHGVSPSDFQASVLGKLIVAAHRMAGAIYIKGAAVTNYKSYCHDLKNKHACRSAVKDEDEWPSKYSKIFIEDSDYTAEFTSFAMKLDDGLELSFTDKRRFAKVRLLKDPTSVPPISELGPDALFEPMTLEKFTESLHKKKTEIKALLLDQSFISGIGNWVADEVLYQARIHPRQVASSLSNESCSNLSKCIKEVIEKAIEVGAESSQYPTNWIFHSREKKPGKAFVDGLLPNFV

SEQ ID NO: 206045 - protein, 263 aa, Glycine max
  Coding DNA Sequence Number=SeqID_89267
  Gene Ontology: Mol. function=oxidoreductase activity, acting on single donors with incorporation of molecular oxygen, incorporation of two atoms of oxygen; Cellular component=cytoplasm; Biological process=flavonoid biosynthetic process
  Homolog annotation: Hit_ID=Q1RX84; Match level="QueryCoverage=90%, HitCoverage=76%, E-value=1e-44, Identity=40%"; Hit description=2OG -Fe(II) oxygenase
AINYGTSSSLLDKVRQVAREFFEQPMEQKKIISKGVEEFEGYGADPVPEEGQSLDWSDRLFLDVSEDTRKPSLWPENPSSLRDAVEEYSAKMREATNLISKAIAKSLDLEENCFLNQFGEQALLQGRISQRGRKTKSKKILYEKYAPRSTIKDGQVDSHLNDKFVLFCHIMTNGIFKSPVHRVLANSKRERISVAMFYTPEPNKEIGPEQSLVNEEQPRYYADTHWKYYQRGMRAIHVAKDITVVARLLESRALNKIKPIDAN

SEQ ID NO: 206046 - protein, 146 aa, Glycine max
  Coding DNA Sequence Number=SeqID_89268
MGKAHMTGIKGAPYQRRMDALTVTDVYWMPYAEHRGFLGRWRQTTWSDFFGFRTRSSCGPRRLLKPRHPPPPHDEEFVEPPIPEVSIASDLPTHSVVDCEGCQGMAEDLERVINLRMVTEGTDLYDIMTRCLRGTRGDAADGSLRS

SEQ ID NO: 206047 - protein, 197 aa, Glycine max
  Coding DNA Sequence Number=SeqID_89269
  Gene Ontology: Mol. function=protein binding; Cellular component =cytoplasm; Biological process=proteolysis
  Pfam annotation: Domain name=Transposase_21; Domain location=55-184; Score=-0.2; E_value=1.4e-14; Accession=PF02992.5; Description =Transposase family tnp2
MSKCPRCGASWYKVKEDEDCSSDENLKKGPPAKVLWYLPIITRFKRLFANGDNAKDLTWHANGRNYDGMRKYMMLSMMISCLRQPGNDIDVYLSPLIEDLRKLWGEGVLVFDGFRNETFEMCAMHFCTISDFPAYWNLSGYSVKVHHACPILKGYTKNLHRSEASIVERYIAEEAIEFCSDYIEKAKPVGLPESQKH

SEQ ID NO: 206048 - protein, 95 aa, Glycine max
  Coding DNA Sequence Number=SeqID_89270
  Subcellular localization annotation: CTP_CleavageSite=49; ConfidenceScore=5.09e-01
MHMTQMQFTNTGAREIVSFLDTTFGGSKVPKRMYFKKATRTLCRFAKVRGSKTKPTHDAYAKGTTRGCIIPFEEHTAAVGTTSNNMFSKKKALDE

SEQ ID NO: 206049 - protein, 317 aa, Glycine max
  Coding DNA Sequence Number=SeqID_89271
  Gene Ontology: Mol. function=chitin binding; Cellular component =extracellular region; Biological process=chitin metabolic process
  Homolog annotation: Hit_ID=UPI000044A8F0; Match level="QueryCoverage =73%, HitCoverage=99%, E-value=2e-40, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALTFRGLHVLAFRGLCILAFKGLHALTFRGRHNLTFRGLHVLSLRGLHVLGFRGLHVLAFKGLHALTFRGLHVLTFKGLHAFTFSGLHVLGFRGLHVLAFRGLHTFTFRGPHILAFRGLHVLTFRGLHTLIFIGLHVLTFRGLHVLTFRGLHILAFRGLHVLTFRGLHVLAFRGLHILAFRGLHALAFRGLHALAFRGSHALALRGPHALTFRGLHVLDFKGVHVLTFRGLHALVRTARPHLQKAERPRLQRITRPHLERPTHPRLRRTICPHLQRATGPRLQGTQGPLPLMLNRGLHSWLRGQWFPFISSWATI

SEQ ID NO: 206050 - protein, 261 aa, Glycine max
  Coding DNA Sequence Number=SeqID_89272
  Homolog annotation: Hit_ID=Q47522; Match level="QueryCoverage=18%, HitCoverage=59%, E-value=2e-21, Identity=97%"; Hit description=LacZ protein
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLNSMSPSALSLASLTQPHTRFSKGCLHFAHDWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 206051 - protein, 56 aa, Glycine max
  Coding DNA Sequence Number=SeqID_89273
MPKEELRRSDFLSKGGYVGAKAPLLSTSKNKKRLLSFETNVRGANTFLKRKYNSRT

SEQ ID NO: 206052 - protein, 400 aa, Glycine max
  Coding DNA Sequence Number=SeqID_89274
  Gene Ontology: Mol. function=DNA-3-methyladenine glycosylase I activity; Biological process=base-excision repair
  Homolog annotation: Hit_ID=Q1SSK0; Match level="QueryCoverage=97%, HitCoverage=99%, E-value=1e-160, Identity=75%"; Hit description =Methyladenine glycosylase
  Pfam annotation: Domain name=Adenine_glyco; Domain location=206-384; Score=282.9; E_value=6.3e-82; Accession=PF03352.4; Description =Methyladenine glycosylase
  Subcellular localization annotation: CTP_CleavageSite=35; ConfidenceScore=5.23e-01
MCSSKTKVTVGLEAVVAAAKPSVARINGRPVLQPTCNRVPNLERRNSIKKVAPPKSLSPPSPPLPSKTSLTPPVSPKLKSPRLPATKRGNDNNGLNSSYEKIVIPRSSTKTPTLERKKSKSFKEGSCVSASIEASLSYSSSLITDSPGSIAAVRREQMALQQAQRKMKIAHYGRSKSAKFERVVPLDPSNTSLASKPTEEEKRCSFITPNSDPIYIAYHDEEWGVPVHDDKMLFELLVLSGAQVGSDWTSTLKKRLDFRAAFSEFDAETVANLTDKQMMSISSEYGIDISRVRGVVDNANQILEIKKDFGSFDKYIWGFVNHKPISTQYKFGHKIPVKTSKSESISKDMVRRGFRFVGPTVVHSFMQTSGLTNDHLITCHRHLQCTLLAARSLCTIEPSQ

SEQ ID NO: 206053 - protein, 166 aa, Glycine max
  Coding DNA Sequence Number=SeqID_89275
  Subcellular localization annotation: CTP_CleavageSite=48; ConfidenceScore=5.04e-01
MDDLTVNFRGARKVRARPADIPSSSAPPAPPTYATPTPAPPISSTHTPAAQDSQRFEAMLQSIHQGQILLLQSLHVVAPPGSILSIEQFIEKVSWPRTLPSTVREGVGVEMRPDEVVLLEPIVPVIHEVVEAGESQLRQEAATPERTPQTPEDSLSPGMDLSFAQQ

SEQ ID NO: 206054 - protein, 273 aa, Glycine max
  Coding DNA Sequence Number=SeqID_89276
  Gene Ontology: Mol. function=protein transporter activity; Cellular component=membrane; Biological process=protein secretion
  Homolog annotation: Hit_ID=UPI00005F75A4; Match level="QueryCoverage =57%, HitCoverage=42%, E-value=3e-40, Identity=58%"; Hit description =COG0845: Membrane-fusion protein
  Pfam annotation: Domain name=Biotin_lipoyl; Domain location=176-241; Score=-13.6; E_value=0.024; Accession=PF00364.12; Description=Biotin- requiring enzyme
MIAQGEQAFYLAHVGRQVRAMQFARQVRLRAQDLLQQRVAGQGAEQAAGGAPVEQRTAEKLQAKRGLFPGVAWRLFAIDQRRHQLPAVKRPGGGEWLRRRNGRLIFTSTGRSILTGFTGHKRRWILVLAVIAALAAAAVWHFRHPAPTDFKTVKASKRDLQQNVLATGQLDAVRKVDVGAQVSGQLEKLYVEIGDKVKKGQLLGVIDPQQAQNSIREGEATLRELHAQLLQAQAEQQLAAVTLQRNQALAKLQAVSRQDLDQAATQLAVKKAQ

SEQ ID NO: 206055 - protein, 78 aa, Glycine max
  Coding DNA Sequence Number=SeqID_89277
MDFEICQIVQQKAVKFVQQNFSTCAENACALMVMGKVVHIEFWKFSSGSQRSKSWKGLWGPGAERNEDKGYVGVCELS

SEQ ID NO: 206056 - protein, 654 aa, Glycine max
  Coding DNA Sequence Number=SeqID_89278
  Homolog annotation: Hit_ID=Q9M0H8; Match level="QueryCoverage=28%, HitCoverage=35%, E-value=6e-13, Identity=26%"; Hit description =Predicted proline-rich protein
  Pfam annotation: Domain name=DUF1421; Domain location=283-651; Score =195.2; E_value=1.6e-55; Accession=PF07223.2; Description=Protein of unknown function (DUF1421)
MNTTPFMDKQIMDLTHAHGSSSSSSTTQLQSKDFIDLMKEPPQNQHNHHHHHLEDEDEEEKASRGNGISKDDIVPSYDFQPIRPLAASNSNNFDSAAFSRPWNSDSNSNASPPILKRESNPRPCEECLGTWTCGAHGPYPFGVRSAPFVVSTKSPLFSLGLHSYIRAFMNQNHWMKIDTCLHVWVPNVVLETNYNSLDSMEPAKVIVEKDQSAFDATMLSEIDRTVKKHMENMLHVLEGVSARLTQLETRTHHLENSVDDLKVSVGNSHGSTDGKLRQMENSLREVQSGVQTIKDKQDIVQAQLQLAKLEVSKTDPQSETQTSTITDPVQQAAFAPGQTQPQLPTPANLPQSIPIVPPPNAPPQPSPQQGLPPPVHLPNQFPQNQIPAAPQRDQYFPPPVQSQETPNQQYQLPLSQQPHAQPGAPPHQQYQQTPHPQYPQPAPHLPQQQPPSHPSMNPPQLQSSLGHHVEEPPYPPQNYPPNVRQPPSPSPTGPPPPPQQFYGTPTHAYEPSSSRSGSGYSSGYGTLSGPVEQYRYGPPQYAGTPALKPQQLPTASLAPSSGSGYPQLPTARVLPQAIPTASAVSGGSGSTGTGGRVSVDDVVDKVATMGFPRDHVRATVRKLTENGQSVDLNAVLDKLMNDGEVQPPRGWFGR

SEQ ID NO: 206057 - protein, 315 aa, Glycine max
  Coding DNA Sequence Number=SeqID_89279
  Gene Ontology: Cellular component=integral to membrane; Biological process=protein secretion
  Homolog annotation: Hit_ID=P45762; Match level="QueryCoverage=90%, HitCoverage=85%, E-value=2e-29, Identity=30%"; Hit description =Probable general secretion pathway protein K
  Pfam annotation: Domain name=GspK; Domain location=1-308; Score=60.9; E_value=4.2e-15; Accession=PF03934.4; Description=General secretion pathway protein K
MSALAAKISQQFCRNLQKTRYQVSQQQLRWSIQSQQKVIEDRLQTYASGESKGLSPKGEWTDPVETEGEHYTVVSQIEDAQTCFNVNNLLAADPTPATQTAGALPEKPVKERIVEQLLADSGISTGDAEEIYQQLMDYLDGDTTTVKEGLETDAWAGVEPARQPANQMMRTPGELKLLPAFPAAAYGKVSKVLCVLPDTASKVDVNTLTEEQAPLLAALFIGSLTEDEAIRLIASRPEEGWESMEAFLKALETNYPQTKDALKQVQALLAVNSNYFRVNSTGNTDDLTLRVVSQLHVDNEAGKVITWQRRYRMVE

SEQ ID NO: 206058 - protein, 157 aa, Glycine max
  Coding DNA Sequence Number=SeqID_89280
MWDKGTKTTNSNSLIIGKLIKAYICFVANDYGHKSKYFTLTTPNSWFGDKNGNNVDIEVYDIGSNIDSKKILVIIEDNVNRVVASSSTILNSNNVTQSTSHGGKKIYRYVQNSIRKRPRKYGRNNPHVSQVDGISSTWQSLSNTCRVYAKRDERFMQ

SEQ ID NO: 206059 - protein, 51 aa, Glycine max
  Coding DNA Sequence Number=SeqID_89281
MTLEFSGILRNRDKGWRVGSEEQDDNNFLVMGKVQRYGNFLDHKNFGTSRS

SEQ ID NO: 206060 - protein, 781 aa, Glycine max
  Coding DNA Sequence Number=SeqID_89282
  Gene Ontology: Mol. function=nucleic acid binding; Cellular component= spliceosome; Biological process=mRNA processing
  Homolog annotation: Hit_ID=Q9LVX1; Match level="QueryCoverage=98%, HitCoverage=80%, E-value=1e-157, Identity=42%"; Hit description =Arabidopsis thaliana genomic DNA, chromosome 3, P1 clone: MGF10
  Pfam annotation: Domain name=GAGA; Domain location=452-504; Score =10.1; E_value=0.069; Accession=PF09237.1; Description=GAGA factor
  Pfam annotation: Domain name=RRM_1; Domain location=480-545; Score =39.0; E_value=1.6e-08; Accession=PF00076.12; Description=RNA recognition motif. (a.k.a. RRM, R
  Pfam annotation: Domain name=zf-CCCH; Domain location=227-253; Score =16.4; E_value=0.009; Accession=PF00642.15; Description=Zinc finger C- x8-C-x5-C-x3-H type (and similar)
  Pfam module annotation: Pfam domain module=GAGA::RRM_1::zf-CCCH; Domain location=452-504::480-545::227-253
MELKVSSPKPESVAPSDCASDPEEKEVSDDDDDDRNHKHRRREARSQSLERDVSDPVISRPFKKRNKNFGNRHPFRENESQAFETLKTYSDATTDKEFYFKFDRRRPGLASAPRAPLDMSQRLRANQSFTGDPGIGRGRGRESGFWNQRESRFGSMDVASQVVPQGSIPPSLYAGRGLLNVSNAQNASWNTFGLIPAVPNGGLDMLHPMGLQGTLRPPINSSLNVNIPRQRCRDFEERGFCLRGDMCPMEHGVNRIVIEDVQSLSQFNLPVSLPSAHLIGAPAGSGPLHSVNASTTLMNNKCLPGKISKSVVNDDGLPLDGVYTGPGCTSGADLYDPDQPLWNDCGLESSNALLTLQSSKIDESEPISNDAPDSDCPVGTARTSVSSQGTSSSVWARIGSSKNRFDMKEKTNSTMSSFNYPENQLKEDNDELVSAHNASFQVKQSIADDADPKALEASLKAQTDSMRNIRKSSQKALCTLFVNGIPQKNNKREALLAHFKKFGEVIDIYIPLNSERAFVQFSKREEAEAALKAPDAVMGNRFIKLWWANRDSIRKDSTTSGNGVIVTPRGQAPAFVPSHPVVTDRGKDIHQADASKTMYEVSSPTDQSKPVITDGPKVPPPLQKKLVNLENLKEELRKKQEMLDQKRNEFKRQLNKFEKQASGLKGEVSTEQAAKRLKMCVPSDVAKLASPQSSDADVGMASPHTEAAADKNKQLVNPVSRSPKASTATRLQESTGLKHPIQPLMPVNRYKLDNRPAAFCIIPPLPSGLANHNMCRQCCSV

SEQ ID NO: 206061 - protein, 102 aa, Glycine max
  Coding DNA Sequence Number=SeqID_89283
  Gene Ontology: Mol. function=DNA binding; Biological process=DNA integration
  Homolog annotation: Hit_ID=Q1S1B7; Match level="QueryCoverage=69%, HitCoverage=10%, E-value=4e-22, Identity=73%"; Hit description =Integrase, catalytic region
MEKGNVGTFAFEDERDEADNVVGVLGRRKKGIKAVKQHLFQHLQTKELGPLHCFLGIEITQSRLGIAISQRKHALDILEEISLIDCKLVDTLVDPNVKLLPK

SEQ ID NO: 206062 - protein, 78 aa, Glycine max
  Coding DNA Sequence Number=SeqID_89284
MVWSLRKWNQVKIPSVPQGKFLLPNNHRRPRAMPVEDLLMVRFVQQGCTVENGEHDCGVEHSDNGETQREGVSVELSA

SEQ ID NO: 206063 - protein, 417 aa, Glycine max
  Coding DNA Sequence Number=SeqID_89285
  Gene Ontology: Mol. function=nucleic acid binding; Cellular component= nucleus; Biological process=positive regulation of gene-specific transcription
  Homolog annotation: Hit_ID=Q9FM47; Match level="QueryCoverage=43%, HitCoverage=39%, E-value=3e-65, Identity=58%"; Hit description =Similarity to RNA binding protein
  Pfam annotation: Domain name=RRM_1; Domain location=153-243; Score =47.9; E_value=3.5e-11; Accession=PF00076.12; Description=RNA recognition motif. (a.k.a. RRM, R
  Pfam annotation: Domain name=RRM_1; Domain location=65-134; Score =73.2; E_value=8.1e-19; Accession=PF00076.12; Description=RNA recognition motif. (a.k.a. RRM, R
  Pfam module annotation: Pfam domain module=RRM_1::RRM_1; Domain location=153-243::65-134
MESPGNEHVVGGAEPNDVVTPFSHREEPHNSQPLTGDGASPGLDDNNVLRFGSNNFPRPIICRKIFIGGLARETTIAQFIKHFGKYGEITDSVIMKDRKTGQPRGFGFITYADPSVVDKVIEEPHVINGKQVEIKRTIPRGAVGSKDFRTKKIFVGGIPSNVTEVLHIYESNVYDLSERCTCADEFRDFFTRYGEVKDHQIMRDHSTNRSRGFGFITFESEEAVDDLLSMGNKIDFAGAQVEIKKAEPKKPNSAPPSSKRYNDSRSSYSSGGYGDAYDGFGGSFGMGGGYRSGGAYGGGRGSGAYGGYASEFGGYGGYAGAMGPYRGDPSLGYAGRYGGSFSRGYDLGGYGGPSENYGAYGAGGGSSGGAGAGAGAGAYQSGYDGNLGGGYGGASGGPFYGSTRGGYSAGRYHPYGR

SEQ ID NO: 206064 - protein, 204 aa, Glycine max
  Coding DNA Sequence Number=SeqID_89286
  Gene Ontology: Mol. function=RNA-directed DNA polymerase activity; Cellular component=chromatin; Biological process=chromatin assembly or disassembly
MAEEDIYMMTFRTSHCHNEYIVMSFSLCNALSTFQATVNELMKPFLRHFVVVFFDDILVYRNSSRVMQPLLPLSIFFFERINFNVVPWLNMPLIEAPVLALPDFKEPFILETDASRSAMGVVLMQKSHLIAFFGKYKSRSSNVVADALSRIPADLSAACFTLSMPNYVFLDQLRVSLQDHSDFAALLTHMGITKTLHCLQGNYF

SEQ ID NO: 206065 - protein, 599 aa, Glycine max
  Coding DNA Sequence Number=SeqID_89287
  Gene Ontology: Mol. function=protein serine/threonine kinase activity; Cellular component=cytoplasm; Biological process=protein amino acid phosphorylation
  Homolog annotation: Hit_ID=P15792; Match level="QueryCoverage=99%, HitCoverage=100%, E-value=0.0, Identity=77%"; Hit description =Protein kinase PVPK-1
  Pfam annotation: Domain name=Pkinase; Domain location=231-555; Score =210.3; E_value=4.3e-60; Accession=PF00069.15; Description=Protein kinase domain
  Pfam annotation: Domain name=Pkinase_Tyr; Domain location=231-549; Score=-48.0; E_value=1.6e-09; Accession=PF07714.7; Description =Protein tyrosine kinase
  Pfam module annotation: Pfam domain module=Pkinase::Pkinase_Tyr; Domain location=231-555::231-549
MESPVNGVDSLSEVQNSVSGVHHDLLSSGTPRPSRPPLRASRNHQTKTIHHQNSHVINQKHSYQEGNNVEHERLPTKLCSKHQPLDDSKNCESSDVLESDNCILGPSKRVVANHARSYCQSEVTFCPSPQSSFYSATVYSEAKQSFTNTEVSECASVDKSCVSGEMANSCDFNESRKTSICRASTGSDASDESSTSSLSSVVYKPHKANDIRWEAIQAVRARDGMLEMRHFRLLKQLGSGDIGVVYLVELSGTRTSFAMKIMDKTKLANRKKVLRSQTEREILQSLDHPFLPTLYTHFETEIFSCLVMEFCPGGDLHALRQRQPGKYFSEHAVRFYVAEVLLALEYLHMLGIIYRDLKPENVLVREDGHIMLSDFDLSLRCTVSPTLVKSSINSLETKSSGYCIQPACIEPTCVMQPDCIQPACFTPRFLSGKSKKDKKFKPKNDMHHQVTPLPELIAEPTNARSMSFVGTHEYLAPEIIKGEGHGSAVDWWTFGIFLYELLFGRTPFKASTVSRISEGEGLLPGDLIRGLLVKEPQHRLAYRRGATEIKQHPFFQNVNWALIRCANPPEVPRQVMKLAQTEKELGVKPSGNYLDIDFF

SEQ ID NO: 206066 - protein, 808 aa, Glycine max
  Coding DNA Sequence Number=SeqID_89288
  Gene Ontology: Mol. function=RNA-directed DNA polymerase activity; Cellular component=chromatin; Biological process=chromatin assembly or disassembly
  Pfam annotation: Domain name=RVP_2; Domain location=36-160; Score= -44.5; E_value=0.0029; Accession=PF08284.2; Description=Retroviral aspartyl protease
  Pfam module annotation: Pfam domain module=RVP_2::RVT_1; Domain location=36-160::229-417
MAYVSIAMKISITDTSVHLGDTLYLGLSPNPPNDHNSTLAQINFHSLSGQLALETLCLLGYIDVHPVVILVDEGSTHNFIQEPLAQLLGLSTRATTPLRVMVGNNQHLDCHQLCEAVCISTQDMSFTVDLHLLPLSGANVVLGVQWFKALDPILTDYNALSMKFFHNDHLVELKGNAASTFHLLSPPQFRRLLRKDGASAYFHIAITPTVLPSKPKLPEIQLFTTKFISIFHPPQSLPPSRPTNHHIHLQPNSDPVNAHPYHMLQKELIRPSTSPFSSPILLIKKHDGTWHLCVDYRALNVMTIKDHFPIPTIDELLDELGGDDVCKIAFCTHHGHYEFKVMPFDLCNAPSLFQATMNAIFRPYLHQFIIVFFDDILIYIRTMEDYLLHLEKVFEAIHQWLVPQSTWALRSFLGLARFYCRFIRDYASTVAPLIKVTTKDPFEWSVDAQHAFHILKEALTSASVLLLPDFTLPFTLETDALGIGMGVVLSQKGHPIAIFSKTFSHKLLQASTYVCELFAITTTMKKWRQYLLSHRFTILTDHQSLKDLMTEVIQTPEQQMYLTRLMGYDYCIQYCSGTTNVVANALSRILNNPTSTMFLLLVPCLTFLEELKKHLAREDIWLPQGLPFIQTFIMEYHSTPTDGHIGDVECFVAACIDCQHTKYKTKKVAGLLCPLPVPYRPREDLSLDFITGLPPFPGNTTSCCRSFLERHSPGHATTPPYFSFGRNLIHGHCREASQHTVKSSFRLRLWDGLFPEDTTWEDWEQLQVEYHLEDKVILEGKGDDNKQEQPVLALEARVPFAKMIIVLL

SEQ ID NO: 206067 - protein, 264 aa, Glycine max
  Coding DNA Sequence Number=SeqID_89289
  Subcellular localization annotation: CTP_CleavageSite=18; ConfidenceScore=5.27e-01
LGSPLATTIASSTLSLAIAATASGRVAFLLRCSLEGWWASCLALKKEAWGRVFRFSSTFGVSAKEGGEDDDNKVRPRRRKSIGFKLGEFDHDGAIDDKGHGGNGDNKARSERGARDLDSPADTKDRDRLMGRRGDDDYKWKDECDSRKRDEDDGYRGKDEQDSRKRDEDDSYRERRTSRDDRRNTDSSHLERRNEGDYSKRPEDSGKQDMKMDYGRRKGSPGDEDYKNGRDDEDYKHRREERGHKRQDIVSDDYPHRRHHGDRR

SEQ ID NO: 206068 - protein, 502 aa, Glycine max
  Coding DNA Sequence Number=SeqID_89290
  Gene Ontology: Mol. function=oxidoreductase activity; Cellular component=membrane; Biological process=electron transport
  Homolog annotation: Hit_ID=O22189; Match level="QueryCoverage=99%, HitCoverage=99%, E-value=1e-124, Identity=44%"; Hit description =Putative cytochrome P450
  Pfam annotation: Domain name=p450; Domain location=36-498; Score =112.3; E_value=1.4e-30; Accession=PF00067.12; Description=Cytochrome P450
MAMLLIYAAITASLFCFLYLFHRRRSCKHPLMRDYPILGMLPPILFNLWRIHDFCTEVLKKQGGTGEFKGPWFTKMHYLITCDSLNVQHMLCKSFDNYIKGPEFREIFEPFGDGVVTADSETWKYFRTVLHSLIKQRRFETFVDKTVQKKVHTSLLPILDHVQQQGEMVDLQDVFNRFTFDNICSTIVGHDPKCLSIDFPEVAIERAFNESEESIFYRHTVPSSVWKFQKWLQIGQEKKMTEACKTFDEFIYSCIASKRQELSKCSREEMDNEAPFDLLTALITEERGRVHDDKFLRDAAFNFFVAGRETMTSALTWFFWLVTKHPLVEAKILEEIKDNFEANYEGVVGIEEVKKLVYLHGALCEALRLFPPVPIERKQAIKDDTLPSGHRVNGNTMILFSLYAMGRCEEIWGKDCLEFKPERWISERGEVVYAPAYKFIAFNAGPRICLGKDLAFVQMKMVAASILRKYRFQVVEGHSPTPSHSIVLLMKNGLKARIMKRL

SEQ ID NO: 206069 - protein, 401 aa, Glycine max
  Coding DNA Sequence Number=SeqID_89291
  Gene Ontology: Mol. function=protein kinase activity; Biological process=protein amino acid phosphorylation
  Homolog annotation: Hit_ID=Q2QZ78; Match level="QueryCoverage=82%, HitCoverage=59%, E-value=8e-83, Identity=46%"; Hit description=AT hook motif-containing protein, putative
  Pfam annotation: Domain name=DUF889; Domain location=216-399; Score =126.0; E_value=1e-34; Accession=PF05970.5; Description=Eukaryotic protein of unknown function (DUF889)
LHIDDSNLMNLVLLEVEQLLQANQRSLKDYPSMSYPENANLLTHADNDLILSELNFNNEELRSEFLNLFSQMTDQQAKIYNQIIQAVNKNEGGMFFLYGYGGTGKTFIWKTLAASLRADNKIVIMVASSNIASLLLPGGKTTHSKLKILVPIFEDSTCNIHQGTQLAELLNETSLIIWDEAPMAHKFCFEALDQSLRDVIKAKSSSDKIFGGKVMVFGGDFRQILPVILKGSRSDIVNATINSSYLWNHCHVLTLLKNMRLEGNIDATDREETSAFAQWILDIGDGIVGQQNDSHGSIEIPKDLLITEYDDPLYAIFNSTFPNLSHHRNNIGYFQSTTILASTNETVQQVNDYILSLILGDYNIPHLILIIYQSGLYVILMKDSAGLVIKSIQYFLSIMIF

SEQ ID NO: 206070 - protein, 49 aa, Glycine max
  Coding DNA Sequence Number=SeqID_89292
MARVRGPKLLMLRQPLRKVLIETPQDRLGIGQSSAFRLSRARLRTTTYW

SEQ ID NO: 206071 - protein, 562 aa, Glycine max
  Coding DNA Sequence Number=SeqID_89293
  Gene Ontology: Mol. function=oxidoreductase activity; Cellular component=Golgi apparatus; Biological process=electron transport
  Homolog annotation: Hit_ID=Q4ZTS3; Match level="QueryCoverage=64%, HitCoverage=96%, E-value=1e-176, Identity=79%"; Hit description=Zinc- containing alcohol dehydrogenase superfamily
  Pfam annotation: Domain name=ADH_N; Domain location=222-340; Score =144.0; E_value=3.9e-40; Accession=PF08240.2; Description=Alcohol dehydrogenase GroES-like domain
  Pfam annotation: Domain name=ADH_zinc_N; Domain location=372-534; Score=91.9; E_value=2e-24; Accession=PF00107.16; Description=Zinc -binding dehydrogenase
  Pfam module annotation: Pfam domain module=ADH_N::ADH_zinc_N; Domain location=222-340::372-534
DATSVVFMADLTVRKGEGRLVPGADIVQVSGRPSLEDYKGSDAARVRAASEGNTALQFYEKQPSGCYKKVLERRVTAGLAILGIPVSGNKKIGMPESKRSVSTRFIPQPNHDYDIVVTGSEFGGDSVSVRDLDPGAKIVGWEGNFCPSVSVAVWCARGLEEGGDKGRLAKRITEREATAKRHAAAAFITDHAREESIMKAVVYNGPFDVSVKEVPDPKIVRPTDVLVRITTTNICGSDLHMYEGRTSFEQGRIFGHENLGQVIEIGSAVERVKVGDYVCLPFNVGCGFCENCEKGLTGYCLTANPGTAGAAYGFAEMGEWDGGQAELLRVPYADFNCLVLPPDAVEKEEDYVLLSDIFPTGWHATELAGLRPGESVAIYGAGPVGLMAAHSAMIKGASQVFVVDTHPDRLALAEQLGAVAINGVGDEAVNKILELTDGRGTDCGCECVGYQCCNKHGHEDNSATLNSLVASTKATGGIGAVGVFVPQDPGGATDLAKEGKVPFDFGNFWFKGQSIKTGQCNVKAYNRQLARLIHQGRANPAQIISHRLALADAAEGYKHFDD

SEQ ID NO: 206072 - protein, 186 aa, Glycine max
  Coding DNA Sequence Number=SeqID_89294
  Homolog annotation: Hit_ID=Q9Z621; Match level="QueryCoverage=88%, HitCoverage=97%, E-value=6e-38, Identity=53%"; Hit description=CigR
  Pfam annotation: Domain name=DUF1236; Domain location=119-186; Score=- 4.2; E_value=0.034; Accession=PF06823.3; Description=Protein of unknown function (DUF1236)
  Subcellular localization annotation: CTP_CleavageSite=43; ConfidenceScore=5.04e-01
MVKIAASFYISIRQHILLRTSVMLTQRTLKTTFALLIGFAVFVAPAYANPGNGNGNGNGNGNGNGNGNHGNNGAHGNKEQGYASSKNEHGHRKNARHPDHVQSDISFSQARALAVNYGLVGYQSLPPGIAKKVARGKALPPGIAKKNLPASMINALPHYPGYEWRAVGDDLVLIALSTAVVTAVIN

SEQ ID NO: 206073 - protein, 93 aa, Glycine max
  Coding DNA Sequence Number=SeqID_89295
MKSQVQGELMYGWLCLNWLPAEPSAPYIPGYAHLAFTVEDLDTLLSKASDYGWKTPGKPQTVYSGPMKGTRVIYLQSPDGQTLELMELSHLSP

SEQ ID NO: 206074 - protein, 362 aa, Glycine max
  Coding DNA Sequence Number=SeqID_89296
  Gene Ontology: Cellular component=membrane
  Homolog annotation: Hit_ID=Q4KE21; Match level="QueryCoverage=52%, HitCoverage=64%, E-value=2e-63, Identity=66%"; Hit description =Membrane protein, putative
  Pfam annotation: Domain name=DUF6; Domain location=73-203; Score =40.4; E_value=6.2e-09; Accession=PF00892.11; Description=Integral membrane protein DUF6
  Pfam annotation: Domain name=DUF984; Domain location=241-336; Score =126.5; E_value=7.3e-35; Accession=PF06171.2; Description=Protein of unknown function (DUF984)
  Pfam module annotation: Pfam domain module=DUF6::DUF984; Domain location=73-203::241-336
  Subcellular localization annotation: CTP_CleavageSite=69; ConfidenceScore=5.09e-01
MALQHVTSAHSIVFLGLLPMATAIFGVVRGGERPRLAFWIFSVAGSLLVMGFALLQKGSVSVTGDLLMLASVIVCGLGYAEGAKLSRELGGWQVICWALIMSLPLMLVATLETLPENMGEISLQAWLSLGYVSLFSMLIGFIFWYRGLAAGGIAAVGQLQLLQPFFGLGLSATLLSETVRPMMILITLAVILEPQYATISLILNTGTVHAINDETFHSPTIEGIFMFAVEEIKKKYPGADAWQMGDSAELASKLAELVKKGIKTASCGSFTAYQQEESAPKIGSYNIILDEEFARKEGEGDLSLEFWQKEHQRFFSREGHFSEDMELIAEEFEVVEVLHIFVAAQFIARSIDGHGAAISRRD

SEQ ID NO: 206075 - protein, 544 aa, Glycine max
  Coding DNA Sequence Number=SeqID_89297
  Gene Ontology: Mol. function=protein kinase activity; Cellular component=membrane; Biological process=protein amino acid phosphorylation
  Homolog annotation: Hit_ID=Q7CL48; Match level="QueryCoverage=54%, HitCoverage=84%, E-value=1e-140, Identity=83%"; Hit description =Putative periplasmic binding protein of ABC transporter
  Pfam annotation: Domain name=ABC_tran; Domain location=290-447; Score= 61.5; E_value=2.7e-15; Accession=PF00005.17; Description=ABC transporter
  Pfam annotation: Domain name=Peripla_BP_1; Domain location=36-310; Score=-68.0; E_value=0.043; Accession=PF00532.11; Description =Periplasmic binding proteins and sugar b
  Pfam module annotation: Pfam domain module=ABC_tran::Peripla_BP_1; Domain location=290-447::36-310
MDFAHISITSARKPMYGACVVSACMLFTTPSFAAKPYDIAVVAKVTGIPWFTRMEVGVKEAAQKLDVNAYQVGASTPDPAQQVKVIEDLIAKKVDAIIVVPNDAKVLEPVLKKARDQGIVVLTHESPDQQIGQWDVETIDSQKYAEANMDELAKDMGGKGGYAIYVGSLTVPLHNAWANAAIKYQKEKYPDMHEVTSRLPVAENIDKSYSTTLDLMKTYPDLKGIIGFGSLGPIGAGQAVQQKRAKNKIAVVGIAMPAQAAPYLMRGDIKKVLLWDPKDAGYALVSVADQLLQGKEVTKDLSIEGLGKADVDMDKKDLSLFPNLSVAENIVIHRYLPGGDFWVHRESMRKKALAAMQRVGVALDPDRKVEKLSIADRQLVAICRAIAADASLVIMDEPTASLTRSEVNGLLRVVNELKAAGICVVFVSHRLDEVMEVADRISVMRDGKLPSAAPGARRCDATAGNQPAEPQRAVSQYFAVAAPGRNHVDYRPARQPDSGEIRINGKVVKFHSNRDAIRHGIAYVSEDRLTQGLIMDQSIYDNTL

SEQ ID NO: 206076 - protein, 502 aa, Glycine max
  Coding DNA Sequence Number=SeqID_89298
  Gene Ontology: Mol. function=transferase activity, transferring nitrogenous groups; Cellular component=intracellular; Biological process=regulation of transcription, DNA-dependent
  Homolog annotation: Hit_ID=Q4KE20; Match level="QueryCoverage=86%, HitCoverage=98%, E-value=1e-146, Identity=59%"; Hit description =Transcriptional regulator, GntR family/aminotranferase, classes I and II family protein
  Pfam annotation: Domain name=Aminotran_1_2; Domain location=143-492; Score=68.0; E_value=3.1e-17; Accession=PF00155.11; Description =Aminotransferase class I and II
  Pfam annotation: Domain name=Aminotran_5; Domain location=159-489; Score=-173.5; E_value=0.0015; Accession=PF00266.9; Description =Aminotransferase class-V
  Pfam annotation: Domain name=GntR; Domain location=62-125; Score =54.3; E_value=4.2e-13; Accession=PF00392.11; Description=Bacterial regulatory proteins, gntR f
  Pfam module annotation: Pfam domain module=Aminotran_1_2::Aminotran _5::GntR; Domain location=143-492::159-489::62-125
MASTPAIEAREKVRKKGSISRTAMRVAGKEPLKMITPVSPFSQPDFRPECVFFTLIQFMKARYKVIVDEFASAIRTGALLPGARLPTHRALSAEKHVSLATATRVYAELEAMGLVSGETGRGTFVREISLPAGLGLDQYAVASDVLDLNFNYPTLPDQAERLRQAMRQLATSGDLASLLRYQPHAGRQSDRETIALWLNASGMTASADEVLIVNGAQHGLSVAVMGLLKPGDVVAVDALTYPGFKALASLYHLELVAIPTDASGPDLTAFRQICQRRRLRAVYTMPTLHNPLGWVMNDAQRRELARIARTFDLLIIEDAAYAFLVRRPPPPLATYAPERTVYVTGFAKSVATGLRVGAVVCPAEMRIALERAIRATTWNTPSLMVSIVCDWIKDGTLKRFEALKRRDARQRQALARKILVNSEWVSHANAYFIWLSLPQEVRADRLVHRLMQQHISVSTAEPFSTSNCVPHAIRLALGSVTMNQLSEALAKIKEAIEYEIDL

SEQ ID NO: 206077 - protein, 98 aa, Glycine max
  Coding DNA Sequence Number=SeqID_89299
MSGPIIDEVTGARGADVRMALLELAEQPAEPSAPYIPGYAHLAFTVEDLDTLLSKASDYGWKTPGKPQTVLSGPMKGTRVIYLQSPDGQTLELMELSH

SEQ ID NO: 206078 - protein, 82 aa, Glycine max
  Coding DNA Sequence Number=SeqID_89300
  Homolog annotation: Hit_ID=Q10S02; Match level="QueryCoverage=49%, HitCoverage=11%, E-value=8e-08, Identity=46%"; Hit description =Cytochrome P450 family protein, expressed
MRKRLFGVQNRKMDLRERRTPNLLGERLVLHSNEAGGSCYFAEGLRSKNEIEFEMEMLWLYMVVGWHDVMTTMGCRNRVFKI

SEQ ID NO: 206079 - protein, 201 aa, Glycine max
  Coding DNA Sequence Number=SeqID_89301
  Gene Ontology: Mol. function=sugar porter activity; Cellular component=membrane; Biological process=transport
  Homolog annotation: Hit_ID=Q665C4; Match level="QueryCoverage=92%, HitCoverage=56%, E-value=2e-74, Identity=74%"; Hit description=ABC sugar transporter, permease subunit
MQPQDVQTETRCGVTVAAHGVNLAAHAGAIHQDAGNDDHSQQAKQRQGQAIVVTVGGGEREPADPVHKPVGETVQPGAVSQIHQQTVKQVQRRDGDNDGRHAQPVHQKTVDQAEQQPNPHRHGKRQRKAAAVMNDVARHHVLTDGGDGGKGDVDAAGNQHHKQTTGQNAQNGIAGGDVCQVTQRHKFTAAGAQPHHQQQHQ

SEQ ID NO: 206080 - protein, 155 aa, Glycine max
  Coding DNA Sequence Number=SeqID_89302
  Gene Ontology: Mol. function=sugar porter activity; Cellular component=membrane; Biological process=transport
  Homolog annotation: Hit_ID=Q665C5; Match level="QueryCoverage=82%, HitCoverage=40%, E-value=3e-41, Identity=69%"; Hit description=ABC sugar transporter, permease subunit precursor
MTTLNRFFPRRPHHPFAVANHCGRCRAVFLYAGWQFLQRRQFPVDLLAVTDSGHAGAGDGHYHADRRDQPFDHCRCQRVFAGDGGDSGGASEPAGICRAGAACGSGGGAGDWGAQWRADRLYRGFTNSGDARHHDADRRAEYSADQRRGHFRFPA

SEQ ID NO: 206081 - protein, 183 aa, Glycine max
  Coding DNA Sequence Number=SeqID_89303
  Gene Ontology: Mol. function=kinase activity; Biological process =carbohydrate metabolic process
  Homolog annotation: Hit_ID=Q8D1N4; Match level="QueryCoverage=97%, HitCoverage=32%, E-value=6e-83, Identity=84%"; Hit description =Putative sugar kinase
  Pfam annotation: Domain name=FGGY_C; Domain location=1-157; Score= -62.7; E_value=0.0053; Accession=PF02782.6; Description=FGGY family of carbohydrate kinases, C-terminal domain
MAGEPENIAFLTKDIHMLPYFHGNRSPRANPTLTGTLTGLKLSRTPEDMALHYLATIQALALGTRHIIETMNQSGYCIDTIMASGGGTKNPIFVQEHSNATGCAMLLPEESEAMLLGSAMMGTVAAGAYDSLPEAMAAMSRIGKTITPQTNKIKEYYDRKYRVFHEMYHDSMKYRQLMQGKVE

SEQ ID NO: 206082 - protein, 175 aa, Glycine max
  Coding DNA Sequence Number=SeqID_89304
  Gene Ontology: Mol. function=oxidoreductase activity; Cellular component=endoplasmic reticulum; Biological process=aromatic compound catabolic process
  Homolog annotation: Hit_ID=Q3KCP9; Match level="QueryCoverage=100%, HitCoverage=69%, E-value=3e-56, Identity=64%"; Hit description=Short- chain dehydrogenase/reductase SDR precursor
  Pfam annotation: Domain name=KR; Domain location=6-173; Score=-40.5; E_value=5.3e-05; Accession=PF08659.1; Description=KR domain
  Pfam annotation: Domain name=adh_short; Domain location=6-170; Score =82.1; E_value=1.7e-21; Accession=PF00106.15; Description=short chain dehydrogenase
  Pfam module annotation: Pfam domain module=KR::adh_short; Domain location=6-173::6-170
MKLTDNTIFITGGTSGIGRAMAEKFHQLGNQVIISGRREALLQEVTAASPGMDYVVLDVTRADSIQAAAHHVLERYPALNVVINNAGIMPFDNAAGELDDAQAVTLLNTNILGPVRVSAAFIEHLKQQPDAVLINNSSVLAFLPLATNALYSATKAAIHSYTLSQRFLLRDTGVQ

SEQ ID NO: 206083 - protein, 364 aa, Glycine max
  Coding DNA Sequence Number=SeqID_89305
  Gene Ontology: Mol. function=sequence-specific DNA binding; Cellular component=intracellular; Biological process=regulation of transcription, DNA-dependent
  Homolog annotation: Hit_ID=Q1LEN9; Match level="QueryCoverage=84%, HitCoverage=98%, E-value=1e-102, Identity=59%"; Hit description =Transcriptional regulator, AraC family
  Pfam annotation: Domain name=DJ-1_PfpI; Domain location=87-225; Score= 20.4; E_value=4.1e-05; Accession=PF01965.14; Description=DJ-1PfpI family
  Pfam annotation: Domain name=HTH_AraC; Domain location=265-311; Score= 39.1; E_value=1.5e-08; Accession=PF00165.13; Description=Bacterial regulatory helix-turn-helix proteins, araC family
  Pfam annotation: Domain name=HTH_AraC; Domain location=317-361; Score= 27.2; E_value=5.8e-05; Accession=PF00165.13; Description=Bacterial regulatory helix-turn-helix proteins, araC family
  Pfam module annotation: Pfam domain module=DJ-1_PfpI::HTH_AraC::HTH _AraC; Domain location=87-225::265-311::317-361
MAACLKPYAWRTARSGTLNIKRRRRSAAGDTAERNRAGHSVADGAGRLKETMMHRVGLLISDHFQVLGLSTLSIFEFANQVNGEPFYHCTVYSERGGAVQSSSGFGVDSQPIHTDMEMDTWLVAGVMTPLELPATAGIVDFLQVQAPRARRVAGICTGAFVLGQAGLLSERRATTHWVHAQSLQLLHPTTRIEEDRIFIIDDHIWTSAGLTAGLDMALGMVEKDLGAEVARSVAHLLVMHHRRSGGQTQHSEMLMLSPRSDRLQSALEYARNNLSKALTIEDLADAVHLSARQLSRLFRSETGKSPAKAIEGLRLENARLLIEQSRLPMEVIARESGFRDRRHMREVFIRGYGIPPQSLRTGKA

SEQ ID NO: 206084 - protein, 271 aa, Glycine max
  Coding DNA Sequence Number=SeqID_89306
  Gene Ontology: Mol. function=estradiol 17-beta-dehydrogenase activity; Cellular component=membrane; Biological process=metabolic process
  Homolog annotation: Hit_ID=Q395P1; Match level="QueryCoverage=95%, HitCoverage=98%, E-value=6e-90, Identity=66%"; Hit description=Short- chain dehydrogenase/reductase SDR
  Pfam annotation: Domain name=Epimerase; Domain location=12-234; Score= -62.4; E_value=0.046; Accession=PF01370.11; Description=NAD dependent epimerasedehydratase family
  Pfam annotation: Domain name=KR; Domain location=10-194; Score=-63.2; E_value=0.0011; Accession=PF08659.1; Description=KR domain
  Pfam annotation: Domain name=adh_short; Domain location=10-177; Score= 106.7; E_value=6.6e-29; Accession=PF00106.15; Description=short chain dehydrogenase
  Pfam module annotation: Pfam domain module=Epimerase::KR::adh_short; Domain location=12-234::10-194::10-177
MTQQTHTNRGTAVVTGASTGMGALYAGRLARMGYDLIIVARNHNRLNQLAEHITTDSGRSVEVITADLADAAQLNALEEKLRQDASITLLVNNAGIGTHTPLLDSDVAQMNAMINLNVIALTRLTYALVPGMVARGRGAIINIASIVSIAPELLNGVYGGSKAYVLAFSQSLHHELAGKGIQVQAVLPGATATPFWDNGGLPVDQLDPNIVMSAQEMVDAALTGFARGELVTIPSLQDEALWTRYEQARQAMMPHLGSDAPAERYRPVSVH

SEQ ID NO: 206085 - protein, 340 aa, Glycine max
  Coding DNA Sequence Number=SeqID_89307
  Gene Ontology: Mol. function=isomerase activity; Cellular component =cytoplasm; Biological process=carbohydrate metabolic process
  Homolog annotation: Hit_ID=Q1SGQ4; Match level="QueryCoverage=71%, HitCoverage=84%, E-value=1e-68, Identity=51%"; Hit description =Galactose mutarotase-like
  Pfam annotation: Domain name=Aldose_epim; Domain location=52-291; Score=83.9; E_value=4.9e-22; Accession=PF01263.10; Description =Aldose 1-epimerase
MPLNIFQDKDGLPRIILTEPKGSSAEDFEKVFHILDFINNLWPSEAVSANILLDLLSTESMLRQVLLYGGQIISWKNHRKEELLFMSSKANKKQHKAIRGGISACLARFGDLSSLEQHGFARNRMWSLDRDPSPLPPLDNQSSVDLILKSTEVDLKTPCSFEFRLRISLNAGKLILIPRVRNTANKAFSFSFTLCNYLSVSDISEVRIEGLETLDYFDNLLNRSRFTEQADALTFDGESAVVWNPWGKKAKAIPDLGDDDYKIMMCVNSAAIDTPILLKPSEEWMGYQELSTVSSSYCSGQLDPRKKGHILKASQGMRRACGGQSEVTMEGCFDGESAET

SEQ ID NO: 206086 - protein, 793 aa, Glycine max
  Coding DNA Sequence Number=SeqID_89308
  Gene Ontology: Mol. function=protein transporter activity; Cellular component=cytoplasm; Biological process=intracellular protein transport
  Homolog annotation: Hit_ID=Q2QP84; Match level="QueryCoverage=96%, HitCoverage=84%, E-value=0.0, Identity=54%"; Hit description=Vesicle tethering family protein, putative, expressed
  Pfam annotation: Domain name=DUF593; Domain location=629-716; Score= -28.6; E_value=0.042; Accession=PF04576.6; Description=Protein of unknown function, DUF593
  Pfam annotation: Domain name=Uso1_p115_C; Domain location=667-790; Score=169.8; E_value=6.9e-48; Accession=PF04871.4; Description=Uso1 p115 like vesicle tethering protein, C terminal region
  Pfam annotation: Domain name=Uso1_p115_head; Domain location=230-565; Score=6.2; E_value=1.9e-10; Accession=PF04869.5; Description=Uso1 p115 like vesicle tethering protein, head region
  Pfam module annotation: Pfam domain module=DUF593::Uso1_p115_C::Uso1 _p115_head; Domain location=629-716::667-790::230-565
ASNEVHPALMNTDLLSREADCISLLLSLLEEDDFYVRYYTLQLLTALLTNSPQRLQEAILTIPRGITRLMDMLMDREVIRNEALLLLTHLTREAEEIQKIVVFEGAFEKIFSIIREEGNSDGGVVVQDCLELLNNLLRSNASNQVLLRETVGLDSLILILKLRGSSFTFNQQKGGSESDPGKDMNKQTNKTTLVQKKILDHLLILGVESQWVPVPVRCAAMRCIGDLIAGDSKNRDLLASKVLGEEPHVEPALNSILRILLRTSSMQEFIAADYIFKSFCEKNADGQSMLASTLIPQPYSMNHAFLEEDVNMSFGSMLLHSLTLGENGDLETCCRAASVLSHMLKDHLQCKERVLRIEIEAAPMQSLGAPEPLMHRMVKYLAVASSMKFHDGKSSTSGNSYVQAIILKLLITWLADCPSAVHCFLDARPHLTYLLELVSNSSETVCIRGFAAVVLGECVIYNKSTDRGKDAFAIVDTISQKIGLSSYFLKFDEMQKSSIFSSLESSLTHRSFARSSAASMADIEDVDGNDLSEKKNLDHPILSSILDSNFMNLVKSLEADIREQIVEVYSRPKMKVAVVPAELEQRSGESDAEYIKRLKVFVEKQCSEIQDLVLRNASMAEDLAKTGSTLQPEQRVSGGSDRVPIETLHRDLQEASQRLEMLKAEKAKVESEAIMYRNLAGKTEADLRSLSDAYNSLEQSNLLLENEVKALKREGHSTFPDVDAIKAEAREEAQKESEGELNDLLVCLGQEQSKVERLSARLLELGEDVDILLEGIGDDAGAAEDGEDEEDDE

SEQ ID NO: 206087 - protein, 85 aa, Glycine max
  Coding DNA Sequence Number=SeqID_89309
  Homolog annotation: Hit_ID=Q2QP84; Match level="QueryCoverage=91%, HitCoverage=8%, E-value=5e-21, Identity=60%"; Hit description =Vesicle tethering family protein, putative, expressed
MDLMSGYKGVVGLLVGNENSSNEDRYVERLLDRISNGKLPEDRRNAITELQAVVSESQAFQLAFGAMGFPIMLSVLKEERDDVEM

SEQ ID NO: 206088 - protein, 386 aa, Glycine max
  Coding DNA Sequence Number=SeqID_89310
  Gene Ontology: Mol. function=beta-1,4-mannosylglycoprotein 4-beta-N -acetylglucosaminyltransferase activity; Cellular component=membrane; Biological process=protein amino acid N-linked glycosylation
  Homolog annotation: Hit_ID=Q0WV60; Match level="QueryCoverage=97%, HitCoverage=97%, E-value=1e-176, Identity=74%"; Hit description=Beta- 1,4-N-acetylglucosaminyltransferase like protein
  Pfam annotation: Domain name=Glyco_transf_17; Domain location=26-385; Score=881.2; E_value=4.8e-262; Accession=PF04724.4; Description =Glycosyltransferase family 17
MSTMSEGYYNSKKSGDIYGQQGTRAALSMSRLRCILRGLNFKTYMFLFLVVPMGIFSLYFHGLKISYFLRPLWESPPKPFHEIPHYYHENVSMETLCRLHGWRIRESPRRVFDAVLFSNEVDILTIRWKEMYPYVTHYVILESNSTFTGLPKPSIFASNRDNFRFVESRLTYGMIGGRFKKGENPFVEEAYQRVALDRLLKIAGIEDDDLLIMSDVDEIPCAHTINLLRWCNGIPPVLHLQMRNYLYSFEFFLDNQSWRASIHRYQTGKTRYAHYRQADVLLADAGWHCSFCFRRISEFVFKMKAYSHNDRVRFAHYLNCNRIQDVICKGDDLFDMLPEEYTFKDIIGKLGPIPHSYSAVHLPSYLLNNAEKYKFLLPGNCRRESG

SEQ ID NO: 206089 - protein, 108 aa, Glycine max
  Coding DNA Sequence Number=SeqID_89311
MVKFLVKLQTNFREDPTVNEGWETFLPRQLHLVSSRSFIKRLLAYSGQLLNDPNGQIMEKCFVKLQTKFREDPTVNEGWKAFLPRQLHVAFSRSFIKRLPPEASSWLL

SEQ ID NO: 206090 - protein, 608 aa, Glycine max
  Coding DNA Sequence Number=SeqID_89312
  Homolog annotation: Hit_ID=Q6AUH9; Match level="QueryCoverage=57%, HitCoverage=59%, E-value=5e-95, Identity=55%"; Hit description =Unknow protein
  Pfam annotation: Domain name=CRS1_YhbY; Domain location=81-165; Score= 114.2; E_value=3.8e-31; Accession=PF01985.11; Description=CRS1  YhbY domain
MSTSKGRSMRSKVERRMQKESGKTLREIRRAKKLKKKLMTEEERLIYNLKRAKKKVALLLQKLKKYELPELPHPRHDPELLTPEQLQAYKKIGFRNKNYVPVGVRGVFGGVVQNMHLHWKFHETVQVCCDNFPKEKIKEMASMLARLSGGIVINVHNVKTIIMFRGRNYRQPKNLIPINTLTKRKVGLHCYIPYLTVPLSGYLNRGDALHALFKARFEQALESQKLNIKKIEQQLRRMGVNPEDPAAMASIQRVASTFFNAIDQKEGSPYVFREGKQSITEPAEGFEESEPIADSDQEELDRFIAEIEDAADKEYEAEEAKEKEEFGRIRYWNKEEFGGRYRRSDASTNDDRDVEARGSRVWQTTHPKRHAVDSDDEENTHSDNDDDDEEEEWHFNNSADASDLDSNSEGSDGTRRRFKESRRKREKQNNPGIGRARDNESSSRHAGAKFRGNMTVEDSESEGMLSDVENAMWESEDEEQENNDSGYLRKLSDSYKSSSSDDEYAHQTMSNKKSGARDHEGKVGGSAQYHDSFDAPKSVRGKKHGVNKIDSESIDEFSCSENWLWPSDAAEETGDYPTNQNSNNVIKSDIPKSQRRTLKEADEAWDSD

SEQ ID NO: 206091 - protein, 303 aa, Glycine max
  Coding DNA Sequence Number=SeqID_89313
  Gene Ontology: Mol. function=DNA binding; Biological process =regulation of transcription
  Homolog annotation: Hit_ID=Q6ZI65; Match level="QueryCoverage=78%, HitCoverage=61%, E-value=4e-73, Identity=56%"; Hit description=No apical meristem (NAM)-like protein
  Pfam annotation: Domain name=NAM; Domain location=88-231; Score=92.1; E_value=1.7e-24; Accession=PF02365.6; Description=No apical meristem (NAM) protein
MAWEASSHRGGNKVIYHSVSVSLGFRGDKTASVSQRSWLIDIRGFAKKVKDTTLSTDDQMKDCGTYSECPKCHYHIDNSNVSHEWPGFPVGVKFDPSDVELLEHLAAKCCIGNREPHMFIHQFIPTLEGEQGICYTHPQNLPGAKTDGSSVHFFHKTANAYATGRRKRRKIHHQDGLTEEHVRWHKTGRTKAVTEDGVHKGFKKIMVLYIRSKKGTKPYKTNWVMHQYHLGSEVEKDGEYVVSKIFYQQHKQNEKNEENTMVEDSNVAAQAGPRTPKPNPPTRPCTAKCDDNFDENELLPFIQ

SEQ ID NO: 206092 - protein, 169 aa, Glycine max
  Coding DNA Sequence Number=SeqID_89314
  Gene Ontology: Mol. function=protein serine/threonine kinase activity; Cellular component=membrane; Biological process=protein amino acid phosphorylation
  Homolog annotation: Hit_ID=Q7XJ65; Match level="QueryCoverage=97%, HitCoverage=51%, E-value=5e-72, Identity=74%"; Hit description =Protein kinase
  Pfam annotation: Domain name=Pkinase; Domain location=14-169; Score= -20.9; E_value=2.6e-07; Accession=PF00069.15; Description=Protein kinase domain
  Pfam annotation: Domain name=Pkinase_Tyr; Domain location=14-169; Score=-42.6; E_value=7.4e-10; Accession=PF07714.7; Description =Protein tyrosine kinase
  Pfam module annotation: Pfam domain module=Pkinase::Pkinase_Tyr; Domain location=14-169::14-169
MGSGNEWLVDPKQLFIGPKIGEGAHAKVYEGKYKNQNVAVKIINKGETPEEISRREARFAREVAMLSRVQHKNLFIRACKEPVMVIVTELQLGGTLRKYLLNMRPKCLDMPVAVGFALDIARAMECLHSHGIIHRDLKPDNLILTDDHKTVKLADFGLAREESLTDDDC

SEQ ID NO: 206093 - protein, 58 aa, Glycine max
  Coding DNA Sequence Number=SeqID_89315
MSLPSAVHVSSIIKRGASGDWEKKEGVETKVVMRLITERAGRTKSVSYLCFPHISGKR

SEQ ID NO: 206094 - protein, 80 aa, Glycine max
  Coding DNA Sequence Number=SeqID_89316
  Gene Ontology: Mol. function=DNA binding; Biological process=DNA integration
  Homolog annotation: Hit_ID=Q1SIT1; Match level="QueryCoverage=77%, HitCoverage=17%, E-value=9e-12, Identity=57%"; Hit description =Integrase, catalytic region
MDQPGEERKWQLSELDEIHLEAYENAKFSKEKTKKFHDNMIVKKDFMVGQKVLLYNFRLGLMRDQKRLPKQELQGQWTST

SEQ ID NO: 206095 - protein, 163 aa, Glycine max
  Coding DNA Sequence Number=SeqID_89317
  Gene Ontology: Cellular component=chloroplast
  Homolog annotation: Hit_ID=Q6Z1V9; Match level="QueryCoverage=21%, HitCoverage=26%, E-value=3e-08, Identity=80%"; Hit description =Chloroplast ORF133; ORF within trnI intron
MSPHGGDMDGGEKRKERDGVSLAFGIAGPGGRPARRAISSVVERAPDNLRRCAWTVRALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFIL

SEQ ID NO: 206096 - protein, 100 aa, Glycine max
  Coding DNA Sequence Number=SeqID_89318
MDKRHENNMQYDLIHKINLYEYLNNIRHIYNINGTPTKLSKELLSVEAMLPKIILMMPKTQFKNQESSKFQESKSRSIKASFKNQRVVQSRFKIQDSRFK

SEQ ID NO: 206097 - protein, 68 aa, Glycine max
  Coding DNA Sequence Number=SeqID_89319
MDERSFLSAQYPSSKLLQWWFLGEEEVYERFLVTLLLLSFCTSASTKYTYLSYTSKTHSFKFKHPKTH

SEQ ID NO: 206098 - protein, 314 aa, Glycine max
  Coding DNA Sequence Number=SeqID_89320
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=27%, E-value=4e-82, Identity=43%"; Hit description =Integrase, catalytic region
MTTVRLVLSLAASQGWHLHQLDVNTAFLHGDLNEERSLYGLKQASGQWNAKLTSTLLDSGFQQSKTDYSLFTKRSPTSLTVILVYVDDLVLPGTDLAKIQQLKHSLDAKFSIKELGMLKYFLGFEVARSNSGIALYQRKYCLDLLQDTGLLAAKPCFTPMDLTLKLHKSSGVPLSDPTVYKRLVGRLLYLTHTRPNICYVVGGLSQYLQYATDIHMQAAQHTLKYLKGNAGKCLFFSSSSSTSLTGFSDSDWGACLDARRSITVVLYCDNQAALHIAANPVFHECTKHIEIDCHVVRDKVQSNMIHLLPISTHE

SEQ ID NO: 206099 - protein, 99 aa, Glycine max
  Coding DNA Sequence Number=SeqID_89321
MDPLALNLTLKTHLQPIGFLLGGKGVSCQFKIGYLMVEEIGESELERVKVRLINGVDQVDGLILVSQVGKGLVDEAYQANNQMEMMEEDLIGCVESADS

SEQ ID NO: 206100 - protein, 263 aa, Glycine max
  Coding DNA Sequence Number=SeqID_89322
  Gene Ontology: Mol. function=nucleic acid binding; Cellular component= membrane; Biological process=DNA integration
  Pfam annotation: Domain name=zf-CCHC; Domain location=237-254; Score =11.5; E_value=0.013; Accession=PF00098.13; Description=Zinc knuckle
MAKKDVVNNAALTNLLNPYYTHPNENPGVAIIVQVLSGGNYHSWSCAMLLALKTKKKIQFMDGSLPRPALHDPNFALWDHCNTLVVSWLHHSLDPEILQTIMWMENASDSWNTLKKHYYQGDVFRISDLQEEIYLLKQGDANITTYFTKLKGDYVIRFLRGLNDQYSTVRSNIMMMDPLPDLDKVFSIIIQQERQLVLQFDDSRVLAQLDTNNGTYGRGRGCGGHTSGGRGRDRSTKICIYCNKSGHMVDTCYKNTWLSSSLA

SEQ ID NO: 206101 - protein, 45 aa, Glycine max
  Coding DNA Sequence Number=SeqID_89323
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=91%, HitCoverage=18%, E-value=2e-09, Identity=54%"; Hit description =Protein ULTRAPETALA2
QAGVVLVLQLAKVAQLVTVKGASSATLRIAIAKNAETLCYMLNLN

SEQ ID NO: 206102 - protein, 64 aa, Glycine max
  Coding DNA Sequence Number=SeqID_89324
MGSEIYPKESNYPLLGGDTSNAGNDYAANAGADGDYVADIATAQRAWDPRPTQDRGPLLIKTLI

SEQ ID NO: 206103 - protein, 69 aa, Glycine max
  Coding DNA Sequence Number=SeqID_89325
MGMEEEEGWLMEEKGRMAKDGGFPLLEMLRLWMYSIESSESQCLSPLLPTPFIGLSGYDGDQELSAGLR

SEQ ID NO: 206104 - protein, 58 aa, Glycine max
  Coding DNA Sequence Number=SeqID_89326
MKLNVIVKGHDVNTVCHDVAWTAWAVQAWWLGVVVTVVEVELEEGFMGKKICAHICNE

SEQ ID NO: 206105 - protein, 362 aa, Glycine max
  Coding DNA Sequence Number=SeqID_89327
MDPYDEKRLRDEVIYLHYLWHQGPPRPPPQNPITHRPFPSPSQPYIPQHTWHARPHQQQPAPARTRSLPPAIPTTTTTSFKKKKKHKRNTPEKNVSQPDPGPEWPCPVRPEPSPTTGWAQPKPKPGSASPPPEVAPEEKERLVAMQAQHKACKALKEFLSNNYDDDDDDDDDDDESECEEIEEFFLVLFLEDHELRGYYQRCYENGLFCCLHSMSILRTMKKRVHRGFGMALCKVLGWDSDRFPAIVMKGTPLGMEMMTPVEAEGEPKENNAADDNDRKDDSHESDDKVLSLEHGDVAAEVPAQRVDQSMNKGEHDGKDGEDHGENGAHKSGDEVVSLGLGDEPVEEHAQGDDQSINKVNCL

SEQ ID NO: 206106 - protein, 459 aa, Glycine max
  Coding DNA Sequence Number=SeqID_89328
  Gene Ontology: Mol. function=adenylosuccinate synthase activity; Cellular component=membrane fraction; Biological process=purine nucleotide biosynthetic process
  Homolog annotation: Hit_ID=Q8ZIV7; Match level="QueryCoverage=93%, HitCoverage=99%, E-value=0.0, Identity=87%"; Hit description =Adenylosuccinate synthetase
  Pfam annotation: Domain name=Adenylsucc_synt; Domain location=4-425; Score=1015.3; E_value=2.1e-302; Accession=PF00709.11; Description =Adenylosuccinate synthetase
MGKNVVVLGTQWGDEGKGKIVDLLTERAKYVVRYQGGHNAGHTLVINGEKTVLHLIPSGILRENVTSIIGNGVVLSPEALMKEMNGLEARGVPVRERLLISEACPLILQYHVAMDLAREKARGAKAIGTTGRGIGPAYEDKVARRGLRVSDLFNKETFAVKLKEIVDFYNFQLVNYYKEDAVDYDKVLSDVLAVADILTGMVVDVSELLDGARKRGDLIMFEGAQGTLLDIDHGTYPYVTSSNTTAGGVATGSGIGPRYVDYVLGIVKAYSTRVGAGPFPTELFDETGEFLCEKGNEFGATTGRRRRTGWLDAVAVRRAVQINSLSGFCMTKLDVLDGLKEVKICVGYRMPDGREMTTTPLAAEGWEGIEPIYETLPGWSENTFGVKTLEGLPQAARDYIKRVEEVTGVPIDIISTGPDRSETMILRDPKKALRVFHTGLSSMLIEALTGVITTISMIH

SEQ ID NO: 206107 - protein, 109 aa, Glycine max
  Coding DNA Sequence Number=SeqID_89329
  Gene Ontology: Mol. function=phenylalanine-tRNA ligase activity; Biological process=regulation of transcription, DNA-dependent
  Homolog annotation: Hit_ID=P0AF63; Match level="QueryCoverage=100%, HitCoverage=78%, E-value=4e-37, Identity=71%"; Hit description =Protein yjeB
  Pfam annotation: Domain name=Rrf2; Domain location=1-101; Score =104.8; E_value=2.6e-28; Accession=PF02082.10; Description =Transcriptional regulator
MATLPQGQQTNITEVTDTYGVSRNHMVKIINQLSRAGFVAATRGKNGGIRLGMDPEKIVIGDVVRKMEPLQLVNCKECAINPACRLRSALNNAVQLFLQELDKYTLADL

SEQ ID NO: 206108 - protein, 265 aa, Glycine max
  Coding DNA Sequence Number=SeqID_89330
  Gene Ontology: Mol. function=N-acetylmuramoyl-L-alanine amidase activity; Cellular component=cell wall; Biological process =peptidoglycan catabolic process
  Homolog annotation: Hit_ID=Q6D064; Match level="QueryCoverage=99%, HitCoverage=48%, E-value=3e-96, Identity=66%"; Hit description=N -acetylmuramoyl-L-alanine amidase
  Pfam annotation: Domain name=Amidase_3; Domain location=2-120; Score =4.9; E_value=1.3e-06; Accession=PF01520.9; Description=N -acetylmuramoyl-L-alanine amidase
  Pfam annotation: Domain name=LysM; Domain location=164-206; Score =73.4; E_value=7e-19; Accession=PF01476.10; Description=LysM domain
  Pfam annotation: Domain name=LysM; Domain location=221-263; Score =67.2; E_value=5.4e-17; Accession=PF01476.10; Description=LysM domain
  Pfam module annotation: Pfam domain module=Amidase_3::LysM::LysM; Domain location=2-120::164-206::221-263
MANWLEQNEKQSELLGGAGDLLANSQADPYLSQAVLDLQFGHSQRVGYDVAVKVLQQLRGVTPLHKRLPEHASLGVLRSPDIPSLLVETGFISNAGEERLLGSSAYQEKIAQSIYKGLRNYFLAHPLQSVPKEEKRPLDRAPAVSVASNPATGTVQYTGATQRHTVTRGETLSGIAARYGVSMATLRELNNLKRDVVWVGQRLKVPAGSGVSTAASRPARHKVVRGDSLTAIAAKYGVSPKAIMQANNMKSSNVMLGQNLKIPQS

SEQ ID NO: 206109 - protein, 478 aa, Glycine max
  Coding DNA Sequence Number=SeqID_89331
  Gene Ontology: Mol. function=electron carrier activity; Cellular component=membrane fraction; Biological process=electron transport
  Homolog annotation: Hit_ID=Q1H4J9; Match level="QueryCoverage=99%, HitCoverage=33%, E-value=1e-152, Identity=58%"; Hit description =Molybdopterin oxidoreductase
  Pfam annotation: Domain name=FAD_binding_1; Domain location=274-469; Score=139.4; E_value=9.5e-39; Accession=PF00667.10; Description=FAD binding domain
  Pfam annotation: Domain name=Flavodoxin_1; Domain location=103-234; Score=131.0; E_value=3.2e-36; Accession=PF00258.15; Description =Flavodoxin
  Pfam module annotation: Pfam domain module=FAD_binding_1::Flavodoxin _1; Domain location=274-469::103-234
MKDIDALARLLGLDTAPEIMLDAQEQLYLQGFMTGLRSEESRKMGGVPMLPEGAPLAPAKHLLVNGILAGIFGRSWLPNGGQLPVGMPDFSAKPASATSTVAILWASQTGNAESFAEKCAQRIKASGLQAAVLTMDSVNMADLAKHSQVLLLASTFGDGDAPDNGSQFWTRLQADNAPRLENTRFSVLAFGDSNYDQFCGFGRKLDARLESLGAERLLGRAECEPDFEETANAWLDQAVTALATMPVTVTEPEMAMASEIVNAPGIHTETRSAPLYTRLSPLRTKLVINQRLNADGAEKEIRQFGFDLTGSGFQYEAGDALGVWPSNCPELVGEMLRALKLSASTMVTVKDHGELALGDALLHHYEIARITPDLLKFVQQRSASPTLALLMEDEQRLKDWLWGKQIIDLLHDFPIKVNATDWLAALKRLQPRLYSISSSPKVYPDQVHLTVSTVRYGEGMSRGGVCSTFMADRAQDSE

SEQ ID NO: 206110 - protein, 211 aa, Glycine max
  Coding DNA Sequence Number=SeqID_89332
  Homolog annotation: Hit_ID=Q8TGM5; Match level="QueryCoverage=18%, HitCoverage=58%, E-value=1e-07, Identity=74%"; Hit description =Uncharacterized protein ART3
  Subcellular localization annotation: CTP_CleavageSite=28; ConfidenceScore=5.60e-01
YLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 206111 - protein, 363 aa, Glycine max
  Coding DNA Sequence Number=SeqID_89333
  Homolog annotation: Hit_ID=P0AF67; Match level="QueryCoverage=25%, HitCoverage=60%, E-value=4e-38, Identity=80%"; Hit description =UPF0079 ATP-binding protein yjeE
  Pfam annotation: Domain name=Carb_kinase; Domain location=1-157; Score=69.9; E_value=8.4e-18; Accession=PF01256.8; Description =Carbohydrate kinase
  Pfam annotation: Domain name=UPF0079; Domain location=140-254; Score =146.5; E_value=7.3e-41; Accession=PF02367.8; Description =Uncharacterised P-loop hydrolase UPF0079
  Pfam module annotation: Pfam domain module=Carb_kinase::UPF0079; Domain location=1-157::140-254
ALKKVALSEKPMLWDADALNLLAINADNRQNRIITPHPGEAARLLGVKTAEIESDRLHAAQTLANRYGGVVVLKGAGTVIASAAGDMAIADVGNAGMASGGMGDVLSGIIAALLGQQATLFDAACAGCVAHGAAADAAATLNLGAQLARVCSSAVVIYLYGDLGAGKTTFSRGFLQALGHQGNVKSPTYTLVEPYQLGDRSLYHFDLYRLADPEELEFMGIRDYFSGDALCLRAFAARQHAAAAVSAGQGTGMMSRVTGMMLALLCLFSSSALAATLSDIKVDNGDSQATVTLSFNGQPVYGFFPLHNPNRVVLDIRQSGNIQGLPLNFSGENIVKRIRNSQPKDKQSIRLVFELTQAAKTRA

SEQ ID NO: 206112 - protein, 76 aa, Glycine max
  Coding DNA Sequence Number=SeqID_89334
MRMKLRVSEGVSDEHESEGVSDERKRRSVNLTLKNPKNKAFEKKILQAVPLLRSHLNLRSPIPLLQSRGRARVTEV

SEQ ID NO: 206113 - protein, 97 aa, Glycine max
  Coding DNA Sequence Number=SeqID_89335
MTPSLNLYHVLFFSSQEKGALDAEEQIGKAHSGKNSDDCYCKTTPVVLELGGKLCCDGRGCYNMLCLGFAQVDKTFHFGTSIRESIRDTSTYLAGVQ

SEQ ID NO: 206114 - protein, 246 aa, Glycine max
  Coding DNA Sequence Number=SeqID_89336
  Homolog annotation: Hit_ID=Q6YXH6; Match level="QueryCoverage=43%, HitCoverage=56%, E-value=1e-28, Identity=57%"; Hit description=FH protein interacting protein FIP1-like
  Pfam annotation: Domain name=GRAM; Domain location=87-168; Score =33.8; E_value=6.1e-07; Accession=PF02893.10; Description=GRAM domain
  Subcellular localization annotation: CTP_CleavageSite=51; ConfidenceScore=5.25e-01
MAATTLMFKFPLFTPTVSVMISGPKPMDTVCDALNRCSRKVGKATRRAETMADNFWNHIRIGSSLADAAVARIVQGTKVLTLGGPDILFQQSFGNFPGEKLIKSFACYLSTSTGPVIGTIYVSTKRVAFCSDYPLCNYPLSLQQNQSVHYKFKVCTRYKDITELQNKSSISLLYLLHIATKKVASIQQPKTITCNTNNNQNSKKQVGSLASSNLHEKTRIFEGIIEAQKIVWMRISGSPWHKQSHT

SEQ ID NO: 206115 - protein, 314 aa, Glycine max
  Coding DNA Sequence Number=SeqID_89337
  Gene Ontology: Mol. function=binding; Cellular component=spindle microtubule; Biological process=regulation of mitosis
  Homolog annotation: Hit_ID=Q1T5W2; Match level="QueryCoverage=99%, HitCoverage=90%, E-value=1e-102, Identity=53%"; Hit description=TPR repeat
  Pfam annotation: Domain name=TPR_1; Domain location=235-268; Score =18.7; E_value=0.022; Accession=PF00515.18; Description =Tetratricopeptide repeat
  Pfam annotation: Domain name=TPR_2; Domain location=158-191; Score =4.2; E_value=11; Accession=PF07719.7; Description=Tetratricopeptide repeat
  Pfam annotation: Domain name=TPR_2; Domain location=235-268; Score =23.8; E_value=0.0006; Accession=PF07719.7; Description =Tetratricopeptide repeat
  Pfam annotation: Domain name=TPR_2; Domain location=67-100; Score =4.7; E_value=9.3; Accession=PF07719.7; Description=Tetratricopeptide repeat
  Pfam module annotation: Pfam domain module=TPR_1::TPR_2::TPR_2::TPR _2; Domain location=235-268::158-191::235-268::67-100
MEKLRGVVRDCVSKHLYSSAIFFADKVAAFTADPADIYMQAQALFLGRHYRRAFHLLNASKIVLTDLRFRYLAAKCLEELKEWDQCLSMLGEAKVDDDGNVYDMKDSNVMYLDKDCEDREINYDKENIVVAKFRDLENESCKSDQSDSSFLRTLKSNTDLLACKAEYYHQCGEYQKCFELTNDLLEKDLFHLKTTLVHLAAAVELGHSNELYLMSCNLVKDYPQIKATSLDGTFPPAWIGYGNAYAAQEEGDQAMSAYRTAARLFPGCHLATLYIGMECMRTHSYKLAEQAKSICSSDPLVYNELGVVAYHMEE

SEQ ID NO: 206116 - protein, 85 aa, Glycine max
  Coding DNA Sequence Number=SeqID_89338
  Gene Ontology: Mol. function=transferase activity; Biological process= DNA integration
  Homolog annotation: Hit_ID=Q1SP23; Match level="QueryCoverage=60%, HitCoverage=14%, E-value=1e-10, Identity=55%"; Hit description =Polynucleotidyl transferase, Ribonuclease H fold
MKENLTYEAQPLRIDDRMVKQLRGKKIWGSASSKDATWELKGQMRDAYPTLFDTESEGTRTGQIELDFLAAVLLMFETLCSFNTY

SEQ ID NO: 206117 - protein, 94 aa, Glycine max
  Coding DNA Sequence Number=SeqID_89339
  Homolog annotation: Hit_ID=Q1S1N3; Match level="QueryCoverage=86%, HitCoverage=25%, E-value=1e-11, Identity=45%"; Hit description =Calcineurin-like phosphoesterase family protein, related
  Pfam annotation: Domain name=DUF1723; Domain location=58-93; Score =29.1; E_value=1.6e-05; Accession=PF08330.1; Description=Protein of unknown function (DUF1723)
MTSTIDPFLWKQHLHRYEEVTNDVIKSYAQTMPSLDPKIEPLLVQVGFSDVANLGQVKINDALVTALVERWRLESHTFHLPVDECTITLEDVAL

SEQ ID NO: 206118 - protein, 102 aa, Glycine max
  Coding DNA Sequence Number=SeqID_89340
MIVSLEDYSKGVIKAKAREEAGRVLISMKHMYEPYATFALANSSRSSAKDKSTMAAEPLASSTWDHPIFCLSEPSSERNTPLAERKEESRRRMSYACSLSEG

SEQ ID NO: 206119 - protein, 433 aa, Glycine max
  Coding DNA Sequence Number=SeqID_89341
  Gene Ontology: Mol. function=ribonuclease H activity
  Homolog annotation: Hit_ID=Q1SZM6; Match level="QueryCoverage=37%, HitCoverage=52%, E-value=2e-25, Identity=41%"; Hit description =Ribonuclease H
MTPLILIFGIQQPTMFITLDPPTSEFARRLTFKFSFKEVGTGFGRAIYHRILNTFFGLPITKIFLLTPSMCGALEEDILHVLRDCNEAKITWRMLDLENNQDFFTLNFFFPQAFCLLVLADSFGGLGMTRFFKTRSNLSAWGRLLGGVPCFWYYTGWVQSEDVVDLLGRTNQDKDDGLEVVGMMPEEEDEEEAKEIEEIDALWKCCKTFRRLCEVSFSGSVKRMSWEWLWRLLFEVAMITRKWKEWRRCVQRHVIGNAKEAFRGGEFSVRETVQTEWTQISWSPPHPFKVKLKIDSSSLDNPGPLGFGGIIRDYFGAWLAGFFRIIDCESDSLVGLNHIAEDNGHCGVTASLKTELFALMHGLRKAWNLGYRNIMCHTDSKLALDLLETSSRLTGMSPFIIRCGKLTPAPTASPNMVPCITMQCSLGIIVLHL

SEQ ID NO: 206120 - protein, 591 aa, Glycine max
  Coding DNA Sequence Number=SeqID_89342
MSSFLSNSAIGMGGSDFGGSIEQPIMDWKRVRALGRIGGGISHPCGRAWPSAAIEELVPITVILPFFVSGGVRIGSGGGDVRASPRVDDVLKYKSSLTSAASFATLQRQVKLAKLVKPEDSCKLVVQGCRSDDFPFLRAVPGIILLLNVFQCALLKHLNMSPSQFHPNSGAIDRFFKVLATGVVVDAMPLMFNRDKEPRFPYLGATIGLIGHAGHYASFFGKRSPHYLGWSLVKQVGPTGRTVPLSEVVATTEEKGQLAGEVTPNAPSSVLAKRKRDDGTGSSSRKKLKASMSLRTLRQAARLTLDAGRPSAAPTATPAPSPPSAVTIQEATLVVVEVIVPASLAGSAVALSSTVVAPLLSADVVTTSAPSFLFGSNDSSLDVDSLWGATYKPKQKTMAGFVSAFDKNLIRLAGEFGNSRGKWIATPRGFAEGGILGGGVGGVLAKLLRTRLDGDELFKRCKDLQVEIKNLGDKLENMVAERDKLAKVVVDLDARLKESKSRLEESKLQATKEREASKELEEELLVYKKEVMEQHGKRFQKAVRQADFFAKDLYLGLFDPFKDVKDDVLLDEEDIVVEEEVADEGQGVGEQ

SEQ ID NO: 206121 - protein, 156 aa, Glycine max
  Coding DNA Sequence Number=SeqID_89343
MERSMIDAASGGALGDMTPAESKNLIEKMASNSQQFSARSDAIVIRGVHEVAKNSSSSAETKKLEDLLNLSSKISHNRTIMTSPATGTIPGGGIIPTLDGRILHNSNNSLIFKMLLAQADHTFLHQSSSNNSNSPRNRKQQPSLEELVRQMTMQNM

SEQ ID NO: 206122 - protein, 103 aa, Glycine max
  Coding DNA Sequence Number=SeqID_89344
  Subcellular localization annotation: CTP_CleavageSite=20; ConfidenceScore=5.47e-01
MDRLTTMMSALLSAQNSQAAAATVEQPLVSTTPLSTVTSPPLFLPPGCTWGMPPPVCGSPQPAVSEVPPPFAQQSAPVPQPSTSFPQAAMTYSAPLIHTIQQE

SEQ ID NO: 206123 - protein, 99 aa, Glycine max
  Coding DNA Sequence Number=SeqID_89345
MELLLLRVGHREEERASIARFLSGLSMEVRDKVELLPYKDLDELVQLCIRVEQQLKKSLLQNLMALSLIQGRTKPMQFVKFRDMPELKRKHRCTIREVP

SEQ ID NO: 206124 - protein, 410 aa, Glycine max
  Coding DNA Sequence Number=SeqID_89346
  Gene Ontology: Mol. function=phospholipase activity; Cellular component=membrane; Biological process=lipid metabolic process
  Homolog annotation: Hit_ID=Q7B171; Match level="QueryCoverage=70%, HitCoverage=98%, E-value=1e-130, Identity=71%"; Hit description =Phospholipase A
  Pfam annotation: Domain name=PLA1; Domain location=119-386; Score =545.2; E_value=6.9e-161; Accession=PF02253.6; Description =Phospholipase A1
CLGGDKALAAARAQVIDAHVDGAHARQALTQLLFADALLARQRMADGTPARRQHPALRQSRHRAESAARHYPPAWFYWQSRVRRNRLQGDPAQGPNSMRKQYALLAAAFMVPALAQADEATVKEVHDAPAVKGSIIANLLEKHDNPFVLYPYENNYLLYTYTSDMNKEAISSYNWADKAKKDEVKFQLSLAFPLWRGILGDNSVLAASYTQRSWWQLSNRGASSPFRETNYEPQIFLGWATDYSLGGWTLRDVELGLNHQSNGRSDPTSRSWNRAYARLMAENGNFLAEIKPWYRLPESASNDDNPDITKYMGYYRAKLGYMLGDSIFSVEGNYNWNSGYGGATFAWSYPISEHVRFYTQLFSGYGESLIDYNHRQTRLGVGEMLAQQVLQDTFGYQQFRPGQQTIIETA

SEQ ID NO: 206125 - protein, 400 aa, Glycine max
  Coding DNA Sequence Number=SeqID_89347
  Gene Ontology: Mol. function=signal transducer activity; Cellular component=membrane; Biological process=signal transduction
  Homolog annotation: Hit_ID=Q9KNI8; Match level="QueryCoverage=88%, HitCoverage=42%, E-value=2e-21, Identity=24%"; Hit description=GGDEF family protein
  Pfam annotation: Domain name=Cache_1; Domain location=90-173; Score =10.8; E_value=0.003; Accession=PF02743.8; Description=Cache domain
  Pfam annotation: Domain name=HAMP; Domain location=253-321; Score =24.4; E_value=0.00042; Accession=PF00672.15; Description=HAMP domain
  Pfam module annotation: Pfam domain module=Cache_1::HAMP; Domain location=90-173::253-321
MVNTTNNVFSNKHYLNLVGFGAVNGDFIQVARGQAESNDYLAVKDAQTDHHLTAYSHLTVNSLEKAVLADYQITQREWYAAVAKDQRPHWTKPFRDYEYENEIGVAFSSPAFNRQGQFVGVVASELHLNELNKSLEKFKPHPESILLIVNEKNELISSSVPSLTRNMLAGGKHSRLNLQTLENTHLPVVVAASRTLKANHHTGLQFFSSGKEEYYVDAFPITDRDDILHWTGIVISPARMITHTIIKYIAITMIMLFVIFVLGLLVVFYGLAKVVKPLRDIVRKADQLATHRWTPPDNKRHFPEIASLETTFMALSHKLAESFDAQRREIEEDKTTGLFSRTGLLRQTSLYQGRNLLALDKLSQKSVSATENCSPHYLSTSIMKRLLRQANTFIPAILAL

SEQ ID NO: 206126 - protein, 79 aa, Glycine max
  Coding DNA Sequence Number=SeqID_89348
MGEVEEVQERMKADMEAMKEQMDTMMEAMMSMKKIMEVYAAVVSATSTVAVVDRNPLSGLNQINPLALDMIAQGGKELG

SEQ ID NO: 206127 - protein, 230 aa, Glycine max
  Coding DNA Sequence Number=SeqID_89349
  Gene Ontology: Mol. function=transcription factor activity; Cellular component=membrane; Biological process=regulation of transcription, DNA-dependent
  Homolog annotation: Hit_ID=Q1LGF7; Match level="QueryCoverage=99%, HitCoverage=76%, E-value=1e-76, Identity=65%"; Hit description =Transcriptional regulator, LysR family
MPAPASTMRHTASKTAHVHALADALAQAAGDVLQEGLDGAVGMDADELVGIDQVGEMGRLRRRQRMVQRRDHGELIAEQRRHIQALDVDVAGHQPQVAGARADRDDDVARDLLFQLDVHVGILGQEGRQRVRQEGIGGGGVGQQAQPPLQAAGVGLQVGVQAFELAEHRVGVLEQHLAGRGQRHARGHAHQQPRLEGLFHVLDARAGGGQRQEGAFGRAGQIERFPHVHE

SEQ ID NO: 206128 - protein, 64 aa, Glycine max
  Coding DNA Sequence Number=SeqID_89350
MGQPRKPYGLTRNCFPRGARRGIWSAGGGIGRGIALAMEQAGAKVVVNDISVSLTGEGGGECPA

SEQ ID NO: 206129 - protein, 41 aa, Glycine max
  Coding DNA Sequence Number=SeqID_89351
MSPDWCGNSIDLEIVNDIKDMLDQHNVFAKTFRMAKESFDI

SEQ ID NO: 206130 - protein, 94 aa, Glycine max
  Coding DNA Sequence Number=SeqID_89352
MAGAGDGGGDYHQLDGSQRLLLDVMIIEMQRLLNRNNEELYGKIEGMENQLNQNTGRHYGGNRQNHATKTPEAVPRKFNCGGVLQGDGDGTSEG

SEQ ID NO: 206131 - protein, 123 aa, Glycine max
  Coding DNA Sequence Number=SeqID_89353
MGRRLALHMFAKGWKIGLGETITVKEVGALETEEKGFCSSMARHSYKTFWAYANEFLIRVTITRGGEANLAGKSLGWNNEEEDKGGRLALYMLGGKGLENRFMGNDDNRGSEGLGDGGGRFLF

SEQ ID NO: 206132 - protein, 148 aa, Glycine max
  Coding DNA Sequence Number=SeqID_89354
  Gene Ontology: Mol. function=nucleic acid binding
MLATGNRLLPSGNRLPKSKTLGWMKGCDHDKFQKLHMPCSHVVAACKHVNHEYRNYIHPMYTLGSVSNICRGLFEELCNEAYWPPCHELMISPNPEKKRSTKGCPVSTHMHTEMDIRESSQPKRYFVCHITSHSKKNCPHHVGSSQQL

SEQ ID NO: 206133 - protein, 83 aa, Glycine max
  Coding DNA Sequence Number=SeqID_89355
MQGFVRHAGFGVGFEESEGHVLWEGVANGDDDARRVGEKEGGIGGHVAEGADFSALRSLRRWWGERHLGISTMTPDSGEWGKI

SEQ ID NO: 206134 - protein, 59 aa, Glycine max
  Coding DNA Sequence Number=SeqID_89356
MPHVFGCSPTICSFNTLLNAFVESHQWARVENFFKYFEAACVTSNVETYNVLLKVLCKK

SEQ ID NO: 206135 - protein, 113 aa, Glycine max
  Coding DNA Sequence Number=SeqID_89357
  Homolog annotation: Hit_ID=Q8W0G9; Match level="QueryCoverage=64%, HitCoverage=10%, E-value=8e-15, Identity=49%"; Hit description =Putative fertility restorer
  Pfam annotation: Domain name=PPR; Domain location=30-64; Score=17.4; E_value=0.051; Accession=PF01535.11; Description=PPR repeat
MEGFYKDGNCKMASKIWAHILEDKLQPDIILYNITLMGLSSCGRVTDAVGFLDDALGCGVLPTAITWNILVRAEHMVSGTWVQYSFPLGYLKFGVAEQQRMCVLVSGIFVCLM

SEQ ID NO: 206136 - protein, 114 aa, Glycine max
  Coding DNA Sequence Number=SeqID_89358
MVSSQGLLICSLIYIQLDIGCIRLRSTDAAHHRRVPRRTRTRHICGYDSSVTWCPLPLLSLNTVEQITLLRLFLAAPASASIAAQCHVCFLPRAEMSVSSPSQAKEQDDDTKPL

SEQ ID NO: 206137 - protein, 263 aa, Glycine max
  Coding DNA Sequence Number=SeqID_89359
  Gene Ontology: Cellular component=chloroplast thylakoid membrane
MEALAGAARKRRRRVILLRQRTPRHTGVVPAYVSGASPTRNTPLTIYHAPRERNTVTDQLAALGANNTLGIYVVPPDGMIALKSLHPFFTPTNIKYGINRSRCLNTKGSVLCLCKSNESESQAPQPGDIRKQELLAQIAMLQTQKVRLTDYFDERSEYLTQFGEEAKAEFDKIGKDALQGLDEASAIITANIESQMVEFEESAELNRQEIQEHEKELGEFEVQMEDGRNEGLFFKNLRRRTPVDKSKAKEEAEKIKDVAREKA

SEQ ID NO: 206138 - protein, 74 aa, Glycine max
  Coding DNA Sequence Number=SeqID_89360
MDFHKGFVPLSTAYNQPPTSSCYHPPLLTQIHDISHEDEEEDDDNNTNNNDDDHDGDDVPQQQQIVTRYHHRTR

SEQ ID NO: 206139 - protein, 103 aa, Glycine max
  Coding DNA Sequence Number=SeqID_89361
  Gene Ontology: Mol. function=protein kinase activity; Biological process=protein amino acid phosphorylation
  Homolog annotation: Hit_ID=Q2R1R7; Match level="QueryCoverage=66%, HitCoverage=4%, E-value=1e-10, Identity=52%"; Hit description=AT hook motif-containing protein, putative
MSKGDYPNNPRLIYVKRDHNTQQLKDEFPSLFGSLTVASSGIAFLLLLGGRIAHSKFAILVPALQNSTCNIGQDSELVELLKVIKLIIWDEAPMAHKFCFKAL

SEQ ID NO: 206140 - protein, 117 aa, Glycine max
  Coding DNA Sequence Number=SeqID_89362
MKVTKNGIIIRDLRWGSAFNIVWLDLVIGGGLDTDLVIGGDGRGIVHGGAEGRLSCTGRWVLARSEGLEGVVVRREMAVVGGYGGGCWWLWCLGQRRRLREKIMCCVVKGNSNNAFV

SEQ ID NO: 206141 - protein, 159 aa, Glycine max
  Coding DNA Sequence Number=SeqID_89363
MLQPYRINIGLKEHSNRVTPKAYTPKSPSGPLPPDSVIPPTAPIEFSNVRETEKRLKPLLVLSSCDSFFSLHEYYLKILTVEVCATEFQTTYPNFMKIQRYDFEIPNGKNVGNWVANVVLKFHDDPTVNESEIVIFLRQDVTFGGGGDRVGVDGYEAPI

SEQ ID NO: 206142 - protein, 76 aa, Glycine max
  Coding DNA Sequence Number=SeqID_89364
MERPELKLVSHRRKVALIGRPVHAIEGLVVATGLSPLIECSVVTARSWTYICICGEVAQGDQHLSPSSKRVDDHTR

SEQ ID NO: 206143 - protein, 403 aa, Glycine max
  Coding DNA Sequence Number=SeqID_89365
  Gene Ontology: Mol. function=transferase activity; Biological process= biosynthetic process
  Homolog annotation: Hit_ID=Q07A02; Match level="QueryCoverage=99%, HitCoverage=62%, E-value=1e-113, Identity=58%"; Hit description =Sulfoquinovosyldiacylglycerol synthase type 2
  Subcellular localization annotation: CTP_CleavageSite=81; ConfidenceScore=5.97e-01
MKTTAITINPSLSPPFCSKATTPPSCSSSSSSFPPSFPRFHLSGAKPISLSCRGTRLCFLKGSKTLWGRKSFVLGAGNMTMAEVDSHEEGENEGALVGSENENNSRPRRIALFVEPSPFAYVSGYKNRFQNFIRCLREMGDEVMVVTTHEGVPQEFYGAKLIGSWSFPCPLYQKVPLSLALSPRIISEVARFKPDIIHASSPGIMVFGALIIAKLLCVPIVMSYHTHVPVYIPRYTFSWLVKPMWLIISMYTFLLTPSNLDSNIEFLHRAADLTLVPSAAIAGDLLAARVTAAFENTHFSVCLLLCCEFLSKFFSCWYPANKIRLWNKGVDSEKFHPKYRSHEMRLRLRCGPFLILSYNQVLAIMSFHHVLKHLSYSNDEPDKPLIIHVGRLGVEKSLDFLKR

SEQ ID NO: 206144 - protein, 148 aa, Glycine max
  Coding DNA Sequence Number=SeqID_89366
MNVDCELAHYVPTCITMEQYQNLLALISLLGTRANGGVEGHDTLPMQGPSLFGFWDRLTAVLKANDGSEGDSVLPCKGLLCLIFFALVLILLWTGKRLTAVLKANSSAEGDDALPWKDFLCSIFFALVLILLWTGKSDFWDRLTAVLK

SEQ ID NO: 206145 - protein, 407 aa, Glycine max
  Coding DNA Sequence Number=SeqID_89367
  Homolog annotation: Hit_ID=Q1RVB5; Match level="QueryCoverage=48%, HitCoverage=59%, E-value=1e-21, Identity=59%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MAAKYEIEQFNGSKLSLWKLKIRAILKKDNFEEAIEGKPVNVIDERWKEMDDNVVSKSLHTIHIEDNFDKLNFVKCYGVEDCEGDLGYSPYYIDGDVERKTIIPPYMCLNGYRLWDPTSHKVVVSKDVVFGENELESEQKNDNTTKDTTIMQIEKTLGEDNSSEAEQGDEEQEPNEANGGQVKKPLEANGFITSNEMADQVERYRARLVVKGYAQKEGSNLTPTLAMVAAIASSFELMPRRHNTSFRVMVISSIGKWKDEISLCHLYTRAFMKPLFAVRYHVVTRANNLDHDTKALTVGSMGNGPKILLDRHASAYDSSFTSVGGCCLSENERVEEKKEKGSFRLGWGGGRRKEKEKRKGHRYEKEKEKGKRRRFGTKMEKEKGKEVLGRGRRKREEGGMRNFEVGG

SEQ ID NO: 206146 - protein, 65 aa, Glycine max
  Coding DNA Sequence Number=SeqID_89368
MNRLRGGLGDATSLGNGEVVMDLVETLFLHAKIFGVDGVMKDNDSQEKTEDVGNVVFSDANIVVF

SEQ ID NO: 206147 - protein, 270 aa, Glycine max
  Coding DNA Sequence Number=SeqID_89369
MQPQCPSTSCARHLEEQFTGFCPSCLRERLIILGHESLSCFHKSLLSLPSLSVHPHRPFASCDRHPEEQFTGFCSSCLYERLTILKHDSSSSIFKHPITSTTSPKAIFRSFTTMLDANCLPRSSSFTFQPMLRRSKSCPIFKTKGLSCALDLRRKSCDFMAYSTIFSIFNPYDKQGIPKKEPKVESHNLASPSIIRDRVQENIKEEPSIELEANEEAEKTIKAMEDHMDIDSQVKKSCGRDSKECILFATSIFTKKFRKWRQKQKMKKNE

SEQ ID NO: 206148 - protein, 57 aa, Glycine max
  Coding DNA Sequence Number=SeqID_89370
MAQKYDLCGVHFQLDEIVRTLRKYSISHLTKGTTILLHKVQFLQVSSLLPVSQPCVQ

SEQ ID NO: 206149 - protein, 112 aa, Glycine max
  Coding DNA Sequence Number=SeqID_89371
MGTETCFREKHLAYLEPNSENCSETGSEINNTGNETYLRSPRVPQSLQQKPIKVLGLTTYSRNRLRYSIEQHRLDEMYLGKLAMDNIKRVVTIFGAMENNKLRCRTREGTRR

SEQ ID NO: 206150 - protein, 50 aa, Glycine max
  Coding DNA Sequence Number=SeqID_89372
MRESRMSKLHVWANLMVSEEPIIRDNVSDFSDDEQQHNFHEHGEPNNQSE

SEQ ID NO: 206151 - protein, 118 aa, Glycine max
  Coding DNA Sequence Number=SeqID_89373
  Subcellular localization annotation: CTP_CleavageSite=36; ConfidenceScore=5.11e-01
MSFNTFNETLGGRGGVELWKVLKKNSPGVHVSVSVSCSVSVSVLVLHRSCELRTQKGQTWIATEAAIVDPCDVVLVVWQNSWQISDLVMGGWVQRCHFSGLVIFHGRDFGWGWMLEGL

SEQ ID NO: 206152 - protein, 105 aa, Glycine max
  Coding DNA Sequence Number=SeqID_89374
MEVKNYRFWVWDDDLKKSLNQDYESNGGTGTNVDNVGCGSNVDVNHLLSQMDELKLKVATNEERICLYEEQNMELKKMLTKEEHQSQANFEVVVELRKKNYKATY

SEQ ID NO: 206153 - protein, 79 aa, Glycine max
  Coding DNA Sequence Number=SeqID_89375
MAPQSAIHQLYYTALPLLAVGYAGRAASYQRSLESRINRQITYEELWENIYKGLKIMAVIICNYRIIIANYKFLGGVAT

SEQ ID NO: 206154 - protein, 84 aa, Glycine max
  Coding DNA Sequence Number=SeqID_89376
MFPFQVAMLNKSNYDNWSIKMKTLLSVQGVWEIVEKANEDEVMVDIAQEDEVMDKDKVGGLMMTTTTSKEEEAQQETVGKATQD

SEQ ID NO: 206155 - protein, 82 aa, Glycine max
  Coding DNA Sequence Number=SeqID_89377
  Gene Ontology: Mol. function=zinc ion binding
  Homolog annotation: Hit_ID=Q1SK91; Match level="QueryCoverage=97%, HitCoverage=22%, E-value=6e-11, Identity=43%"; Hit description=Zinc finger, SWIM-type
MEEGEDESPRLILNRVFWAFNLCIEDFKYCKPLVQVDGTFLTDKYHGYEMRKPQFETKLLAMRAKFLQAADWLDQIPKSKWT

SEQ ID NO: 206156 - protein, 155 aa, Glycine max
  Coding DNA Sequence Number=SeqID_89378
  Homolog annotation: Hit_ID=Q1SAV4; Match level="QueryCoverage=37%, HitCoverage=16%, E-value=3e-14, Identity=56%"; Hit description =Integrase, catalytic region
  Pfam annotation: Domain name=Chromo; Domain location=23-66; Score =17.1; E_value=0.0094; Accession=PF00385.14; Description='chromo' (CHRromatin Organisation MOdifier
MVLSIPSASATSPPDAVDNNPLVEPLAILDTKLNKLILVQWLGLAPEDTSWEKWDDFEALYHLEDKVVFSLRIDVKMLETCILFSRSLSTRVQLYTTAGSTVNGKKYTSWSWLRAKNESFKCTFYEWYNQPKHCLIYSYATVREENTRPPTYWRE

SEQ ID NO: 206157 - protein, 80 aa, Glycine max
  Coding DNA Sequence Number=SeqID_89379
MEIEKQGFHRIHMAEGDIHKTSFQTYHGHYEYRALKCTISKAHILAPLDFTEPFMPETNASGAATGVVLMQKNHFIAFFS

SEQ ID NO: 206158 - protein, 80 aa, Glycine max
  Coding DNA Sequence Number=SeqID_89380
MKVMEVRRDLEISKPWGNIGAWTANSELVKADEAEAQAAVVAMVVKPQRFPSLKEAMNSKPMKKKGTTITLSEFNCGSFD

SEQ ID NO: 206159 - protein, 121 aa, Glycine max
  Coding DNA Sequence Number=SeqID_89381
  Homolog annotation: Hit_ID=Q9SJV8; Match level="QueryCoverage=38%, HitCoverage=22%, E-value=2e-08, Identity=63%"; Hit description =Expressed protein
MKHFTDTLISANIGTKAGTGPPLEVDGIDKLDLALLVLAVVLVIIVAVKPKKLQFDLEQLGVQYMGITHNPPSIASLSLTIHLLFAATNPNKVGIKIEFLQPGGSTSSRAAATAVELQFAL

SEQ ID NO: 206160 - protein, 139 aa, Glycine max
  Coding DNA Sequence Number=SeqID_89382
  Homolog annotation: Hit_ID=Q1SKA6; Match level="QueryCoverage=42%, HitCoverage=7%, E-value=1e-08, Identity=50%"; Hit description =Rad21/Rec8 like protein, C-terminal; Rad21/Rec8 like protein, N- terminal
MCHKISKSSNTLQSNHHCYSTHDFFQAAHHNYCWYQEMVYPSGTRHESLKHVVKGLNPDECIYGENLVEREIPLMSANRTFYKKVEYVLEDCNEVLVKINKFVINKEGLVCVETLCMPVTKPERFELDAFELDEPEDAG

SEQ ID NO: 206161 - protein, 88 aa, Glycine max
  Coding DNA Sequence Number=SeqID_89383
MMTHHLPEGYRVNTTFNISDLIPFACGVDIEEEELTDLRSNPLQGGGDDVILPRKKPVTKAMSKRLQEDWARAAKEGPRILMNLRIDF

SEQ ID NO: 206162 - protein, 92 aa, Glycine max
  Coding DNA Sequence Number=SeqID_89384
  Subcellular localization annotation: CTP_CleavageSite=38; ConfidenceScore=5.78e-01
MAESSKKRKGSSASASASRAHRFGATSASTTPIPPSLSSSPVFSSDEQQKRYSNLFSSRSIIDPKFIDMEFFSVETFDCIQAFQNLGQHSDF

SEQ ID NO: 206163 - protein, 359 aa, Glycine max
  Coding DNA Sequence Number=SeqID_89385
  Gene Ontology: Mol. function=glycerol kinase activity; Cellular component=mitochondrial outer membrane; Biological process=glycerol -3-phosphate metabolic process
  Homolog annotation: Hit_ID=Q0K1Y4; Match level="QueryCoverage=94%, HitCoverage=66%, E-value=1e-140, Identity=71%"; Hit description =Glycerol kinase
  Pfam annotation: Domain name=FGGY_C; Domain location=209-359; Score= -56.5; E_value=0.0021; Accession=PF02782.6; Description=FGGY family of carbohydrate kinases, C-terminal domain
  Pfam annotation: Domain name=FGGY_N; Domain location=1-206; Score= -47.9; E_value=5.7e-07; Accession=PF00370.11; Description=FGGY family of carbohydrate kinases, N-
  Pfam module annotation: Pfam domain module=FGGY_C::FGGY_N; Domain location=209-359::1-206
MVKDGTSYVEINVSFSPKVVAQLRRINRAIRIYSLAKQIATAVLWDTATGRALVPAMVWQDTRYVDELDRLAPAWNPLLLEQVGRPAGVRSQYLWAARHLRDSPAVAQAWRERRLAFGTVDTWLLWHMSDRRECVTTPTNATSAGAYVLSGHRYYLDWIDALEFPRELLPALRQEADDFGQTREDILGLAVPIRASAGDQHAGAVGLGCKDRGQAKCVHGTGSFVDLIIGPEAPVNSGRYEGSLTMTARRQDQVSQFAVETFVATTGSALNWVCDKLKWFRNAQEISELAATAQSAGGVTFIPALTGLRVPRMAAGARASLTGISMATTQAEVAYAILEGIAHSVPSCIEADEEVSGVQ

SEQ ID NO: 206164 - protein, 77 aa, Glycine max
  Coding DNA Sequence Number=SeqID_89386
MVKACSKIDPSNIDCNDATQAECQSLSVTADHDPVAGLPLTPKKRMSSDEADDELGSSQISPAQLSSNKLTRHSHKS

SEQ ID NO: 206165 - protein, 158 aa, Glycine max
  Coding DNA Sequence Number=SeqID_89387
MTNATARKGEEHAEIEIHQESICQVTSIHHQLSNEEEKPEVFNTPEYPYLAIVGYVGGKDKGRLELSMEDQKISFDLFEAMKHSDMGDACFEEEEVEQEIALLASTMVLQSLLEKEPGYRRDFLARDEELDDSKDSCVEQVVFVELEKLRPAKSPKHN

SEQ ID NO: 206166 - protein, 211 aa, Glycine max
  Coding DNA Sequence Number=SeqID_89388
MEEASPSIPIEKPLFKPFKVSDKAKRKIRELRKSKSLIEGVGDNHSELLNKIGSLLKVIPETPQTSENTSTMVTRSTSKIINVINEDSDQNSDNATEIGSVSEKNINPINSKHWKTPSKLYYQRPTAPDLLFEEIGENNFKSFSANNIYEWNIDAQTEYNIMNTLQHMTMVATAYQTSHEYSEETIIDILVVGFSGQLKGWWDNYLTNGEK

SEQ ID NO: 206167 - protein, 125 aa, Glycine max
  Coding DNA Sequence Number=SeqID_89389
MFFKYGIDNVFVHRFQPTYASWLKVSVDLRDRWFGEFKLKEFQRPPTAWKVMKKTKKLKSREWVNDKSCEFAEKYQHHRDEILQHSTEEGTSTQDSPNTATFVNDNEIYMNVVGGPNYKENVYGL

SEQ ID NO: 206168 - protein, 106 aa, Glycine max
  Coding DNA Sequence Number=SeqID_89390
MAKFDPEVVLEFYANAWRTEVGVRDMRSWVRGQWIPFDVDALSQFLGDPLVLEEGQQCEFSQRRNRADRFNEEAIAQLLCTPGQDFARTAAGRRVRIMHTSMTTLT

SEQ ID NO: 206169 - protein, 131 aa, Glycine max
  Coding DNA Sequence Number=SeqID_89391
VGVEEVKDPDAPVPVPTDEATTSPAKPPQKPDPEVDDPLYLMTLTIPELFLRPYQVTWDATMFRIFNPNFSLYIKHEDLSEIAHGGQCLSISVLQLHLTETSMRVGNSDLYGFLEPRSIQRPDNYLKGIIN

SEQ ID NO: 206170 - protein, 46 aa, Glycine max
  Coding DNA Sequence Number=SeqID_89392
MVVILGIASVRLFPGLHAHIVNTSAMTNLKDRDLVAIAKGDRGGGR

SEQ ID NO: 206171 - protein, 119 aa, Glycine max
  Coding DNA Sequence Number=SeqID_89393
MVMLTGFASEKHKGDSINDYGGEHGARKGRRLTGFGRILAALWWCGKRIPMVIVGLRNLEELAVVFPITWKNFVLQIINNQSSTHPSSSFDNTTSTFVPLAYGTPIQALGFRYQLDKDW

SEQ ID NO: 206172 - protein, 197 aa, Glycine max
  Coding DNA Sequence Number=SeqID_89394
MTLAKTMIQYLPIYPMMTSLIPKIQEIQKFQRAFHFEGVEQELKEIEWLPFDACTKGCLQELEQLNGGLEPSSEGWVTINSDDFVNEQDGLTACGGCFERIAISSKESFSQVFGSNDASNGFGGKVIRRLMSSIMGIHFCHIYHEGNSCVDSLANLTYDLERNFVIFEQPLTYLQVLLLVDCGDLCWTIVPITNLLY

SEQ ID NO: 206173 - protein, 88 aa, Glycine max
  Coding DNA Sequence Number=SeqID_89395
MYKDKWTQHWPMGSKIYPEVHENPRAFFNSSSPILLEPLAHGFGNWPLPREDCIREVDKGVALAPTYPQIYFICEQRVIKALDLEMTF

SEQ ID NO: 206174 - protein, 90 aa, Glycine max
  Coding DNA Sequence Number=SeqID_89396
MDLEGQGLRKWHSCSVETEFCWWPFASLTLPRLVWTTGIAVVVVRMEELDADKGDDKKLKDQSKNNSSESRTIQEFKIKIKKNSRLKMKV

SEQ ID NO: 206175 - protein, 51 aa, Glycine max
  Coding DNA Sequence Number=SeqID_89397
MSYHTIGNPTLSLSPRRHHWWRVRVFHPCKDTPTHVINMSLKDIPNRCNPK

SEQ ID NO: 206176 - protein, 35 aa, Glycine max
  Coding DNA Sequence Number=SeqID_89398
MAQSEAISWIVTLVLIRTDRNALVGNLMDCHTGAN

SEQ ID NO: 206177 - protein, 90 aa, Glycine max
  Coding DNA Sequence Number=SeqID_89399
  Gene Ontology: Mol. function=nucleic acid binding; Biological process= DNA integration
MEAILYASVVGSIMYAYICTQLDISFTAEMRFDHLKVIEYSDSNFTGSVDMRKSTIDYVFLLAGGAVLWKSAKQLVVVASIMKAEFVACF

SEQ ID NO: 206178 - protein, 211 aa, Glycine max
  Coding DNA Sequence Number=SeqID_89400
MTPPSMDFPLSSSENTLFAPSSSFRWPNQVPHQCEDHSLTIAGEEEPNCSCEALNIMASYSMVGVMHRYGLGLVGGRDICNEKGAAPKHRQVLFSVESGNLDKCENCRSVKLIKPPSLDKCCLGCFCQVVRGKHPFDFEVSTLSNTTEAGKSWGSCKVAVKACESDDLLFLRAGPLVKQIEPAGGTTPSSIVPPIAEEGGQPTGEVGPAAK

SEQ ID NO: 206179 - protein, 55 aa, Glycine max
  Coding DNA Sequence Number=SeqID_89401
MNHVFIGPRALLGIMEYVAGELDREPMLTSSCTRAELTSSSATERYKSKGTPGLG

SEQ ID NO: 206180 - protein, 174 aa, Glycine max
  Coding DNA Sequence Number=SeqID_89402
  Gene Ontology: Mol. function=ribonuclease H activity; Cellular component=mitochondrion; Biological process=DNA integration
MKGSRARIILEGTHNVTLEKSLKLNIKALNKQTEYKVLILGLKLAREVRAKRLRCYKNSQFVQGQVANIYQTKETMLLKYYHIAKTLINDFNYFEMYYILRESNTGVDLLSKLASTKKIEHLKTIIQETLQDPTIDTEEVMAGEEKEPDWMTPFENFLIWGLLPLDEHETRRQT

SEQ ID NO: 206181 - protein, 549 aa, Glycine max
  Coding DNA Sequence Number=SeqID_89403
  Subcellular localization annotation: CTP_CleavageSite=52; ConfidenceScore=5.12e-01
KRDDNAGALGHKKSRALLSLRALRQAVGFTPGLGHPLSLQDVRPTPVVVEAPASTVVATVTPAPPPPLVVPVQEVTLVAGVDVLATLAGSIMTSSSIIATLLLSANVVTTSAPMITLVILPKSSSREVWRFWKRMDNGNKKLCTRPNHQLSSKVGIVLVKLMRTRKRKKDLVAKVEGIAVEMDELAKETEADKELEEELIMYKKKDGTEDDVLLDEEDIVAEEEVVEEQGGDATDPVDVKVLPTIMVAVHLVEPGSLTVVVEECVPRVDLAYLEFLWRWNLAKEGLTKAFGELTRDASVLDFGETHQGQTLDLTSLGIVCLGFWRDSPRADLGFDEPSICSAYAVLLHVSLRGVACTGDVVSCSCIPVTRGVAHIRDVIDVVSWFCIHVTRGVACTRDMVARALAYVTLVEWHILEMWWCVLAYVSLVEWHILETWWLALVYMSLMEWHIQETRWIWRDSPRVDLGFKELEELTMDACCDPEWAFPVRTKFSCLGVFSGFAIRGHMGPKDDSVGSLCLTIGLGSSTKVHFSASLAIISCNGLASIHLVK

SEQ ID NO: 206182 - protein, 91 aa, Glycine max
  Coding DNA Sequence Number=SeqID_89404
MAIGGGLEPPKGISRMKPNRVLTMGEKEREMMRDCGVYFIAAPRWAPNVLTTIQNWHTSGWAWLRRTRGGTYKIKDSDAQSMREPDTYRSE

SEQ ID NO: 206183 - protein, 361 aa, Glycine max
  Coding DNA Sequence Number=SeqID_89405
  Gene Ontology: Mol. function=nucleic acid binding; Cellular component= intracellular; Biological process=DNA integration
  Homolog annotation: Hit_ID=Q1S3Z1; Match level="QueryCoverage=99%, HitCoverage=33%, E-value=4e-99, Identity=47%"; Hit description =Integrase, catalytic region; Zinc finger, CCHC-type
MATKFDLEKFTGSNDFKLWKMKMEAILIQQGCDKALKGESNMPLTLMQEEKKSMIDKAKSVIILCLGDKAPREVAREKTAAGIWAKLELMYMTRSLAHRLCLKQQLYSFKMAESRTIEEQLTEFNKNIDDLENIRVKLEEDNVVILLNALPKTFEHFKDALLYGKDQLITLEEGKRKKGEGKWKKSKLETKKQASKGYESAGVLVASSNDSQKSWVMDSGYTYHMCPVKDYFEDLEQKEYGIALLGNNKACKVHGIGTIRPRMFDNREMLLQDVRYVPELKRNLISISMFDFIGYTTKVENGMMKRTEDKSKLWHLWLGHISEKGLIELEKQHLLMGDKLHKLEFYDQCVLGKSHKVKFGT

SEQ ID NO: 206184 - protein, 199 aa, Glycine max
  Coding DNA Sequence Number=SeqID_89406
  Homolog annotation: Hit_ID=Q1STT2; Match level="QueryCoverage=48%, HitCoverage=20%, E-value=3e-10, Identity=36%"; Hit description =Lipocalin
MVVLEGLRWRLGDGNRIHVWFDPWLRGGTKKLTKPIVNSFDPNLLLNDLIDRDSEVDDAIEAKPMPLINLQGEDKPIWRFSKDGTYTVRTTYHMFMEDNKNPMSSNMVHKANAFLSEKRQAQEEGLSKPTTTTRQAQDDKWQPPSTGLIMCNLDATFFNVEGEFGAGMCIRDDLGQFLLVATKLYPIFPLMNKGEALVL

SEQ ID NO: 206185 - protein, 102 aa, Glycine max
  Coding DNA Sequence Number=SeqID_89407
  Gene Ontology: Mol. function=nucleic acid binding
MEQPPPHERNLRQMAAPDFSYESLCIQYPDEGVPYVLKTGLIHFLPKFRGLAGEDSHKHLKEFHIVCSTMKPRDVQEDHIFLKAFPYSLEGVAKDWLYYLAL

SEQ ID NO: 206186 - protein, 140 aa, Glycine max
  Coding DNA Sequence Number=SeqID_89408
  Gene Ontology: Mol. function=nucleic acid binding; Cellular component= intracellular; Biological process=DNA integration
  Homolog annotation: Hit_ID=Q1S9T9; Match level="QueryCoverage=99%, HitCoverage=27%, E-value=1e-25, Identity=54%"; Hit description =Peptidase S8 and S53, subtilisin, kexin, sedolisin; Integrase, catalytic region; Zinc finger, CCHC-type
MAKGFTQIEGVDYNDIFSPVVKHYSVRILMSIVNQYNLHLEQLDLKTAFLHGDLKETIYMRQLEGFALDDMRNPQGGAMIEGFVDGDFAGCLNTRKSLSGYVFTLFGTAINWKSNLQSVVALSTIEVEYNALAEGVKEGL

SEQ ID NO: 206187 - protein, 966 aa, Glycine max
  Coding DNA Sequence Number=SeqID_89409
  Gene Ontology: Mol. function=RNA-directed DNA polymerase activity; Cellular component=chromatin; Biological process=chromatin assembly or disassembly
  Pfam annotation: Domain name=Chromo; Domain location=897-951; Score =20.2; E_value=0.0041; Accession=PF00385.14; Description='chromo' (CHRromatin Organisation MOdifier
  Pfam annotation: Domain name=RVP_2; Domain location=217-336; Score= -37.5; E_value=0.00083; Accession=PF08284.2; Description=Retroviral aspartyl protease
  Pfam module annotation: Pfam domain module=Chromo::RVP_2::RVT_1; Domain location=897-951::217-336::433-615
MALPFWVVDGQQWPVHFLACFHPGTPNLLHVFLLRQPTGTLFKLQQTDTVAQYLSDFEDLANRIVGLTPQFLMSCFILGLTLDICRKVQTLQPLTLVQAVGLARLQEEKLLDTRPPFRNRAPPILPVPQPRPTPSLALLSPPIPRLPPPRPPPTLKHMSPEEIISRRERGLCFNCDEKYHRGHRCASRVFFLVTEKDEAIDPNIEGLDPGPEPPDIHLASETLRLIGMVVGHFMVVLVDGGSTHNFIQEELVAQLGLQTRDTSPLRVMVGNGQHLVCTRYCADISLTIQHFTCVVDLYVLPIAGTNIILGVQWLKLLGSVLTDYSTMSMKFFYDGQLIELHGDTKPMLTMLTPPQFRRLTRKSDTSSFYHIVVLAEAQSSDSSIPLPPRIQALVDHFGALFQPPSLLPPERVTDHHIHLILLVAPGLIRPSTSPFSSPVLLVRKQDGSWQFCVDYRALNAVTICDRFPIPTIDELLDELGNACWFSKLDLLQGYHQIRMHSPDIAKTAFRMHHGHYEFKVMPFGLCNAPSSFQATMNMIFRPFLHRFIIVFFDDILIYSMTFEEHVGTRGASLSGGIPWTRGFAKGGGTSFHKGGGGTPMAVETNASGVGMGAILSHHGDGQEVAAISSRPPLYHSYRSPQSKGAAHAILSNPIVAHVPCSTDGAIQSFLAKYPEFTIANGLILRKGRIWLPPQLPLITTLLLDYHATPTRGHLGTTKTIARLMDNFFREGLQDDVTKFVESFLDCQHTKYETKRGNTIILVVVDHFSKGIHLGSTPYEVTFGWKPFNFLKYLTGNSKVDVVDEMLTNCEEAFLLIRKKLIKAQGLMKKYADQKCREVVYILVLDRVGPVAYRLKLPKGTSVHPVFHCSLLKPFKGSSETTDTTPLPDQIVHNQPLISPLAILDYCQASSGVDSHWEVLVQWSGLSPDETSWESWPQLCRDYHLVDKGCKKQLVVSLVETLTMGCN

SEQ ID NO: 206188 - protein, 40 aa, Glycine max
  Coding DNA Sequence Number=SeqID_89410
MKGRVNLGLEGESMVLTYEKLGLCKREKQMTKVNNEPFLG

SEQ ID NO: 206189 - protein, 63 aa, Glycine max
  Coding DNA Sequence Number=SeqID_89411
RSKYTNEKLESLGTEYLLVGDEQKRKTESKNAKKDDPRAANSGTLTMSPPFSWISILPNLNLL

SEQ ID NO: 206190 - protein, 111 aa, Glycine max
  Coding DNA Sequence Number=SeqID_89412
  Gene Ontology: Mol. function=nucleic acid binding; Cellular component= nucleus; Biological process=DNA integration
  Homolog annotation: Hit_ID=Q1SEE1; Match level="QueryCoverage=93%, HitCoverage=9%, E-value=2e-30, Identity=64%"; Hit description =Integrase, catalytic region; Zinc finger, CCHC-type; Peptidase aspartic, catalytic
MVVASSNMDEIQNLKIQLSKEFDMKDLGSTKKILGMQIMRDEQKGIFAVISGKDQLPQTEEERGFMAKILYASAIGNLMYAIVCTKPDIGHAVRVVSRFMSNPGKNSLGRS

SEQ ID NO: 206191 - protein, 140 aa, Glycine max; identical to SEQ ID NO: 146870
  Coding DNA Sequence Number=SeqID_89413
  Gene Ontology: Mol. function=oxidoreductase activity; Cellular component=integral to membrane; Biological process=electron transport
  Homolog annotation: Hit_ID=P0AFY2; Match level="QueryCoverage=90%, HitCoverage=53%, E-value=8e-61, Identity=88%"; Hit description =Protein sanA
  Pfam annotation: Domain name=DUF218; Domain location=2-87; Score =30.5; E_value=8.3e-07; Accession=PF02698.7; Description =Uncharacterized ACR, COG1434

SEQ ID NO: 206192 - protein, 76 aa, Glycine max
  Coding DNA Sequence Number=SeqID_89414
QTAIANGEFAEHLPRGKENATGDGDFIAASSRQLYWRVWARDSSLLFRREARFSAFSDKGEDTFFSLGELQLPLAS

SEQ ID NO: 206193 - protein, 159 aa, Glycine max
  Coding DNA Sequence Number=SeqID_89415
  Subcellular localization annotation: CTP_CleavageSite=102; ConfidenceScore=5.71e-01
MKLLKRQLGAPSNLLNGPFCPSFRNLKKFSSSSGTSQSLAACLLLLREPDCLFSSSDSNPSRKTCKGFFRNFRKKVFRKISGRRVLPKVTKGHPEAHFFRKYSGAPSSGNFPEEVVLSESFRKKGSSRCPLNIPEELFGRATFFGKFPEELLLPEVLFS

SEQ ID NO: 206194 - protein, 183 aa, Glycine max
  Coding DNA Sequence Number=SeqID_89416
MPISPCRWIVPTNRPVGPKKSNRALGFPALVMGLYQSYRVPIPPARSCHRDIGIAPTKTPSGPEEVQQGPGVSSSGYGPLSVLQGTRSPSKGSRPQDTQWTRRSPTGSWSCQALITGLCQFYGVPVAPSKIIRPPTNRAFIKKYCVPRQAQGETPQQPGDDRQRATDAPPSPLEFTSAHPQKG

SEQ ID NO: 206195 - protein, 157 aa, Glycine max
  Coding DNA Sequence Number=SeqID_89417
  Gene Ontology: Mol. function=RNA-directed DNA polymerase activity; Biological process=RNA-dependent DNA replication
MGILSWNCHGIGQHRATPTLKDLVRSHKVDVVFLCETLAIVSKIEECVIEDFNDLLSMDDKRGQVDHPLGLLNGFRSTVMCSGLRDVRLEGYQFMRARGRGIEELVEERLDKALTSHEWIDVFLNCKLQNLIAMIFYHFLIWLCGVPKIMTGLIVMI

SEQ ID NO: 206196 - protein, 370 aa, Glycine max
  Coding DNA Sequence Number=SeqID_89418
  Gene Ontology: Mol. function=protein dimerization activity; Cellular component=nucleus; Biological process=regulation of transcription, DNA-dependent
  Homolog annotation: Hit_ID=Q39895; Match level="QueryCoverage=100%, HitCoverage=93%, E-value=1e-153, Identity=77%"; Hit description =TGACG-motif binding factor
  Pfam annotation: Domain name=PHD; Domain location=70-119; Score=1.1; E_value=0.044; Accession=PF00628.19; Description=PHD-finger
  Pfam annotation: Domain name=bZIP_1; Domain location=310-370; Score =39.4; E_value=1.2e-08; Accession=PF00170.11; Description=bZIP transcription factor
  Pfam annotation: Domain name=bZIP_2; Domain location=304-364; Score =36.2; E_value=1.1e-07; Accession=PF07716.5; Description=Basic region leucine zipper
  Pfam annotation: Domain name=zf-C3HC4; Domain location=71-116; Score =3.6; E_value=0.067; Accession=PF00097.15; Description=Zinc finger, C3HC4 type (RING finger)
  Pfam module annotation: Pfam domain module=PHD::bZIP_1::bZIP_2::zf -C3HC4; Domain location=70-119::310-370::304-364::71-116
MERSGGMVTGSHERNELVRVRHGSDSGSGIGNENWSLTVSDFLIVMHIKDFITNFVKIMSKPLKNLNGQICQICGDTIGLTATGDLFVACHECGFPLCHSCYEYELKNVSQSCPQCKTTFTSRQEGAEVEGDDDDEDDADDLDNGINYGQGNNSKSGMLWEEDADLSSSSGHDSHIPNPHLVNGQPVMYFADSEFLYLGEIASVPAKMWELMSGEFPCATSDAQSMQTTSDPMGQSEKVHSLPYADPKQPGPESDEEIRRVPEIGGESAGTSASRPDAGSNAGTERAQGTGDSQKKRGRSPADKESKRLKRAFENGNRLLRNRVSAQQARERKKAYLIDLETRVKDLEKKNSELKERLSTLQNENQMLRQ

SEQ ID NO: 206197 - protein, 59 aa, Glycine max
  Coding DNA Sequence Number=SeqID_89419
EDPEELPPEPAVDALDFLEGDEDPLPKVDSPEDVMSASEADSTEDSGPGEMAISGGSSS

SEQ ID NO: 206198 - protein, 70 aa, Glycine max
  Coding DNA Sequence Number=SeqID_89420
MVKENECKEKKKYDWYASKEENTDAERIIDVRKELRVQERNFGNFQVERRMKVDSCFILQKHGSIKAHKN

SEQ ID NO: 206199 - protein, 65 aa, Glycine max
  Coding DNA Sequence Number=SeqID_89421
MKGLKSVNFIEHRAEQGAKFSSFREISEFLRDCEIPRGGGDIPTPLDFSIGKCTISLEIDRAGTE

SEQ ID NO: 206200 - protein, 179 aa, Glycine max
  Coding DNA Sequence Number=SeqID_89422
  Gene Ontology: Mol. function=nucleic acid binding; Biological process= DNA integration
  Homolog annotation: Hit_ID=Q1SEE1; Match level="QueryCoverage=98%, HitCoverage=19%, E-value=2e-30, Identity=39%"; Hit description =Integrase, catalytic region; Zinc finger, CCHC-type; Peptidase aspartic, catalytic
GTKDEDWALLDRQPLGVIRLTLSCNIAFNIAKETTTTGLMAALSKVRALTLLSSLPKSWNAIVITVSISLGSNKLKFNDVRDLEEIQPEDMNVENQKTTGGPNPRIIEVPSTRKLSSVGIVEKSGITKINATLHQIIKRKKAEANVNSTLGGDNALIRSLENKKESWVLDFGASFHATS

SEQ ID NO: 206201 - protein, 277 aa, Glycine max
  Coding DNA Sequence Number=SeqID_89423
  Gene Ontology: Mol. function=nucleic acid binding; Cellular component= chromatin; Biological process=DNA integration
  Homolog annotation: Hit_ID=Q1SEE1; Match level="QueryCoverage=99%, HitCoverage=25%, E-value=2e-98, Identity=58%"; Hit description =Integrase, catalytic region; Zinc finger, CCHC-type; Peptidase aspartic, catalytic
  Pfam annotation: Domain name=rve; Domain location=1-104; Score=6.2; E_ value=0.0018; Accession=PF00665.16; Description=Integrase core domain
MAENETGLEIKRHRTDNGGEYVDRFKKFFYEHKIRRERTMPGTPQHNGVVEHMNQTLTERAKSLHVQSSLPNVFWVETINMSTYLINQGPSVPLEHGIPEKIWSGKEVKLTHLRVFGCVACINDQGRNKLDPKSKKCTFIGYGENEFGYHLWDNENQKMICSRDLIFNERVMYKDRNDTHTSNPEKSGPIYVEVDDVPKTPIVESPQLEESTEHSSDNNLIDQNLLLQELAMKYEMKPLIFNQTWKLAMLAMGKKALHNKWIYQVKEDHDGSKKYKA

SEQ ID NO: 206202 - protein, 120 aa, Glycine max
  Coding DNA Sequence Number=SeqID_89424
MGSFYQVADPEGHGLLAGHHLPSESARKTWKHTCDLCGTLITIEAEAHFTGTNLVSHKTSSLGDELGPPLEPSGVPPASYGGEEDGECTLSGLEKGHPLKKLIQLGRHIILSSCKGKLVG

SEQ ID NO: 206203 - protein, 69 aa, Glycine max
  Coding DNA Sequence Number=SeqID_89425
  Subcellular localization annotation: CTP_CleavageSite=50; ConfidenceScore=5.36e-01
MSLLSAVHVSPLSSAKLLVTGKHVILLFSRSVPSPKEKRRNGDESRHHRRAGRTKSVSYLCFPLISDER

SEQ ID NO: 206204 - protein, 86 aa, Glycine max
  Coding DNA Sequence Number=SeqID_89426
  Subcellular localization annotation: CTP_CleavageSite=45; ConfidenceScore=5.24e-01
MTAYCEVTKVCVSKQPTIQKFNSACFSCTSTGCKPQFRNSIVPVPAAHQLAAYLSGSTHYCWRTESNSRKEKFTLVVKTYILNPLC

SEQ ID NO: 206205 - protein, 111 aa, Glycine max
  Coding DNA Sequence Number=SeqID_89427
MKNHEIHFGKNYSIENFQGGQELQPYYQNEAERGSNRDKLLMQFMETTKSTQLALQSVEIQVGELAEAVTQFMFRQEKYFVEVEAQKKSPVKEHESREKDEEKDEEQAQQQ

SEQ ID NO: 206206 - protein, 169 aa, Glycine max
  Coding DNA Sequence Number=SeqID_89428
  Gene Ontology: Mol. function=binding; Biological process=metal ion transport
  Homolog annotation: Hit_ID=Q6YUT6; Match level="QueryCoverage=89%, HitCoverage=38%, E-value=7e-18, Identity=30%"; Hit description =Putative pentatricopeptide (PPR) repeat-containing protein
MQLPHQSNIITTCNDHARQCKPVKAETKLSNFCKEPQCWPTLTPISIGSYKGVVRDNVWLGNFIEHLAGEVDKGVFGIGIDEGVVGEDIGVLGEVEGSLGIVEGATFGVEEGEVIGQVGGGWDEGLEVKGMEGFASYEVPLGYAGFEKVAEGVVWLWLMVVLKWKQGPQ

SEQ ID NO: 206207 - protein, 437 aa, Glycine max
  Coding DNA Sequence Number=SeqID_89429
  Gene Ontology: Mol. function=binding; Cellular component =intracellular; Biological process=metabolic process
  Homolog annotation: Hit_ID=Q6ETD1; Match level="QueryCoverage=97%, HitCoverage=75%, E-value=7e-96, Identity=31%"; Hit description =Putative pentatricopeptide (PPR) repeat-containing protein-like protein
  Pfam annotation: Domain name=PPR; Domain location=10-44; Score=45.3; E_value=2.1e-10; Accession=PF01535.11; Description=PPR repeat
  Pfam annotation: Domain name=PPR; Domain location=112-147; Score =12.4; E_value=0.25; Accession=PF01535.11; Description=PPR repeat
  Pfam annotation: Domain name=PPR; Domain location=215-249; Score =34.9; E_value=2.7e-07; Accession=PF01535.11; Description=PPR repeat
  Pfam annotation: Domain name=PPR; Domain location=250-284; Score =15.0; E_value=0.13; Accession=PF01535.11; Description=PPR repeat
  Pfam annotation: Domain name=PPR; Domain location=286-320; Score =16.4; E_value=0.086; Accession=PF01535.11; Description=PPR repeat
  Pfam annotation: Domain name=PPR; Domain location=352-386; Score=8.1; E_value=0.82; Accession=PF01535.11; Description=PPR repeat
  Pfam annotation: Domain name=PPR; Domain location=45-79; Score=7.5; E_ value=0.96; Accession=PF01535.11; Description=PPR repeat
  Pfam module annotation: Pfam domain module=PPR::PPR::PPR::PPR::PPR::PP R::PPR; Domain location=10-44::112-147::215-249::250-284::286 -320::352-386::45-79
MGEGGGRDEVSWNAMIVACGQHREGLEAVELFREMVRRGLKVDMFTMASVLTAFTCVKDLVGGMQFHGMMIKSGFHGNSHVGSGLIDLYSKCAGGMVECRKVFEEIAAPDLVLWNTMISGFSQYEDLSEDGIWCFREMQHNGFHPDDCSFVCVTSACSNLSSPSVGKQVHALAIKSDIPYNRVSVNNALVAMYSKCGNVHDARRVFDTMPEHNMVSLNSMIAGYAQHGVEVESLRLFELMLQKDIAPNTITFIAVLSACVHTGKVEEGQKYFNMMKERFRIEPEAEHYSCMIDLLGRAGKLKEAERIIETMPFNPGSIEWATLLGACRKHGNVELAVKAANEFLQLEPYNAAPYVMLSNMYASAARWEEAATVKRLMRERGVKKKPGCSWIEIDKKVHVFVAEDTSHPMIKEIHVYMGEILRKMKQAGYVPDIRWAL

SEQ ID NO: 206208 - protein, 49 aa, Glycine max
  Coding DNA Sequence Number=SeqID_89430
MTLLSESDLTNPLCGVSCYVLLSAPGWFFTDMVDDYEEHHARGHGNTTL

SEQ ID NO: 206209 - protein, 436 aa, Glycine max
  Coding DNA Sequence Number=SeqID_89431
  Gene Ontology: Mol. function=protein binding; Cellular component =integral to membrane; Biological process=xylan catabolic process
  Homolog annotation: Hit_ID=Q1SWI7; Match level="QueryCoverage=100%, HitCoverage=93%, E-value=1e-147, Identity=39%"; Hit description =Leucine-rich repeat
  Pfam annotation: Domain name=LRR_1; Domain location=127-148; Score =4.3; E_value=45; Accession=PF00560.23; Description=Leucine Rich Repeat
  Pfam annotation: Domain name=LRR_1; Domain location=155-176; Score =12.2; E_value=1.5; Accession=PF00560.23; Description=Leucine Rich Repeat
  Pfam annotation: Domain name=LRR_1; Domain location=179-201; Score =7.0; E_value=14; Accession=PF00560.23; Description=Leucine Rich Repeat
  Pfam annotation: Domain name=LRR_1; Domain location=203-225; Score =10.5; E_value=3.1; Accession=PF00560.23; Description=Leucine Rich Repeat
  Pfam annotation: Domain name=LRR_1; Domain location=227-250; Score =13.2; E_value=0.93; Accession=PF00560.23; Description=Leucine Rich Repeat
  Pfam annotation: Domain name=LRR_1; Domain location=252-275; Score =8.9; E_value=6.1; Accession=PF00560.23; Description=Leucine Rich Repeat
  Pfam annotation: Domain name=LRR_1; Domain location=300-322; Score =7.9; E_value=9.6; Accession=PF00560.23; Description=Leucine Rich Repeat
  Pfam annotation: Domain name=LRR_1; Domain location=324-346; Score =15.1; E_value=0.25; Accession=PF00560.23; Description=Leucine Rich Repeat
  Pfam annotation: Domain name=LRR_1; Domain location=348-370; Score =17.0; E_value=0.068; Accession=PF00560.23; Description=Leucine Rich Repeat
  Pfam annotation: Domain name=LRR_1; Domain location=372-393; Score =6.8; E_value=15; Accession=PF00560.23; Description=Leucine Rich Repeat
  Pfam annotation: Domain name=LRR_1; Domain location=57-80; Score=7.5; E_value=11; Accession=PF00560.23; Description=Leucine Rich Repeat
  Pfam annotation: Domain name=LRR_1; Domain location=82-115; Score =5.2; E_value=30; Accession=PF00560.23; Description=Leucine Rich Repeat
  Pfam annotation: Domain name=LRR_1; Domain location=9-31; Score=0.7; E_value=2.1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=127-148::155-176::179-201::203-225::227-250::252 -275::300-322::...
  Pfam module annotation: Domain location=324-346::348-370::372-393::57- 80::82-115::9-31
EDDLANLTSLTEFGASGNNFTLKVGPNWRPNFRLSYLDVTSWQLSPNFPSWIQSQNKLEYVGLSNTGIFDSIPTQMWETLPQVLYLNLSHNHIHGESGTTLKNPISIPVIDLSSNHLCGKLPYLSSDVSQLDLSSNSISESMNDFLCNDQDEPMQLQFLNLASNNLSGEIPDCWMNWTFLVNVNLQSNHFVGNLPQSMGSLAELQSLQIRNNTLSGIFPTSLKKNNQLISLDLRENNLSGSIPTWVGEKLLNVKILLLRSNSFTGHIPNEICQDESSSGIVSVLLWLKGRGDEYGNILGLVTSIDLSSNKLLGEIPREITDLNGLNFLNLSHNQLIGPIPEGIGNMGSLQTIDFSRNQISGEIPPTISNLSFLSMLDVSYNHLKGKIPTGTQLQTFDASRFIGNNLCGPPLPINCSSNGKTHSYEGSHGHGVNWFF

SEQ ID NO: 206210 - protein, 203 aa, Glycine max
  Coding DNA Sequence Number=SeqID_89432
  Homolog annotation: Hit_ID=Q8SA70; Match level="QueryCoverage=30%, HitCoverage=9%, E-value=2e-30, Identity=96%"; Hit description =Transcription factor EIL2
  Pfam annotation: Domain name=EIN3; Domain location=1-192; Score= -164.4; E_value=1e-05; Accession=PF04873.4; Description=Ethylene insensitive 3
KGKPVTGASDNLREWWKDKVRFDRNGPAAITKYQADNAIPGKNDGCNPIGPTPHTLQELQDTNQAYRYRRPRGGARYQLLFPLVRVNFELGVIMVIAVSFGKPVVPAALMNRPTRGERRFAYWALAECILAYYVGTDEGVSEVLHVAEKKGCTGASAEYVIQDIFPLPRSLTRYARSFDCGERKWLTNGAEISWKMPGRYLTG

SEQ ID NO: 206211 - protein, 204 aa, Glycine max
  Coding DNA Sequence Number=SeqID_89433
MTIVCCDLSRPPSSCGYKGKEKAKLKKSHYVIKPPSSIVATIPPPIRIATTKSHAQCLQDSPSQHDVPSSSKDNLENLSDNEHDLDGEMEEPSSADHSMIISRGGGFEPSRIASQAISMTISVQCMQLLLLKELLVSLKLPLLVVMCLLVFGFMVLIMAKQGDLENIMEVMMQSFQEGDPSPEPWLGDSRKIGLGMQEKALGFS

SEQ ID NO: 206212 - protein, 186 aa, Glycine max
  Coding DNA Sequence Number=SeqID_89434
MKWKNVSVAEWNQDLSSSLLPCNKQYTKCFSRGNKILQQQAIHLEPNSVRKAYSLAKMYESSFSNTQAKPFVKNQKSSFVPKPPLLPNPPRSTNPLTINPSTKPQTPKHLTPTYMAERRSKGLCYFCDEPFTLEYGLTHKRLQIHVLEIEDEEEGPGPQQPDANVVTEPDSEPLISVNALTGVANF

SEQ ID NO: 206213 - protein, 506 aa, Glycine max
  Coding DNA Sequence Number=SeqID_89435
  Homolog annotation: Hit_ID=Q10SS1; Match level="QueryCoverage=94%, HitCoverage=63%, E-value=2e-62, Identity=35%"; Hit description =Expressed protein
  Pfam annotation: Domain name=DUF726; Domain location=347-506; Score= -147.6; E_value=0.034; Accession=PF05277.3; Description=Protein of unknown function (DUF726)
  Subcellular localization annotation: CTP_CleavageSite=55; ConfidenceScore=5.33e-01
MAAPPPPPPPTTPSFLSPTQRYAAAALFGLALHEAHLNQTSPFPLPASEDSLSVSEQRTSNSSSSGSDSVSDDPDLWVHSNSGLLRPVFKFLDIDSAAWSGLEETAGSSSATHHVGPFLRLLSQELDDGSSQRLDQERALSSAVDGIALDMQRKSESSECKREKLREYEHQCREKISIDDVQPHCEKVDAHLEVQKETDAAPLLDCKETQQGSVDWKIDERPIEEVMMLSDQRKVTVLYELLSGCLSNLGEDIGRRRKGYDARHRVALRLLATWLDVKWTKMIMRYECHGLCWIVVNIAFISKLLELELNVIVNEAIETMVACSAMAFLKGQESKNEETQSKDSKWVKLKRGGIIGAAALTGGALLAITGGLAAPAIAAGLGALAPTLGTLIPVIGASGFAAAAGAAGTVAGSVAVAASFGAAGAGLTGSKMARRVGGVDEFEFKAIGENHNQGRLGVEILVSGFVFEKEDFIRPWEGQNDNLERYNSEHLPSIILVPLVKEGGFT

SEQ ID NO: 206214 - protein, 250 aa, Glycine max
  Coding DNA Sequence Number=SeqID_89436
  Gene Ontology: Mol. function=RNA-directed DNA polymerase activity; Cellular component=chromatin; Biological process=chromatin assembly or disassembly
MEFFVHGKRHVLRGATPTNLAIAQKQHLHKTISYGVHLSLISLQSAVEGSLLHSLTTHASQQEPSGLPPCRVGHDHKIPLMQGDNPVNKRPYRYTKQQKDIIDGLIQDYLKSGIIQKSDSPYASPVVFVGKKDGAWRLCVDYRDLNKATVKNKFPIPLVEDLLDELHGSTIFSKIDLRAGYNQVQMDAINIHKTVFRTYAGHFEYLVMPFGLTNARATFQGLMNSIFRHYLRRFLLVFFDDILIYNRKSS

SEQ ID NO: 206215 - protein, 90 aa, Glycine max
  Coding DNA Sequence Number=SeqID_89437
  Homolog annotation: Hit_ID=Q10SS1; Match level="QueryCoverage=36%, HitCoverage=4%, E-value=9e-09, Identity=84%"; Hit description =Expressed protein
MVAAVGAGLTGSKMARRVGGVDEFEFKAIGENHNQGFTHERISWNPTCRYSWDFENEKPGEEGVFSKQVEAIISVNQKLSYGGGYCLDLL

SEQ ID NO: 206216 - protein, 286 aa, Glycine max
  Coding DNA Sequence Number=SeqID_89438
  Gene Ontology: Mol. function=3'-5' exonuclease activity; Cellular component=intracellular
  Homolog annotation: Hit_ID=Q8GWN3; Match level="QueryCoverage=86%, HitCoverage=43%, E-value=5e-58, Identity=47%"; Hit description =Putative nucleolar protein
  Pfam annotation: Domain name=PMC2NT; Domain location=29-116; Score= -4.6; E_value=0.0077; Accession=PF08066.2; Description=PMC2NT (NUC016) domain
  Subcellular localization annotation: CTP_CleavageSite=57; ConfidenceScore=5.22e-01
MNVDHDQPPSATKAQALQTLTAGPLSSSVAKLAASSRCIPSDKDFHFYRNFEEFKVPVEEIARESRSMLEAIGAAAAHAAFPDNDVDDDAAYDWLVNANDDVLERFDASVDEFRKVRQEEEETGRPAMHPMEEDGFQLVTGKKKKGGKGNVTPAATGSEVAAVAPPGVTVATKDKKTMGPKSKVPFHIPTIRRPQDEYNIVVNNANMPFEHVWLQRSDDGLSFIHPLEKLSVLNFVDTNLGDVVPVKPPSIESTPFKLVEEVKDLKELAAKLRSVNEFAVKHDYYS

SEQ ID NO: 206217 - protein, 202 aa, Glycine max
  Coding DNA Sequence Number=SeqID_89439
MEDIMRSTVLFRVLLVVVVVIATRPCLANVKNDFHETNGGNICNYTAQVSRGGLGGGGVGVSEKNSSGMLLGERKFSGGNGGKGGGGGGNGKGGGNGGGSGKGGHEGRKRRGGGGSGGGGGGGSGGGGGGGNGQGHGGGGGGHGWGGGSGSGGGGGGGGGSGEGWGWGRGRGGGSGNVKCWVWGCEKKLEKRSEIRSSNSKG

SEQ ID NO: 206218 - protein, 470 aa, Glycine max
  Coding DNA Sequence Number=SeqID_89440
  Gene Ontology: Mol. function=3'-5' exonuclease activity; Cellular component=intracellular; Biological process=mRNA catabolic process, nonsense-mediated decay
  Homolog annotation: Hit_ID=Q9FFL2; Match level="QueryCoverage=95%, HitCoverage=51%, E-value=2e-87, Identity=44%"; Hit description =Nucleolar protein-like
  Pfam annotation: Domain name=HRDC; Domain location=59-137; Score =56.0; E_value=1.2e-13; Accession=PF00570.13; Description=HRDC domain
MRIKLFALSKESESSESSDTPLVEVYKRSYDVCIQLYEKELLTENSYLHIYGLQGAGFNAQQLAIVSGLCEWRDIVARAEDESTGYVLPNKSVLEIAKQMPLTTSKLRRLVKSKHPYVEHNLDTVVSIIRHSIQNAASFEEAAQQLKEAQAVTASDVVPVTDGTEDPPSHTRHSKESSQHQATSVPIKIKSNSLIFEPPKDSLTIAEQNRDANVGALSTAKGNGAAVQVLKKPTGAFGALLGSSASKRKLGPGKGKEEIKLEQIRSSVSLPFHSFLGSSEKSEPTEEIPSVASEMSEPQKPVSDVVSASPVDEIIMLESDTGAKDMEQNNLENSNEHREKDSVVSTSGKEDEDEPVSLSELSSNLKKCFHSNDQNNKIRQPKKTEQPSGLVQLKPFDYEAARKHVKFGEHKKHASSKGSDGHMEVVEDSGSKKQRSTTGQGQASDLSKQLPQGRRRQAFPASGNRSSTFR

SEQ ID NO: 206219 - protein, 129 aa, Glycine max
  Coding DNA Sequence Number=SeqID_89441
MAIFMEPSLISITQQPPNPIANKPHTTHILVTSVKPTMTTITNHKQKASMETYPATHHSDCHFLFAHCFFMFLMVSFFKKEKEDKRKGKARDVRRKDGGGSLSTTKGAQSLTRKFVWKSERENARELKR

SEQ ID NO: 206220 - protein, 172 aa, Glycine max
  Coding DNA Sequence Number=SeqID_89442
  Subcellular localization annotation: CTP_CleavageSite=27; ConfidenceScore=5.31e-01
MANNVKIRVFTSLSLNSRPKTLTPPLSAPTTTGGRQEPQLLVVGTQHEDERFNQSEIFRMHLEDLVENRALSPSFVVSSRFGIYSSAIGPTNMNVRDLRATQRGADGEISIGDRSLFLFFMRKKLVLGGCHLVWNFLKTQADHHGEEVAYARQGDLDTCCLAFLSKSVAWKH

SEQ ID NO: 206221 - protein, 300 aa, Glycine max
  Coding DNA Sequence Number=SeqID_89443
  Gene Ontology: Mol. function=sequence-specific DNA binding; Cellular component=nucleus; Biological process=regulation of transcription, DNA-dependent
  Homolog annotation: Hit_ID=Q1S9S7; Match level="QueryCoverage=96%, HitCoverage=99%, E-value=1e-53, Identity=47%"; Hit description=Zinc finger, GATA-type
  Pfam annotation: Domain name=GATA; Domain location=220-255; Score =69.6; E_value=9.8e-18; Accession=PF00320.17; Description=GATA zinc finger
MECLEAALKSSFRKDMALKQTLFLEEFSSASNVQNVVASSDDLFVDDLLNFSLLENNTNNNNNNEEPDQQLNNHDSTTPQNNQENYNYNPSFNDNNFNTELTVPAEEEVADLEWLSRFVEDSNFSEYSLPFPATVTEKVKVKSPEPGNTAFTFKTPVPAKARSKRTRTGVRVWPLKSPSLAAASSTTTSSSSSSSPSSPQRADSRAKKRAAADGGAARRCSHCGVQKTPQWRTGPLGAKTLCNACGVRYKSGRLLPEYRPACSPTFSSELHSNHHRKVLEMRRKKEDVPEPDTASPPSLP

SEQ ID NO: 206222 - protein, 44 aa, Glycine max
  Coding DNA Sequence Number=SeqID_89444
MKEMWDLIQVTREGTPEQGETIGDVQKRFTHIVNHLKGLGKVFE

SEQ ID NO: 206223 - protein, 103 aa, Glycine max
  Coding DNA Sequence Number=SeqID_89445
MANGGREIQALEIYKIANAIRNVAMEIVLVNIKPSGKHHASNGRRGILPENLFPDRPSSERDFNEAKTEEEHYQISGCCQGTSFRAAKGFGMFAGMPPLNLFE

SEQ ID NO: 206224 - protein, 310 aa, Glycine max
  Coding DNA Sequence Number=SeqID_89446
  Gene Ontology: Mol. function=endonuclease activity; Biological process=DNA catabolic process
  Homolog annotation: Hit_ID=Q9ZR87; Match level="QueryCoverage=48%, HitCoverage=59%, E-value=1e-35, Identity=39%"; Hit description =Bifunctional nuclease
  Pfam annotation: Domain name=S1-P1_nuclease; Domain location=18-215; Score=45.0; E_value=3.8e-15; Accession=PF02265.7; Description=S1P1 Nuclease
MQNIQVVRKKIWLNITKLASRLFSLVHNLVWEYKRVLGVLLCVYPETAVLVGHTYYYHWSNALHYVDMPDFKCNNEYCRDCHDSYKRKHRCVSGAIYNNTMQLKSADESTSSEFNLWDDLIIHSTLKIFYDSDLSIMIQAIERNTTYNWPNDVSIWEHCANNHTACPNRYASESISLACKFAYRNATPGSTLEVLHVHTCHAPLPKRLNMKRIRHMTRLFITCSDDGALYLETKLNLNMVEFLTPPKLEFLNKFLPCKPNKMHSHRETLPQVLVQVNIFNYARIAIGICNLHTLLHAICRGSREEVAFPD

SEQ ID NO: 206225 - protein, 37 aa, Glycine max
  Coding DNA Sequence Number=SeqID_89447
MPTVSQAEPVNANIGHRIEDMMHTILGKTFFNKHMDP

SEQ ID NO: 206226 - protein, 419 aa, Glycine max
  Coding DNA Sequence Number=SeqID_89448
  Gene Ontology: Mol. function=receptor activity; Cellular component =integral to membrane; Biological process=protein amino acid phosphorylation
  Homolog annotation: Hit_ID=Q9FH56; Match level="QueryCoverage=99%, HitCoverage=98%, E-value=1e-129, Identity=57%"; Hit description =Similarity to elicitor-inducible receptor-like protein
  Pfam annotation: Domain name=LRR_1; Domain location=109-131; Score =20.0; E_value=0.0086; Accession=PF00560.23; Description=Leucine Rich Repeat
  Pfam annotation: Domain name=LRR_1; Domain location=133-155; Score =13.6; E_value=0.74; Accession=PF00560.23; Description=Leucine Rich Repeat
  Pfam annotation: Domain name=LRR_1; Domain location=157-179; Score =20.1; E_value=0.0078; Accession=PF00560.23; Description=Leucine Rich Repeat
  Pfam annotation: Domain name=LRR_1; Domain location=181-202; Score =13.1; E_value=0.99; Accession=PF00560.23; Description=Leucine Rich Repeat
  Pfam annotation: Domain name=LRR_1; Domain location=204-223; Score =12.9; E_value=1.1; Accession=PF00560.23; Description=Leucine Rich Repeat
  Pfam annotation: Domain name=LRR_1; Domain location=226-249; Score =8.7; E_value=6.6; Accession=PF00560.23; Description=Leucine Rich Repeat
  Pfam annotation: Domain name=LRR_1; Domain location=251-273; Score =15.4; E_value=0.21; Accession=PF00560.23; Description=Leucine Rich Repeat
  Pfam annotation: Domain name=LRR_1; Domain location=275-294; Score =5.3; E_value=30; Accession=PF00560.23; Description=Leucine Rich Repeat
  Pfam annotation: Domain name=LRR_1; Domain location=305-326; Score =7.2; E_value=13; Accession=PF00560.23; Description=Leucine Rich Repeat
  Pfam annotation: Domain name=LRR_1; Domain location=329-352; Score =6.0; E_value=21; Accession=PF00560.23; Description=Leucine Rich Repeat
  Pfam annotation: Domain name=LRR_1; Domain location=361-383; Score =3.5; E_value=64; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =109-131::133-155::157-179::181-202::204-223::226-249::251-273::275 -294::305-326::329-352::361-383
MCSLRLHLFLLVAASTSSLFESATTHWSDKQALKDLKNNLDPSSITPGSCLYSWDFSLDPCDNLFSDNFTCGFRCDAVVSGATRVTELALDPAGYTGPLVINHHNNLPFLQSLDLSNNYFSGPIPDSLSNLTRLTRLGLSKNSFSGPIPSSLGSLINLQELYLDNNNLNGTLPVSFDGLTNLKRLELQSNSLNGVLPDLTSLKNLYFLDLSFNSLTGGFPSNLPDSLVQISIRNNSLNGAFESDALKSFSYLQVLDLSSNRLNGSLPLSLFELPSLQQLTLSFNGFSGIKPPSFAFDGGVAVPSELIAVDLSNNELGGFLPMFFSLMPKLSSLSLENNKFVGMIPTQYALKTVFPEPGVEPFERLLLGGNYLFGGIPSALMALEPGSANVRLVDNCFYRCPLSFFFCQGGEQKSYEECK

SEQ ID NO: 206227 - protein, 644 aa, Glycine max
  Coding DNA Sequence Number=SeqID_89449
  Gene Ontology: Mol. function=DNA binding
  Homolog annotation: Hit_ID=Q1S9R4; Match level="QueryCoverage=99%, HitCoverage=97%, E-value=1e-103, Identity=36%"; Hit description =Forkhead-associated
  Pfam annotation: Domain name=FHA; Domain location=546-620; Score =31.8; E_value=2.4e-06; Accession=PF00498.16; Description=FHA domain
MEPWLPQDDFLLKNAIEGGASLESLAKGAVRFSRRFSVTELRDRWQALLYDPDVSAAALAAMAHLEAAKYGGAAGTSEGGGGGKKRKSESIRKHYFAMQRRLRGCRHSDAKNATEGCEVSDVPMWKTIEDFSLPDMPVNVEGNGRGLEVRVNSKGECGNGGLRINAPDDAVLRDDAKNDLECLLNSANEDGLVFMDVDRKEVTAVDKDKPSYDNFDLILSSSPCDVQGDSDGREPLGGGCADQHCVSESGNDAGSSGAVQSPLPERGEGYMICVLNTEDTDIPSNDPTDIPILFPELMPLKSQPVIQELGCLESSINNKRRNESDGSLKIEAVLSQSFAALQTVWQGLMPNVNSSHRPLVLGLKSENPGRNSTSAVSRQNNNVNANINPSHGRLVRATVMPASDGHLKQEETNAPASAHSKAEEHTALSKSEVKSLSLDQEGCDIKDDDDEDNDNELPNFADVEEMLFLIYLMLPGQILEMDLSPADQDTNASREVLQFQHEQSKRTIMRLEQGAQSSMGRAISSQGAFAVVYGRILKTYITKSKVILGRETHDVHVDIDLGREGQEATRISRRQAVIKLEADGSFIIINLGKRSIFLNGKEIATGQARGLSAGSLIEILGISLIFETNNGCVRKFLENENEKR

SEQ ID NO: 206228 - protein, 70 aa, Glycine max
  Coding DNA Sequence Number=SeqID_89450
  Homolog annotation: Hit_ID=Q9SD67; Match level="QueryCoverage=62%, HitCoverage=5%, E-value=2e-12, Identity=79%"; Hit description=FtsH metalloprotease-like protein
MAALVVRISNTPKLSYWIGFGRLKCQLAGIEEKTAKLKGSEKALVARHEASHAVVGTAVANLLAGQPHVE

SEQ ID NO: 206229 - protein, 183 aa, Glycine max
  Coding DNA Sequence Number=SeqID_89451
  Subcellular localization annotation: CTP_CleavageSite=21; ConfidenceScore=5.20e-01
VNKSGAVAPTYPPSKRKSDLRSSFLRVNQAILFTWKVVILRRWTLKMILFTWRENDLNNQLKLVKNGRKETEIERNKNENQETRNELKVTDLETYPLKNEEQMKNGGSGTLRTAPINLFIGKKGRRLPPNSPKRAGLLPPEAIQLQKYYGRPNFKISKFLFAPPIFDKFTPFFRNLRKSYGSP

SEQ ID NO: 206230 - protein, 502 aa, Glycine max
  Coding DNA Sequence Number=SeqID_89452
  Gene Ontology: Mol. function=aldehyde dehydrogenase [NAD(P)+] activity; Cellular component=chloroplast; Biological process =aldehyde metabolic process
  Homolog annotation: Hit_ID=Q1S9R3; Match level="QueryCoverage=99%, HitCoverage=99%, E-value=0.0, Identity=80%"; Hit description =Aldehyde dehydrogenase
  Pfam annotation: Domain name=Aldedh; Domain location=3-456; Score =121.2; E_value=3e-33; Accession=PF00171.12; Description=Aldehyde dehydrogenase family
MDIGGGVEEPVRELRQYFKTGKTKSVTWRKNQLTSLIDLVHENEDAIFKALHKDLGKHPVEAYRDEVGGVEKSASKALSCVEKWMAPKKNITFIVKSSKSELYAIKSDIPFLFFPAKGEVLSEPLGVVLIISSWNFPIILALDPIIGAISAGNVVVIKPSEQAPACSSFLANTIPRYLDSNAIKVIEGGEDVCEQLLRQKWDKIFFTGSPRVASVVMSAAAKNLTPVTLELGGKCPAILDSLPNPSEFELAVKRIVGGKWGPCSGQACIGIDYLLVEEKFSSAVIKLLKKFIRRFYGENPVESKVISRIINKQHFERLCNLLKDPLVAASIVHGGSVDEENLFIEPTILLDPPLDSEIMAEEIFGPLLPIITLDKIQESIEFINAKPKPLAIYAFTKDETFKRKILSETSSGSVVFNDTMVQFLCDTLPFGGVGQSGLGRYHGKYSFDTFSHEKAVMHRKLFLEIEPRYPPWNKFKLEFIRLAYRLNYFGLVLHMLGLKRYN

SEQ ID NO: 206231 - protein, 239 aa, Glycine max
  Coding DNA Sequence Number=SeqID_89453
  Homolog annotation: Hit_ID=Q47522; Match level="QueryCoverage=21%, HitCoverage=62%, E-value=1e-21, Identity=94%"; Hit description=LacZ protein
YDGVFEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMVLMPTKNCPQMKLGYDTKVHFYLEWSQELLRLLAKAKAMVDVYSTPEELLFPLVRVNFELGVIMVIAVSFGKPVVPAALMNRPTRGERRFAYWALAECILAYYVGTDEGVSEVLHVAGEKRLH

SEQ ID NO: 206232 - protein, 140 aa, Glycine max
  Coding DNA Sequence Number=SeqID_89454
MGKPIDHVPSTFDRDVVSILLITHLGIPTEEEAMVMTTIGGRMRSMWLAELYHRYVELGSRVWTIMISSALGNRCTMYLYDHIPYAHQYTRKQSWAFAHFPNAGYLEHGTGALDYLIASSWKPTRGFGFAFSFREKLDEL

SEQ ID NO: 206233 - protein, 43 aa, Glycine max
  Coding DNA Sequence Number=SeqID_89455
MELQRKIKEKRYHKHGKCDSSTWEASLRSKKGSFLGKQGRKLP

SEQ ID NO: 206234 - protein, 154 aa, Glycine max
  Coding DNA Sequence Number=SeqID_89456
MSSKIYPEVHENPKVFFSSSSPILLKLLSHSSGGRCYNIIRKQGASEFVKEPYHNYVSSELFVYFTRLTYAYKYTNKHIKGYMTLLMHGYLSILLPFLVVSRCWIMTTNTATNRLVTTWKPLRSTNKAAGTRELLDQLLGTRELLDQLQMTDVA

SEQ ID NO: 206235 - protein, 38 aa, Glycine max
  Coding DNA Sequence Number=SeqID_89457
MEILIANTSTTFHRDERLRNTHAMHGKWENARVTHEQT

SEQ ID NO: 206236 - protein, 144 aa, Glycine max
  Coding DNA Sequence Number=SeqID_89458
  Homolog annotation: Hit_ID=Q9FIV2; Match level="QueryCoverage=45%, HitCoverage=17%, E-value=9e-15, Identity=63%"; Hit description =Similarity to pre-mRNA splicing factor
MWSLGSQSSAISAWTGKNSLLALQIVLSTFMIISCEENQAHDQACIDVAFHPVIPNVIASCSWDGNLMSDSLILQVYNYSESWCELYKKQFKGMILQCVKLHRDLCWPLASNLAKESNLLPPLWNNKKHRNENIGYMTIEILKT

SEQ ID NO: 206237 - protein, 86 aa, Glycine max
  Coding DNA Sequence Number=SeqID_89459
MQWYLMLTRTFCQPEASEPIDTQRLTLSFAPLSSRDGKPGDMRWYLMVISTLCQQEESGPVDTQRLTSSSAPFINKRQASPLTRRD

SEQ ID NO: 206238 - protein, 189 aa, Glycine max
  Coding DNA Sequence Number=SeqID_89460
  Gene Ontology: Cellular component=nucleus; Biological process=cell division
  Homolog annotation: Hit_ID=Q9FIV2; Match level="QueryCoverage=84%, HitCoverage=38%, E-value=3e-52, Identity=64%"; Hit description =Similarity to pre-mRNA splicing factor
  Pfam annotation: Domain name=WD40; Domain location=48-86; Score=23.9; E_value=0.00058; Accession=PF00400.22; Description=WD domain, G-beta repeat
  Pfam annotation: Domain name=WD40; Domain location=90-128; Score=6.6; E_value=6.1; Accession=PF00400.22; Description=WD domain, G-beta repeat
  Pfam module annotation: Pfam domain module=WD40::WD40; Domain location=48-86::90-128
MHWSSTHCKFSLLTNCSPELAYSSPPCICWDGSCGLHMECMEQKSEESMPAKLPVFHNAAVKDVKWSQQGHFLLSCGYDCTSRLIDVEKGLETQVFRQDQIVGVIKLHPDDSNLFLSEGSKGQIKLCDARTGKVVHDYNQNLGLILDVEFTMNGKQFISSSDVSQSNASENAIIVWDVSREVPLSNQHY

SEQ ID NO: 206239 - protein, 208 aa, Glycine max
  Coding DNA Sequence Number=SeqID_89461
MEENEKGRETNRGWQGRKENVGVPTSLFIYFNKMVHFNMIALCICVSVAKSIEFVLQVQFGIYRKTVTSTTVKAAYNDPPQYLCIVRSLRALGPYSTIAEASTHDSRATSRIDPVGNTVINLMKGIQTQLLGNVVACLKCPKDVSKELWRYVANKKNVGTSATVANRDFDFSPIGYDKSEDEFEDSISAVTATNKKNVTKKGANGHVL

SEQ ID NO: 206240 - protein, 98 aa, Glycine max
  Coding DNA Sequence Number=SeqID_89462
MVEVCGIEFRTTYPNFTIIQRKRLQCEGFFSQFRHDIEIPNGENARNCVANMILKFHDDPTVNGFEIVVFLRLVWWAAGKRKGFERRGKTKMRPKGGS

SEQ ID NO: 206241 - protein, 221 aa, Glycine max
  Coding DNA Sequence Number=SeqID_89463
MGDPISRLSFPENNETFSSLTSYPELRRSEFLIGGYVGARASLLSTIPPFVAMTQELVARGDTLRLSAPRHSETPSVIDEQRPKTKFGHSAPMIRGDTLWLFAPFCHPEAAGPMTSRDQVWSFCTHDTRRYLMVIRTLLSSRGGGPDDKQRPKTKFGHSAPMIRGDTLRLSAPFCHPEAAGPMTSRDQVWSFCTHDMRRYLTVIRTLLSSRGGGPDDKQRP

SEQ ID NO: 206242 - protein, 163 aa, Glycine max
  Coding DNA Sequence Number=SeqID_89464
  Homolog annotation: Hit_ID=Q2HRG4; Match level="QueryCoverage=60%, HitCoverage=7%, E-value=3e-07, Identity=36%"; Hit description =Ribonuclease H
MDTYLHCEPDHKSMSAHDSLQGIFLRKRPTDFGSLDSMVTMITLRTCMLSSLLSSMGCTMHGIMSLYIIIETYFLAAIHLIKHQSPSFHSFVTIVASIKSLLALQWEIHIIHTLRDTNVGTDILVKKEASTNVSLVMLELCPDDVLPCVIAYALERVLYACNS

SEQ ID NO: 206243 - protein, 131 aa, Glycine max
  Coding DNA Sequence Number=SeqID_89465
  Homolog annotation: Hit_ID=Q1SZM6; Match level="QueryCoverage=97%, HitCoverage=42%, E-value=3e-08, Identity=26%"; Hit description =Ribonuclease H
MVHPIEDSKELNMHVRSVIIVTIESKEPKSLRVPHYTSITQWPWVTQRTSINIQQGERRNRCRLYDVTWVSCGGRSLEVSHELTLTCDLVHSVNMCPFLTLETTMVTTFPNDLAWSPKELRITPHGILAQP

SEQ ID NO: 206244 - protein, 68 aa, Glycine max
  Coding DNA Sequence Number=SeqID_89466
MFSTGFFADGENAYSFGSSGFYSLFFDNDNILRLLYDGLEVSAFTGHIHGWHLGKLIRTQCMPDGVVK

SEQ ID NO: 206245 - protein, 50 aa, Glycine max
  Coding DNA Sequence Number=SeqID_89467
MSLSSSSNAYNVPWVEKYRPIKMICSMVELTVQQVEKLREMSPLYEFVKE

SEQ ID NO: 206246 - protein, 116 aa, Glycine max
  Coding DNA Sequence Number=SeqID_89468
MDFKICQIVQQKAVKFVQQNFPNVQKNAYALLVMGKEYVSSVEDGQRGMVGSCLICGCGRVDLHHRPIATYGTWRYVAGVRRPWGRQASSWQSSNKRTKTTKQGGLCGGWPAMDLE

SEQ ID NO: 206247 - protein, 291 aa, Glycine max
  Coding DNA Sequence Number=SeqID_89469
  Gene Ontology: Mol. function=DNA binding
  Homolog annotation: Hit_ID=Q1SWX1; Match level="QueryCoverage=72%, HitCoverage=42%, E-value=1e-21, Identity=31%"; Hit description=IMP dehydrogenase/GMP reductase
MGSSQKPSLKKRFYQVKIKSLEVTSLRKLGQLMGQLQRQAFRKAYGKIWDLARVEVSMEPIASLSQYYDQPLRCFTFEDFQLVPTVKEFEEILGCPLGGRKPYLFSGFYPSTTRVAKVVKISAQELDRVKQNRNGVVWRTGQRPWQIKANGLSFIDILALLIFGVVLFPNMEGLVDLAAIDAFLAFHHGKESPVIAILAMYDTFDWGCERSSARIVCCALALYVWLVSHPFLQEGRPVYPLQGHRSCVEKGKANWDQLLASMEGRLLIGSLARRKEESGFYLHAKDVQMFS

SEQ ID NO: 206248 - protein, 468 aa, Glycine max
  Coding DNA Sequence Number=SeqID_89470
  Gene Ontology: Mol. function=protein-tyrosine kinase activity; Cellular component=integral to membrane; Biological process=protein amino acid phosphorylation
  Homolog annotation: Hit_ID=Q2HVC0; Match level="QueryCoverage=91%, HitCoverage=54%, E-value=1e-172, Identity=73%"; Hit description =Protein kinase
  Pfam annotation: Domain name=LRR_1; Domain location=115-137; Score =4.5; E_value=41; Accession=PF00560.23; Description=Leucine Rich Repeat
  Pfam annotation: Domain name=LRR_1; Domain location=139-161; Score =10.6; E_value=3; Accession=PF00560.23; Description=Leucine Rich Repeat
  Pfam annotation: Domain name=LRR_1; Domain location=163-185; Score =14.2; E_value=0.46; Accession=PF00560.23; Description=Leucine Rich Repeat
  Pfam annotation: Domain name=LRR_1; Domain location=187-209; Score =7.9; E_value=9.6; Accession=PF00560.23; Description=Leucine Rich Repeat
  Pfam annotation: Domain name=LRR_1; Domain location=211-232; Score =15.2; E_value=0.24; Accession=PF00560.23; Description=Leucine Rich Repeat
  Pfam annotation: Domain name=LRR_1; Domain location=234-252; Score =4.3; E_value=45; Accession=PF00560.23; Description=Leucine Rich Repeat
  Pfam annotation: Domain name=LRR_1; Domain location=255-277; Score =6.2; E_value=19; Accession=PF00560.23; Description=Leucine Rich Repeat
  Pfam annotation: Domain name=LRR_1; Domain location=279-301; Score =8.2; E_value=8.2; Accession=PF00560.23; Description=Leucine Rich Repeat
  Pfam annotation: Domain name=LRR_1; Domain location=303-325; Score =8.6; E_value=7; Accession=PF00560.23; Description=Leucine Rich Repeat
  Pfam annotation: Domain name=LRR_1; Domain location=327-346; Score =10.8; E_value=2.7; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=115 -137::139-161::163-185::187-209::211-232::234-252::255-277::279 -301::303-325::327-346
MPYWNCRESACGCEGEPNFSSEQDFLLSIFHTEQLQSSDSKTLLRIQQQLNFPPVLSSWNKNTDFCSTDSTSSLTVVCYEGTITQLHIVGETRALLLPRNFSIDSFVRTLVRLPSLKVLTLVSLGIWGPLPGKIAHLSSLEIVNVSSNFLYGSIPLQFSLLSHLQTLILDDNMFSGHLPEWLDSFPALTVLSLKNNLFNSSLPDSLNSLENLRILSLSHNHFYGPVPDLGRLANLQVLELDDNAFGPRFPQLGDKLVTIVLRNNKFRSSIPDEVSSYYQLEKLDISANTFVGPFQLALLSLPSITYVNISGNKLTGMLFENLSCNPGLEAVDLSSNLLTGSLPKCLMSNSNDRTVLYARNCLETNQNQHALPFCHTEAIAVGIVPEGKKHKRVSKEVLSIGIVCGTFGGVAIVALLFFIIRRESVKSKIKNPPTKLISENAASGYTSKLISDASNSLTPHPEMHMPSN

SEQ ID NO: 206249 - protein, 165 aa, Glycine max
  Coding DNA Sequence Number=SeqID_89471
  Gene Ontology: Mol. function=nucleic acid binding; Biological process= DNA integration
  Homolog annotation: Hit_ID=Q1S077; Match level="QueryCoverage=97%, HitCoverage=56%, E-value=2e-22, Identity=33%"; Hit description =Asp/Glu racemase
MEHGLLVNLLSSITVIGYKWHFRLILSLVISHKWPLQQLDVNNAFLNGILEEEVYMSQPPRSIVYILVYVDGIFLTSNNIKIISWELKFKNKKIDHSFSISLSKLEISWLRLINPISSPMVGGCKLTKLGFEDFIDPSLYKSIVQALQYATITRPEISFSINKVS

SEQ ID NO: 206250 - protein, 231 aa, Glycine max
  Coding DNA Sequence Number=SeqID_89472
  Gene Ontology: Mol. function=nucleic acid binding; Cellular component= cytoplasm; Biological process=DNA integration
  Homolog annotation: Hit_ID=Q1T4S3; Match level="QueryCoverage=68%, HitCoverage=13%, E-value=5e-36, Identity=42%"; Hit description=Zinc finger, CCHC-type
  Pfam annotation: Domain name=rve; Domain location=2-157; Score=26.8; E_value=3.4e-05; Accession=PF00665.16; Description=Integrase core domain
MVETILLMVVVVETLVVEVLVEVDLPMCSIKSVDSKQVLLKEVVGKDGLYQFPQLLVSMSQSKRYSNSDWGKEFRPFTKFLSDHGIQHILTCSHTHHHNGVVERKHKHIVELGLILLSQAKLPLHYWDHTFVSNIYLIKKFPSSVSFLGYSPSHKGYKCFAANERLYISKDVIFNELIFPYPTLFPKPSLITSNVLDSTPTFTILSNNQPFLASNPTPQPFIPNHTYVSSS

SEQ ID NO: 206251 - protein, 158 aa, Glycine max
  Coding DNA Sequence Number=SeqID_89473
  Homolog annotation: Hit_ID=Q1SPG0; Match level="QueryCoverage=39%, HitCoverage=15%, E-value=1e-14, Identity=57%"; Hit description=Zinc finger, SWIM-type
MPINLKDEYWIDDGVESNNEECFEDEFVEGEQGNDVFHAIESGGIDCMQDIADLNLISVPTEELTKCHFPNIKVSYEFYNWYARGKGFAPRKVKILRNSKFVSNKIEETYVWLFEQLLEVMKRKVSTYVITDGDLAMRNAIKKVFTTTHHRLCAWHLY

SEQ ID NO: 206252 - protein, 76 aa, Glycine max
  Coding DNA Sequence Number=SeqID_89474
MVMYLCRLRKRKKKKNFAILFSPVDGGVVFYVDAMHGATTTGAFDRDVARGAGVAIPTSASPFADVALEAPTTMAS

SEQ ID NO: 206253 - protein, 56 aa, Glycine max
  Coding DNA Sequence Number=SeqID_89475
MGRIWGDSEEGGEYGGQCSWSFLTGRKRVDSSSKSNSQSQLAKELIVPHLMAIGKL

SEQ ID NO: 206254 - protein, 106 aa, Glycine max
  Coding DNA Sequence Number=SeqID_89476
MDKDAIKLICIMWVALAGTTHQCKVDDGEHVKMLGLKNEIVHGDDVLSEGLLVVYVTGASLSLGVIDYFAEVATITHLRDDRGVDDNPKYDKGEERVKEKDIDSVK

SEQ ID NO: 206255 - protein, 72 aa, Glycine max
  Coding DNA Sequence Number=SeqID_89477
MAPKKLPAKRSRKDATREGSSAALQAGMDFDGHKFRIVEHQQRFEAIKGWSFLRDGRVQLRDEEYAEFQEEI

SEQ ID NO: 206256 - protein, 207 aa, Glycine max
  Coding DNA Sequence Number=SeqID_89478
MITAGGGGGGLPSPNGGDALPIQSSPMNTNFIYSIIEKLDAVKYLLWKSQELQILERFAALADRDVGRVIEAYCAWEQHDQLLLSLLQYTISTLMLCKFMTSNQNQIPNQNQFLNYPQTGQNQNQQSNFSGGRGGCYGDRGGRSSIQFNALSASNLDMMLLIAGTCLPPHSMVLNLSYVHTNDTTYVSYTTTICTIPYAVWCCAYAI

SEQ ID NO: 206257 - protein, 201 aa, Glycine max
  Coding DNA Sequence Number=SeqID_89479
  Gene Ontology: Mol. function=aminoacyl-tRNA ligase activity; Cellular component=intracellular; Biological process=tRNA aminoacylation for protein translation
  Homolog annotation: Hit_ID=UPI000034F21F; Match level="QueryCoverage =52%, HitCoverage=10%, E-value=5e-51, Identity=84%"; Hit description =EMB2247; ATP binding / tRNA ligase/ valine-tRNA ligase
  Pfam annotation: Domain name=tRNA-synt_1; Domain location=1-198; Score=-395.4; E_value=0.0037; Accession=PF00133.12; Description=tRNA synthetases class I (I, L, M and V)
MIVRMWESQGYFRPSFDRGSDPFVIPMPPPNVTGSLHMGHAMFVTLEDIMIRYNRMKGRPTLWLPGTDHAGIATQLVVERMLASEGVKRTELSRDEFTKRVWQWKEKKYFQKKLVSLGGAPSEMSLLLAFTIGRMKDYFVSMRAQSERTQETSSDNNGGSKGSGGKKDSQYGGSMVPHYSKMEFPTYDDTGDSLGCLKHCE

SEQ ID NO: 206258 - protein, 460 aa, Glycine max
  Coding DNA Sequence Number=SeqID_89480
  Pfam annotation: Domain name=RRM_1; Domain location=43-113; Score =24.9; E_value=0.00028; Accession=PF00076.12; Description=RNA recognition motif. (a.k.a. RRM, R
RGKQREGERPRVDPKTNYDNNKLGQSQRYHHVNWRDKDAITTFYFTRFHEHITKKDLWAQFKKWGDVREIFIPKDRNKGGRRYGFVRFKGVSDELRLEKQLDNIILDGLKMYVNVPKYGRGKVRVEERTSKPGILKEGHSKEMTAARHRAMQNSKRHMPRWSPLPKGITDDIRWELGVNVVLKYLGDDMVLLLGMAGNKAEEIIAEEYQHGTSPFHSLERWNPTMRPGHRLVCAQCWGIPIEAGQDDDDVEDMRRLDRARILIRTPWKPFFHHTVAVTIGGELHQVNIVEEGASDDGRRNFLGRRPSDSSEELDSDGIDGESLIALHSPLYELRRQPNNPDADLVFAVDNNGDPLTGTGTLIGRSANPSDVNHFDDLDGGPPIAVQVQLISRWGKPFTPDGDTVAGEGESLTGIDVPLEDKQREVAVGEWASLNIVDPAHFTKLGTVTSLYHKKGSETPK

SEQ ID NO: 206259 - protein, 789 aa, Glycine max
  Coding DNA Sequence Number=SeqID_89481
  Gene Ontology: Mol. function=RNA-directed DNA polymerase activity; Biological process=RNA-dependent DNA replication
MELKVFARRKGCKQQVAQKDLNRGKAIESILTGYNSHTESRGRAIPKRSKETNSQMHVKSIGPDEGQIEEALTQWELAKIMGVSIESEQTTIIHKIKDMETRDKKEAEELGLGRGVKWAAVRRLVTKHKVDILCIQETKKEQIDKPMCQALRGDTDVAWEFQPAVNTAGGLLCMWNDQAFKVERRVQGRGYILLDGIWTHENQRGHEEMWCLLGDFHNIRHPSEREGVFHRGVEAASINEFNEWVSDMELVEILSVGRKLTWFKPNGASKSKLDRFLVSHEWLLKWPDYTTSILDMNFFYHCPILLRTTNTDWGPKPFRVFDCWLKDKSFDQTVRECWRNAQPRGWGGYVLKEKIKNLKESLKLWNNVHYGDTLKKTVKLSRANNSQETTGGTLDSSTLTRVLDEAEGKSEMAQRRGLIGQQQNDMLVGAFTEAEIRVAPEIRRFITAFHANGIFPRGTNASFIALIPKIVTKLLASKLKKVLPHIINERQSAFTAGRQLLHSVLIANEAVEEAKRHNKPCLVFKVDYERAYDSVSWNFLSYMMYRLGFCPKWIRWIEGCLNSASVSVLVNGSPTNEFNPHRGLRQGDPLASLLFNIVAEGLTGLMREALDKSIYNSLLVGKNRIPVNILQYADDIIFFGEATMQNVRTIKSMLRSFELASGLKINFAKSSFGVIGKPDQWLKEAADYLNCRILSLPFLYLGISIGDNPRHSEFWDPIIRKFLWGGGQEHKKIAWVDWKTVCLPKDKGGLGIKDLRTFNAALLGKWRWDLFHKQKEPWATMIYSKYGGW

SEQ ID NO: 206260 - protein, 85 aa, Glycine max
  Coding DNA Sequence Number=SeqID_89482
  Subcellular localization annotation: CTP_CleavageSite=35; ConfidenceScore=5.11e-01
MKKIATKETMTSRRVEGCARSPVVSEGTSQLVSCRASLRRCFPKTWWKSSVQRQSFLALSLLTKFLITKISPLKQLRRCSNQTSL

SEQ ID NO: 206261 - protein, 119 aa, Glycine max
  Coding DNA Sequence Number=SeqID_89483
MVCTNQADMTGRLLAGSLAFECHIMHNLIVRILLPRSSNLAQVSEEDLIIMWVFLTGHQIDWAHLGQPFPCVQESFTTRDPRSLNPFSEVRRREEEISLERDRLYNEDQSQFLIEYASV

SEQ ID NO: 206262 - protein, 175 aa, Glycine max
  Coding DNA Sequence Number=SeqID_89484
  Gene Ontology: Mol. function=helicase activity; Cellular component =membrane; Biological process=protein amino acid phosphorylation
  Homolog annotation: Hit_ID=Q9LTU4; Match level="QueryCoverage=99%, HitCoverage=12%, E-value=3e-55, Identity=61%"; Hit description =Helicase-like protein
MTYEQTSIYNQIVEVVNKDEGGMFFLYGYGGTGKTYIWKTLASSLRADNEIVIMVAFSGIASLLLPGGRTAHSKFEIPVPVFEDSTCNIHQGTQLAELLNQTSLIIWDEAPMAHKFCFEALDHSFRDIIKHNSKDNKIFGGKVMVFGGDFRQILPVIPRGSRSDIVNATINSSYL

SEQ ID NO: 206263 - protein, 284 aa, Glycine max
  Coding DNA Sequence Number=SeqID_89485
  Subcellular localization annotation: CTP_CleavageSite=33; ConfidenceScore=5.54e-01
MAKTKGKRMKSIRHRATTPKMNSKKKNEPTKGRSSNKGKRITRSPSPTPSPNITPWFSKEHYEASYMYNYAKKDFIQPKFLNLEWLKTQGFVFPKLLEYHGLKKHMEMKGTFYPELIVMTLEVWEETVGLSSVGRMLNDKDLKDPGQGKIWHMPLVVGTQTSGLCDCLDHYSQEEQTCITDREGSSSHQPYAREDEVGLELKFEVNSKVLKQMGYLYIEVDEKGGGWIQKPKEGEGTTIVIVKEKLMSPFELMMVAKMEEFMRMHKEGYGELNECFETISESLD

SEQ ID NO: 206264 - protein, 475 aa, Glycine max
  Coding DNA Sequence Number=SeqID_89486
  Gene Ontology: Mol. function=nucleic acid binding; Cellular component= nuclear pore; Biological process=DNA integration
  Homolog annotation: Hit_ID=Q1S7C5; Match level="QueryCoverage=97%, HitCoverage=51%, E-value=8e-58, Identity=39%"; Hit description =Integrase, catalytic region
PFTSFLQQEGIMHRVICPHTHHQKGVVERKHRHIVVHGLTLLAQAILPLTYWDHAFLTSVYLINRLPTSSLNVVFWGYSPAHKGYKCLSADGRIYISKDVVFNESKFPYPDLFFSSPTSHPSLESHVPNTTIPLVSVPQPQSPTPSPVDSPANTSHSSQSPPLPIDPQHDSQPAPPTPTNSSSQSSVLPQAPLIPSIPQNTHPMQTRSKNPDGSVNKYKARLVAKGFHQQYGTDYTETSSPVMKPITVRLLFSLAVTYGWPLQQLDVKMPFSMAFLKRRGIEVKHQSDGSIALTQSKYIKDLLARTSMSVVGALQYATITRPEISFSVNKDPKVPQRYSRMGLHLKPASAPFSINAFCEADWASDPDDRRSTSAVARSSTESEYRSLALVTAEVSWLQSLLTELAVPHKLPVIHCDNTSTVSLAPNPVLHARTKHMDLDPVFCSGKDMVELSQIRSRDSVLHVIGLESTLHLMNS

SEQ ID NO: 206265 - protein, 827 aa, Glycine max
  Coding DNA Sequence Number=SeqID_89487
  Gene Ontology: Mol. function=protein serine/threonine kinase activity; Biological process=protein amino acid phosphorylation
  Homolog annotation: Hit_ID=Q9LFA2; Match level="QueryCoverage=95%, HitCoverage=94%, E-value=1e-161, Identity=57%"; Hit description =Protein kinase-like
  Pfam annotation: Domain name=Pkinase; Domain location=445-776; Score =245.4; E_value=1.2e-70; Accession=PF00069.15; Description=Protein kinase domain
  Pfam annotation: Domain name=Pkinase_Tyr; Domain location=445-776; Score=-15.2; E_value=1.5e-11; Accession=PF07714.7; Description =Protein tyrosine kinase
  Pfam module annotation: Pfam domain module=Pkinase::Pkinase_Tyr; Domain location=445-776::445-776
MDTSGNTCEIVESREEIISEFKMDEKPESSCAHKSGKKYSIEDDINQLFQAIEIKSSSRSRSSSRLQKSALKRPIKVTSSQASGIGISEPVSLKQALRGLCISQASEMAALKRLTKPCSSSRVSEAGTIKRLYTAVVDEGKGNLVEISLVPEISAPSDKLSGVTISSSSDNHASPLVDATKPKEMITGFASQYQIVPLPLEVEGEELITGTGKPILANLSPVASASEEVPEARMHHASSSKASLGSSLPDKGHEANLPSASCPPSSSTGNGADKSTSSNTCLSKPIFNNLNFLKKKVKQDLSSASSCSTPCTSNLDKEGGNSDLKHDVKHNEKQSPSSSNHSIEVNSINGGTDSSKSGFSLNCNKRTKFLVTKVDEKSRSKEKGEYSQSSKSSIGEYSSSTSISEESSLSGSSRSGHRPHMSKHLRWEAVRAVQQQHGSLNLKHFKLLRRLGSGDIGTVYLAELIGTSCLFALKVMDSEFLASRKKMFRAQTEREILQMLDHPFLPTLYSHIATDKLSCLIMEYCPGGDLHVLRQRQPYKSFSEQATRFYVAEVLLALEYLHMLGVVYRDLKPENILVREDGHIMLTDFDLSLRCSVNPMLVKSSSPDTEKTSSPCSEASCIHPFCLQPDWQVSCFTPILLSAGVKSRKMKADIASHVGPLPQLVVEPTSARSNSFVGTYEYLAPEIIKGEGHGSAVDWWTFGIFLFELLYGKTPFKGQSNEDTLANVVSQSLKFPGTPIVSFHARDLIRGLLIKDPENRLGSVKGAAEIKQHPFFEGLNWALIRCAAPPELPKFRDFGSTAPSVAANKENANDLEDIEDCEEFELF

SEQ ID NO: 206266 - protein, 63 aa, Glycine max
  Coding DNA Sequence Number=SeqID_89488
  Gene Ontology: Mol. function=aminoacyl-tRNA ligase activity; Biological process=tRNA aminoacylation for protein translation
  Homolog annotation: Hit_ID=UPI000034F21F; Match level="QueryCoverage =95%, HitCoverage=6%, E-value=7e-25, Identity=88%"; Hit description =EMB2247; ATP binding / tRNA ligase/ valine-tRNA ligase
MVNWSPTLQTAVSDLEVEYSEESGYLYHIKYRVAGRSDFLTVATTRPETLFGDVALAVHPKVG

SEQ ID NO: 206267 - protein, 94 aa, Glycine max
  Coding DNA Sequence Number=SeqID_89489
MTTLTWIWMTLLFSNILPSDHNANLPLQMDHAHKTPSGLEEVQQGPGVSSSGYGPLSVLQSTRPPSEGSRPQDTQWTRRSPTGPWGFQLWLRAS

SEQ ID NO: 206268 - protein, 718 aa, Glycine max
  Coding DNA Sequence Number=SeqID_89490
  Gene Ontology: Mol. function=RNA-directed DNA polymerase activity; Biological process=RNA-dependent DNA replication
MATSKYLTALEAFGSGPNMFIPYIANGKGELGLNSQHTPPLLQGSILLHFKKGVVNPLLNSSPSRMTVYGESLERLLDDSLEVPNLFGAGLLGDQVYFGVSLPGYVVHFKAFKIIDESFGNVVVLEQHYFLGLALKLSLGACSRVTLSGPSRMIHVPLPFTLDTPSTSNYESSTDHATILPMSLGFRKTCLMGVIEYAVGEVDGEHVLPLLLSRGTPGLGQLKTGGVAMVFLKVRKACSPVSSHRKGSLFLSNFLNVGRAVHLQYGNAFVVVGFNPPMNDHETKEFASAYLECTFFKVEAHVIFAEFPKDFFQVCHVLGYALRLDDHVIHIYFNISSDQLFKYSVNQSLASRKLHRLAYRYKVKYLTSLMKLSLRSLFTSSLAALCCSSPIFLFSDTGLHLGYKPVLMAGEALVRSVVARIYIEFIVQTCLVDGSLVAGSLHSIVVLTLIFLDGYNLLGQAPGKLALTESAALVDEDFEHLEVCNDDGDNHGFVLVNGIDTLKVPIRESVDVDVSNGVKVAFSGLVVACVATGVSVYLNLPLYLFLCLLSDSYVTPFGVLRYLVASNPGLEGFVEGSLMGTSKLKASSRIVMRLVVRVSLGASFSLVALMPSLSDFVPESGHFFHLDGEEHGMQCDLWVKILDLDDDAPKFVHEFSKRLVICVSQIGQGSRGQAMRPVGCVLCTKAFNEGVEAIYGSWWESTVPDQCRPLEGHWEDTT

SEQ ID NO: 206269 - protein, 85 aa, Glycine max
  Coding DNA Sequence Number=SeqID_89491
MATGGGLEPLKGVSRLRPDRVQTMAKERDMTRDCGVCFIAASRWVPNVLTKIRGWHTSGWTWWAPRLHTSALRDIFVKRTRGGDL

SEQ ID NO: 206270 - protein, 304 aa, Glycine max
  Coding DNA Sequence Number=SeqID_89492
MAYSQLHPNSWAMIGKIGWVSLNSVSKKLFEFDSNIFHRFKDHFFKILATNVVADNFPLMFNKDGELRFPFYWVDKAILEQLLASLDTRATLSLPLASDLFAALNGKVSNLVLFCNEERGLVTHVVVLPFTLRNFSSDAFSPLMVMRNIFGLPLVEGLTNQPGVGILTNGGSWVFDRLVFRHRVNLGFNEPWTRDVFALGFDKPVELRRGLPMIDFRFDYPMRLTKCRAWDSPRADLGFYVPFGGSTKEFYDLGFGCRALAYMSLVCVARTRDIMACSCIRVTRGVTPTRDVVACSCIHVTHCG

SEQ ID NO: 206271 - protein, 78 aa, Glycine max
  Coding DNA Sequence Number=SeqID_89493
MLNPNNKREHSDGQIQMVIRSALRINHYRVIAAGGGAQLCMRFFLVSSDMVENVVATTSGWVQSWIVFTAEKKEITKQ

SEQ ID NO: 206272 - protein, 206 aa, Glycine max
  Coding DNA Sequence Number=SeqID_89494
  Gene Ontology: Mol. function=aminoacyl-tRNA ligase activity; Cellular component=intracellular; Biological process=tRNA aminoacylation for protein translation
  Homolog annotation: Hit_ID=Q7EZJ3; Match level="QueryCoverage=75%, HitCoverage=16%, E-value=7e-71, Identity=82%"; Hit description =Putative valyl-tRNA synthetase
  Pfam annotation: Domain name=tRNA-synt_1; Domain location=1-194; Score=-372.4; E_value=0.00051; Accession=PF00133.12; Description =tRNA synthetases class I (I, L, M and V)
MAIVPQTFGRHVPIIADKHVDREFGTGVLKISPGHDHNDYLLARKLGLPILNVMNKDGTLNDVAGLYSGLDRFEARKKLWAELEETRLAVKKEPHTLRVPRSQRGGEVIEPLVSKQWFVTMEPLAEKALQAVEKGELTIIPERFQKLNSHVLNDNKAIKWLHFDLEAAGSSIRNSHCVVRPCTSPPSLKLTRWQYCTLGHPITWAW

SEQ ID NO: 206273 - protein, 58 aa, Glycine max
  Coding DNA Sequence Number=SeqID_89495
MVEFEEKLRIDEAEAEFENEDEASSPCGGCVWNRVAQTGTSVLLAAAMKKDQRALNTM

SEQ ID NO: 206274 - protein, 60 aa, Glycine max
  Coding DNA Sequence Number=SeqID_89496
MCHASCASTSLAGKGSLWQCVELAAHVDGVVFLKEAKSKGISVAMKGEATVVAGGRFSIS

SEQ ID NO: 206275 - protein, 318 aa, Glycine max
  Coding DNA Sequence Number=SeqID_89497
MKWQMATHGNTPQDPFHVLRKGGVYYQNRRRAEEAPPHPRFVESHLSVHLKVAEGERKWYTNTWVGRLKNLGAFERVEEDIPWELGVYVVPKYIGDDMILLLGLSVSKAEEIILEESQHGTSPFQSLEKWNPTMRPGHRLVWVQCWGVPLEVWDIRNFRKIMVAVGDLIEVDNDVEELRRLDRARILIRTPWRPLFHHTVAVHISGEVHTVHIVEEGWSDAGTRIPLRRGVTDSSEELDFDDNNSGILCAAMATISDIRHRPNSLNGDWIVVADNQQLSPLPDGPRVMENPVGNAQDSWAHLPNIDICARSETEKEKK

SEQ ID NO: 206276 - protein, 194 aa, Glycine max
  Coding DNA Sequence Number=SeqID_89498
  Gene Ontology: Mol. function=nucleic acid binding
  Homolog annotation: Hit_ID=Q1S7C5; Match level="QueryCoverage=54%, HitCoverage=9%, E-value=5e-24, Identity=54%"; Hit description =Integrase, catalytic region
  Subcellular localization annotation: CTP_CleavageSite=49; ConfidenceScore=5.71e-01
MAESPLPPSATPFSSSSAFSHSISKKLTDSNFLLWKQQKLTRAGARQLRAELRSTTLNSKNVSEFLLRIKALADALASVGDPITPEQHVDVILEGLSSDNNSVISAIESKFQLMQIEEMEALLAHEMRLEKSQKKLASETASLNLMEIPSSKSQQQQSSSAQANVASENANSNYNSYSGYCSSRRGRDGRNGCG

SEQ ID NO: 206277 - protein, 108 aa, Glycine max
  Coding DNA Sequence Number=SeqID_89499
  Gene Ontology: Mol. function=DNA binding; Biological process=DNA integration
  Subcellular localization annotation: CTP_CleavageSite=40; ConfidenceScore=5.01e-01
MAEAKSISSPMVTNLKLSKNGNDLLSDPTMYRSLVGALPYATITRPEISFAVFRTLDSDLYQPLFISLSVCMLTVMLIGKLTLMIGDPPQAEYRSLAQTLADILWLQT

SEQ ID NO: 206278 - protein, 313 aa, Glycine max
  Coding DNA Sequence Number=SeqID_89500
  Gene Ontology: Mol. function=aminoacyl-tRNA ligase activity; Cellular component=intracellular; Biological process=tRNA aminoacylation for protein translation
  Homolog annotation: Hit_ID=UPI000034F21F; Match level="QueryCoverage =99%, HitCoverage=34%, E-value=1e-134, Identity=71%"; Hit description= EMB2247; ATP binding / tRNA ligase/ valine-tRNA ligase
  Pfam annotation: Domain name=Anticodon_1; Domain location=94-245; Score=144.6; E_value=2.6e-40; Accession=PF08264.3; Description =Anticodon-binding domain
MSKTLGNVIDPLDTIKEFGTDALRFTLALGTAGQDLNLSTERLTSNKAFTNKLWNAGKFILQNLPNENDTSAWEEILSYKFDSEVTVVNLPLPECWVVSKLHLLIDSASASYDKFYFGEVGRETYDFFWADFADWYIEASKERLYQSGAGGKSVASVAQAVLLYTFENILKVLHPFMPFVTEELWQALPYRKHALIVSPWPETQLPRNTCSVKKFENFQALVRAIRNARAEYSVEPAKRISASVVANNEVIEYIAVRNADQSVHLVAGEGLEAYLPLADMVDISAEVDRLSKRLSKMQKEYDGLIAKLNSPQV

SEQ ID NO: 206279 - protein, 83 aa, Glycine max
  Coding DNA Sequence Number=SeqID_89501
MEVKVKRKTNEGDDSLEMEVENDKEEGDSYKEKLLVAKGVVPFSAFDGRCYDNPDKEVPPAPIMKEDVEHFKELPIFDEEFSD

SEQ ID NO: 206280 - protein, 269 aa, Glycine max
  Coding DNA Sequence Number=SeqID_89502
  Gene Ontology: Mol. function=6-phosphogluconolactonase activity; Cellular component=cytoplasm; Biological process=carbohydrate metabolic process
  Homolog annotation: Hit_ID=Q1BUU1; Match level="QueryCoverage=78%, HitCoverage=51%, E-value=3e-32, Identity=38%"; Hit description=3 -carboxymuconate cyclase-like precursor
RGGDGIPIGGDGKLGERVQHFPFTPGSGVVQGRQEGGHAHSTTFSRDGQYLYAADLGGDKLRAYRYRSDNAQPLQADASRDVAFAPGAGPRHMAFSPEGEYAYVITEMASEIEVFAVSDHRLTRQGKVKLNGGQDSAEAKSGGAIILSPSGRYLIATNRGADNHLLVLKIGEDGLPGAPTRYEAGGIEPRALAFDAGGNHFYVTNVFTNTVMLFDFDDEKGELQARGQATTARRPIFGAQIVADLRVAYQRKDKGAADDVARQRRQGER

SEQ ID NO: 206281 - protein, 42 aa, Glycine max
  Coding DNA Sequence Number=SeqID_89503
MIMPCAWSEVASSIGKSETSPLDLALEESIKTLGTKNLARDY

SEQ ID NO: 206282 - protein, 46 aa, Glycine max
  Coding DNA Sequence Number=SeqID_89504
MKKTIVDGVTITKEITGEEGGKGVLGRGVRKFGVKVNVGGSKFYKS

SEQ ID NO: 206283 - protein, 209 aa, Glycine max
  Coding DNA Sequence Number=SeqID_89505
MKREVTHPQTLPDELIHEILLRFKSVHKSWLSLISEPGFAKSHFDLAAAPTTDFFSSASILILKLIILMLIWSLTFHFHYLLWEACMNTDNNDFFDFVITGQRIQRQTNHVCIHPPMSGIGNDSLADDYVVAILQLSLDQDWPSYPKVDLFSSRTNSWSRIEGTLPCYFSGQKNVRHKFVHKFMHMFLNGALHWMIESYNDIGLIIELD

SEQ ID NO: 206284 - protein, 134 aa, Glycine max
  Coding DNA Sequence Number=SeqID_89506
  Gene Ontology: Mol. function=binding
  Homolog annotation: Hit_ID=Q60EM0; Match level="QueryCoverage=78%, HitCoverage=16%, E-value=5e-16, Identity=36%"; Hit description =Unknow protein
MITEYAQHGRAKKALVVFEGMQKQNLEMNAITFTGVISAGTHAGLVDKAQHYFNGMINGHQIKPTMKHYSNIELGKLAAEKIISLEPQNSEACHIIQYVCCSRKLGHIVVRDKNGFTTLKVVCAHVGTTGYVLG

SEQ ID NO: 206285 - protein, 518 aa, Glycine max
  Coding DNA Sequence Number=SeqID_89507
  Gene Ontology: Mol. function=binding; Cellular component =intracellular; Biological process=RNA processing
  Homolog annotation: Hit_ID=O64858; Match level="QueryCoverage=95%, HitCoverage=89%, E-value=1e-151, Identity=54%"; Hit description =Expressed protein
  Pfam annotation: Domain name=DUF946; Domain location=15-517; Score =899.3; E_value=1.7e-267; Accession=PF06101.2; Description=Plant protein of unknown function (DUF946)
MSSSLSQFKKKQNLPIETTFKLPADIPVWPPGGGFATGIIDLGGGLLVSQISTFNKVWTTYEGGPNNLGATFFEPTGLSEGFFMLGCYCQPNNKPLHGCVLVGKDNSSTSNGALAEPVDYKLVWNTKSQKIKQDGHGYIWLPISPDGYNPVGHVVTTSPEKPSLDKIRCVRSDLTDESTTCHSMKLWRTENKRFNVYDVRPIKRGIEAQGVSVGTFLAQSGGGTNSKAFPIFCLKNTKGSFSYMPNLSQIKAMIKAYSPYMYLHPMEEYLPSSVDWFFTNGAVLIEKRKGVIRESSIEPNGTNLPQGSSNDYDDATYWLDLPLDETKRVSVKKGDLASSQAYVHVKPMLGGTFTDIVMWVFYPFNGGARAKVACTNIPLRTKGEHVGDWEHLTLRISNFNGELWKVYFSQHSKGQWEDASELEFQNGNRPVAYSSLHGHALFPKPGLVMQGMRGLGVRNDAAKSDAVMDMATWFEIVAAEYLGSQIREPPWLNFCMNWGPKEGPKGPKQKDMWKGDER

SEQ ID NO: 206286 - protein, 125 aa, Glycine max
  Coding DNA Sequence Number=SeqID_89508
  Gene Ontology: Mol. function=nucleoside-triphosphatase activity; Cellular component=membrane; Biological process=defense response
  Homolog annotation: Hit_ID=Q5JBT4; Match level="QueryCoverage=97%, HitCoverage=12%, E-value=5e-36, Identity=65%"; Hit description =Candidate disease-resistance protein SR1
  Pfam annotation: Domain name=TIR; Domain location=14-118; Score=19.7; E_value=7.6e-07; Accession=PF01582.10; Description=TIR domain
MSSSASEAQTHAMVFLAISTRLFMTEEFTLSLITRIFGVDIVVLSNNYASSLFCLDELAYTLECRERKNLLVLPIFYNLNPSHVRHQKGSYDEALAKHARRFQHNPEKLHKWKMALRQVADLSGF

SEQ ID NO: 206287 - protein, 53 aa, Glycine max
  Coding DNA Sequence Number=SeqID_89509
  Gene Ontology: Mol. function=pyridoxal phosphate binding; Cellular component=mitochondrial matrix; Biological process=arginine metabolic process
  Homolog annotation: Hit_ID=Q38IW9; Match level="QueryCoverage=87%, HitCoverage=10%, E-value=3e-20, Identity=100%"; Hit description =Ornithine aminotransferase
MLACEWEEVRPDIVILGKALGGGVIPVSAVLADKDVMLCIQPGQHGSCQTSGL

SEQ ID NO: 206288 - protein, 308 aa, Glycine max
  Coding DNA Sequence Number=SeqID_89510
  Gene Ontology: Mol. function=binding; Cellular component =intracellular; Biological process=RNA processing
  Homolog annotation: Hit_ID=O64858; Match level="QueryCoverage=93%, HitCoverage=54%, E-value=2e-91, Identity=54%"; Hit description =Expressed protein
  Pfam annotation: Domain name=DUF946; Domain location=4-308; Score =230.7; E_value=3.2e-66; Accession=PF06101.2; Description=Plant protein of unknown function (DUF946)
MAFKTDERYKISKCYDHELLHLHPDEEFFPSSVEWFFSNGALLYKKGQESSPVPISPNGANLPQDPNDDGAYWVDLPADSTNKDRVKKGDLKSAISYVHVKPMLGGTFTDISMWVFYPFNGAARAIVDFLTIDLGKIGEHVGDWEHVTLRVSNFNGELKHVYFLQHRKGAWFDSSQLEFQSGNKPLYYSSLHAHASYPHAARNITDKIGIRNDTAMSDSVMDLGAFQLVSAEYLVSDVVEPPPWLNYFREWGPKIYYNVDEELKKLEKFLPGKLKSTLENIVKNLPSEVLRQEGPTGPKVKDSWSGDE

SEQ ID NO: 206289 - protein, 65 aa, Glycine max
  Coding DNA Sequence Number=SeqID_89511
MGANVGIICVLFLLATQTVGVPAFAPWKKLHVPWKKHSKDLCFDKNIIGENGEELQVVLDHYGLS

SEQ ID NO: 206290 - protein, 65 aa, Glycine max
  Coding DNA Sequence Number=SeqID_89512
MHTKCNNFGILLKGQSAHNSVKFVKEKVMDEPKFIPSSFYTQLVSQRCLEAVGASNGITEKVLRS

SEQ ID NO: 206291 - protein, 85 aa, Glycine max
  Coding DNA Sequence Number=SeqID_89513
  Gene Ontology: Mol. function=protein binding; Cellular component =integral to membrane; Biological process=protein amino acid phosphorylation
  Homolog annotation: Hit_ID=Q1S979; Match level="QueryCoverage=95%, HitCoverage=13%, E-value=2e-17, Identity=54%"; Hit description =Leucine-rich repeat
  Pfam annotation: Domain name=LRR_1; Domain location=11-33; Score=4.5; E_value=41; Accession=PF00560.23; Description=Leucine Rich Repeat
  Pfam annotation: Domain name=LRR_1; Domain location=35-57; Score =20.4; E_value=0.0064; Accession=PF00560.23; Description=Leucine Rich Repeat
  Pfam annotation: Domain name=LRR_1; Domain location=59-81; Score =12.4; E_value=1.4; Accession=PF00560.23; Description=Leucine Rich Repeat
  Pfam module annotation: Pfam domain module=LRR_1::LRR_1::LRR_1; Domain location=11-33::35-57::59-81
MTFPNLKNLKLLLRLELRNCLITGPIPNYIGEIESLKSIDLSSNMLTGSIPDSFQDLGNLNYLFLTNNSLSGPIPDWILSIKRHM

SEQ ID NO: 206292 - protein, 97 aa, Glycine max
  Coding DNA Sequence Number=SeqID_89514
  Gene Ontology: Mol. function=protein binding; Cellular component =integral to membrane; Biological process=protein amino acid phosphorylation
  Homolog annotation: Hit_ID=Q1S979; Match level="QueryCoverage=83%, HitCoverage=11%, E-value=2e-15, Identity=56%"; Hit description =Leucine-rich repeat
MADSNSARLKEFFPRKVFELTGNYFNGSIPKSLGRLSSVVTLTIDTCFRNLLGNRLTGSIPSEIGDMASLQELILEDNQLEGPLPLSLGKMSNLLRL

SEQ ID NO: 206293 - protein, 79 aa, Glycine max
  Coding DNA Sequence Number=SeqID_89515
  Subcellular localization annotation: CTP_CleavageSite=60; ConfidenceScore=5.28e-01
MWLSKANEPASSLLVISTWLVQTNWRASCTEKSNFQSSFSVPSNGSIMEREEKRFMYRIRCSSDENNEEEEMEEGICVS

SEQ ID NO: 206294 - protein, 99 aa, Glycine max
  Coding DNA Sequence Number=SeqID_89516
MSYAGGLKDELGQCCCGKLVEDQKDWILHVPYAILISKVLDHFKVDVHYEINDFVKLEFELKTKPKKTTTEETEDKPMSPFELMLMAKMDENMRMQKED

SEQ ID NO: 206295 - protein, 1956 aa, Glycine max
  Coding DNA Sequence Number=SeqID_89517
  Gene Ontology: Mol. function=nucleoside-triphosphatase activity; Cellular component=membrane; Biological process=RNA-dependent DNA replication
  Pfam annotation: Domain name=AAA; Domain location=36-235; Score= -28.6; E_value=0.031; Accession=PF00004.19; Description=ATPase family associated with various cellular activities (AAA)
  Pfam annotation: Domain name=AAA_5; Domain location=36-189; Score= -19.7; E_value=0.057; Accession=PF07728.4; Description=ATPase family associated with various
  Pfam annotation: Domain name=Exo_endo_phos; Domain location=858-1109; Score=29.9; E_value=9.1e-06; Accession=PF03372.13; Description =EndonucleaseExonucleasephosphatase family
  Pfam annotation: Domain name=RRM_1; Domain location=224-294; Score =23.5; E_value=0.00076; Accession=PF00076.12; Description=RNA recognition motif. (a.k.a. RRM, R
  Pfam module annotation: Pfam domain module=AAA::AAA_5::Exo_endo _phos::RRM_1::RVT_1; Domain location=36-235::36-189::858-1109::224 -294::1318-1586
MLWVDKYRPKTLDQVMVHTDIARNLKKLVTEQDCPHLLFYGPSGSGKKTLIMALLRQMFGPGAEKVKVDNRTWKVDAGSRSLDLELTTLSSANHIEMSPSDAGFQDRYIVQEVIKEMAKNRPIDTKGKKGFKVLVLNDVDKLSREAQHSLRRTMEKYSAYCRLILCCNSSSRVTEAIRSRCLNVRINAPSEEQVPCLNIDRKNIGNHHSYMRANWRDKQDVTSFYFTRFPDDATEKDMWIHFKQVGDVREIFISRKRNRNGKRYGFVRFKGVKDVHQMEKKLDSMIFGGLKMYANTPKFGRARWDKSQTTARGRAESNQQQEVNRDTYLSMKPDLNVGAQQGSYAEVVRRHIPITKQRRTPAKELYTGDSSRSTMILDISLKGQQWLQEAWVGRLKNLAMFDRIEDEMLWDIGENLSPKYIGDDMVLILGLNEEKAMKVMEEEDTGWGDLFISLEKWNPKLRPGYRLTWVHCWGIPLMAWDIPHIKQIVSSIGEMVEADDDVEDLRKLDMARILIKTPWKPLIQHVVNVQIEGEIFTVNIVEESGVSCARCQCWRQNEFSSSEEIQSEESEGGTSREARLKAWRNMMRTLSIAGTFGEVRGGVSVSGEGKVDDLRSASAKTPPNGDMQRSSETPTEDRASTMGGDESQKRWNDGLQGVLENSKEGLATGKNEEDASKWMTAAMQQSPENLADGTNLGMVGADTQKGTSGYCPKDNGDARQVYAQSDTVRPDFVVSQMSDRMEAETNQTPLHLNGGSWHNEKCGISDNSENFHEKGNRRAQLNVEDKRSFKSVADQSRDKEVGGVADLGCDIYTPTKICSPHQPSPKSHLTGQNNSWLVYSRKRGDKKILAHRGAAHELRPVINSADTLSHPKQQEKDKKEARAQGLGRGVKWPAIRRLVNEHHVDMLCLQETKKENVEKSMCQALWGDTEISWEAYPASNAAGGIICIWNDRHFKVESRITGAGFILLIGKWRQETQPVHVNIYSPCNLQNKRILWDSVKQLKDQNPGGYWCILGDFNNIRSPAERLGSCQRGSMDGSIREFNEWIADMEVEEVPSVGKRFTWSRSNGTTKSKLDRFLVSPEWISKWPGSSQHTLHRNFSDHCPKIKTLKDKIKVWNKEQFGDTFKKYKKIEDDLNKLEEESDDRQLDHNELIVRKQLQQELWEAAQAHESLLRQKARSKWIKEGDCNTRYFHLLINSRRRANCLNGVLIDGSRKDEPAIVKEEIRRFFSQRFQESVQERPRLDGICFQSMGSQQNDMLVERFSEDEVKRAVWSCGNDKSPGPDGLNFKFIKQFWDIIKSDFLRFFDEFYVNGVFPRGLNASFIALIPKLADPQVLNDYRPISLIGCTYKILAKVLANRLKKVMHLIISERQSAFIQGRHMLHSVLIANEVVEEAKRCQKLCIIFKVDYKKAYDSVSWEFLTYMMTRMGFCTKWIQWIAGCLKSVSVSVLVNGSPSSEFLPQKGLRQGDQLSPLLFNIVAEGLNGLMSKAIEKTLYRGFLVGTHKVDISLLQYADDTIFFGETSMENVRTIKVILRAFELASGLKINFAKSSCGAFGVSDLWISGAANYLHCSVMSFPFTYLGIPIGANPRRCQTWDPIVTKCERKLVRWKQRHLSVPKKVEDKLIKLQRNFLWGGASEQNKIAWIRWETGELWARVIESKYGGWRNLSEARSANNESTWWRDLKIVAQHPQQGQVLNRSIVWKQDHFIQQMGDVKDSGWEWDFKWRRPLFDSEIDLAVSFLEDIQGHRIRANSADQWVWVADPSGQYTVRSAYTVLREDLMQEDQDGEFKELWKVKVPSKVAVFAWRLLKDRLPTKDNLRRKHVELQDFTCPFCRTMEESAKFIGKKEGLQLPPGFAARIVEKSNRNLRRAILSFETCRVQQYPFTNKQTIPPMDWEEYISEIASDIMKEQSPKRLFQVRGKLYELLINCIPPEIILKRLLYELLRKLDAELKHE

SEQ ID NO: 206296 - protein, 752 aa, Glycine max
  Coding DNA Sequence Number=SeqID_89518
  Gene Ontology: Mol. function=nucleic acid binding; Cellular component= nucleus; Biological process=DNA integration
  Homolog annotation: Hit_ID=Q1S1X7; Match level="QueryCoverage=99%, HitCoverage=65%, E-value=1e-167, Identity=39%"; Hit description =Integrase, catalytic region; Zinc finger, CCHC-type; Peptidase aspartic, catalytic
  Pfam annotation: Domain name=rve; Domain location=322-484; Score =45.6; E_value=1.7e-10; Accession=PF00665.16; Description=Integrase core domain
  Pfam annotation: Domain name=zf-CCHC; Domain location=116-129; Score =13.4; E_value=0.0061; Accession=PF00098.13; Description=Zinc knuckle
  Pfam module annotation: Pfam domain module=RVT_2::rve::zf-CCHC; Domain location=610-751::322-484::116-129
MEEGSSIKEHVSLFTKAVLDLKSVDVRIDEEDQAVMLLCYLPSSYENLEDTMLFRRDTLTLEEVKATLNSRELKKKITENKGEVGDPKALMARGRSEKRDSKSKNKRRSKSRNKDYCKKEGHFRKECPERKKKNNGKYNDESDIAVVANGYESAEVLSISTEKHSEEWILDSGCSFHMTPNLEWLSSYKEIDGGKVLMGNNMACNVIGIGTVKLKMQDGSVKLLPDVRHVPELKRNLLSLGMLDQSGCSFKGEGGTLKVFKGSLQVMKGTRQNGLYKLQGNTILNSAGLVSISEPNASKLWHYSLGHVSEKGLEELHKQGLIGNGNYQKLNFCKHCVYGKQKRVSFHNATHITQGILDYVHSDVWGPARAFKCFKKWKLFVENQTGRHVKLLKTDNGLEYLSEEFNKFCKDNGIRRHKTVRLTPQQNGLAKRMNRTILERVRCKLEPRAKKGIFLGYLEGVKGYKVWLLDPAGTKSIISRDVLFREEDMITNYQQKSDSVQKGVQAEQNRHSDQGIRLEIEKLAQTSSPVEDRNEASHDEPMISSILEPVDTSYNLVRDRQRRQIKAPIRLGYADLIAYALSIEFDDQGSEPISYKDAISRTDSDQWRSAMQEEFDSLMKNDTWKLVEKPVKQKVVGCKWIFKRKPEETGMDSYRYKARLMARVVKHTSIRIILALVAVHNLELEQMDVKTTFLHGNLEETIYMSQPEGYEVKGKEEMSPRQWYKRFESFVVSNGFSRSSYDSCVYFRRLKL

SEQ ID NO: 206297 - protein, 53 aa, Glycine max
  Coding DNA Sequence Number=SeqID_89519
MALADLVVSQMQMGQLHQVLDLVLDDGDFVTTITELAFRNSDKNFQILGTQSE

SEQ ID NO: 206298 - protein, 195 aa, Glycine max
  Coding DNA Sequence Number=SeqID_89520
MESDFDGWFHIGLGGVLVDFSSWMGCKKYNEDCERDQRVTTFINGVAYMIEIVEEVCCGSQSCNCNRGGHGESSKEISLEWSDIGCDIQSEEDQVDDETPTPNTISDSEGDARAGTRGKQLLLVVYYPYFATTVNNVENMDYSPNSGPTHYSLGETLVVQKKIDTTKQNEKGKEDKRQQNLAIESHHTGEANALM

SEQ ID NO: 206299 - protein, 153 aa, Glycine max
  Coding DNA Sequence Number=SeqID_89521
MELKLHALMASIPHAVFTHSSFSILFCTYAVLDASRRPNGNTSSRSTHKIPPLCKEKHLNEQKLKLDHQNQNNLNVGLVALCGEGNHDQQMKQAGVPSDGETFELFFTACAQAGGGGLVSVRGGVVVGGTVVTKEVGEVIDEVAVPRVISFKQ

SEQ ID NO: 206300 - protein, 83 aa, Glycine max
  Coding DNA Sequence Number=SeqID_89522
CEATSTTLGRNMCNTMRQVQSQLGGNGRSNNWRDALDILSLYFTRFPENMGEKDLWVAFKKWGDVREVLLHGTRIEMAVAMVL

SEQ ID NO: 206301 - protein, 271 aa, Glycine max
  Coding DNA Sequence Number=SeqID_89523
  Gene Ontology: Mol. function=nucleic acid binding; Cellular component= intracellular; Biological process=DNA integration
  Homolog annotation: Hit_ID=Q1S1X7; Match level="QueryCoverage=96%, HitCoverage=23%, E-value=1e-81, Identity=50%"; Hit description =Integrase, catalytic region; Zinc finger, CCHC-type; Peptidase aspartic, catalytic
MEAIKELKNLLQSEFEMKDLGAARRILGMDIIRKRNEEDEIKDMSRIAYSNATGSLMYAMVCTRLDLAYSASIVSRFMENPGKQHWSAIKWILRYLKGSKSVGLVYGRNLERINGLSSYVDVDYACGIDKRRSLTRYLFTLYGSVISWKANLQSVVALSTTEAEYIALIEAIKEAIWLKGLVHELEGKTGLVEVWCDSQSVIDLSKNQVFHERTKHIDIRMHYIRDIIAQGEVEVRKVARANNPADMLTKVVPCSKFTHCLNLVNIGTCDT

SEQ ID NO: 206302 - protein, 610 aa, Glycine max
  Coding DNA Sequence Number=SeqID_89524
  Gene Ontology: Mol. function=RNA-directed DNA polymerase activity; Biological process=RNA-dependent DNA replication
MEKKVKGNGFIYLEGTWVGDGGKVTIINIYSPCDITSKRILWDEVKQLRTANNGGLWCILGDFNSIRRKFERVGLCQRIQNGGSLKEFNNWIVDLDVEDVPSTHLLLKVASPLSLPSPFRFHSSSKRQRNPLMKKIIGLQAPMELTSDKSFKKVVQDVGATTMYLAGGYVLKEKFKKLKQRSIDPQHNELLVAHFKEDEVKAAIWDCGSAKSPGPDGLNFNFIKQFWDLLKSDVLRFLNEFHANGVFPKGSNASFLALIPKGRQLLHSVVVANKVVEERMGFCAKWIKWIEGVNGSPIEEFCPHRGLRQGDPLVPFLFNIVVEGLSASLENVKAIKLLLRNFELVSGLRINFVKSKFGAIGMSHHWIQNATNYLSCRVLAIPFLYLGIPIVANPRHSMIWEPIVERFPNEGGHQIGEVIAMVLMGGKLDQRKIAWEKLEIICLPREKGGLGVQDITKFNCALLGKWWWNLFHHKGELWARLLESKYGSWLNLDATRTNSADSVWWQDLRHVDIVAKFMEDIEAVTVQVNQQDGWGWRLDPCGVYTVGSAYKVLIRERLPTKVNLKRRNVELNDILCLFCGSNEEETISFNMAMVISRALSISDGKYGGLP

SEQ ID NO: 206303 - protein, 180 aa, Glycine max
  Coding DNA Sequence Number=SeqID_89525
  Gene Ontology: Mol. function=DNA binding; Cellular component=beta -galactosidase complex; Biological process=DNA integration
  Homolog annotation: Hit_ID=Q2HRM8; Match level="QueryCoverage=93%, HitCoverage=16%, E-value=5e-39, Identity=45%"; Hit description =Polynucleotidyl transferase, Ribonuclease H fold
MDSMLKLHKEAVSHLSQYIDNPTSMHFTAAGRVLRYIKKSPAQGLFFSAESDNKLKVRSNPLCPDLPSEAEYRALAQATCDAEWLIYLLNDHRVYTVSPAVLYCDNQEAIHIAANPVFHERTMHIGLDCHCQGKITNGTIHLLPVSSQSQLANIFTKSLVLGPFTNLQSKVGMLDIHIPA

SEQ ID NO: 206304 - protein, 258 aa, Glycine max
  Coding DNA Sequence Number=SeqID_89526
  Gene Ontology: Mol. function=DNA binding; Biological process =regulation of transcription
  Homolog annotation: Hit_ID=Q8LFS2; Match level="QueryCoverage=96%, HitCoverage=69%, E-value=2e-33, Identity=29%"; Hit description =Regulatory protein
MVDESMASPGSILDILLQSFKSGEGTERLLNHLVIISMDPQAFEYCSSLHPYCIHPSIFPRPIMTTPDHNLFTWTRNDVLYEVIRLGYNIIFTDADVLWLRSPFINFHAASELTISCSDGQSGSDLQDGGIFFLKASENSLEFFKYWKLTKFLHPNNPAEESLCTTVSVMQDAVSRYSFDVQLANTSSFGDFCQLNMNTLREAYTIQANCCDDLKSKVHDLRIVLDDWIRFRKRASEGNALDKMDLRWPQKCSIRNYT

SEQ ID NO: 206305 - protein, 149 aa, Glycine max
  Coding DNA Sequence Number=SeqID_89527
  Gene Ontology: Mol. function=nucleoside-triphosphatase activity; Cellular component=protein complex; Biological process=protein catabolic process
  Homolog annotation: Hit_ID=Q9SSB5; Match level="QueryCoverage=94%, HitCoverage=33%, E-value=5e-74, Identity=96%"; Hit description=26S protease regulatory subunit 7
  Pfam annotation: Domain name=AAA; Domain location=49-148; Score=8.9; E_value=4.5e-05; Accession=PF00004.19; Description=ATPase family associated with various cellular activities (AAA)
MMTVEEKPDVTYNDVGGCKEQIEKMREVVELPMLHPEKFVKLGIDPPKGVLCYSPPGTGKTLLARAVANRTDACFIRVIGSELVQKYVGEDARMVRELFQMAHSKTACIVFFDEVDAIGGARFDDGVGGDNEVQHTMLEIVNSTGKSTF

SEQ ID NO: 206306 - protein, 164 aa, Glycine max
  Coding DNA Sequence Number=SeqID_89528
  Gene Ontology: Mol. function=DNA binding; Biological process=DNA integration
MCWHCNIIKPKLKLRASSFGLTLYGLKQSPWAWFGRFTKPMYLKATLCKGLLFKRGGSLTIDAHIDANYVGLMSDKRSTSSYCTFLCENLVIWRIRRKMKWLDQVLRQNLDLWHKEFIKYEGSMKLFCDNKSAICIAHNCVQHDRTKHIQIDTGTSSRRSWIVN

SEQ ID NO: 206307 - protein, 147 aa, Glycine max
  Coding DNA Sequence Number=SeqID_89529
MEKPSKPELPPKLWKLSHETRSSKLSEEEKVKISSNGIGCTRSKGCGHYNFDNVIACATRKNFHPIHGVETFLVLLFSKIMYRIYNFAMYPVANRVMEMVLVNVESHFKELEEAKQTERDVGTLNISDHPTIGRYYETIGSDHPTKT

SEQ ID NO: 206308 - protein, 56 aa, Glycine max
  Coding DNA Sequence Number=SeqID_89530
MENKVEVDHRLAGIVEPTIIYMDSNVDFAIVGKIRVVMLVVDYVVAECVGVMKENL

SEQ ID NO: 206309 - protein, 382 aa, Glycine max
  Coding DNA Sequence Number=SeqID_89531
  Gene Ontology: Mol. function=nucleoside-triphosphatase activity; Cellular component=integral to membrane; Biological process=transport
  Homolog annotation: Hit_ID=Q9C6W5; Match level="QueryCoverage=71%, HitCoverage=42%, E-value=4e-87, Identity=56%"; Hit description=White- brown complex homolog protein 14
  Pfam annotation: Domain name=ABC2_membrane; Domain location=113-319; Score=189.5; E_value=7.9e-54; Accession=PF01061.14; Description=ABC -2 type transporter
MRVQKGWSFLPMNLVFKVAIANGVIRSGELIRLYHNPSFVGFTTCIVADVKQEEQIDHHEDQASIKQFLVSSYKKNLYPLLKQEIQQNHRELAFLNSGTPRSSENQWTTSWWEQFMVLLKRGLKERRHESYSGLRIFQVLSVSILSGLLWWHSDPSHIQDQVGLLFFFSIFWGFFPLFNAIFAFPLDRPMLTKERSSGMYHLSSYYVARTVGDLPMELVLPTIFVTISYWMGGLKPSLVTFVLTLLIMLFNVLVSQGIGLALGALLMDVKQATTLASVTMLVFLLAGGYYIQQIPFFIAWLKYISFSHYCYKLLVGVQYSVNEVYECGQGLLHCKSCGLFSFEDGAASLTRDCIVDQGFMAIILIDILVVWIIGLSRRVIRF

SEQ ID NO: 206310 - protein, 353 aa, Glycine max
  Coding DNA Sequence Number=SeqID_89532
  Gene Ontology: Mol. function=transferase activity, transferring groups other than amino-acyl groups; Cellular component=cellular _component; Biological process=flavonoid biosynthetic process
  Homolog annotation: Hit_ID=P17957; Match level="QueryCoverage=91%, HitCoverage=83%, E-value=1e-169, Identity=93%"; Hit description =Chalcone synthase 2
  Pfam annotation: Domain name=ACP_syn_III; Domain location=101-184; Score=-3.4; E_value=0.002; Accession=PF08545.1; Description=3 -Oxoacyl-[acyl-carrier-protein (ACP)
  Pfam annotation: Domain name=ACP_syn_III_C; Domain location=222-325; Score=-5.9; E_value=5.8e-05; Accession=PF08541.1; Description=3 -Oxoacyl-[acyl-carrier-protein (ACP)
  Pfam annotation: Domain name=Chal_sti_synt_C; Domain location=177 -327; Score=343.7; E_value=3.1e-100; Accession=PF02797.6; Description= Chalcone and stilbene synthases, C-te
  Pfam annotation: Domain name=Chal_sti_synt_N; Domain location=1-168; Score=383.4; E_value=3.5e-112; Accession=PF00195.10; Description =Chalcone and stilbene synthases, N-te
  Pfam module annotation: Pfam domain module=ACP_syn_III::ACP_syn_III _C::Chal_sti_synt_C::Chal_sti_synt_N; Domain location=101-184::222 -325::177-327::1-168
DKSMIKKRYMYLNEEILKENPSVGAYMAPSLDARQDMVVVEVPKLGKEAATKAIKEWGQSKSKITHLIFCTTSGVDMPGADYQLTKLLGLRPSVKRYMMYQQGCFAGGTVLRLAKDLAENNKGARVLVVCSEITAVTFRGPSDTHLDSLVGQALFGDGAAAVIVGSDPLPAEKPLFELVWTAQTILPDSEGAIDGHLRQVGLTFHLLKDVPGLISKNIEKALVEAFKPLEIDDYNSIFWIAHPGGPAILDQVEAKLGLKHEKMEATRHVLSEYGNMSSACVLFILDQMRKKSIENGLGTTGEGLEWGVLFGFGPGLTVETVVLRRDNWVEVVVRVVRGVVDPVESDLEDDVGV

SEQ ID NO: 206311 - protein, 53 aa, Glycine max
  Coding DNA Sequence Number=SeqID_89533
MEAIMMWWLWCDGEVTMADCGCSDSNNDNGDRMMVVVVEAVTMARTVVVMEVC

SEQ ID NO: 206312 - protein, 969 aa, Glycine max
  Coding DNA Sequence Number=SeqID_89534
  Gene Ontology: Mol. function=RNA-directed DNA polymerase activity; Cellular component=chromatin; Biological process=chromatin assembly or disassembly
  Pfam annotation: Domain name=Chromo; Domain location=866-916; Score =25.1; E_value=0.00025; Accession=PF00385.14; Description='chromo' (CHRromatin Organisation MOdifier
  Pfam annotation: Domain name=rve; Domain location=577-751; Score =76.5; E_value=8.4e-20; Accession=PF00665.16; Description=Integrase core domain
  Pfam annotation: Domain name=zf-H2C2; Domain location=524-559; Score =7.0; E_value=0.042; Accession=PF09337.1; Description=His(2)-Cys(2) zinc finger
  Pfam module annotation: Pfam domain module=Chromo::RVT_1::rve::zf -H2C2; Domain location=866-916::157-324::577-751::524-559
MVGNGQHLDCYCLCTDVPIEIQSMIFTADLHVLPISGANVVLGVQWLKSLGSMLTDYNTLSMQFFYDGRLIELKGDNDAHLRLVSSPQFRRLCHRQGEGYCFHISMIMDTAISLDNSTLAPELQSLLTKYAVLFQPPHSLPPARTTNHHIHLLPQATPVNSPVLLVRKHDGTWRFCVDYRDLNAVKDRFLIPTVDELLDELGSARCFSKLDLLQGYHQIRMNPEDVPKTAFRIHHGHYEFKVMPFGLCNALSSFQETMNLLFGPYLRQFIIVFFDDILVYSSTFEDQLRHLDTTFQVLLANQFVLKLSKCFFAQPQVEYLGHIVSHKGVEPVAAKVAAIQQWPVPKSTKALRSFLGLVGFYRRFIKHYATIAAPLMKVTTIDPFKWTPEAQSAFANLKLALSTTPVLTLPNFDNLFTLESDASGAGMGAVLTQNGHPIAFFSKPFSPKLLRASTSSLYDPHRPPEFERTSLLDALSRLLEPPTNLHMILSVPSLIFLAELRQQLDTNDDYRHKRQAIMDFPAEHPEYSVTQNLVLNKNFHWPGIREDVIRFVAQCLECQLTKYEAKKASGFLCPLPVPHQPWVDLSLDFIVGLPAYQGNTVILVVVDRFSKGIHLGMLPISHTAHMVASLFVNIVVKLHGLPQSLVSDRDPLFISRFWQELFLLSGTLLRMSSAYHPQSDGQTEVLNRVIEQYLLAFVHRRPGLWGKLLPWVEWSHNSSWSVSTEYIVGSSNIAAVDDMLGEKDTTFQAIRWKLIKAQENMKKYADTKRREVTHQVGDWVLLRLRPYRQSTAKGTPTSSVKLAKRYYGPFKILERIGEVAYRLELPEGVRIHPVFHCSVLKAFQGSPDSVPQVQLHPEAINGQPLVVPLAILDYRRSSTDDDAPWEVLVQWQGLSPDETSWEDWTQLCETHHLEDKVVFQGLGSVSISEAANRTPGNMDTKQQKKVQVVQIAKKPKRKVTRPAYLKDYA

SEQ ID NO: 206313 - protein, 254 aa, Glycine max
  Coding DNA Sequence Number=SeqID_89535
MGAATVNQQHHLVVVNSSHQMQRFRGYVAFQRIEANLGWAWVMGIGDEEKNPRGTTVTSMVFLIAGEAEALLTAGSDLLRGKGEGKVVEIVDKGCGAVVRVRGKVEDKGNVWGVVVEEGRDRQPERESEVEGSAPRDEFPATSPPQSTSLVIVKELVDLEDPAIGVCSIKSWLRLRDNGIGRRNRGNRIVVWVNVSEKGIKFLAQRKLLNGEAGEDFFKFQGRFRRGGVGHNNESTRMLGAELSWLRGLVPPEA

SEQ ID NO: 206314 - protein, 176 aa, Glycine max
  Coding DNA Sequence Number=SeqID_89536
  Gene Ontology: Mol. function=receptor activity; Cellular component =integral to membrane
  Homolog annotation: Hit_ID=Q651J5; Match level="QueryCoverage=98%, HitCoverage=24%, E-value=4e-35, Identity=43%"; Hit description =Putative xenotropic and polytropic murine retrovirus receptor
  Pfam annotation: Domain name=SPX; Domain location=2-165; Score=0.5; E_ value=3.4e-06; Accession=PF03105.10; Description=SPX domain
MVKFSKQFEGQLIPEWKEAFVDYWQLKKDLKNVHYFINNTNNTPNNTSLPKYIFSSIRNYSLFGHQHREPGPIQVHRKLASSSFNGDMYETELLEQFSDTDATKEFFACLDQQLNKVNKFYRTKEKEFMDRGDSLKKQMDILLMLKTTFKEQQSKAGSSHGSKEDQSISCTFSNGT

SEQ ID NO: 206315 - protein, 1298 aa, Glycine max
  Coding DNA Sequence Number=SeqID_89537
  Gene Ontology: Mol. function=RNA-directed DNA polymerase activity; Cellular component=chromatin; Biological process=chromatin assembly or disassembly
  Pfam annotation: Domain name=Chromo; Domain location=1222-1270; Score= 19.7; E_value=0.0046; Accession=PF00385.14; Description='chromo' (CHRromatin Organisation MOdifier
  Pfam annotation: Domain name=rve; Domain location=919-1075; Score =114.2; E_value=3.8e-31; Accession=PF00665.16; Description=Integrase core domain
  Pfam annotation: Domain name=zf-H2C2; Domain location=860-901; Score =27.2; E_value=5.9e-05; Accession=PF09337.1; Description=His(2) -Cys(2) zinc finger
  Pfam module annotation: Pfam domain module=Chromo::RVT_1::Retrotrans _gag::rve::zf-H2C2; Domain location=1222-1270::426-605::103-193::919 -1075::860-901
MADHGTRKTTTNHLEDAIPRLTNSQANLTERYTNLSDRVDSILDHLRICDAHQNQPSSNNSNNHRNSVKLDIPRFDGRDPLGWIFKINQLFQYQNTPEEERITVASLYLNGAALSWYQWMFSNGFITSWQGFLQALESRFAPTFYDNPKGALFKLVQRGSVNNYLTEFEKLANRVVGLPPPFLLSFFISGLNPELRCEVLALQLIFLLQATALVKLQEDKLCDKRSSFQRPFQPSPSSSSTSLNPKSKPPYVQRTPEDMAFRREKGLCYNCDDKWSPNHRCKGRILLFIAYDLPPNDGDPNSITPNSCLEDNGGDSEPAMDTSFPHVSLHAMSGLPSSETFRIYGTIKNARLTILIDSGITFHLLQISGADAVLGIDWLKQFGSVTTDYTSFIMRFTHLGQEISLQADVAIGLEPASTAQVKRLIHTASTVSHLPPLAELVARLLRRYDKLFQSPTHLPPSRDHTVILTLLPTTTPDEHESILFSSPFGEEEARHMAPLGHASWFSKLDLRQGFPHGHYEYLVMPFGLCNAPSTFQAAMNHLLVPFLCHFTTVFFDNILVYSDSLSSHVQHLDITFQALLRCQYYLKQTKCLFAQTQLEYLGHVVFGNGVALEPSKIQAIIQWPTPTSAKELRAFLRLTGFYLKFIQKYAAITTPLTNLLCKDAFEWSLESQDAFDKLKTAMTSVPVLALPNFNEPFTVETDASGTTMGLYAIIAAVRKWRQYLLGRPFTILTDHKSLRELMSQVIQTPEQHYYLSKLLGFDYTIQYKAGATNVVADALSRRPPDSGQLLFLSVPQMDFMRDIQQTLEDDPSSQELVRNIKANPSAHPQFRLSKGYLLFNGRIWLNKTNPYIPSLLLEFHATPLGGHLGIAKTTHHLESSFFWQGMKHDVKQFIRECKVCQQNKSSTRRMAGLLQPLPVPTGVWEDISMDFFTHLPPSNGFTVILVVVDRYSKGVHLGALPTGFSAFKVATVFIDIICKHHGFPKSIVSDRDPVFLSAFWRELFWLCGTRLRLSTAYHPQSDGQTEVMNRFLKQYLRCFVHSQPSTWLRYLSLEEWCYNTSLHSSSGLTPFEVIYGKPPPSIPHYIPGLTNNEVVESLVESRQTMHAKLQKRLKKAQDSMKKYADARHEDITFSVGQWVYVKLCPNRQRSVAGVNHSKLSKRYFEPFKILARVGEVAYRLELPAEARIHPVFHCSLLRHYHGALPSATEPWPLEIIGHKPLQRPLCILDSKLDTSTSPPTQLVLTQWTGQPPEDTSWEPWPELQEAYHLEDKVVSGGEGIVSTHAACYRHDEAYSRSN

SEQ ID NO: 206316 - protein, 361 aa, Glycine max
  Coding DNA Sequence Number=SeqID_89538
  Gene Ontology: Mol. function=receptor activity; Cellular component =integral to membrane; Biological process=red or far red light signaling pathway
  Homolog annotation: Hit_ID=Q651J5; Match level="QueryCoverage=97%, HitCoverage=43%, E-value=1e-100, Identity=53%"; Hit description =Putative xenotropic and polytropic murine retrovirus receptor
  Pfam annotation: Domain name=SPX; Domain location=2-185; Score=-37.3; E_value=0.0018; Accession=PF03105.10; Description=SPX domain
MMSNYVYLKLCSLQTEEDSVRSRAQQEEMLDTTSTDDFEKNEAPFSDFPRVEELAKSMQIKREDGKLRTLSGRVINCQGKNLRINIPLTTPSRTFSAISYLLREDFLNQSSRKCGPEGANNIHLNKTNLHHAEKMIKGGFIELYKGLGYLKVYRNLNLLAFIKILKKFDKVTEKQILPIYIKVVESSYFNSSDKVMKLADEVEELFIKNFAEDNRRKAMKYLRPSQRKESHAVTFFIGLFTGTFLALLAGYAIMAHVTGLYRPHQNSVYMETVYPVLSMFSLVFLHFFLYGCNTLAWRKTRINYSFIFEQTPTKELKYRDIFLICTMAMSAVVGVMFLHLTLLTKGYSYARVQDIPGLLLL

SEQ ID NO: 206317 - protein, 155 aa, Glycine max
  Coding DNA Sequence Number=SeqID_89539
  Gene Ontology: Mol. function=receptor activity; Cellular component =integral to membrane; Biological process=red or far red light signaling pathway
  Homolog annotation: Hit_ID=Q651J5; Match level="QueryCoverage=92%, HitCoverage=17%, E-value=3e-57, Identity=70%"; Hit description =Putative xenotropic and polytropic murine retrovirus receptor
  Pfam annotation: Domain name=EXS; Domain location=36-155; Score=34.7; E_value=2.4e-10; Accession=PF03124.5; Description=EXS family
MADQLCSQVPMLRNLEYVACYYITGSYKTQDYGYCMRTKHYRDLAYAVSFLPYYWRAMQCARRWFDEGQTSHLVNLGKYVSAMLAAGAKVAYEKDGSVGWLCVLVVMSSAATMYQLYWDFAPLSFFTKEPMVWAIGMQLAPQKLVASLIKIRQTS

SEQ ID NO: 206318 - protein, 293 aa, Glycine max
  Coding DNA Sequence Number=SeqID_89540
  Subcellular localization annotation: CTP_CleavageSite=42; ConfidenceScore=5.68e-01
MAASALYSSPIFLPPLWHPKPMHPLCCFNPPPSISLSRSKFSGAAVAPQKLPRRVFRVRGLLGHDSGTAPQPETPNSEAFIHSHIKDTTGMCERLGDGAGAVSDSAVESGGAGGLLRIIVGAGAGAGAGTSITGAGAGAGTSITGAGAGVAAGGGGTGDGVGAGFVGAGAGAGVAFAGAGDGGVLAGVGAIFGGGNGGGDATGGGGSGGGETGEGFGGCGATLGADGFTGAGLGATFAGGWDVVGGVLVVGGDATTVGGCVTASGVLEDGDVAVGVVGGKVVGGNFTGTVAGA

SEQ ID NO: 206319 - protein, 136 aa, Glycine max
  Coding DNA Sequence Number=SeqID_89541
MENYTKQSLSMAPTSVVENGELHQAITKHDSKLVGGGRMNENAIHGAPKKGREWRIALSNHYAWLQTRRGRDWRIALSNHYAWLKTLGWSMNENAIHGAPKQGREWRIALSNQNAWLQTGGWRMHERKCNSWGYEK

SEQ ID NO: 206320 - protein, 108 aa, Glycine max
  Coding DNA Sequence Number=SeqID_89542
MRTCLVKRQNFLLIRATHAFRMKNNVSTEEGEGNTGFNKNRRKLLKVYQSHTGQGLTFSPWVKVYGELGFWLKACRTAGHDICQGVGLASESGIREMSHIISMIHMQQ

SEQ ID NO: 206321 - protein, 190 aa, Glycine max
  Coding DNA Sequence Number=SeqID_89543
  Gene Ontology: Mol. function=xanthine dehydrogenase activity; Cellular component=membrane; Biological process=purine ribonucleoside salvage
  Homolog annotation: Hit_ID=P77324; Match level="QueryCoverage=98%, HitCoverage=58%, E-value=8e-86, Identity=82%"; Hit description =Putative xanthine dehydrogenase yagS FAD-binding subunit
  Pfam annotation: Domain name=FAD_binding_5; Domain location=1-190; Score=253.7; E_value=3.9e-73; Accession=PF00941.11; Description=FAD binding domain in molybdopterin dehydrogenase
MQHPGARFIAGGTNLLDLMKLEIETPSHLIDVNGLALDSIEPTAGGGLRIGALVRNTDLAADARIRRDYAVLTRALVAGASGQLRNQATTAGNLLQRTRCPYFYDVNQPCNKRQPGTGCAAREGFSRQHAVVGVSEACIATHPSDMAVAMRVLDAVIETVSPDGSQRAIPIAEFYCAPGDTPHIETVLQP

SEQ ID NO: 206322 - protein, 137 aa, Glycine max
  Coding DNA Sequence Number=SeqID_89544
AVHVSSTFKFGAEFHECLSADSQGNPPYSTFVPEPHECYCLALFMCPPLSSAKSLVTGKHKKKKKEWRRESSSQKGQDGRNQCPIFGFLLSPMRGGANSNQADLGPPEDSSRRLLLLEEATLLAWASWAASFSPILL

SEQ ID NO: 206323 - protein, 404 aa, Glycine max
  Coding DNA Sequence Number=SeqID_89545
  Gene Ontology: Mol. function=protein binding
  Homolog annotation: Hit_ID=Q1SJP5; Match level="QueryCoverage=84%, HitCoverage=93%, E-value=2e-64, Identity=41%"; Hit description =Cyclin-like F-box; Serine/threonine protein phosphatase, BSU1
  Pfam annotation: Domain name=F-box; Domain location=55-102; Score =16.7; E_value=0.085; Accession=PF00646.23; Description=F-box domain
  Pfam annotation: Domain name=Kelch_1; Domain location=187-235; Score =42.6; E_value=1.3e-09; Accession=PF01344.15; Description=Kelch motif
  Pfam annotation: Domain name=Kelch_1; Domain location=237-283; Score =33.0; E_value=1e-06; Accession=PF01344.15; Description=Kelch motif
  Pfam annotation: Domain name=Kelch_2; Domain location=187-235; Score =24.9; E_value=0.00029; Accession=PF07646.5; Description=Kelch motif
  Pfam annotation: Domain name=Kelch_2; Domain location=237-283; Score =8.9; E_value=2.6; Accession=PF07646.5; Description=Kelch motif
  Pfam annotation: Domain name=Kelch_2; Domain location=291-331; Score =14.1; E_value=0.5; Accession=PF07646.5; Description=Kelch motif
  Pfam module annotation: Pfam domain module=F-box::Kelch_1::Kelch _1::Kelch_2::Kelch_2::Kelch_2; Domain location=55-102::187-235::237 -283::187-235::237-283::291-331
MTNRKALPVPSFVSGICFSYHSSQKKMRVRELSPSDGNGSSTNGDEPLPQDADYSNVLSLSDELETSILARFPRSQHWKLCFLNKRFLALARSGEIYKIRRELRFKEPSVFMLASGESNWWGMEWPFNSSKKLPPIQSDYNFEYGDKESFCAGSHLLVSGKEIDGAVIWRFDSIKNEWLKGPSMINPRCLFASATCGAIAFVAGGFDAITYTQVLDSAEKYNSESQCWEPLPRMNKKRKFCSGCFMDNKFYVLGGQDEHGKDLTCGEFFDGKTNSWNLIPDIWKDIPLFDSQSPPLLAVVNNELYSLDASSNELKVYVKGTNSWKTLGVVPVRADAQRGWGVAFKSLGDELLVIGAPSVSHTVHALSMYTCCPDPDDEKLRWRQIGCGSIQLNHFIRNCAVMGT

SEQ ID NO: 206324 - protein, 104 aa, Glycine max
  Coding DNA Sequence Number=SeqID_89546
MPRKRQGPQIDLEGKVKKSEDFETWKCPMRQQRLHIYNITYKDQRRKEREEKEKKKLLQRKEAKSKEAINGMRALQYCNQNKEKRDVGSEFKLITTQHHNPCEV

SEQ ID NO: 206325 - protein, 286 aa, Glycine max
  Coding DNA Sequence Number=SeqID_89547
VNLLEIIFSYWLQAFKDRFNPKPSSRATQLKGVTFVKMGIAESFPNYVKKHISKKVKKESKEEPQSVLATKRKDPPPPFEPKPPTSSKKQKKQLPSNPKKRRPSDSRSDFELFSKPKTKKPTIRIKPYQPQPQSVISSPPKPQESSIMILESPQTKPASPSSEVEIKKAAMLQSDIEASFNENKYDVIKTDHGALRVHPFSSTESVPFDAMKFKLEIKKRTKPKPQTQPDITIEPDTKVRLFHGSRVMECQTCNKAWKEKMGIGSHILDPQMQKLELQMLNLVIVS

SEQ ID NO: 206326 - protein, 425 aa, Glycine max
  Coding DNA Sequence Number=SeqID_89548
  Gene Ontology: Mol. function=calcium ion binding; Cellular component =extracellular region; Biological process=pathogenesis
  Homolog annotation: Hit_ID=Q8XQP2; Match level="QueryCoverage=98%, HitCoverage=89%, E-value=3e-80, Identity=38%"; Hit description =Probable hemagglutinin/hemolysin-related protein
AVDRQPAYRRRRQGIDVHRRRDVAGADVTRRIGHRGAQRVRAVRQRGGGEAPAAITPRGHRTNGAGTVVDGDHGTRFRGAAQRWRGIARKGAVRQRHRRTADVINDGQRTGDRHHGVDDQRGRHLRADVARRVGLRHVQRVAAVAQRVTYHEAPAAVAAHRGGAQKCGAVVHRDARARLAIAAQQRRAVVGDAIIRNGHRRAAVVVERQQIGDGRRCRGIDDHRGRGGTADVTCGIRYRHRDRVRPDAQRCQWREAPAAVRLHNRRAQCQTVVQNGDACPGLRCADAAAQRWRGVVGRAAVDDGGTGRIINNGETGVRWRHRIHGEVNHLRAGTDVARAVGHRHAQRMGGIAQRRRDEAPAAAGVSLHRSEQRVAIVNRDNRVRFRRALVSPVAAIGGAVSTVSARDAAGTVIAGRIGGRHAERV

SEQ ID NO: 206327 - protein, 502 aa, Glycine max
  Coding DNA Sequence Number=SeqID_89549
  Gene Ontology: Mol. function=oxidoreductase activity; Cellular component=membrane; Biological process=electron transport
  Homolog annotation: Hit_ID=Q9SMP5; Match level="QueryCoverage=91%, HitCoverage=91%, E-value=1e-157, Identity=59%"; Hit description =Cytochrome P450-like protein
  Pfam annotation: Domain name=p450; Domain location=39-499; Score =98.1; E_value=2.6e-26; Accession=PF00067.12; Description=Cytochrome P450
MGGAFMILLSLPFSLIFLLILFYITLPATTGRGKKISGPAGPATYPLIGCLISFYRNRYRLLDWYTELLAQSPTNTIVVQRLGARRTIVTTNPQNVEYMLKTNFNNFPKGKPFTEILGDFLGQGIFNVDGESWLASRRLASHEFSTKSLREFVMHTLEKEVCERLVPVLDEALCGENKVVDLQELLRRFSFNVICKFTLGTNNYNRCCLDPSVPTCPLARAFDVAAEVSAKRGAAPLFMIWRVKRWFCAGSERLLKIAVGEVQTHVMRMIQERKQKGEINYYEDDLLSRLICAGHEEEVIRDMVISFIMAGRDTTSAAMTWFFWVLSHYSHLEDKIVEEAKGVLDYESLKNLSFLKACLCESMRLYPPVAWDSKHATDDDLLPDGTVVKAGDRVTYFPYGMGRMEDLWGKDWFEFRPNRWFVEPRNSEGIVLNEVSPFLFPIFQAGPRVCLGKEMAFIQMKYVVASILSRFTFKIVSPDRPIFVPLLTAHMAGGLRVMIYRQ

SEQ ID NO: 206328 - protein, 399 aa, Glycine max
  Coding DNA Sequence Number=SeqID_89550
  Gene Ontology: Mol. function=transcription coactivator activity; Cellular component=nucleus; Biological process=regulation of transcription from RNA polymerase II promoter
  Homolog annotation: Hit_ID=Q1T094; Match level="QueryCoverage=83%, HitCoverage=72%, E-value=3e-78, Identity=42%"; Hit description =SWIB/MDM2
  Pfam annotation: Domain name=SWIB; Domain location=183-258; Score =60.2; E_value=6.7e-15; Accession=PF02201.9; Description=SWIBMDM2 domain
  Subcellular localization annotation: CTP_CleavageSite=55; ConfidenceScore=5.75e-01
MSMNNNNNSNPHGPSSSGPVPSFPGPRAHTQPERQTFPSKTPNSHLQTEPAPTATAAAATARRKKHKPNERQLREKALAILPESEIYTQLLDVEARVDAALARKKVDIQEALKNPPRIQKTLRILVFNTFSNQNNADSSAPTMGGAVAAQRMPPLCPKFCSSVAHEGFEVKRKGDREFPAQIRLEMNYVPPALREVLGVQVDTRSRIVSAIWYYVKARKSQNLNDPSFFQCDQALQRVFGEDKVKFTMVLQKISQHLFPSQVILLEHMIKLSGNSPVGSACYDVMVDIPFPIQRELNALVPNVERTKENDVCDESICGIIRKIHEHHRRRAFLVGFSQSSLEFIKALVESQNKDLKVLLGESGQNAEKDRKSDFFKQPWVEDAIVCYLNRKPAAGSVVK

SEQ ID NO: 206329 - protein, 74 aa, Glycine max
  Coding DNA Sequence Number=SeqID_89551
MQSRYNESTTQKVQDAKDEISTTSLSASHSLSEHSMTFEFSEFKLTCLASRLAQPNSKIIKSREGFGLSMKDHA

SEQ ID NO: 206330 - protein, 95 aa, Glycine max
  Coding DNA Sequence Number=SeqID_89552
  Subcellular localization annotation: CTP_CleavageSite=62; ConfidenceScore=5.57e-01
MACICASPFLSSIQSLVSCYNPSTTLLPCLSRLISTVQCHSFPLPLLSQLDTATLLLPLSLSLSTLSRINEALGLNLELGLSLNPELGLDLKRAD

SEQ ID NO: 206331 - protein, 124 aa, Glycine max
  Coding DNA Sequence Number=SeqID_89553
  Gene Ontology: Mol. function=nucleic acid binding; Biological process= DNA integration
  Subcellular localization annotation: CTP_CleavageSite=38; ConfidenceScore=5.31e-01
MAEVAKLVNNADASNPTPPTATFAKSLPNISKIEVFTVVFALSTPKPNFSDDASQLQQWVQANKDVVRQRFIIANYYCWTMNKEKDIKVQISEYHKLLEDLKIENISMPDEFDSELLIEKLPKS

SEQ ID NO: 206332 - protein, 106 aa, Glycine max
  Coding DNA Sequence Number=SeqID_89554
MCRAKRMTSRKREAIASQPREPYDTTRFISEVAWERYSQKVHFRNILSERNINLFVTKYDEFRRELIRRNWHKALTQHMDRHIDMGLVKEFYSNLYDHEDKSPKQI

SEQ ID NO: 206333 - protein, 63 aa, Glycine max
  Coding DNA Sequence Number=SeqID_89555
MVAQSKFAKVSRPQKVNIDMTEGAINIIIVPTHEMITMRQVKTVAMPIQTHLPSKPMFVCVDR

SEQ ID NO: 206334 - protein, 60 aa, Glycine max
  Coding DNA Sequence Number=SeqID_89556
MEKRLKPPLVLSSCDSFFSLQEYYLANPNGKGKGYNEKGISLNSNMISKFPTVQMLGIGL

SEQ ID NO: 206335 - protein, 78 aa, Glycine max
  Coding DNA Sequence Number=SeqID_89557
MEESVLCGLCEAAEEVVGGRKLNTKWTQRRGTGFKTMSDTILPRKGPVTRVMSKRLQEDWARAVEEGPRVLMNLGVDF

SEQ ID NO: 206336 - protein, 336 aa, Glycine max
  Coding DNA Sequence Number=SeqID_89558
MPRMWLTNSNLSKVGSLFVSRRYQVELVDNIVEMLQPVIRIDPKEGLKPEPHGPYVEPQLVGILGHLFGGGPVDVLALTLQGPLCWSCMDLPCAVRAEACQPWCPGLLECPCGEVTLGDVLLPPACQRDERLCEDFADDPPWHIDRGRTMVLTTAGARVRLTWMTELYHCYIESISCVWDAMAYLMHMHLVYGTIFIDKSSIHVHLAYLLYLDNLDACHEYTWAVAVGGYMAILMCGTGALDDLVASRWKPTKGSSFAFPIREKLDKLQMDAVVDVWPYLLERVLRQFGHHVIPLDDVVPPRGPTRLRLLLLAGCSLKGQRKRETKVAKGGKGRGK

SEQ ID NO: 206337 - protein, 362 aa, Glycine max
  Coding DNA Sequence Number=SeqID_89559
  Homolog annotation: Hit_ID=Q6I8E6; Match level="QueryCoverage=28%, HitCoverage=25%, E-value=2e-17, Identity=55%"; Hit description =Pseudo-atpA
MDTFESLVRRLAFSLGNQALSRLLLQRGCSVGLTVAIVVLFFTAEAAPGLGNQIAASSGAENRVSSWHQYLTSNMEGESANEPSTSSSWMGALLSSETEMGGTGTSVNDRVAWPVPLANPVASGEAEAGQSHVVPFPYDENEVIGGDYVLSIQRRLLAKYEFPSAEEIKITKIKAEDLFEVKVDIIRQMTPQDPEEDWLNRGARALDNPRAASGETSLRIEIELNVGLGHTSMCPGRANRFLAPKSEGERDLVSPGIVAVGCRRPDGLGEGGKVDYGWKKTGGDEPNESEATYANQAAKKTYWVAFHAKPAHGPDWYSNSSDQEAWTMSPLSKRGMRSPGDRTDVLDPSSSHMGPMAEGLTK

SEQ ID NO: 206338 - protein, 117 aa, Glycine max
  Coding DNA Sequence Number=SeqID_89560
MDRTWMKASHISDVYENGVEEFLQFVQQNTPVMGGKYFCPCVKYTTTLPHTQVIDVHIKDRIKDMIPDLGQEGFRQANAPYYDNLQSDSKKPLYSGCTTFTRLSAVLALVILKAGFG

SEQ ID NO: 206339 - protein, 110 aa, Glycine max
  Coding DNA Sequence Number=SeqID_89561
MTKEHDGRAAWEMAGWVAINEGHDLSHGMGMVGLSELIKSSIHWDRPKRVHEEIMKRLQYPLIHKVTYGDYLLPAPASVDCDSLPGEPESIDSLKCLDPKESGWYSQRSL

SEQ ID NO: 206340 - protein, 61 aa, Glycine max
  Coding DNA Sequence Number=SeqID_89562
MRKCPTCGVSHYKVKDDACSDNATTNNDRPAKLVEKGDGSLRHAVDSPQWKTINCLYPEFT

SEQ ID NO: 206341 - protein, 162 aa, Glycine max
  Coding DNA Sequence Number=SeqID_89563
MGKKGSWFSAVKKVFSSDSKKDKKKQKSDKSKKASSDKDAEAAVVLPPIEDAKLIEAEKEQSKHAASLAFATAVAAEAAVAAAQAAAEVVRLTSMPHYTGRTKEEIAAIKVQTAFRGYMSQMVLYCSSHLQLQPQCRGFWTCCKCIATAIASASAASPRNFP

SEQ ID NO: 206342 - protein, 140 aa, Glycine max
  Coding DNA Sequence Number=SeqID_89564
MTPTATTTMIVNRCHHDHRRHHQHDFYCHYHHHHHGCRDGSKGDHVGGDNDSYDVDHGGGSDTLPKEATLEKSPQIRDPLRYSTIRLAEYPLEKKKDHSKDTNKEEIYLPTPWQMPHSSAIKQNIADFTYHDFANHERHK

SEQ ID NO: 206343 - protein, 80 aa, Glycine max
  Coding DNA Sequence Number=SeqID_89565
MDNWRRIHNIVYNPKRRKKGNYETQYKTSNFEGQTTTTKMDKVQENEDPNEVGKTFRDLCMRIPESCKSNSKVHLLGVAE

SEQ ID NO: 206344 - protein, 166 aa, Glycine max
  Coding DNA Sequence Number=SeqID_89566
MNRKIKKKEKLQHLHVTIVTLKPPQCHHYSTLLSWPQLKSVIDPSCVEARTTFVPPQHLHVATIAIETTMVPPPLCLAGVGRVQFCYRFESWRSSLYLCRHDSCLGPQNLTTMGIVGGNMEAGKGAKRGREEDEEMWRQGERLEEDYVLLYIIYNYANKKNISKHM

SEQ ID NO: 206345 - protein, 68 aa, Glycine max
  Coding DNA Sequence Number=SeqID_89567
MPKDRGTYLDFRYCHHQKGGDCRQRIKLKVLMMPKDYMNHMLLKDLLKTKPLEIFKMDNQDSLRKDIK

SEQ ID NO: 206346 - protein, 166 aa, Glycine max
  Coding DNA Sequence Number=SeqID_89568
  Homolog annotation: Hit_ID=Q1SMF0; Match level="QueryCoverage=93%, HitCoverage=29%, E-value=7e-20, Identity=37%"; Hit description =Tetratricopeptide-like helical
MRSDTLTSSRGRSSFVLIGCERNGQYRCRKKDFVRRDTWSRKYGCPFKLHGKPVIGGQSWMVKLMCGIHNHELAKSLVRHPYAGRLTKDEKTIIADMARSMVKPRNILLTLKEHNANSYTTIKQIYNARSAYRSSIRGSDTEMKHQMKLLEGDQYIHWHRLKDEDV

SEQ ID NO: 206347 - protein, 72 aa, Glycine max
  Coding DNA Sequence Number=SeqID_89569
MVAIPPARVPQPPFFQGYDLNATCAYHEGVPAHSIKHCITLKSIGLFAQATCAPEFGLPRPFNQKLLVLHIW

SEQ ID NO: 206348 - protein, 36 aa, Glycine max
  Coding DNA Sequence Number=SeqID_89570
MALSATSRGFSIERCIVSLELDRAGLGYRMSGHGVQ

SEQ ID NO: 206349 - protein, 96 aa, Glycine max
  Coding DNA Sequence Number=SeqID_89571
MTYIQVVGLSLHGKGNFSLNGLGCDTQNITLVDLVLGYLFRCEYEMRQMLQAGFSDVAKLKQAKIDDSLVTTLVERWRPESHMCCFPKECTGGVNT

SEQ ID NO: 206350 - protein, 232 aa, Glycine max
  Coding DNA Sequence Number=SeqID_89572
  Homolog annotation: Hit_ID=Q8RV04; Match level="QueryCoverage=25%, HitCoverage=53%, E-value=1e-14, Identity=61%"; Hit description =Expressed protein
  Subcellular localization annotation: CTP_CleavageSite=46; ConfidenceScore=5.19e-01
ATPFLAGLAVAAAALASKYGIQAWQAFKTQPPKPRLRKFCDGGFQPTMTRREAALILGVRNFGSSFLGIRQLECLYIQRDILNKVQVKKDEGPEAEALLRHGNGEEQGGVLSPQSPTPTSQHILVPVSDTRRNFPLGSSLNQSRAYQDNPYGVYPDLSSLSGSGVIQNFVTCIKRSAPSKDHIKRENATADKVKEAHRRVMVANHLGGSLASKINKAKKVMVGKGKGSGSAF

SEQ ID NO: 206351 - protein, 774 aa, Glycine max
  Coding DNA Sequence Number=SeqID_89573
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =98%, HitCoverage=94%, E-value=3e-96, Identity=40%"; Hit description =actin binding
  Pfam annotation: Domain name=Extensin_2; Domain location=8-359; Score= -138.1; E_value=0.066; Accession=PF04554.4; Description=Extensin-like region
  Pfam annotation: Domain name=FH2; Domain location=334-753; Score =404.7; E_value=1.3e-118; Accession=PF02181.13; Description=Formin Homology 2 Domain
  Pfam module annotation: Pfam domain module=Extensin_2::FH2; Domain location=8-359::334-753
MMLQSWPFMSLVFVLLLHSLSITPYCHCQTSNSPPQNIETFYPNGTSATQQPLPPPPQPQQPPPLPTANVAPSHGSLNHNIATAVAATAASTIVVCGLIFFLVQRCLRKRRRRREETRSNTATADGDTRVVPQGNVFERIDGNVRGLIVDEDGLDVIYWRKLEGKNSNKDLLHKEVVSSPRNKEKAEHGHDENQVKKSKSIQVVPLLRGKSSTSHLNVSPEEDEPYRFSPLPSPTPSSLPASAGIVIKDVQKPDSPTQPSTPPPPISPSTPSSSASFAAIPKRNTPAPSPPPLPISVRRSPAPPPPPPASSKPPPAPIEMTAIKQRNSSGKGMPETSNDQVKLKPLHWDKVNSNNADHSIVWDKVDRGSFRVDQDLMEALFGYVATNRRSPKGKSHSAIPSKDGSASSAKTFLLDPRKSQNIAIVLKSLAVSQGEILDTLIDGKGLNADTLEKLARVSPTEEEQSLILQYKGDPARLPAAESFLYSILKAVPSAFKRLNAMLFRLNYDSEIQEIKESLQTIELGCNELKSKGLFVKLLEAVLKAGNRMNAGTARGNAQAFFNLASLRKLSDVKTTNGRTTLLHFGVEEVVRLEGKRVSLNRNGSLSSSSSRSNSNSNGNYENNIASNELIEREYVTLGLPIVGGINSELSNVKKAAQIDYNNLVGSISALSTWLVEIRELASLCGNGGNFVKEMDHFLGNAEDELKLVRDKQTSVFQLIKKTTQYYQGGASKETAEDNLQLFVIVKDFLGMVDQTCTEIAREHQKRKPPKAIFG

SEQ ID NO: 206352 - protein, 81 aa, Glycine max
  Coding DNA Sequence Number=SeqID_89574
MYNTTGGIWVSLFWNKKILPDATSIPSQDQIPTLVKGSSVKPLVQATFYFTLNFHGYIGDTSWRCGIANDQTSDINISLKS

SEQ ID NO: 206353 - protein, 61 aa, Glycine max
  Coding DNA Sequence Number=SeqID_89575
MAMACRGAPLVLEGEGSCPLATASSSLLCQQHTQPNMMGDDFGDVLIGECHLDDINVEHKR

SEQ ID NO: 206354 - protein, 325 aa, Glycine max
  Coding DNA Sequence Number=SeqID_89576
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q71EW8; Match level="QueryCoverage=97%, HitCoverage=41%, E-value=1e-160, Identity=87%"; Hit description =Methionine synthase
  Pfam annotation: Domain name=Meth_synt_1; Domain location=2-318; Score=596.0; E_value=3.5e-176; Accession=PF08267.2; Description =Cobalamin-independent synthase, N-termina
MASHIVGYPRMGPKRELKFALESFWDGKSSADDLKKVASDLRASIWKQMIDAGIKYIPSNTFSYYDQVLDTTAMLGAVPPRYGWNGEEIGFDTFFSMARGNASVPAMEMTKWFDTNYHFIVPELGPDVNFSYASHKAVNEYKEAKALGVDTVPVLIGPVSYLVLSKPAKGVDKSFCLLSLLPKVLAIYKEVVADLKQAGASWIQFDEPILVLDLGSQTLQALTAAYAELESTLSGLNVLIETYFADIPAEAYQTLTALNGVAAFGFDLVRGTKTLDLIKGGFPSGKYLFAGVVDGRNIWANNLTASLDTLNSLEGIVGKGTCCNS

SEQ ID NO: 206355 - protein, 220 aa, Glycine max
  Coding DNA Sequence Number=SeqID_89577
  Gene Ontology: Mol. function=oxidoreductase activity, acting on the aldehyde or oxo group of donors, disulfide as acceptor; Biological process=metabolic process
  Homolog annotation: Hit_ID=Q5ECP6; Match level="QueryCoverage=38%, HitCoverage=21%, E-value=6e-39, Identity=92%"; Hit description=E1 alpha subunit of pyruvate dehydrogenase
  Pfam annotation: Domain name=E1_dh; Domain location=46-220; Score= -50.9; E_value=7.9e-07; Accession=PF00676.10; Description =Dehydrogenase E1 component
METCAEALDNYVELLKKTNNHQKSWVQLCSLYFCVFEIGINLEENAEIQQLALVFSIKQARWRRNWQQRSKVIPSLHQYVYYCLLVLLLEEDIRFVLGVVDWKKNFLCLLSTTERINQLAWGSSSLTRGLKFEFWVDGMDALAVKQACKFAKEFALKNGPIILEMDTYRYHGHSMSDPGSTYRTRDEISGVRQERDPIERVRKLLLTHEIATEKELKVIE

SEQ ID NO: 206356 - protein, 137 aa, Glycine max
  Coding DNA Sequence Number=SeqID_89578
MPLAKESEFHKCRPRQIIFTTTQLFEVMTGGAVQTKTSNSHKQNLHKRFQLENPTLLMRDNEDPGPNLGLGRGRCVDFMCQTKGSGQAVRGGLFDYATSRVRSCSLRCTKPLGLLDILPGGGGGVWWQRTVASVIIK

SEQ ID NO: 206357 - protein, 637 aa, Glycine max
  Coding DNA Sequence Number=SeqID_89579
  Gene Ontology: Mol. function=nucleic acid binding; Biological process= DNA integration
  Homolog annotation: Hit_ID=Q1SRN1; Match level="QueryCoverage=25%, HitCoverage=14%, E-value=1e-52, Identity=49%"; Hit description =Integrase, catalytic region
MLLTWLQSTLSKSVLSHVLGSTHSYKVWNNVHEYFQLQTKNIANELAGVGNPVQHEEYVDAILASLPQDYAQVIAVIEVVQMLVMLAAVAVAVVTPILVASAVVVVEADPTKIVEYGHTANICYYRSDNYQPHESLVLYDPTTQQPVQFNSPQSNNRTTNTWVNPNLKSSKQSANASSAIPGAMLANTSFQRAANSTWILDSGASYHGTGEPQNIDQLSHFDGQDQITLVTAKGTNEILLQGVVGADGLYSFPNLKLQDPSVLVSSSAESTSDSAVHSSSSSPMFNSNSTSSASKPIPDDPTLYRSVVGALQYATLTRPEISFVVNKVCQFVAKPLDSHWVTVKRILRYLKGTLFHCLHMRPATAGQSLTLTAMCDADWASDINDRRSTSGSWWSRKHAVAIARNPVFHSRTKHMEIDVFFVQEKLLSKQLLIYHIPDLDQWAEVLTKPLSPARFEFLRGKLNVKIVSAAMWVILLLHSIMNLFELITNGNLINNLTTAFRTQLLELIHHVTCDCYAHGLGECFEENVLDREQEKKRSHRNTYNLILSLLQADKIVNVLEKSEVEVEEVKLEVVNLSRATFKHLETYRKDLVEQACINIVVGRDSKVRRVGMWRIRKDDVPRDLRMVRLFELDNGAP

SEQ ID NO: 206358 - protein, 121 aa, Glycine max
  Coding DNA Sequence Number=SeqID_89580
MFLGGLKAESKLMLDASTGRKTSLKPPREAIEITENMDVNANEFQSDRAMVPSKRLLKFNTQEGLLAQQKLPDRKIEKLLAKPIYRLRESSAERTTLAAEREEESGRRMSCTCALSKGSSR

SEQ ID NO: 206359 - protein, 571 aa, Glycine max
  Coding DNA Sequence Number=SeqID_89581
  Gene Ontology: Mol. function=ubiquitin thiolesterase activity; Cellular component=transcription factor TFIID complex; Biological process=ubiquitin-dependent protein catabolic process
  Homolog annotation: Hit_ID=Q33AW7; Match level="QueryCoverage=72%, HitCoverage=42%, E-value=1e-100, Identity=47%"; Hit description =Ubiquitin carboxyl-terminal hydrolase family protein, expressed
  Pfam annotation: Domain name=DUF1055; Domain location=109-244; Score =192.8; E_value=8.3e-55; Accession=PF06337.3; Description=Domain of Unknown Function (DUF1055)
  Pfam annotation: Domain name=UCH; Domain location=333-496; Score= -1.5; E_value=2.1e-06; Accession=PF00443.19; Description=Ubiquitin carboxyl-terminal hydrolase
  Pfam module annotation: Pfam domain module=DUF1055::UCH; Domain location=109-244::333-496
MTIADSVFPMDNVASCIQLPPEEENRIVSELIKESELNLKEGNLYYVISNRWFSRWQSYVGPCVGMLSIDKQSSDNHLITHPKIADRPGPIDNSDIISKGNNCDSNNLDIHRMLEEGTDYVLVPEKVWERLLEWYKGGPALPRKLISQGLELKQYNVEVYPLSLKVTDARDNSQSIVKLSRKATIGELHELVCKIKGVEQNKACIWDYFNLKKQSLLTVSGQKTLEDANLIMDQDVGSLELYRSLIVIDFKLILLEVSLDRDHSSHSGMDSMGNELALVPLEPPRSSVSIAGGPTMSNGHSTGSSFSSYQGSSVSSSLTNMDDKYDVYRGERGGLAGLQNLGNTCFMNSSIQCLVHTPPLSEYFLQDYSDEINMDNPLGMRGELALAFGDLLRKLWSSGRTAIAPRAFKSKLARFAPQFSGYNQHDSQLGRHQQGNVLLHRQHHCRDLRSYLHCERARGVCVRQVGHGPCEAWQRRADRSSVDVVGGGTEARVGAYMASKAVIGVMTKILAKELKGTKALWLFILIMDMPPRFRYFLFPNLTEENVENNSCVFLKMGFIQKMFSHKTFSKC

SEQ ID NO: 206360 - protein, 75 aa, Glycine max
  Coding DNA Sequence Number=SeqID_89582
MTCRKLKGSASAQSVKFRNIPEGKKGDDYVIRVQIATMPTWAFQNIPPEGGCFWRKQPSSPGRAGWQASPLFSYR

SEQ ID NO: 206361 - protein, 269 aa, Glycine max
  Coding DNA Sequence Number=SeqID_89583
  Gene Ontology: Mol. function=oxidoreductase activity; Cellular component=outer membrane-bounded periplasmic space; Biological process=electron transport
  Homolog annotation: Hit_ID=UPI00006807C8; Match level="QueryCoverage =82%, HitCoverage=30%, E-value=2e-33, Identity=36%"; Hit description =Pyrrolo-quinoline quinone
  Pfam annotation: Domain name=PQQ; Domain location=102-138; Score =22.8; E_value=0.0012; Accession=PF01011.11; Description=PQQ enzyme repeat
  Pfam annotation: Domain name=PQQ; Domain location=151-188; Score =29.5; E_value=1.2e-05; Accession=PF01011.11; Description=PQQ enzyme repeat
  Pfam module annotation: Pfam domain module=PQQ::PQQ; Domain location =102-138::151-188
MYTNLYSLWMFDMKTAQKNCLLRGVVIGVSYLLFACAQTAKPTMSSGFQAEDWPSYGLNMASQRFSELTQINQKTVSQLQPAWSIETGIKATFQATPIVVNGVMYVSLPFNHVLALDAATGKQLWKYTHARKADWPMCCGPANRGVAVSAGKVFIGTVDARLIALDAKTGQKLWDIDVAGTQVNTEHQDALNGDDPNKTRKVTGGTGVGIAMAPVVYKNKVIIGITGVGYGLHIDNPRSDAPLGAVIGVTGRYGRPGFLAAFDINDGHQ

SEQ ID NO: 206362 - protein, 125 aa, Glycine max
  Coding DNA Sequence Number=SeqID_89584
MGYVGVRELSWRWATGDGGFMRALWMWKNLLCTIARPPPSTTVVPGDMSQGSGDLGDVRRAPGSQQIKGTKTTKQGGLWWLASCEFCVICGLWPLVIDYQGWEAKEASGNRLPACVIDYTEEWVT

SEQ ID NO: 206363 - protein, 70 aa, Glycine max
  Coding DNA Sequence Number=SeqID_89585
MRGTVHDPQANLGVDKKFLPGRLLMIPFESNGGLCFGISPCHQVSAGSTDPWHHSIALNQESFTWSYNKV

SEQ ID NO: 206364 - protein, 66 aa, Glycine max
  Coding DNA Sequence Number=SeqID_89586
NRKHTTLRPRHKAQLRVVQQGLLSWKLAEGGLKTVTEDTWCERGSRTNWKGVRLSIVGAFDLQQSG

SEQ ID NO: 206365 - protein, 86 aa, Glycine max
  Coding DNA Sequence Number=SeqID_89587
  Gene Ontology: Mol. function=RNA-directed DNA polymerase activity; Biological process=RNA-dependent DNA replication
MKIVNLGVGEEKKEVKVGTGMTTPIRDELVALLSDYQDIFAWMKPKMSLKIKEEVKKKFDTSFLAVVRYPEWVANIVSVPKKDGKV

SEQ ID NO: 206366 - protein, 341 aa, Glycine max
  Coding DNA Sequence Number=SeqID_89588
  Gene Ontology: Mol. function=RNA-directed DNA polymerase activity; Biological process=RNA-dependent DNA replication
  Homolog annotation: Hit_ID=Q8H6Q8; Match level="QueryCoverage=86%, HitCoverage=51%, E-value=4e-44, Identity=40%"; Hit description=CTV.20
  Pfam annotation: Domain name=DUF755; Domain location=94-205; Score= -26.5; E_value=0.0049; Accession=PF05501.2; Description=Domain of unknown function (DUF755)
  Pfam annotation: Domain name=Ku_C; Domain location=101-179; Score =0.1; E_value=0.084; Accession=PF03730.4; Description=Ku70Ku80 C -terminal arm
  Pfam module annotation: Pfam domain module=DUF755::Ku_C; Domain location=94-205::101-179
MTMMREIPDAVNTLIFTIAQHFIGDPSLWKDRSAELLSNLKCRTLADFRWYRDTFLTRVYTREDSQQPFWKEKFLAGLPRSLGDKVRDKICSQSANGDIPYENLSYGQLISYVQKVALKICQEDKIQRQLAKEKAQTKRDLGSFCEQFGLPACPKQKKKQTSKKEAQDHKPANRKRFSKRRYSQKPSTKTSEEETETSSSVLSDENLNLIQQDDQLSLTNDDGQVNTLTREQDLLFEAINSIPDPQEKKVFLEKLKKTLEVKPRQKDFITNNKFDVSNILKRLENSSTKPTTIQDLQTEINNLKGEVKELHQQQEIHQIILSQLEDDSDSESANNSEENQP

SEQ ID NO: 206367 - protein, 154 aa, Glycine max
  Coding DNA Sequence Number=SeqID_89589
  Gene Ontology: Mol. function=nucleic acid binding
  Homolog annotation: Hit_ID=Q1RXW3; Match level="QueryCoverage=96%, HitCoverage=21%, E-value=5e-11, Identity=29%"; Hit description=Zinc finger, CCHC-type
  Pfam annotation: Domain name=zf-CCHC; Domain location=76-93; Score =24.4; E_value=9.4e-05; Accession=PF00098.13; Description=Zinc knuckle
MFDIRFLILVTHSLAFLIASPQIQEVSDKEDLIDLNEDYDLSLFVKRFNKFLKIRGNQRRPNFKPKRRTEDSSSTPKCFECNQPGHMRVDCSIFKKRMEKSEKKNFGEKKMKKAYITWDDNDMESFEDSENEEINLCLMAKSYESDEEVSLKKK

SEQ ID NO: 206368 - protein, 399 aa, Glycine max
  Coding DNA Sequence Number=SeqID_89590
  Gene Ontology: Mol. function=hydrolase activity, acting on ester bonds; Biological process=lipid catabolic process
  Homolog annotation: Hit_ID=Q01T59; Match level="QueryCoverage=97%, HitCoverage=49%, E-value=1e-88, Identity=42%"; Hit description =Phospholipase C precursor
  Pfam annotation: Domain name=Phosphoesterase; Domain location=32-277; Score=35.8; E_value=7.9e-12; Accession=PF04185.5; Description =Phosphoesterase family
MSGEQEAWLSNFTDNPIEWFSAFNVKFSKGYYKHIPHMISYLQKEIEKNPNQKERLERLIAELKEDQVKYHPDNYAKLSQKEKNLHEKAFTNNSGDPDFWNLETGNDEYGEKLVVPKGDVLFQFRKDVEEKKLPLVSWLVAPEHFSDHPGSPWYGAWYISEVLNILTKDPETWKKTIFIINYDENDGYFDHVLPFSPPLNPSQPVDMNGKEGVEYVNKDQEYMLSSQLRDYERIEGTVGLGYRVPMIIASPWTKGGFVNSEVSDHTSVLQFLEKFIRKKFSKDVTIDNISDWRRAICGDLTSAFNDSNVTVPKMDYLNQKEYTKTINAAKNKPVPDLKWHSEHELSHALLEIQERGIKPSNALPYNYHVNLTDNSIKMENLKETGVPLLIYDRTKLDDH

SEQ ID NO: 206369 - protein, 263 aa, Glycine max
  Coding DNA Sequence Number=SeqID_89591
  Homolog annotation: Hit_ID=UPI00005F82DD; Match level="QueryCoverage =53%, HitCoverage=79%, E-value=5e-44, Identity=67%"; Hit description =COG3126: Uncharacterized protein conserved in bacteria
FAVLDGADAARAETVAVAQGFHVVNDRLAAVAWAQEVTVERMHAAFVRHRLFGCVQRLADHLSAEHLAQPQIFTLAAEQPFFDFLQIQQIEECAEYHGAASTFCVKGPMRMLLIVDALGDRSMKLWQIVGGAAALTITLAGCAQKSADVPTQAAGNPAAAQTQIQGPAVTGSVNIRQRIALPPDAVLTVTLSDASLADAPSKVIAQRAVRTEGQQAPFSFTLPYNPSDIQPNARIILSAAVTVNGRLMFITDTIQEVVNRNGT

SEQ ID NO: 206370 - protein, 334 aa, Glycine max
  Coding DNA Sequence Number=SeqID_89592
  Gene Ontology: Mol. function=transporter activity; Cellular component= integral to membrane; Biological process=transport
  Homolog annotation: Hit_ID=Q2ZQ46; Match level="QueryCoverage=72%, HitCoverage=60%, E-value=3e-44, Identity=43%"; Hit description =General substrate transporter:Major facilitator superfamily precursor
MSGHAIDAAGPAGEATRLPWAGLLALAGGGFITLLTETLPAGVLRPMGESLGVSDAAVGQLQLPADPGRALPGRRVWWPAVVAGGRLRRAHGGALAAGPGDCGGDGRIAVGAVAGRTGRHVAGPADRLALGIRADERAGSRAAGLRALGIARVAGGGGRSAYVVGYGVAHAGRAQCVGGDGAVRAGAQRALHLHRTTGGGGRCRPVAGPPAAGLRPGRHRRHWHCRLGCGPSSAHAGVGRGDRFHRAGADPAVVAGRRDRAAAGDDPVGRCLRRGTYVVPDRIGAACRCRRGSGAVDAGDRLEPGHRRRRCCRGCAAAGGRPEPVGMAAAAAAV

SEQ ID NO: 206371 - protein, 389 aa, Glycine max
  Coding DNA Sequence Number=SeqID_89593
  Gene Ontology: Mol. function=transferase activity, transferring phosphorus-containing groups; Cellular component=membrane; Biological process=two-component signal transduction system (phosphorelay)
  Homolog annotation: Hit_ID=Q5H630; Match level="QueryCoverage=99%, HitCoverage=31%, E-value=1e-161, Identity=79%"; Hit description=Two -component system sensor protein
  Pfam annotation: Domain name=APH_6_hur; Domain location=161-373; Score=-129.5; E_value=0.062; Accession=PF04655.5; Description =Aminoglycosidehydroxyurea antibiotic resistance kinase
  Pfam annotation: Domain name=HisKA; Domain location=240-306; Score =66.9; E_value=6.5e-17; Accession=PF00512.15; Description=His Kinase A (phosphoacceptor) domain
  Pfam annotation: Domain name=PAS; Domain location=94-206; Score=8.8; E_value=0.059; Accession=PF00989.14; Description=PAS domain
  Pfam annotation: Domain name=PAS_4; Domain location=100-211; Score =12.3; E_value=0.012; Accession=PF08448.1; Description=PAS fold
  Pfam module annotation: Pfam domain module=APH_6_hur::HisKA::PAS::PAS_ 4; Domain location=161-373::240-306::94-206::100-211
  Subcellular localization annotation: CTP_CleavageSite=21; ConfidenceScore=5.38e-01
MWAICWHWPRAWSANVMRGVRSSSRRSRWAVNWQSSAPADRPWVQFTERLLAASIGAASARLLLTSLLRGSGMDLGEVVAVLDEAGQELRFNREILSTTLENISAGVSVVDPDMRLTAWNRRYQDMFGYPDGMLYVGRPVADLIRYNAERGELGEGDIEVQINRRIGYMRAGSPHVFERTRSDGKVIEMRGQALPGGGYVTSYNDITDYKHAEKALLEANETLEQRVAERSHEAEVAQQSKTRFLAAISHDVLQPLNAARLFASALRDSDHVSDEQKHLAERVDASLRAAEELLDGLLDVSRLDAGGLHPVIGEFDVSALMRELAAQYTPVAAGRGLRLDLFARPAWVRSDRRLLRRVLQNFLANALRYTRQGRIVLAVRHRGDEVELQ

SEQ ID NO: 206372 - protein, 155 aa, Glycine max
  Coding DNA Sequence Number=SeqID_89594
  Homolog annotation: Hit_ID=Q51613; Match level="QueryCoverage=36%, HitCoverage=64%, E-value=2e-16, Identity=92%"; Hit description=, complete genome
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPDETKVQTWSSQHYRNEPVVVVAAPRLQKYSSFDDQSGDKPLLLPI

SEQ ID NO: 206373 - protein, 125 aa, Glycine max
  Coding DNA Sequence Number=SeqID_89595
MEDPSKFKRPQLLPRMSIQAHNISRSSQDIQMVHNISRSSKLNMEAQGKFKWPQLLTHMSDSGQLYIESIEIEQWKLLRKSNGHKFSIGCPIQVHNISRCSKLNMEAQGKFKRQKILARTPDSGQ

SEQ ID NO: 206374 - protein, 214 aa, Glycine max
  Coding DNA Sequence Number=SeqID_89596
  Homolog annotation: Hit_ID=Q1RT77; Match level="QueryCoverage=34%, HitCoverage=12%, E-value=5e-07, Identity=41%"; Hit description=Zinc finger, CCCH-type
  Subcellular localization annotation: CTP_CleavageSite=76; ConfidenceScore=5.33e-01
GGPLGTRPRLQRTTRPHLQRTACPYFQRTAHPHLQRTTRPHLQRAARPRLQRTRHPRRQRTRCPRLQRTIRPRLLRAMHFRLQWAPHPHLKRIYGPPTLMLNQDLRSRATNYASTTRGRDYRVATVHTGGRFHPCHCKETSADHAHQHEHSYIDDVATLQHSAQQPQCRSPPAKVSVGLCHPDIGPWGFQLGLRASISPIGCSYPPARSYHHDI

SEQ ID NO: 206375 - protein, 66 aa, Glycine max
  Coding DNA Sequence Number=SeqID_89597
MSPRICKRKREGKENRKIEEGKGEKEYKIEDANDRSVEDLCSISNGNIDHSKEAYGMGIMRNDPNT

SEQ ID NO: 206376 - protein, 328 aa, Glycine max
  Coding DNA Sequence Number=SeqID_89598
  Subcellular localization annotation: CTP_CleavageSite=65; ConfidenceScore=5.10e-01
RPRLFVASERAGASPLQGLTSAIRPWPQARNAVPRGPAELAGSAGGKWQKHSSRSKESRTARRLSHMSKRTRRKKTGASAQGFYRHSRGVYPCARVLKRYSETATMAAPIIMAKSGSSIPWDAEYSMSPPAGQQARQHEAHRVAAPVCQAYIARHHEPEGQRITQAQQGVLPLKDGRGPTPLPFFVLVCDFPVIDHLPVMVRRAVAQRFNAHHVLRHAVHHQHALDARKPVLRRVEREPQVAVDAAQQRIVADVDTPPVSGFAAGHNQFAAQLARDGAARQFCDHVIPAPFFVLRHRQLDAAQMLVARPGGALCEPQHRRFVTLAIRT

SEQ ID NO: 206377 - protein, 400 aa, Glycine max
  Coding DNA Sequence Number=SeqID_89599
  Homolog annotation: Hit_ID=P12057; Match level="QueryCoverage=40%, HitCoverage=87%, E-value=6e-14, Identity=29%"; Hit description =Protein traE
MAGQDTSGKASRRISPSVNADAAVGGAGVQRAADGDVTGRGVGGLVLDAVHAGDAVFLHVGGLGGQHLLHFRARGGRRPAQQQRVLPVDRLGRHVEAQVNQRANQHPVQPGVTAVHVGDKRLVEGHRHGEGLLRVCKVPRHRAGHAGPDGEDENERNQPREGVNHHAMARLFYLKLHGSSRKWRKMPPCGAAGKLLHPVAVTGIRHAPELRAEKRGGQVPVEQVKKPPGPLPLLEVADEKPERPPGEEHNDEHGFREPVPLRLPVLHGSPNHAVERAGHQQNDDEADEDQRVAGFNEAHHRDDDFRKVYPAHHRALQPEGVAGVLLLRFQQVGGVGQVREGGDDQHQRPQQQGEAKSRARLLRDVKHAEGRHKAGGKMADNRAARIIPERAWRTLAACPG

SEQ ID NO: 206378 - protein, 190 aa, Glycine max
  Coding DNA Sequence Number=SeqID_89600
  Gene Ontology: Cellular component=outer membrane; Biological process =conjugation
  Homolog annotation: Hit_ID=Q8KNL8; Match level="QueryCoverage=76%, HitCoverage=58%, E-value=1e-19, Identity=36%"; Hit description=TraK
  Pfam annotation: Domain name=TraK; Domain location=1-190; Score=-1.2; E_value=1.9e-06; Accession=PF06586.2; Description=TraK protein
MKTPLLSLIVALTAGAGLALPAAAAVPGPAGTAFENNAHLKAQMSNTSPNKIIIDGELITAVTGPENAYTKATTADGALLITPLMGQDFTLFLETAGGIGVSIDVSPKPGNGRTLHLIPADVPLKPNPDAKAWEESQPFQKTLVSVARSVVNGDVPENYTEVKASRGPAYNPPAGVQLTPERQLAGFALA

SEQ ID NO: 206379 - protein, 610 aa, Glycine max
  Coding DNA Sequence Number=SeqID_89601
  Gene Ontology: Mol. function=nucleoside-triphosphatase activity; Cellular component=membrane; Biological process=conjugation
  Homolog annotation: Hit_ID=Q8KNL1; Match level="QueryCoverage=94%, HitCoverage=65%, E-value=1e-117, Identity=39%"; Hit description=TraC
DGLADFIQRLCRTGQHGEQPLDALRGALDAGDVGKRVKAQRGTVQIDAARLPAEVFIASPHVDNPAEAAGVECLSQRLLNQEAFARPGGTGHRNVGVCGAVLFAEHIKKSQLPPVGGQRAAEGRHLPLCHHRHQVHRVKAFAAQGGPHVPHVVPQPLLHQERQRGEPVAQLLIAGRRHFQFVLTEHVDGRVLAFLLRTRAVGRKQGQIQRHVAHGNFVVRQLLAQPPPLLVSALRAREQLRVRGAGLLAQILLFAERGVLAFHLVLHAHRPAQDKRTGNAEIGEAHVLQVVGRLPERELERRFGHLQAHNARAGDVRLPFLTQRPVFALTRRGEPQVARMDLELRAGIHALAMQFLIAIPVTAAGDHLPLAIVQLFTHHRKKGFRSDAQGVHLCGQQRHAYGFTQLHRLVHCAYPAPPRLPVNQKHAVIAQIEGVLVFIGQPHQRRPLPVGFGDGVQAGRHAALPHVAAESLVQHLAHALAGHHQHGHRGFARQLLAEQVVQRLHHLLIGAGQGRHLQNKAHGPAVHVELPGLVIGAPGQQATQGRIAEALSQQGGSVFRAALVPAAAEDAGKVFENVTEHADLLRMVRAARCSSRPVTAGFCLRRCRRR

SEQ ID NO: 206380 - protein, 246 aa, Glycine max
  Coding DNA Sequence Number=SeqID_89602
  Subcellular localization annotation: CTP_CleavageSite=78; ConfidenceScore=5.19e-01
MSVRVNRMVRVALVKAQKFAIQSVCFFFIKVGTICRSLGASSLIARWLLAAGTFFTGAFMRAQTSARGVPGETWRMTSAMYAASRSIVMSASAGTCPEFITSGRIAASGTGRVLSLSSRNTILPAGCVTRMSSASGGVTVLSGTISTSDNGFGQTLTHIHTGNIMSELNAVSGKPVITFSCDDKQICEEIIALKTFVFSLLRMMPEDISLDVVKNLSGNGDNPPLNRLCTEMVDAMIATSTHVQEH

SEQ ID NO: 206381 - protein, 252 aa, Glycine max
  Coding DNA Sequence Number=SeqID_89603
MVPDKTVTPPEALLIRVTHPAGNMVFRLERLNTLPVPDAAIRPLVMNSGHVPALADITIERLAAYIADVIRQVSPGTPRADVWARIKAPVKNVPAASSHRAMSEDAPKDLQMDIPMQKIFACALLCAALTGCAGMNSDFDCNKTATDQCLSMSEASKLASKGKSLDDLTAQKEAGPKPAAEALATPGNVKPAVNPYRPVSVATLTLRPVSGQALSADGLRASTVPVRAATPVVPGDYSGPGQLPSARRGGIR

SEQ ID NO: 206382 - protein, 143 aa, Glycine max
  Coding DNA Sequence Number=SeqID_89604
MATLFSGFIIISTLAFEGSAVSGYYPGSLVAAWRARADHQEDFTYQRPYDHHERTSLTNKRLKFIKVNRDQGKHPDHHKRRPYAAEFSATGAVQPAGLLHRRYNAYPAPALLSIPKKESPCLHQGNQRYPARRISITVIRSNA

SEQ ID NO: 206383 - protein, 343 aa, Glycine max
  Coding DNA Sequence Number=SeqID_89605
  Gene Ontology: Cellular component=periplasmic space; Biological process=conjugation
  Homolog annotation: Hit_ID=Q65AH0; Match level="QueryCoverage=86%, HitCoverage=94%, E-value=1e-115, Identity=64%"; Hit description=TraU protein
  Pfam annotation: Domain name=TraU; Domain location=29-292; Score =208.6; E_value=1.4e-59; Accession=PF06834.2; Description=TraU protein
MKRFLLILCLLTAGIMAKPVMAATSNAGDGRWVNPISDVCWKCLFPMTLGSIQLASGAHPDTPNPASPIQLCPYGIFYRLGLAIGFWEPLAMTDVTREPGVMVNMGGFKIDLGRTGTGRGGQSDAPTPGSFYHVHWYKYPLIFWLNIITSTGCMQTGDMDIAYLSEVDPLWNDSTLAMILNPEVALFSNLLAQGACAADSIASTAGLDVPVHGLYQQRVFAAGGFAAGQRAHGLQAAPGGTGDGDGRGGRGGVLRISVPDHPKIPLALPDGEHVPRTLGLPPVRHDHAAVGLGTQLTHVEEELRLPHVAQAQLRLPVRNQHEYSTDYGAGPRRCAALRDHAGG

SEQ ID NO: 206384 - protein, 95 aa, Glycine max
  Coding DNA Sequence Number=SeqID_89606
MQDTHWHRELSFTLTDGMLLGVLGLVVVTLWWRAIADYRGLRRKERRNAAMQNGNAALRHAWWRRDRVNVVLEFTMAAMVTLASGCLLIVLLPYY

SEQ ID NO: 206385 - protein, 109 aa, Glycine max
  Coding DNA Sequence Number=SeqID_89607
MDAAGKPARARGAGRLPLAAVTGFPENIHHPFRHVVFHPGGRRLQIVFIKPGFKFTRLRILIAACRQEKSRMRPAAPAIAHDRLSRYFSGVCHKRKFRGCGSRAAGVRR

SEQ ID NO: 206386 - protein, 428 aa, Glycine max
  Coding DNA Sequence Number=SeqID_89608
  Gene Ontology: Cellular component=outer membrane; Biological process =conjugation
  Homolog annotation: Hit_ID=Q65AG8; Match level="QueryCoverage=97%, HitCoverage=66%, E-value=1e-42, Identity=29%"; Hit description=TraN protein
  Pfam annotation: Domain name=TraN; Domain location=342-375; Score =21.0; E_value=0.0043; Accession=PF06986.2; Description=Mating pair stabilisation protein Tra
AGYAGANKGQGTSAAKGTDPASVIPGYTSSPSQSGYYGGVQGGDGGISDKGQTELSHNEAGLAISDSSTKNPAVTIDPNADFIQNGKNAEANSGSIVDGTNQQCTTKVVSKSVFENYSCDRDVAQVQTCARTGSIQITGSKEYYNTELVLDSHNSTAVILDDYWVRFDFTVPDDGVVSTGTWDFRYPRSPNYHGSDGNRLWYTMKAFDLTVDHIQLNNGGQAAITPQRVTKGQTVSLYIHYHTDGHYSEGRDGIIKNARDGTFVMKMTFPLTAERDTTSSQVVWSESCGFDKSKATGTAGTVCTDPGGSRTVNQNGKDYTQSASCWQYSDAYIVPVSSTGNCSTLMANKNCTVSARSCTQTEGGTCLHEQDTYQCQTTYSSEGLLCGGQYFCRTGDCSGTDGAGDSGLIPRWPSLPAWPRPATTSSRS

SEQ ID NO: 206387 - protein, 430 aa, Glycine max
  Coding DNA Sequence Number=SeqID_89609
  Gene Ontology: Cellular component=periplasmic space; Biological process=conjugation
  Homolog annotation: Hit_ID=P15069; Match level="QueryCoverage=98%, HitCoverage=93%, E-value=1e-138, Identity=56%"; Hit description =Protein traH precursor
  Pfam annotation: Domain name=TraH; Domain location=1-415; Score =507.9; E_value=1.1e-149; Accession=PF06122.2; Description=TraH protein
  Subcellular localization annotation: CTP_CleavageSite=18; ConfidenceScore=5.02e-01
GDLNGYFGSLGFDGNVSKAQAWQGQAAGYFTGGSVYLRNPVKQVQLISMQVPSLNAGCGGIDAYLGAFSFINGAELQRFVKQIMSNAAGYAFDLALQTMVPELKQAKDFLQKLASDVNSMNMSSCQAAQGIIGGLWPVSQVSNQKICQDIAGESNIFSDWASSRQGCTVGGQGDSVTSRASDKDKDQVLKNKNLIWDALGRNHLFDGNRQLKELVMSVVGSIIFNKDGQVTILTPLVDNRDIINVLMRGGTAKIYGCDEQDLCLGPMPASVTVSSDVALVTQVRNLMISIDSKLSADTGLSDKEKGFINTTSVPVLKYLTNSRSMGMSPTYLIQVADFIAQDMMIQYLQELVKQASQSLAGKNFPEQAAGELRNNVQAATSLLAQMKLQSTADQNALDGIDRNMQYLQQQVSTIISTSYQGNYQWGTGND

SEQ ID NO: 206388 - protein, 56 aa, Glycine max
  Coding DNA Sequence Number=SeqID_89610
MTPNVVGKEEADDIYANPHDYSTWLASSSSSFCSSIIVAIYLEADTKSHTAMILGD

SEQ ID NO: 206389 - protein, 105 aa, Glycine max
  Coding DNA Sequence Number=SeqID_89611
MIMRGQDIYSSQDEATTSPSSSESEEAKEEESKVPMSLKRIKVIPEWATPPSVEGRSSEFQEPLDLWSNHFQGGGNDAILPPQGHWIEESKKIGPDMQEKALRFS

SEQ ID NO: 206390 - protein, 77 aa, Glycine max
  Coding DNA Sequence Number=SeqID_89612
  Gene Ontology: Mol. function=mannose-6-phosphate isomerase activity; Biological process=carbohydrate metabolic process
  Homolog annotation: Hit_ID=Q19KC7; Match level="QueryCoverage=99%, HitCoverage=19%, E-value=2e-23, Identity=71%"; Hit description =Mannose-6-phosphate isomerase
MQKLNNSLQNYAWGSKTALTELYGIENPQGLPMAELWMGAHPKSPSTVEVNGVTRSLRDVINDDPLATLGAAVAQRF

SEQ ID NO: 206391 - protein, 125 aa, Glycine max
  Coding DNA Sequence Number=SeqID_89613
MVSNSQQFSARSNAIVIRRVHEVATNSSSSGETKKLEAIEQPEAYAGNIYNRPPQPQQQNQPQQNNYDLSNRYNLGWRNHPNLRWSNPSQQQQQQQQPYFQNATGPSRPYVPPPIQQQQQQQPQK

SEQ ID NO: 206392 - protein, 533 aa, Glycine max
  Coding DNA Sequence Number=SeqID_89614
  Gene Ontology: Mol. function=cytochrome-c oxidase activity; Cellular component=1-2nm peptidoglycan-based cell wall; Biological process =regulation of cell shape
  Homolog annotation: Hit_ID=P0ABG7; Match level="QueryCoverage=66%, HitCoverage=96%, E-value=1e-149, Identity=75%"; Hit description=Rod shape-determining protein rodA
  Pfam annotation: Domain name=DPBB_1; Domain location=437-527; Score =121.4; E_value=2.5e-33; Accession=PF03330.8; Description=Rare lipoprotein A (RlpA)-like double
  Pfam annotation: Domain name=FTSW_RODA_SPOVE; Domain location=20-365; Score=580.1; E_value=2.1e-171; Accession=PF01098.10; Description=Cell cycle protein
  Pfam module annotation: Pfam domain module=DPBB_1::FTSW_RODA_SPOVE; Domain location=437-527::20-365
MSMNDSPQKRTIWTRIHIDPLFMLIIISLLAYSAIVIWSASGQDPGMMERKLGQIAMGTIIMLVMAQVPPRVYESWAPYLYIVCVILLVAVDAFGHISKGAQRWLDLGFVRFQPSEIAKIAVPLMVARFINRDVCPPTLKNTGIALVLIFMPTLLVAAQPDLGTSILIAASGLFVLFLSGMSWKLIGVAVLLVAAFIPILWFFLMHDYQRDRVMMLLDPESDPLGAGYHIIQSKIAIGSGGLRGKGWLHGTQSQLEFLPERHTDFIFAVLAEELGLVGVLLLLVLYLLLIMRGLVIAARAQTTFGRVMSGGLMLILFVYVFVNIGMVSGILPVVGVPLPLVSYGGSALIVLMAGFGIVMLHMRKDWLGVALASLVLAACSTPEQQTNTAPPQPAYNGPVVEIPGVEPRYEPINPSTSQDYSVNGKTYRVIKDPSNYSEVGLATWYGEEAQGNRTALGETYDPDALSAAHPTLPLPSYVRVTNLANGRQIVVRVNDRGPYTPGRIIDLSRAAGDRLNISNNTRVRVDYIKVAPD

SEQ ID NO: 206393 - protein, 765 aa, Glycine max
  Coding DNA Sequence Number=SeqID_89615
  Gene Ontology: Mol. function=serine-type D-Ala-D-Ala carboxypeptidase activity; Cellular component=membrane; Biological process=proteolysis
  Homolog annotation: Hit_ID=Q7CJV7; Match level="QueryCoverage=51%, HitCoverage=98%, E-value=0.0, Identity=85%"; Hit description=D -alanyl-D-alanine carboxypeptidase, fraction A
  Pfam annotation: Domain name=Beta-lactamase; Domain location=396-653; Score=-41.7; E_value=0.011; Accession=PF00144.14; Description=Beta -lactamase
  Pfam annotation: Domain name=DPBB_1; Domain location=76-166; Score =121.4; E_value=2.5e-33; Accession=PF03330.8; Description=Rare lipoprotein A (RlpA)-like double
  Pfam annotation: Domain name=PBP5_C; Domain location=654-745; Score =140.1; E_value=6.1e-39; Accession=PF07943.3; Description=Penicillin -binding protein 5, C-termi
  Pfam annotation: Domain name=Peptidase_S11; Domain location=397-635; Score=502.6; E_value=4.4e-148; Accession=PF00768.11; Description=D -alanyl-D-alanine carboxypeptidase
  Pfam annotation: Domain name=SPOR; Domain location=288-361; Score =52.7; E_value=1.2e-12; Accession=PF05036.4; Description=Sporulation related repeat
  Pfam module annotation: Pfam domain module=Beta-lactamase::DPBB _1::PBP5_C::Peptidase_S11::SPOR; Domain location=396-653::76-166::654- 745::397-635::288-361
MRKDWLGVALASLVLAACSTPEQQTNTAPPQPAYNGPVVEIPGVEPRYEPINPSTSQDYSVNGKTYRVIKDPSNYSEVGLATWYGEEAQGNRTALGETYDPDALSAAHPTLPLPSYVRVTNLANGRQIVVRVNDRGPYTPGRIIDLSRAAGDRLNISNNTRVRVDYIKVAPDGSVSGPGTIGTTVAKQSYALPARPDLSGGMVMTGASSAPAPAAQDVRAVDNSSLQSNGNIGAPVQSRGFLGAPQPLASGVLEGSAPATPVAPSPAAPAAAAAASPAPASHNASAHAGSGFVVQVGALNDAARARQMADSLGQRFGVPGAVEANGNVYRVQLGGFSSRAQAAALQQRTFFTLNPTDAVVLNMNTLKPSRFLKRLTVGSLVALSLSHVAFADDVNLKTMIPGVPDIDAEAYVLIDYNSGKVLAEKNADARRDPASLTKMMTSYVIGQAVKAGKIHQDDIVTVGKDAWATGNPVFKGSSLMFLKPGDRVPVSQLTRGIVLQSGNDACVAMADYVAGSQDAFVNLMNNYVGALGLKNTHFQTVHGLDADGQYSTARDMALIGQALIRDVPDEYAVYREKEFTFNNIRQMNRNGLLWDTSLNVDGIKTGHTEAAGYNLVASATEGQMRLISAVMGGHTFKGRETESKKLLTWGFRFFETVAPLKAGKEFASEPVWFGNSDRVQLGVEKDAYLTIPRGRMKDLKASYVLNNTELHAPLQKNQVVGSINFQLDGKTIEQRPLVVLNEVQEGGFFSRIIDYIKLMFHHWFG

SEQ ID NO: 206394 - protein, 475 aa, Glycine max
  Coding DNA Sequence Number=SeqID_89616
  Gene Ontology: Mol. function=nucleoside-triphosphatase activity; Cellular component=1-2nm peptidoglycan-based cell wall; Biological process=transport
  Homolog annotation: Hit_ID=Q1M7S5; Match level="QueryCoverage=97%, HitCoverage=83%, E-value=1e-122, Identity=47%"; Hit description =Putative transmembrane ABC transport protein
  Pfam annotation: Domain name=ABC_tran; Domain location=252-447; Score= 223.8; E_value=3.8e-64; Accession=PF00005.17; Description=ABC transporter
  Pfam annotation: Domain name=BPD_transp_1; Domain location=1-206; Score=55.9; E_value=1.3e-13; Accession=PF00528.12; Description =Binding-protein-dependent transport s
  Pfam annotation: Domain name=SMC_N; Domain location=241-450; Score= -116.5; E_value=0.0043; Accession=PF02463.9; Description=RecFRecNSMC N terminal domain
  Pfam module annotation: Pfam domain module=ABC_tran::BPD_transp _1::SMC_N; Domain location=252-447::1-206::241-450
MVLGTVLGLLLAVWRLSENKLLSGVSALYIWFFRGTPLLVQLIFWYNLSTLFPTLSITVPWTDITFASWNTNDLITPLTAAIAGLALNEAAYMAEIIRAGLLSVDHGQVETTQAFGMSRSRALRRIIIPQAMRAIIPPTGNQLISMIKATSLVSVIAMGDLLYSVQAVYNRTFEIIPMLMVAVIWYLLITSILNVGQSAIERYYARGSKRTVVVNKRRASSDTALAAAPRLKEDSFGDNAVLKGIDLDVFPGEVVVILGPSGSGKSTFLRCINHLEEMNAGSIMVGDEQIGYALKRGLLHRLSARKIAHQRQKIGMVFQQFNLYPHMTVLQNIMEAPIGVHKFPRDEVLQHARELLATVGLSDKADAWPRHLSGGQQQRVAIARALAIKPLLMLFDEPTSALDPELVGEVLATMRTLADRGLTMIVVTHEIGFAREAADRVVFMDGGVVVEQGPPEQVIGNPQHPRTQAFLSRFI

SEQ ID NO: 206395 - protein, 606 aa, Glycine max
  Coding DNA Sequence Number=SeqID_89617
  Gene Ontology: Mol. function=4 iron, 4 sulfur cluster binding; Biological process=lipoate biosynthetic process
  Homolog annotation: Hit_ID=P60716; Match level="QueryCoverage=49%, HitCoverage=94%, E-value=1e-164, Identity=92%"; Hit description =Lipoyl synthase
  Pfam annotation: Domain name=Radical_SAM; Domain location=70-234; Score=87.1; E_value=5.4e-23; Accession=PF04055.11; Description =Radical SAM superfamily
MALIPVKTVVTERQEILRKPEWMKIKLPADSSRIQGIKAAMRKNGLHSVCEEASCPNLAECFNHGTATFMILGAICTRRCPFCDVAHGRPNAPDANEPLKLAQTIADMALRYVVITSVDRDDLRDGGAQHFADCISAIREKSPSIKIETLVPDFRGRMDRALEILTATPPDVFNHNLENVPRVYRQVRPGANYEWSLKLLERFKEAHPDVPTKSGLMVGLGETNVEIIEVMRDLRRHGVTMLTLGQYLQPSRHHLPVQRYVSPAEFDEMKEEALAMGFTHAACGPFVRSSYHADMQAKGLEIMQSSFHIDELDFMRAADVSGPSSGRPRSGASGESLDALKARTTPMDITNPFVTPHASCELAFLATAISIDHRYDEIHLHLPQSAQPASAPALPFTELRSVTPDETPLLPALPPLESAQQAAGESVWPSLPEIPALSLVLSLVSALPAAWYAAEHQTPPPSPVTTLTARQPLSLPEVAVLRDMQQHDYAVVTGDAQGHWQFAQPADLSAAQHVFSAEFVDEQGHVSSPAAIITPIDDSDLSAIDCALMELAMQQDDIAPALLPLTFSEAWLDEWHSADSTLTASGDHGGNLPGWDEPLEHHIVWH

SEQ ID NO: 206396 - protein, 319 aa, Glycine max
  Coding DNA Sequence Number=SeqID_89618
  Gene Ontology: Mol. function=4,5-dihydroxyphthalate decarboxylase activity; Biological process=aromatic compound catabolic process
  Homolog annotation: Hit_ID=Q1YKX1; Match level="QueryCoverage=97%, HitCoverage=96%, E-value=9e-25, Identity=27%"; Hit description=4,5 -dihydroxyphthalate decarboxylase
MITIRLAVRDWDYFTPLALGDIQPQGFRLIIDRVGTLVDNLASSEHYEGGEVSFSRYAQARARGDNSLLGLPHFLMRGFRQRCIITTTASPLTTPAQLKGKRIGVTGWQDSGNTWTRTELREAGVDINDAFWFAGRLTADHPIVDRLAGFGRPGRIEPAPDERPLIELLKAGELDAVFTPFMPEGFFLKDSGLRQLQADFVSAERDYFNRVGYVPGIHLLALKPALAAAHPWLPQALSEVIDCAYQLWMRKREKYADTTPWLLDDLRRTAQELPADWNQNGFTANKRMIADFARELFQQGLTTTLLSPEEIFPAAARGE

SEQ ID NO: 206397 - protein, 120 aa, Glycine max
  Coding DNA Sequence Number=SeqID_89619
MFSLVALRTLVIVPPNAVKISRLKQNHPYGDGDDDVECARDHGGISSRHKFLFENTYAFPTLMVEVFLFVLEGSQTLGHPPLSVTRDISSLCDDNKNDDVKCIHDHGELSYMDIMELKLC

SEQ ID NO: 206398 - protein, 288 aa, Glycine max
  Coding DNA Sequence Number=SeqID_89620
  Gene Ontology: Mol. function=peptidase activity; Biological process =glycolysis
  Homolog annotation: Hit_ID=UPI000067F951; Match level="QueryCoverage =76%, HitCoverage=66%, E-value=4e-50, Identity=50%"; Hit description =Transglutaminase-like
  Pfam annotation: Domain name=Bact_transglu_N; Domain location=70-151; Score=80.7; E_value=4.6e-21; Accession=PF08379.1; Description =Bacterial transglutaminase-like N-ter
  Pfam annotation: Domain name=Transglut_core; Domain location=247-287; Score=19.3; E_value=0.00036; Accession=PF01841.9; Description =Transglutaminase-like superfamily
  Pfam module annotation: Pfam domain module=Bact_transglu_N::Transglut_ core; Domain location=70-151::247-287
MDENNPNSVVFQIKGLVKYLEEMDAQDNAGGIATELNGCWQALLQLDPDQCFIAGNAALADWLNQTYNMRYQVEHQTIYSYDLPVIQSQQLLHMMPRQTPFQTCVSYTLACEPIPAEQSQRLDFFGNHNHYLTMLATHQVLQVTSRFQVELQPRPPITALMQSPAWEQVQAMLQVQGAQHLEAVPFIYATNRVKSSEALAAFAKNCFTPQRSLLDAAMALTQKIHAEFEFDAQATDVSTPLDEVLKGRRGVCQDFAHLMIGALRSLGLACRYVSGYILTHPPPGQPRL

SEQ ID NO: 206399 - protein, 88 aa, Glycine max
  Coding DNA Sequence Number=SeqID_89621
MSNHKSTESALKNLEVQVGQLVKQITDKSSNSFVANTEHNPKEECKAVMTRSKRFVEVEDEDSVVHKKKTVDKKGIDGDAILSRKGIG

SEQ ID NO: 206400 - protein, 360 aa, Glycine max
  Coding DNA Sequence Number=SeqID_89622
  Gene Ontology: Mol. function=transferase activity, transferring nitrogenous groups; Cellular component=intracellular; Biological process=biosynthetic process
  Homolog annotation: Hit_ID=Q1M4H9; Match level="QueryCoverage=63%, HitCoverage=50%, E-value=4e-60, Identity=50%"; Hit description =Putative GntR family transcriptional regulator
  Pfam annotation: Domain name=Aminotran_1_2; Domain location=1-330; Score=-39.4; E_value=2.1e-05; Accession=PF00155.11; Description =Aminotransferase class I and II
MAAPDPALLPDLRPAMLAGLASPQLNSYQREAISPQLQAAIAPRWPCPAEAWLATDGGFDAMNLIVQTLLSPGDRVVIEDPTATRLLDMLDNIGAEILPLPGDEQGPLPAVLATHLQKAPAMFIYQPRTHSATGYSVSQQRSEALAQVLAQSATLIVEDDGIGDLSRWPVWSLGRHYPQRTLHVHSFSKAYGPDLRLAVVSGTAELVKRLQSWRNFGVSWTSRILQDAVAWMLSDAPTQQRIQQAKATYAARRQQLLAALARRGLANAAASTADSSFASALRGCRPISSTASPMPWRFNVAFSRIKLVGFQSRGVTMHFHAVAAAGARQLLGVVQQLLAAAFTALALGDTEIADAREIAR

SEQ ID NO: 206401 - protein, 342 aa, Glycine max
  Coding DNA Sequence Number=SeqID_89623
  Gene Ontology: Mol. function=oxidoreductase activity; Cellular component=membrane fraction; Biological process=metabolic process
  Homolog annotation: Hit_ID=Q13CA2; Match level="QueryCoverage=77%, HitCoverage=64%, E-value=7e-36, Identity=38%"; Hit description=Iron -containing alcohol dehydrogenase
  Pfam annotation: Domain name=Fe-ADH; Domain location=74-341; Score= -33.8; E_value=1.3e-11; Accession=PF00465.9; Description=Iron -containing alcohol dehydrogenase
MRHPVTGIMLRVTLTGKHLVQRVNFCFAKVINFLSEGYQNVCPGSGVAFGYTSCFMPTDKDLQVSENLIELYSNQQTLFGRGSIDRLVPLLAANPQPTLLFCGRSFLNSPAWARLGATLNDHILGYEIVSHEASPDEIDGWVTRWRGHVDRVVAIGGGSVLDAAKAFGAMMQHPLNIARYLEKVGDTPVQAVTLPLIAIPTTAGTGSEVTQNAVVTDQQHIKVKASLRHPVFVPQVAILDPDLLKGAPDRVLATCAIDAFTHLFEAYLSRKGNLFSQQNALNGLQLFMQAWPYLNQDDSRGDAAREAMMMASWLGGISLSSAGLGVVHGIAGELGAIKPFHH

SEQ ID NO: 206402 - protein, 152 aa, Glycine max
  Coding DNA Sequence Number=SeqID_89624
MISVDKGPVLAARRIIQTACPPVIDAIVWTAKLRRCRITTAKIMTAPGKAIAAAMSLRHTMIGIVIVTIRARSTIVAKVTTVMMIGTRAAILMAVAAVRIPARITGTVGPGDAGKQDNGSLRAVEAYYYLNKAKTAFPKLLKIGDLQYITPG

SEQ ID NO: 206403 - protein, 437 aa, Glycine max
  Coding DNA Sequence Number=SeqID_89625
  Gene Ontology: Mol. function=two-component sensor activity; Cellular component=membrane; Biological process=two-component signal transduction system (phosphorelay)
  Homolog annotation: Hit_ID=Q8ZPW4; Match level="QueryCoverage=98%, HitCoverage=92%, E-value=1e-105, Identity=43%"; Hit description =Putative methyl-accepting chemotaxis protein
  Pfam annotation: Domain name=GGDEF; Domain location=278-433; Score =133.0; E_value=8.3e-37; Accession=PF00990.12; Description=GGDEF domain
MSGYMRYIIEKGESTFLYDKYQNQLIISQFLRKLDTPPNQTEVEQVCNSVQHNGDVSGLNIAGYTYHQLHGTLSAAHADCGKWRGDIPALQAFDRAVAKNDSWQPEVPATLKSEKRFRYYIDLDSKLGISQASLDGLEQGRSLISTVYVDAMTGKNILSFLTPVYFKDKLKGVVMVDVTAQEIEALLYTSDRPLVWRYLDITLKDSDTGALIEVHHSKTHLLNYAHYTHQVAENLRITLSLDVMYFLLSSWKLFLFYLLSTAALLHLVRVHFRLYNSVSKDNISDTMTGLYNRKILTPMLESRLQRLTAQGVNVVTMALDCDGLKKINDTWGHNAGDEAIILLAQAISASIRSSDYGVRLGGDEFFLILIDYPEAEAENIPARIRQYLAIHDHQQRVDFSWGAASLAPEQSLSEAMKAADARLYMNKKQKKSPGIRR

SEQ ID NO: 206404 - protein, 52 aa, Glycine max
  Coding DNA Sequence Number=SeqID_89626
MEEPSKKWKGTSSRSQRHSGSQETPIPSFIPSGPLFSSEECWTTGLRYLKKG

SEQ ID NO: 206405 - protein, 142 aa, Glycine max
  Coding DNA Sequence Number=SeqID_89627
MESLQVVAPPGIILTVEPFMEKVAWPGTQPSLVREGEGPNAQAGGTQVRQKAATPKRSPQISPDPPSPVVDQSSPQQLADPPTPVHEMPADPSTPLLEILEDPATPVLGLTTTPSTTHVLHFTDKEGTQDQDTQQDDQSHEF

SEQ ID NO: 206406 - protein, 434 aa, Glycine max
  Coding DNA Sequence Number=SeqID_89628
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-51, Identity=29%"; Hit description= UPI00006A17C9 related cluster
DYTSSPSEGYTSSPLEGYTPSNSEDYTSSPLVGYTSSPFQGLHILAFRGLHALTSRGLHVLAIRGLHVLPFRVLHVLLFRGLHALAFRGLHVLPFRGLHVLTFRGLHVLAFRGLHAHKGLHVLAFKGLHLLAIRGLHILTFRGRHVLACRGLHALNFRGLHVLTFRGGLHVLAIRGLHVLSFRGLHALTFRGLHVLAIIGLDVLAFRGLHVLAFSGLHVLISRGLHVLAFIGLHALTFRGIHDLAFRGLHVLAFRGLHALSFRELNILAFRGLHVLTFGGLRVVAFKGLPVLLLRGLHVLTFRGLHALTFRGLHVLAIRGLHVLAFRGLQALTFRGLHVHPIKGLHVLQIRGLQILTFRKLHVLPFRGLHVLTFRGLHVLAFIGLHVLAIRGLHILSFRRLHVFTIRGPHVLTFRGLHVLAFRGLHLLAFRGLR

SEQ ID NO: 206407 - protein, 130 aa, Glycine max
  Coding DNA Sequence Number=SeqID_89629
MGILYPNLASSVRRFLRGYRVSLSSVILLQHAGEEIITAGQPDTIAAGPFGQCLPYLAFQLFPAPDDDVAVHGRPSPTLQENTGRLRAPAAGEQADQEQDNADDKHDFSRPGGGARQRTEPQCRSDKRDD

SEQ ID NO: 206408 - protein, 106 aa, Glycine max
  Coding DNA Sequence Number=SeqID_89630
MWILSLKKLNLMVKLLLLPWLSKTREALTQALLDHAHVEKEAHRRSMIGDYFYKETTSWKPPHTPMPPCSPIHLSSDSANFGDEFLRKPDEEVAKKGKEIVKVKVS

SEQ ID NO: 206409 - protein, 102 aa, Glycine max
  Coding DNA Sequence Number=SeqID_89631
MVIGGEALIIPSYSQDSRPIVYNGLTGPQLLKSINAKLKEEPNELEGYRKEDFKILWIPIEFNFQTGIDLIKEVFNYKGNPIIMLISPEGKVENSDAKQIIS

SEQ ID NO: 206410 - protein, 71 aa, Glycine max
  Coding DNA Sequence Number=SeqID_89632
MEMGYVYSLQDLIVTDFKWVQQELLLWHSATGNLLRHVGDSPYQSSKSQEKYTSLKCKAKITSFSMDQERE

SEQ ID NO: 206411 - protein, 214 aa, Glycine max
  Coding DNA Sequence Number=SeqID_89633
  Gene Ontology: Biological process=multicellular organismal development
  Homolog annotation: Hit_ID=O04479; Match level="QueryCoverage=97%, HitCoverage=95%, E-value=9e-58, Identity=55%"; Hit description=LOB domain-containing protein 6
  Pfam annotation: Domain name=DUF260; Domain location=7-107; Score =240.9; E_value=2.7e-69; Accession=PF03195.5; Description=Protein of unknown function DUF260
MASSNSPCAACKFLRRKCQPECAFAPYFPPDQPQKFANVHRIFGASNVTKLLNDLHPHQREDAVNSLAYEAEMRLRDPVYGCVGVISLLQHQLRQLQMDLYCAKSELSRYQNLSITTNLSSLASESATTAYHHHHQNMSGAGAGAGRDHHYHYHRHHQFFPRDQHQQQQVVRSFDAGNNYDASLLAMNISANLGQLNQLQHHSAAGGGDDRNCS

SEQ ID NO: 206412 - protein, 195 aa, Glycine max
  Coding DNA Sequence Number=SeqID_89634
MAKQKTKFGHSAHMIRGDTLRLSAPPLPFRHSRVRWQAETKFGHSAHMIRGDTLRLSAPPPFAIQTQSCSMASRDQVWSFCTHDTRRYLTVIRPPLPFRHSRVRWQAETKHSRVRWQAETKFGHSAHMIRGDTLRLSAPPLPFRHSRVRWQAETKFGHSAHMIRGDTLRLSAPLCHSGTVVFDGKQRPSLVILHT

SEQ ID NO: 206413 - protein, 77 aa, Glycine max
  Coding DNA Sequence Number=SeqID_89635
MTSYGVVSPFIFLLLHSAAIRPQEAKESIDEEDPRPTSSTWSYITHLLRRVNSSLPNGQGVTILKNVLELITQGEIF

SEQ ID NO: 206414 - protein, 156 aa, Glycine max
  Coding DNA Sequence Number=SeqID_89636
  Homolog annotation: Hit_ID=Q9FHX2; Match level="QueryCoverage=37%, HitCoverage=13%, E-value=8e-09, Identity=52%"; Hit description =Mitochondrial carrier protein-like
MQHPGPHSIGKPHPPFLLQNLLHCGRNPIVHNNRNLAHPLASYPHHQPTSSNGVSHDVDIALARVPYKTLCTGSNKHLPLAALHAGLHLLHDELLQAHDRGQHDVPHGIDCGRDKQGVDLVLEALMERCPWSLLRWLGNHRGGVREWERVEGDIKY

SEQ ID NO: 206415 - protein, 378 aa, Glycine max
  Coding DNA Sequence Number=SeqID_89637
  Homolog annotation: Hit_ID=Q8H897; Match level="QueryCoverage=60%, HitCoverage=21%, E-value=2e-07, Identity=26%"; Hit description =Putative retroelement
  Pfam annotation: Domain name=Transposase_23; Domain location=161-231; Score=-4.2; E_value=0.0033; Accession=PF03017.5; Description =TNP1ENSPM transposase
MARTKKTGEMTTEAAKEIAEKIDSFEEQATQGSFVPHRRQDVLAAAIGRPEHPGCVHAAGSGVTINQYFGSAPRTSHSASSLPPDELQQLTKQIRDQLEESIIQNVTRQVMASFSHLQSQLQSQMQSQGLAVPPEPLVGPSGPRVSTKGSCVDPSGNDPETGDSDRCGLYIEADPARLVAMGRFYEGSTVVHNAPLLLGQVKVSVEEVTDADASVPVPTDEVSLEGQALYTFLAWPTHLVMSLSQQVAVSPPKPPPKPDPEVDDPLYLMTLTIPELFLRPYQVRWDATVFGVVNPDFPLYIKHEDLSEIAHGGQCLSISVLQLWILHLTETCMRAGNSDIYGFLEPQSIQRSGQSQFESESSTAADTGRWWSSCPRNT

SEQ ID NO: 206416 - protein, 109 aa, Glycine max
  Coding DNA Sequence Number=SeqID_89638
MEEFLVVCYDGDMIPTYEVIIFNVLMDDCVEYECIKLKHDKHVAKMFFIFVEFVSLISIKLCNMLSRSSEEIITLMCKSRFAEEIVCFMRETMATTNTNDERSVSWSKP

SEQ ID NO: 206417 - protein, 107 aa, Glycine max
  Coding DNA Sequence Number=SeqID_89639
MEDCLEGPLLGNHGTQLQLENGGHMNDNAIHSWGSEKSSNSKVEDTLMTTQFIHVALEKDENGGLPLGSCLRQSWNTAANSKVEDPRIALSNNIHVTPEKDENGGFP

SEQ ID NO: 206418 - protein, 114 aa, Glycine max
  Coding DNA Sequence Number=SeqID_89640
MDQKVPTKLVDNKEVEKSEDEYDEDDMKSLELEAKAKNILHCALNPDIFEIFSDDPKSAKQMWDELDRFFFDREMTGANSPTPQGQLSKDPNTPDATQFNSPDLYFFQDTSTVK

SEQ ID NO: 206419 - protein, 373 aa, Glycine max
  Coding DNA Sequence Number=SeqID_89641
  Gene Ontology: Mol. function=transferase activity
  Homolog annotation: Hit_ID=UPI000016344C; Match level="QueryCoverage =96%, HitCoverage=64%, E-value=4e-46, Identity=33%"; Hit description =protein binding
MALEMAREWEELAYARDENKDTALHLLALNQNPLDSCCHCSEIKDPIQINPEVGNFGFLSELISAYPSMIIWEVDNKNQSIIHTAVSYRHASIFNLVHEIGSIKDIIISYFVKENNPLCFQPKNKNNTLLHLAAKLAPPDRLELVSGAAFQMCLEIIWFKEVKKIMPPSFIKLKNSDGLTAEELFTKEHEGLRKEGEEWMKRTAEFCMLISTVIATAVFAAAINIPGGIDDGTNKPNYLNKASFQVFAISDAAAFVFSATAILIFLSILISRYAEYDFHKSLPLKLICGLITLFISIACMMVAFGSAFFITYYYGLKAVPDIIAVLACLPLLLYIGLQFSLWSDIIYSTFYCRNLFKPSKRMIYVATKELGTL

SEQ ID NO: 206420 - protein, 496 aa, Glycine max
  Coding DNA Sequence Number=SeqID_89642
  Homolog annotation: Hit_ID=UPI000016344C; Match level="QueryCoverage =84%, HitCoverage=79%, E-value=1e-46, Identity=31%"; Hit description =protein binding
  Pfam annotation: Domain name=Ank; Domain location=142-174; Score =22.3; E_value=0.0018; Accession=PF00023.20; Description=Ankyrin repeat
  Pfam annotation: Domain name=Ank; Domain location=256-288; Score=7.7; E_value=2.4; Accession=PF00023.20; Description=Ankyrin repeat
  Pfam annotation: Domain name=Ank; Domain location=73-107; Score=6.9; E_value=3.1; Accession=PF00023.20; Description=Ankyrin repeat
  Pfam module annotation: Pfam domain module=Ank::Ank::Ank; Domain location=142-174::256-288::73-107
LLHLSKPGISTGVVPTAAAAAASLMSDGGEEARHRYLTQCVPLHKAALKGDWKEAKKILDQDPTLLKSAITKGWATVLHIAVGANHECFVEELVKLLSREDLELLDDKGNTAFCFAAAVGNVHIAEIMRIKNESLPTIRGGEGVTPLHLAVLQGRSEMTRYLFDKTREILYDDDWITLFLICVNSGLYGKNMKDPPVLKLTRRIWDIFLTLDDSEMMDAIREPSQVTFIAAEEGNFEFLSVIMSTYPDLIWELNTMGRSIIHVAALHRHASIFNLIHEIGPSKDFVLTFLDDEGSTLLHSVAVIAPTDRLNVVSGAAFQMMLELTWFEEVKKIMLPSFVEMPNYEGIIPRELFTNQHEDLLKKGESWMKRTASSCMVVSTLIATGVFSAAFSVPGGIDDKLGSPNYLKKPLFTVFALSDALALTLSTTSTLIFLSILISRYAEEDFLSITFDELSVEARESKEASQVPLVVGDWPLEHHDNLGVVWFYPISGNNMS

SEQ ID NO: 206421 - protein, 192 aa, Glycine max
  Coding DNA Sequence Number=SeqID_89643
LENEVRKLGELLVIDYQASKGNWKTVEASGNRLPVCVINYTGEWVTGNRLPVCVIDYTGEWVIGNRLPVPRGSLGDPRRKREVPISGNELVHPDEPARTLQRTMEWILPTPTPYRLGEPVQVIEVTSSEEDPEEDLEELPLEPAVDALDFLEGDEDPLPEVDSPEEVMSASEADSTEDSGPGEMAISGGSSS

SEQ ID NO: 206422 - protein, 80 aa, Glycine max
  Coding DNA Sequence Number=SeqID_89644
  Subcellular localization annotation: CTP_CleavageSite=33; ConfidenceScore=5.10e-01
MREGIFGWKETPPPSFLCFQVQGCSPRRAQLAQASSARPSELTLILGCLPATLSACPEMGMGRRSIDRDPSLYSRPSPST

SEQ ID NO: 206423 - protein, 132 aa, Glycine max
  Coding DNA Sequence Number=SeqID_89645
  Homolog annotation: Hit_ID=Q1RUD8; Match level="QueryCoverage=54%, HitCoverage=14%, E-value=2e-07, Identity=41%"; Hit description=IMP dehydrogenase/GMP reductase
EWALFIDILALLIYGGVLFPNVDGLVDLAVIDAFLAYHDHKESPIVAMLADLYDTFDQRCEKRSTRIVCYTPVSYPNFVRGPLLDDMRPFFGPCESKCFRNASVSDSVEILHRSSSFFTVLHPFFVRSSFFN

SEQ ID NO: 206424 - protein, 205 aa, Glycine max
  Coding DNA Sequence Number=SeqID_89646
  Gene Ontology: Mol. function=xylulokinase activity; Cellular component=integral to membrane; Biological process=carbohydrate metabolic process
  Homolog annotation: Hit_ID=O52719; Match level="QueryCoverage=99%, HitCoverage=41%, E-value=1e-73, Identity=63%"; Hit description=D -xylulose-kinase
  Pfam annotation: Domain name=FGGY_N; Domain location=1-205; Score =269.9; E_value=5.2e-78; Accession=PF00370.11; Description=FGGY family of carbohydrate kinases, N-
MYLGIDIGTSELKALIVNPQGEIVASNHATLSVQRPHPHWAEQDPERWWQACGQAIAGLRQQAPDAWAAIRAIGLSGQMHGAVLLDAAGEVLRPCILWNDTRSAAQCDALRQHHPQMMEIAANLIMPGFTAPKLHWVAEHEPEIFRRIDKVLLPKDYLRWRLTGRFVSEPSDAAGTLWLDVAQRDWSDALLAISGLTRAQMPELG

SEQ ID NO: 206425 - protein, 59 aa, Glycine max
  Coding DNA Sequence Number=SeqID_89647
MSLGDWIKVGIWIFIWYPMEEIALNKLNERMWISDIRCMNFGSGYAGKVLRCKGTKVVL

SEQ ID NO: 206426 - protein, 122 aa, Glycine max
  Coding DNA Sequence Number=SeqID_89648
MSERGHGMYYTPQTFAEYPTQMYQYPFQGHHTDTSASQQSFGGVAETQAHFSWPTMTPSQQYHGPIPTPNAPLGTQWNVPGQIPNTGDLFGVDLRHAFSAEADEEEAGRHRGRRNPDRQARR

SEQ ID NO: 206427 - protein, 221 aa, Glycine max
  Coding DNA Sequence Number=SeqID_89649
  Gene Ontology: Mol. function=binding; Cellular component=integral to membrane; Biological process=porphyrin biosynthetic process
  Homolog annotation: Hit_ID=P0ACB7; Match level="QueryCoverage=99%, HitCoverage=55%, E-value=2e-94, Identity=76%"; Hit description =Protein hemY
YLLAAEAAQQRGDEIRANQHLERASELSENDTIPVEITRVRLQLARNEDHAARHGIDRLLEVAPRHPEVLRLAEQAYIRTGAWGALLDILPSMQKAQINDENQRNALQQQAWLGLMNQAMADQGSEGLKKWWQNQSRKTRQETALQVAMAEHLIECDDPDTAQSIVLEGLKRQYDDRLVLLMPRIKSGDPQALEKALRQQIKQHGATPLLHSTLGQLLMRH

SEQ ID NO: 206428 - protein, 268 aa, Glycine max
  Coding DNA Sequence Number=SeqID_89650
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-38, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
AFRGLHVLAFRGLHALAIRGLRVLAFRGQRALAFVGIHVLTIRGLHVLAFRGQHVLALGTSTPTFNGLHALAYKRLHVVTFRGLHILAFRGQHALAFRGLHILAFRGLHVLAFRGLHALAIRGLRVLAFRGQCALAFVGIHVLTFRGLHVLAFRGQHVLALGTSTPTFNGVQALAYKRLHVLTFRGLHVLAFRGGHALVFRGLHILVFKGLHVLAFIGVHDIAIRGLRVLAFRGLRALAFVGVHALTFRGVRVPAFRGVHTLDIRGLH

SEQ ID NO: 206429 - protein, 576 aa, Glycine max
  Coding DNA Sequence Number=SeqID_89651
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=lipid metabolic process
  Homolog annotation: Hit_ID=Q6DAY7; Match level="QueryCoverage=93%, HitCoverage=93%, E-value=1e-124, Identity=59%"; Hit description =Putative fatty acid desaturase
HLAQQIDQQNLPDADGRRQQPARDRQRQQQVRRLARQKLAPAAHALLCHARRHPGASRPIQPVEQPDVVRERQRRHQRPIVTLGAHKGPPALERRLPQHAVGVDVGVVMFDIVMGMVEQHVPHAPTVGIQPQRDAHQGVQPAVGPGPTEKRVMRGIVHHVHRSARNTGRTAPAAAPPLPACRRRRSGDRRWPPDNAGRPASARDAGRRRRADRLTDAALSWLPHKAQEALLLRQQFAIADAAICHAVPLRHFRQRGGQRRIVAVIPAGKQVVGQVIVQPAGQVLQPARLGLPVAGGGEIVPVPTVRHAVARRRRIELGLRPVGAQQQEHHQQRGKHLAERVSQQHPAPTDAVQVAQDQRHHQHQRHMKQFAQHEQRPTAAPRQHAFFPQRRFIEPIGPIENPRDVGQRERGDQRPVQMLIAHMRPPALERRLAEKAVLFGVQIVVFDVGVNVVVIHVPRAPVVRIDAQRQRHQPPHQAIGPGRAQEGVMRSIVVDVDVEQHAHGHEQEIAEEKCPGLMLHQAQGIKPDAQRQQQCGLGQSRGIGIAMIARQAGVRRALEIAVKRLLAIGGKTQRRQ

SEQ ID NO: 206430 - protein, 125 aa, Glycine max
  Coding DNA Sequence Number=SeqID_89652
MASKKRKSPSTPTQARFDRSRFTSLEAWERYTDIVVPRKLLPERNVVVYYTEFDEIKEELKRRHWDEKLTDFSNSSIDIAIMKEFYTNLYDPEDKSPKQVRVRDPCSVGGGGEFVYIFQICTPEA

SEQ ID NO: 206431 - protein, 299 aa, Glycine max
  Coding DNA Sequence Number=SeqID_89653
  Gene Ontology: Mol. function=acetyl-CoA C-acetyltransferase activity; Cellular component=mitochondrial inner membrane; Biological process =poly(3-hydroxyalkanoate) biosynthetic process
  Homolog annotation: Hit_ID=Q7W9L2; Match level="QueryCoverage=94%, HitCoverage=70%, E-value=1e-123, Identity=80%"; Hit description =Putative thiolase
VRVGHQARQRLDAALGRHRRVHQHQRAGAVVQARGVAGRDGAVFFLEHRLERGQALGRDVAAHVLVGIEHHFTLARLLHDRHDLVAEMAGLDGVGGAAVRLGRQRVLVLAADAELGGDVLGGHAHVHAAERIGQGAGHHVLHDAVAHARAPALRRRDVGSAAHALGARADGDVGIAQQNGLRRRHDGLQAGAAQAVDVEGRGFLGDAGVDGGHARQVHVARLGVDDVADGDVADFVALDAGAFQRGLDDGRAQVAGRHVLERAAEIADSGTDGGCDDDFLLDGFPPGDPFIILAPPRCP

SEQ ID NO: 206432 - protein, 116 aa, Glycine max
  Coding DNA Sequence Number=SeqID_89654
VAPTRHPVDPEEPNRALGFPALVTGLCQSYRAPVPPASSCHRDIGITPARHSVDPEKSNRVLGFPALIMGLCQFYGVSVTPSKVIKPPTHRAFIKKYCVMEACLWSFYGGWIFELQ

SEQ ID NO: 206433 - protein, 90 aa, Glycine max
  Coding DNA Sequence Number=SeqID_89655
MPNQMLKVKGVSKLRHEVYIIETGRQQGDPTNGRPPRARYMKHTRPTQHNPTPPKADEKIKQVNNTRELLTQFGATSPTSGGYQAREEIH

SEQ ID NO: 206434 - protein, 74 aa, Glycine max
  Coding DNA Sequence Number=SeqID_89656
MPIVIIFIKFGESFSLGSLLNQSQTYQGNPCGVYPDLSSFIGSGVYPDLSSFNGSGPVSFSKSHNSSNGSLDQT

SEQ ID NO: 206435 - protein, 516 aa, Glycine max
  Coding DNA Sequence Number=SeqID_89657
  Gene Ontology: Mol. function=transporter activity; Cellular component= integral to membrane; Biological process=transport
  Homolog annotation: Hit_ID=UPI00005F9DA9; Match level="QueryCoverage =62%, HitCoverage=38%, E-value=1e-111, Identity=58%"; Hit description= COG3188: P pilus assembly protein, porin PapC
  Pfam annotation: Domain name=Pili_assembly_C; Domain location=440 -516; Score=13.1; E_value=0.0034; Accession=PF02753.7; Description =Gram-negative pili assembly chaperone
  Pfam annotation: Domain name=Pili_assembly_N; Domain location=316 -432; Score=45.4; E_value=1.9e-10; Accession=PF00345.11; Description =Gram-negative pili assembly chaperone
  Pfam annotation: Domain name=Usher; Domain location=1-322; Score= -289.0; E_value=1.1e-09; Accession=PF00577.10; Description=Fimbrial Usher protein
  Pfam module annotation: Pfam domain module=Pili_assembly_C::Pili _assembly_N::Usher; Domain location=440-516::316-432::1-322
MYTVTLNKSFRDLGVTAYLSYTHQSYWNRPASDNFSLSMSRYFDIGRLKNVSVSLAAYRNKFNKVTDDGAYISLSFPFGNSSNISYSADVKRDDTSHDVSYYDRVNENSSYQLRAGHSRRGNSMGGYVSHHGDIADTTASINYQEGQYSSLSVSAQGGAVLTPEGGALHRNMMLGGTRLLVDTSGVPDVPVRGFGAPVYTNRFGKAVISDVNSYYRSSARIDFGKLDDNAEATRSVVQTTLTEGAIGYRRFNVIAGAKAMAIIRLADGSVPPFGASVMNSKKQETGIIYDQGNIYLSGVHPAERMDVSWNGQVQCSVTLPATLPDDLSGDAAHAGDRTAGAGRGGAGSYPDEQGNKLNGPLVLLPPVQRIEPGEKSQMKVQALPAAAQLPQDRETVYYFNLREIPPRSEKPNVLQIALQTRVKLFYRPAAIVPDRKAMENPWQEQLTLTRQGDSYMAHNPTPYYITLVDATTHKEGKTVAGFAPLMVPPKGSIKLGGSASALGNAPVLTYINDYGG

SEQ ID NO: 206436 - protein, 105 aa, Glycine max
  Coding DNA Sequence Number=SeqID_89658
  Homolog annotation: Hit_ID=Q1SN45; Match level="QueryCoverage=55%, HitCoverage=3%, E-value=3e-10, Identity=44%"; Hit description=AAA ATPase
MDNHEHANHRDTAQARIKNKVSSPENQNYMSLANEPAINREGYSDLGDQLMQCSHCNANMWYDERVLKDKRTTNPRFSLCCGNGKVELPLLQNPPKYLYQLLYDH

SEQ ID NO: 206437 - protein, 140 aa, Glycine max
  Coding DNA Sequence Number=SeqID_89659
  Homolog annotation: Hit_ID=Q9SYH9; Match level="QueryCoverage=39%, HitCoverage=32%, E-value=2e-13, Identity=63%"; Hit description =Putative RNaseP-associated protein
MPSRNSAKTPKKDGNNSNSSLSSLENNFYEGERLTNLLQSIRRGIQSARHLDGSSLPEKIWLKQQFSIGVNDVTRVLERMKPCTELESSTELISLRSNHTASSVKLQVDFLCLSNVEYVWVKTKEDIIDVLHYSGCACSF

SEQ ID NO: 206438 - protein, 72 aa, Glycine max
  Coding DNA Sequence Number=SeqID_89660
  Homolog annotation: Hit_ID=Q1S1R8; Match level="QueryCoverage=62%, HitCoverage=10%, E-value=5e-13, Identity=75%"; Hit description =Tetratricopeptide-like helical
MAAELGQQTVELSILITHAAHNKSFDTLVKSKGITKELGCSWIEMNGIVHTFIYEDRGHPREAEIYSKIDEI

SEQ ID NO: 206439 - protein, 477 aa, Glycine max
  Coding DNA Sequence Number=SeqID_89661
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=Q75LI0; Match level="QueryCoverage=82%, HitCoverage=82%, E-value=1e-166, Identity=70%"; Hit description =Putative polygalacturonase
  Pfam annotation: Domain name=Glyco_hydro_28; Domain location=88-441; Score=13.3; E_value=7.9e-10; Accession=PF00295.8; Description =Glycosyl hydrolases family 28
MIFSTMRRRLTDGGTFLLQLVDGFLVLALFSCSTWTVWSSSCCNQINSYEVRPHSVSITEFGAVGDGITLNTIAFQNAIFYLNSFADKGGAKLFVPAGRWLTGSFDLISHLTLWLDNDAVILGSMNSDDWPVVDPLPSYGHGRELPGGRHRSLIYGRNLTDVVITGNNGTIDGQGSIWWNNFWNKTLNYTRPHLVELMNSTGVLISNVTFMNSPFWTIHPVYCSHVTIQNVTIIAPLSSPNTDGINPDSSDNVCIEDCYISTGDDLISIKSGWDGYGISFGRPSTNINIRRLIGKTTSAGIAIGSEMSGGVSEVHAEDIYIFDSHSAIRIKTSPGRGGYVRNVYISNMILVNVDIAIRFTGLYGEHPDDTYDPDALPVIERITIKDVIGEKVKRAGLIQGIKGDNFVNICLSNITLNVSKKLPWNCSYVKGYSDLVSPEACEPLRERIFPEHCSDCYYLPNHLKSLSNQNWGAWLLS

SEQ ID NO: 206440 - protein, 319 aa, Glycine max
  Coding DNA Sequence Number=SeqID_89662
  Gene Ontology: Mol. function=sequence-specific DNA binding; Cellular component=nucleus; Biological process=regulation of transcription
  Homolog annotation: Hit_ID=Q9ZSI7; Match level="QueryCoverage=76%, HitCoverage=51%, E-value=1e-55, Identity=48%"; Hit description =Probable WRKY transcription factor 47
  Pfam annotation: Domain name=WRKY; Domain location=93-153; Score =138.2; E_value=2.3e-38; Accession=PF03106.6; Description=WRKY DNA -binding domain
METNLNGMMFGQHLLDPRGPFTKLDAQVAPFPDDKSGQRGHPETDPVEDVLEQSTSQSWGSSKSPKFEESNSSELPLKKTRVSVRARSEAPLISDGCQWRKYGQKIAKGNPCPRAYYRCTMAVGCPVRKQVQRCMDDKTVLITTYEGNHNHPLPPSAIVMANSTSAAASMFLSSSCSTSNNNEALSNTVGVFSSMPYIPMATLSTSAPFPTITLDMTTNPSALTSPLPLHATTFPQLLGHPVIFPHKMPHPLLGQQQPLFTTETMSAAIASNPNFTIALAAAISSIIGAPRGNDGINNNSSNGGSDLPLNGTSMLPGST

SEQ ID NO: 206441 - protein, 111 aa, Glycine max
  Coding DNA Sequence Number=SeqID_89663
MLQPYGISIGLKEHSNPVTPKAYTPKSPSGSLPPDSDHFGFLRERKRLQCERYFSQLKHDIKIPNGENARNWVAKVVLKFHDDPTVNESKIVIFLRQVRWPVGKREDFERR

SEQ ID NO: 206442 - protein, 508 aa, Glycine max
  Coding DNA Sequence Number=SeqID_89664
  Gene Ontology: Mol. function=zinc ion binding
  Homolog annotation: Hit_ID=Q2QUH9; Match level="QueryCoverage=99%, HitCoverage=96%, E-value=1e-110, Identity=42%"; Hit description=DHHC zinc finger domain containing protein, expressed
  Pfam annotation: Domain name=zf-DHHC; Domain location=148-212; Score =94.6; E_value=2.9e-25; Accession=PF01529.11; Description=DHHC zinc finger domain
  Subcellular localization annotation: CTP_CleavageSite=62; ConfidenceScore=5.15e-01
MRRHGWQRPLHPLQFVGAAVYGFLVVCFFTFLGLFLGNRTAEITLTLTFSSVAVAVMFLFVRCTAIDPTDRTCFRNKKKQRAKSDAIPKLNYGFILGQIVMRFFRRVERKLLRTFIKRKYLDPFKTSPQMEPLLPFPLVMKDDDDAIAPNLNEDDISFCALCDFEVKKHSKHCRTCNRCVEGFDHHCRWLNNCVGKRNYTTFFLLMIFVLLMLLIEGGTAIAIFIRCFVDRRGIEKELQRKLYVDFPRGVLATICVFLLLLTAYSSAALGQLFFFHVVLIRKGMRTYDYILAMREENEAMDLESLDDSDFSSDESIDFDSPEKPPLMSRFLCKGNQSSPRLSIRIEGETEPSPLIKTKKFHVSINPWKLIKLTREKAQLAAEKAREKIMREKPMGEHNSLKPLPLETKCGPLMSPDKNMDTKDFGSTSFIAKGRLTESPGGRFSSPRRRFSAGSPTVFSSSMMASPHHKYRSSFDLKLTGVSRELETHISRQVLCSVISKDDSEPSPR

SEQ ID NO: 206443 - protein, 376 aa, Glycine max
  Coding DNA Sequence Number=SeqID_89665
MVNLEVTKYSKATGIGKGGSGGKKRKAKSIRKHYFAMQRRLRQCRHFDAKNATEGSLSVDERCLVSSVVALKNVRVASRCGLLSPRAWTCVVRAAFAKLSMMDMCQPIRDREAISIGGPSFEDTCRGVSDSKSSSSEKSILVTMIISLSAFVGVRRVGGSRDVRDDVLKYRSSLTSVVSIVVLQSQVKMVNAEDSYKLVVQACKSDDFPFLRADPFFKVLAIDVEVDGMPLMFNRDGELRFLLYWQYDHTRFKLYDEDLLTLMKRVDKEILKQLSASLDARSILSLPLASDPLVALDGIMGDFAWRPLMKQVELAGGIVPPSFVALSTGEGRRETILLGRLAQDVPPTAPTVEVHAVAIEATPVIPAHSPPTVDVV

SEQ ID NO: 206444 - protein, 217 aa, Glycine max
  Coding DNA Sequence Number=SeqID_89666
  Gene Ontology: Mol. function=hydrolase activity, acting on glycosyl bonds; Cellular component=vacuole; Biological process=cell wall catabolic process
  Homolog annotation: Hit_ID=Q9SBT5; Match level="QueryCoverage=99%, HitCoverage=85%, E-value=1e-104, Identity=73%"; Hit description =Class II chitinase
  Pfam annotation: Domain name=Glyco_hydro_19; Domain location=1-211; Score=385.7; E_value=7e-113; Accession=PF00182.9; Description =Chitinase class I
  Subcellular localization annotation: CTP_CleavageSite=29; ConfidenceScore=5.07e-01
KELFDSIFIHKDNNACPARNFYTYDSFINASKRFPRFGTTGSPTTRKREIAAFLAQISHETTGGWATAPDGPYAWGLCFKEEISPQCHYCDSTNTQWPCYPGQSYKGRGPIQLSWNYNYGPAGKALGFDGLRNPDVQKPKPSCHNVMVGKYVPTQADIAANRTAGYGFVTNIINGGLECGIPDDSRVNDRIGYFQRYATMFNVDTGPNLDCANQKSF

SEQ ID NO: 206445 - protein, 596 aa, Glycine max
  Coding DNA Sequence Number=SeqID_89667
  Gene Ontology: Mol. function=protoporphyrinogen oxidase activity; Cellular component=chloroplast; Biological process=chlorophyll biosynthetic process
  Homolog annotation: Hit_ID=P55826; Match level="QueryCoverage=92%, HitCoverage=95%, E-value=0.0, Identity=65%"; Hit description =Protoporphyrinogen oxidase, chloroplast precursor
  Pfam annotation: Domain name=Amino_oxidase; Domain location=74-581; Score=162.3; E_value=1.3e-45; Accession=PF01593.14; Description =Flavin containing amine oxidoreductase
  Pfam annotation: Domain name=DAO; Domain location=66-407; Score= -51.7; E_value=0.016; Accession=PF01266.14; Description=FAD dependent oxidoreductase
  Pfam module annotation: Pfam domain module=Amino_oxidase::DAO; Domain location=74-581::66-407
  Subcellular localization annotation: CTP_CleavageSite=45; ConfidenceScore=5.63e-01
MVSVFNEILFPPNQTLLRPSLHSPTSFFTSPTRKFPRSRPNPILRCSIAEESTASPPKTRDSAPVDCVVVGGGVSGLCIAQALATKHANANVVVTEARDRVGGNITTMERDGYLWEEGPNSFQPSDPMLTMVVDSGLKDELVLGDPDAPRFVLWNRKLRPVPGKLTDLPFFDLMSIGGKIRAGFGALGIRPPPPGHEESVEEFVRRNLGDEVFERLIEPFCSGDPSKLSMKAAFGKVWKLEKNGGSIIGGTFKAIQERNGASKPPRDPRLPKPKGQTVGSFRKGLTMLPDAISARYYMLPNTNVLVKFLLFSRLMILANCDPVNRLGNKVKLSWKLSSISKLDSGEYSLTYETPEGVVSLQCKTVVLTIPSYVASTLLRPLSGFKDMSSPVAGFSLSHITKMHAAAADALSKFYYPPVAAVSISYPKEAIRSECLIDGELKGFGQLHPRSQGVETLGTIYSSSLFPNRAPPGRVLLLNYIGGATNTGILSKTDSELVETVDRDLRKILINPNAQDPFVVGVRLWPQAIPQFLVGHLDLLDVAKASIRNTGFEGLFLGGNYVSGVALGRCVEGAYEVAAEVAISLPLHYSPLFLESW

SEQ ID NO: 206446 - protein, 233 aa, Glycine max
  Coding DNA Sequence Number=SeqID_89668
MGDMYWSHHRDTVLHVCHSPWVTCTGVTIVICSCIRVPRRAWHTLESSTEVELQVGGIPWTFPIGAKLSHLGIFSGFTFDSLYEVARLKGSWLNLCISPCQRFLDFYEDHGVCVICESALRLIEPSLQGPEDDYSIATSKYVTAPRAFGSGPNMSIPHMEKGQGELRLKPARTILVARERPLLAIKDDLAVGLSSKALGFVLIHCHNFLSICGDSLERLLDDGLKVPNLLVAG

SEQ ID NO: 206447 - protein, 159 aa, Glycine max
  Coding DNA Sequence Number=SeqID_89669
  Gene Ontology: Mol. function=protein dimerization activity; Cellular component=nucleus; Biological process=regulation of transcription
  Homolog annotation: Hit_ID=Q8RVH6; Match level="QueryCoverage=87%, HitCoverage=89%, E-value=3e-31, Identity=52%"; Hit description =Aux/IAA protein
  Pfam annotation: Domain name=AUX_IAA; Domain location=1-159; Score= -56.0; E_value=1.9e-05; Accession=PF02309.7; Description=AUXIAA family
  Subcellular localization annotation: CTP_CleavageSite=19; ConfidenceScore=5.50e-01
MGKASSSSSSSISSCRNPSNSTASSLTHQHSQDHLRTDLRLGLSLSATQHVGSSSSGGHWQPMQPHLISSFSQATEVNDCSDHTSFFVKVYMEGIPIGRKLNLLAHDGGTEMDGVQPERCHVLTYEDGEGDLIMVGDVPWEMFLSAVKRLKITRVEAFG

SEQ ID NO: 206448 - protein, 296 aa, Glycine max
  Coding DNA Sequence Number=SeqID_89670
MALLAVILVAMVSPSSSLCPHISLDHLYTSMLIHYGNATDFSKVFLQRSLMILEENELRHQEAVQKIASLEVEDEPSTVFQAGLGCKVESMATEKDELAKRITELEVRLTDSESKLVESELRVAKEREADKELEEELLLYKKEVVEQHEKGFEKAVRQGSLFAKDLDLGQDVKDDILLDEEVIATKEEEEAADEGQGVTEQGDDPIDRGGLVKSVAESSQVLPNQCGGRSLDLLSVSSDVLPNSGATVRLVDLRPLTVIVLAAPWWTLSFGTKGRPWVLDKLAFMHGGPWVCRALD

SEQ ID NO: 206449 - protein, 86 aa, Glycine max
  Coding DNA Sequence Number=SeqID_89671
MAFSDQQKQLRLIYNRFKEEVNQHLQDCRSTVEDLEADRIEIKRTMEKQRVAHKKLLSQVEAAVQIQLDDAQRKITFTQEESIRYM

SEQ ID NO: 206450 - protein, 354 aa, Glycine max
  Coding DNA Sequence Number=SeqID_89672
  Gene Ontology: Mol. function=binding; Cellular component =intracellular; Biological process=protein amino acid phosphorylation
  Homolog annotation: Hit_ID=Q8LIR0; Match level="QueryCoverage=99%, HitCoverage=84%, E-value=1e-66, Identity=27%"; Hit description =Selenium-binding protein-like
  Pfam annotation: Domain name=PPR; Domain location=153-187; Score =13.8; E_value=0.17; Accession=PF01535.11; Description=PPR repeat
  Pfam annotation: Domain name=PPR; Domain location=254-288; Score =39.9; E_value=8.6e-09; Accession=PF01535.11; Description=PPR repeat
  Pfam annotation: Domain name=PPR; Domain location=83-117; Score=16.6; E_value=0.08; Accession=PF01535.11; Description=PPR repeat
  Pfam module annotation: Pfam domain module=PPR::PPR::PPR; Domain location=153-187::254-288::83-117
ALLFGKMREQGLMPDSVIVTSVLPVCGRLEAVKLGMALQGCAVRSGFESDLYFSFAMIDMYCKCGDPFDAHRVFSRMVYKDVVSWSTSIVGYSQNRLYQESYELYTGMVNVGLATNAIVVASVLPTFGKLKLLKQRKDMHNFVLIEGLMPNVVVGSALIDMYANCGSIKEVESIFECMSNKDIMVWNSVIIRYNLVGDSESTFFTFRRIWGAKHRPNSITLVSILPICTQMEAFRQGKEIHVKIFKQMMVRNVITYSTMISASGAHGLGEKGLAFYEQMEEEGIRPNKVTFISLLSACSHACLFDREGDLDGAYKFITRMHMTPDANVLGSLLGHYVLLSNLYAYGKRWEGMSK

SEQ ID NO: 206451 - protein, 75 aa, Glycine max
  Coding DNA Sequence Number=SeqID_89673
MEVLGLSKLVTIFKDRIQKAKKKDKKKANDDDEDYIPEYRGGLGSKSSSENYVDDRPDEFAATNNLESQKRNVMK

SEQ ID NO: 206452 - protein, 138 aa, Glycine max
  Coding DNA Sequence Number=SeqID_89674
  Gene Ontology: Mol. function=nucleic acid binding
MNDNITLILHHGGRFTPRASDGKVEYIGGEFDVWEDMSADCLNAFILYDLVKACKKYSNIGECFWLIDKDLDFNHGLRSCTTDGDILHLVRDAFENENEINVYFHHEVDPILEGVPQMLYLECDPIPEVVENEDDLDD

SEQ ID NO: 206453 - protein, 51 aa, Glycine max
  Coding DNA Sequence Number=SeqID_89675
MERHNCESLFQDSLKTKPCLKTECFQDMQGSGNRLPGSVIDYQKTGLRNSG

SEQ ID NO: 206454 - protein, 118 aa, Glycine max
  Coding DNA Sequence Number=SeqID_89676
MEGRTHRVVAKMRIELGMEDEAGPSNTQQQRSTPPPSRLSTLNKELEMVLATLPVTDTFFGNRLILTVDNENVMNSDAQTCVETSFMMMNQVDSSSFDDDKKPKRMISRLSQQVQDQV

SEQ ID NO: 206455 - protein, 400 aa, Glycine max
  Coding DNA Sequence Number=SeqID_89677
  Gene Ontology: Mol. function=helicase activity; Biological process =viral genome replication
  Homolog annotation: Hit_ID=Q2R1R7; Match level="QueryCoverage=77%, HitCoverage=43%, E-value=4e-34, Identity=40%"; Hit description=AT hook motif-containing protein, putative
MNNMCSLHNNLYNDFEDASSTSTRVANSEMHDNSLVREHANDPLQQTDEGYLDDNTEIGGNVDSLLHDDNHLGDDGDECAHDISTGYIDLGDPSKTCPYCHTAMWYEERTRKDKNQANAKYSLYCDMGRVQLPFLKNPSLLLQQLLCDQESRESKNYQHNIRAYNMMFAFSSLGAKIDTSVLNGKGPSIYKIHGQSCHLIVSLLPMPEKPPKFAQLYIYDTENEIQNRIDATHINIEWCNQSTSIKYLFKYINKGYDRITATLVPVQNDDGTTKQVVDEIKHYLDGRLYFHFPGQNSIIFVDDDDIDVLLSKPTIKESMFTSWLQANSIYHEAKDLTYLHFVSKFTYIAKSRCWRPRKGGNTIGRLNWVPPSTSEIYYLRMMLVVVKGLTTYEKICTVNG

SEQ ID NO: 206456 - protein, 330 aa, Glycine max
  Coding DNA Sequence Number=SeqID_89678
  Gene Ontology: Mol. function=helicase activity; Biological process =protein amino acid phosphorylation
  Homolog annotation: Hit_ID=Q9ZQR0; Match level="QueryCoverage=98%, HitCoverage=26%, E-value=8e-80, Identity=47%"; Hit description =Putative helicase
  Pfam annotation: Domain name=DUF889; Domain location=133-330; Score =216.3; E_value=6.8e-62; Accession=PF05970.5; Description=Eukaryotic protein of unknown function (DUF889)
MSVVNKQVGGMFFLYGYRGTGKTFMWKTLSDTLRSKGDIVLTVASSGIASLLLPNGRTAHSKFVILVPTLENSTCNIHQGIEQARLLKATKLIIWDEAPMAHKYCFEALDKTLNDFMLMSNSDSVPFGGKVVVFGGDFKQIFPIITRGSRSDIVNATINASYLWDYCTVLKLTKKMHLQSNLTITNAQEIKRFSQWLIDVGEGKLEISNELLIKNFNDHIELIVGHTYPYIQHNYKDEEFLKSRAILASTNEIVDQINDYILNIISGDEKEYLSCDSIDITDVASSESHEAVTPEFLHSFKTSGMPNHKIRIKIGTPIMLIQNLDQVEGL

SEQ ID NO: 206457 - protein, 143 aa, Glycine max
  Coding DNA Sequence Number=SeqID_89679
MDNVPKIKTEPGFEDENGPSHHDRAMLHQHHYRQLSTGQLTRVQALRLVPNSVTFNMLLNEYKATCNSLDVPSSMYNFMKEKRFTQLNIAYCAEMPLCLQLVAKDDKNWIWMERFFQIPKLQSWNLFEFPDPNVNYAFIWPCL

SEQ ID NO: 206458 - protein, 457 aa, Glycine max
  Coding DNA Sequence Number=SeqID_89680
  Gene Ontology: Mol. function=pyridoxal phosphate binding; Cellular component=cytosol; Biological process=metabolic process
  Homolog annotation: Hit_ID=Q1SEN7; Match level="QueryCoverage=95%, HitCoverage=98%, E-value=0.0, Identity=75%"; Hit description =Peptidase M, neutral zinc metallopeptidases, zinc-binding site
  Pfam annotation: Domain name=Aminotran_5; Domain location=53-437; Score=-123.6; E_value=3.2e-06; Accession=PF00266.9; Description =Aminotransferase class-V
MTTLPETPTVSPMENENTILRNGTAKKPKLTHAISEAEIREEFSHHQRGVARINNGSFGSCPRSVLNAQSIWQLRFLQHPDDFYFNSLRPGILASRAAIKDIINAEHVDDVSLVDNATTAAAVVLQQIGRHFVRGHFHRNDAVVMFHCAYQAVKKSIEAYVTPIGGTVVEVQLPFPVRSEEEIVTEFKKGLENGKLNGGKVRLAVIDHITSMPSVVLPVRELIRVCREHGVEQVFVDGAHAIGSLHVDVKEIGADFYVSNLYKWFFSPPSVAFLYCKEKSNDVHHPVVSQEYGKGLPVESAWVGMRDYSPQLVVPSILEFVNRFEGGIEGIMKRNHDGVVKMGTMLAESWGTVLGSPPEMCASMIMVGLPSRLCVMSDDDALRLRSYLRVYHEVEVPVYYQALRNGDRDPRDKDGFITGYVRISHQVYNTVDDYERLKTAINQLVEDGKVCSGIPTE

SEQ ID NO: 206459 - protein, 260 aa, Glycine max
  Coding DNA Sequence Number=SeqID_89681
  Gene Ontology: Mol. function=protein binding; Cellular component =membrane; Biological process=intracellular protein transport
  Homolog annotation: Hit_ID=Q1SEN5; Match level="QueryCoverage=98%, HitCoverage=26%, E-value=1e-106, Identity=77%"; Hit description=SecA protein
  Pfam annotation: Domain name=SecA_DEAD; Domain location=42-251; Score= 320.3; E_value=3.3e-93; Accession=PF07517.4; Description=SecA DEAD -like domain
  Subcellular localization annotation: CTP_CleavageSite=39; ConfidenceScore=5.48e-01
YHHKTPSPPYSTVLRGDVQLHPPSVSRTRRSRRRQSGAVASLGGLLGGIFKGADTGEATRQQYAATVNIINGLEPEISALSDSELRDRTFALRERAQQGQSLDSLLPEAFAVVREGSKRVLGLRPFDVQLIGGMVLHKGEIAEMRTGEGKTLVAVLPAYLNALSGKGVHVVTVNDYLARRDCEWVGQVPRFLGLKSVEDLVIRGFNYCIIDEVDSILIDEARTPLIISGPAEKPSDRYYKAAKIAEAFERDIHYTVCNKG

SEQ ID NO: 206460 - protein, 460 aa, Glycine max
  Coding DNA Sequence Number=SeqID_89682
  Gene Ontology: Mol. function=protein binding; Cellular component =membrane; Biological process=intracellular protein transport
  Homolog annotation: Hit_ID=Q1SEN5; Match level="QueryCoverage=67%, HitCoverage=26%, E-value=1e-134, Identity=82%"; Hit description=SecA protein
  Pfam annotation: Domain name=GRP; Domain location=10-122; Score= -19.6; E_value=0.0074; Accession=PF07172.2; Description=Glycine rich protein family
  Pfam annotation: Domain name=SecA_DEAD; Domain location=90-257; Score= -133.5; E_value=7e-08; Accession=PF07517.4; Description=SecA DEAD -like domain
  Pfam annotation: Domain name=SecA_PP_bind; Domain location=112-213; Score=148.9; E_value=1.4e-41; Accession=PF01043.10; Description=SecA preprotein cross-linking domain
  Pfam module annotation: Pfam domain module=GRP::SecA_DEAD::SecA_PP _bind; Domain location=10-122::90-257::112-213
MVIVVMSIAMTIEISMVVAVEVALLVVVAVLVVAANGGDVVVVVGGGGINVGGGGNGVGGGGNYGGGIVGGGGGNNDSGDDSDGDGGSNADGDVGGDDGGTKWWQCGGGGSHTSDDGDGGGGLVVTVVDEKQKSVLLSEQGYEDSEEILAVKDLYDPREQWASYILNAIKAKELFLRDVNYIIRGKEVLIVDEFTGRVMQGRRWSDGLHQAVEAKEGLPIQNETVTLASISYQNFFLQFPKLCGMTGTAATESTEFESIYKLKVTIVPTNKPMIRKDESDVVFRATSGKWRAVVVEISRMHKTGRPVLVGTTSVEQSDSLSEQLKEAGIPHEFIYLNIDNTSVLEESIHLEVLAQVFELTKYSFNWKPNEERSACVIQQVLNAKPENVEREAEIVAQSGRLGAVTIATNMAGRGTDIILGGNAEFMARLKLREILMPRYYGALIDSFIMENLFFHVLVAF

SEQ ID NO: 206461 - protein, 513 aa, Glycine max
  Coding DNA Sequence Number=SeqID_89683
  Gene Ontology: Mol. function=nucleotide binding; Cellular component =chloroplast; Biological process=intracellular protein transport
  Homolog annotation: Hit_ID=Q41062; Match level="QueryCoverage=92%, HitCoverage=40%, E-value=0.0, Identity=75%"; Hit description =Preprotein translocase secA subunit, chloroplast precursor
  Pfam annotation: Domain name=SecA_SW; Domain location=253-470; Score =394.9; E_value=1.2e-115; Accession=PF07516.3; Description=SecA Wing and Scaffold domain
MVKNESGKNMGWHYKIKLCKMNVCMMVDREFWWKMKKVNEKLFPCQLSNKNVDLAEKAVQLAVETWGKRSLTELEAEERLSYTCEKGPAQDEVIAKLRNAFLEIGKEYKVFTEEERKKVVEAGGLHVVGTERHESRRIDNQVFSSFLFLVRLKGGKLGCTGLWPWTSAYLLPSSIIIAAIITTAASTTPTLLNKYLKLEHFFLSSIKLRGRSGRQGDPGSSRFFLSLEDNIFRIFGGDRIQGLMQAFRVEDLPIESKMLTKALDEAQRKVENYFFDIRKQLFEYDEVLNSQRDRVYTERRRALESDNLQSLLIEYAELTMDDILEANIGSDAPKDSWDLEKLTAKIQQYCYLLNDLSPDLLGNTCSDYEELRNYLRLRGREAYLQKRDIVEQQAAGLMKEAERFLILSNIDRLWKEHLQALKFVQQAVGLRGYAQRDPLIEYKLEGYNLFLDMMAQIRRNVIYSVYQFQPVLVEQDQDKTENRKSGKRNARTQVNPNPDPVGTVEPSTTSTTS

SEQ ID NO: 206462 - protein, 43 aa, Glycine max
  Coding DNA Sequence Number=SeqID_89684
KLKKSETLIRVDFVECPKVEVVYGSSWKSGDLKMEDLDIDLME

SEQ ID NO: 206463 - protein, 54 aa, Glycine max
  Coding DNA Sequence Number=SeqID_89685
MESWVMESLGDEWRKPSWGMSLQSTWCRVLANDGWNCMDTCQVDGECRLFCDIA

SEQ ID NO: 206464 - protein, 322 aa, Glycine max
  Coding DNA Sequence Number=SeqID_89686
MDTACWNTGHQNTLRMFSVRLGGPLYLVISVGRVVAVGFLSLSVTYTVQEIQQWREARKKNHPFNNNIQKMLLSNNQFLNHYLQKHSEHPKDRKAINREVLQRELKEVLAKQAELGVEVAEIPSYYLKNSDNQALQSEGKNKFTDKRKFQNKFNKKSDRKGRFAKRQKFDDKDFSESPSLKKRKPTLLQKLLSSDVKRDKSHLIQVFRFMVMNSFFKHCLDKPLRYPLVVVKEKGSEVDGEEKYLHTGKDVLKGGNEETVQKIVTFNNDNSHDCEDEDSDDDENDSIVDNNLHKDPSSLVKRQCDSGEGIGKFDEEEGEIIE

SEQ ID NO: 206465 - protein, 171 aa, Glycine max
  Coding DNA Sequence Number=SeqID_89687
MKVGLAKGIDVSNDDSDYLDNLKANGAAKDRVEEHIIEVAIAYQGKYDGVKIPLTKLLASQLVSSLEEASLTRTPTSIGIFDKNSGANTGRNGIGASGVDNCFSRDIDSMVSVRGCATNVVIVAESIDLYINGDFVEGKYEEGWLVTRICNFRRMTSSLETMEARITVEWS

SEQ ID NO: 206466 - protein, 77 aa, Glycine max
  Coding DNA Sequence Number=SeqID_89688
MDEAPVDTPAHVEQPRHAVKACQEIAKRLERLFNLRIMTEGIEVYIVMENCLRIARGVTAECNVYVRLQRRWRMEDE

SEQ ID NO: 206467 - protein, 99 aa, Glycine max
  Coding DNA Sequence Number=SeqID_89689
MNENQSMHDNIMSKEVDMNEQNEDEISVKSKHVDCFDAFNTSQVFATHDDVLNWVRALAYEIGFVPVIMRSNTNIVRVEFAHWTLNRLLQNSLGDLCSV

SEQ ID NO: 206468 - protein, 1282 aa, Glycine max
  Coding DNA Sequence Number=SeqID_89690
  Gene Ontology: Mol. function=hydrolase activity; Cellular component =cell surface; Biological process=homophilic cell adhesion
  Homolog annotation: Hit_ID=Q8GY37; Match level="QueryCoverage=92%, HitCoverage=89%, E-value=1e-132, Identity=31%"; Hit description =Putative deaminase
  Pfam annotation: Domain name=dCMP_cyt_deam_1; Domain location=1081 -1182; Score=148.6; E_value=1.7e-41; Accession=PF00383.13; Description=Cytidine and deoxycytidylate deaminas
MATQTSVTKDLTEPHHTVCHAVVVVITVQSPLTELILGGGDHYLSRLPAYGVLRGCQELNSSVNERTDYSSSSRWRIKGRYIRAASQKGREFSHSFGSDGAEAVLSLLSEEADKDAICSKCKNASSSKRVEVDKRKNVSREKHLSSSEKVETEKKGILKRRESSSVDLRREYGKANQEREAFVKSESHRKRRDASSCSSYYSLSSGDFGSELEVQDEIGLEELSLEYEKDEANCLEEVKEEFNRQGDDSKKLQAVSNKGRIAFGVDIDWNLRNKSEKKLIEGTLQNTESIREQQDMHSREFRTHDSGHKKSSISQKRVNSEEDKSSFIDNLDKKANKAYIQTVNRRKHQSIDVQESGCDEVETTLLSQKKFSGREGKLEISETMLKETTDEYKKFVGSTSTTGKETLTSKKAFSGREGNLAISETLSQETNDKHKKIVGSTSTSGRDVIDRSSQKYSGNLKIEDTERTSNTRMKDMGVKKVSVLSSVQGVDKQKHQKGEKIITQMKDKEGRKKSEQFSEVSEAHKSNVEDTSSIKSRTRLKNMEEKSNISSDARVTLLQTDKRTTQSFQHRKGSELVSTLSEGYVSDEKQVSSSQKAYEKVRLIPKSKSTSLVRTRESSSQTDERIAKFELARDDQRSCNLSISDETNSREESSSQGSLSLISGAGKHSILASGEKRRSATMLIPSSSEMGGDSVQFELTAGIASPEIFLGTSESGSSALYDNSGRSSALHPDAIDLANRLEKSSRQFVDEFAERVMHEVTTSEAQEMEVTGTKLTLEVGGDQIYSSRQQGTQNDAQSKKHDSSRSSGFPGTKGPSDEMWDVMEPSVEQGQVAKETDISKETGKAVVTRTGRSLWGMIGDIVQLRWGSRAGSSTSAGRSAERNSPNKSDSDTWFSGQEHEETTKTNVLKKTSVPPQVMTSDKLKPGKHYTQSEGEVSDNTKLKDRGKHLEVGLSSPNTLESGSMSVGASHTSGEENVSGTEDKKDLKATTSGTQNMELPISVPARGPSIDGEIVSIGGSDMSGAESVVPIKESIAPVRSELSGSERKDGELKQRKFQRNRQVLRDRFDDWEEAYQCELEQRRIDEMFMKEALLEAKKAADTWEVPVGAVLVQHGKIIARGCNLVEELRDSTAHAEMICIREASKLLRSWRLSDTTLYVTLEPCPMCAGAILQARVDTVVWGAPNKLLGADGSWIRIFPDGGENVSEQRDMPPAPVHPFHPNMKIRRGVLATECADAMQQFFQLRRKKKKEEPPNGPSSLPVTHHPSKLLNKIHDVFHIMFCL

SEQ ID NO: 206469 - protein, 269 aa, Glycine max
  Coding DNA Sequence Number=SeqID_89691
  Pfam annotation: Domain name=DUF1262; Domain location=23-269; Score =119.9; E_value=7.1e-33; Accession=PF06880.2; Description=Protein of unknown function (DUF1262)
MYVTRPLSMYKRNPSAVSDPPLGPNSGYLVILDKEAQAYSFFGLFKDRAIRDLPFPQNKNLSINYGSDGEEDLFVPVLNQPLSSNRYYVIKRKGKHKGQASTSSKEEDMETFLCCSFVQDVKPRPLDPSDDYQQVEIIKRVNNDFKAKSVAPDGILPGLLRRKGWRVYAHTPTDYHLGEALGSDDSLRAKLPDFNVFPLSNDRSESVDVGKWYCPFMFVKERLMKLKEQMKKTVFYELTLKQRWEKIFSKENNDGENLAVFVDVVVQTE

SEQ ID NO: 206470 - protein, 68 aa, Glycine max
  Coding DNA Sequence Number=SeqID_89692
MLLKGSLSESNWLSEAYPLSKEVSSLSEHKTLEDVKLESSTLSAQPVLNVGKCLESLELGRAARGLYI

SEQ ID NO: 206471 - protein, 92 aa, Glycine max
  Coding DNA Sequence Number=SeqID_89693
MHLVAVAQGTSTTYFNTTNKPEQDQTFVNTEDQSYMMLSVPSSNSKLYGCAKNRGADTTKFKEGHHKALLPQRLCIRKKGRKEDDLEAYPRQ

SEQ ID NO: 206472 - protein, 293 aa, Glycine max
  Coding DNA Sequence Number=SeqID_89694
  Gene Ontology: Mol. function=RNA-directed DNA polymerase activity; Cellular component=mitochondrion; Biological process=RNA-dependent DNA replication
MDKIEELVQKGCLNDFVRGNNYNCGSYRERGRGGRKGGFRGEYFKVWGNNDQQPIREGEQRQHENPPVRTKEFPPQSLPTITFPDADFIRNDPTQDDPMVVRRLRPYFQSHQIKVKTDHPIRQILQKPELTGRMVAWSIELSEFGLKFKPQGPIKTQCLDDFMVEFPPKLSSSDRGLKLTKEVGVKKVRCRSDSKLVIGQVNGDFQAKDTQMHKYYHLTMCLLSCFDEYELKHIFRENNDRANVLAKLASSKKSRQHRTFIQKALITPSIDKYDIFASKLVVTLGSTQYGIIL

SEQ ID NO: 206473 - protein, 117 aa, Glycine max
  Coding DNA Sequence Number=SeqID_89695
MVTKVDPEMMDFVGADNSLDSTRFSSMCLLLLFAIGELAFMISREDGFKKALCQIALFAPEMDSKEFNVLKDVKEEELVRESEMRSYEDVLDRETTCKAGDVEATSKSTPTSNPPTS

SEQ ID NO: 206474 - protein, 45 aa, Glycine max
  Coding DNA Sequence Number=SeqID_89696
MNWAPLKCTNPNHLIFRRSCSAALVRETPETQKPVYTGLDNLLQG

SEQ ID NO: 206475 - protein, 51 aa, Glycine max
  Coding DNA Sequence Number=SeqID_89697
MENFQSSEGALSAQPITRAQHVVAESQTHESSTSCVLEGLRKGLGELDSLV

SEQ ID NO: 206476 - protein, 50 aa, Glycine max
  Coding DNA Sequence Number=SeqID_89698
KVDYLTLPDEEQQTRAFRKGVPYCEIEKGTPLDAVPASSVTVTATTMMRD

SEQ ID NO: 206477 - protein, 372 aa, Glycine max
  Coding DNA Sequence Number=SeqID_89699
  Gene Ontology: Mol. function=ubiquitin thiolesterase activity; Cellular component=lysosome; Biological process=ubiquitin-dependent protein catabolic process
  Homolog annotation: Hit_ID=Q8LMT7; Match level="QueryCoverage=80%, HitCoverage=33%, E-value=3e-82, Identity=49%"; Hit description =Putative ubiquitin carboxyl terminal hydrolase
  Pfam annotation: Domain name=UCH; Domain location=8-304; Score=103.0; E_value=9e-28; Accession=PF00443.19; Description=Ubiquitin carboxyl -terminal hydrolase
MKGGDRKLFGTPLVTCLVEDPQFGANIEASVHKMLAPLRKTYSSSKSHDGKENGFISGDSDEQSNISNTESESLSLTTGNKEQEGTSCGESSLQLVLTNESCLSCEPIEKASLIKPNQVVRVFLDWTDKEQELYDSSYLRDLPEVHKTGFTVKKTRQEAISLFSCLEAFLTEEPLGPDDMWYCPRCKEHRQATKKLDLWKLPEILVFHLKRFSYSRYLKNKLDTFVNFPIHNLDLTKYVKSKDGESYVYNLYAISNHYGGLGGGHYTAYCKLIDDNKWCHFDDSHVSPVTEAEIKSSAAYVLFYQRNRSKGQMEGETSQVKTHHEFTIIAVFDSCMYQYRARRAALVFLKGIVPSFCYFVVRILGPSIMWKR

SEQ ID NO: 206478 - protein, 90 aa, Glycine max
  Coding DNA Sequence Number=SeqID_89700
  Gene Ontology: Mol. function=ATP-dependent helicase activity; Cellular component=cytoplasm; Biological process=regulation of translation
  Homolog annotation: Hit_ID=Q8RXK6; Match level="QueryCoverage=67%, HitCoverage=12%, E-value=3e-24, Identity=90%"; Hit description=DEAD -box ATP-dependent RNA helicase 8
MGIYEKGFERPSPIQEESIPIALTGSDILARAKNETGKTAAFCIPALEKIDQDNNVIQGLMPSSSSLALSFSHDSHSLVERIVFKDVSVP

SEQ ID NO: 206479 - protein, 333 aa, Glycine max
  Coding DNA Sequence Number=SeqID_89701
  Gene Ontology: Mol. function=nucleic acid binding; Cellular component= intracellular; Biological process=regulation of transcription
  Homolog annotation: Hit_ID=Q1RV65; Match level="QueryCoverage=91%, HitCoverage=83%, E-value=1e-124, Identity=71%"; Hit description=Zinc finger, C2H2-type
  Pfam annotation: Domain name=zf-C2H2; Domain location=92-115; Score =17.3; E_value=0.054; Accession=PF00096.16; Description=Zinc finger, C2H2 type
MVKNSQGIYAPKNDKVVVLWDLDNKPPRGAPYDAAVSLKTLAARFGHLVDFSAYANRHAFVHLPQWVLHQRRHRRNLDILERKGVITPPEPYTCGVCGRKCKTHLDLKKHFKQLHQRERQKKLNRLKSLKGKKRHRFKERFLRGNHKYDDAARTLVVPKVGYGLAAELRRAGVFVKTVQDKPQAADWALKRQMVHSMSRGIDWLFLVSDDSDFSEMLRRAREADLGTVVVGDWDKALGRHADLWVPWSGVENGEVGDLLPKRRRENSRRREQGEEHGFGLEDDDGGVFLNEDEELGQEFMLLYSEDEDEDVDVEDYYDDDDDDEEEEDGFYIL

SEQ ID NO: 206480 - protein, 491 aa, Glycine max
  Coding DNA Sequence Number=SeqID_89702
  Gene Ontology: Mol. function=drug transporter activity; Cellular component=membrane; Biological process=multidrug transport
  Homolog annotation: Hit_ID=Q1SP70; Match level="QueryCoverage=99%, HitCoverage=88%, E-value=0.0, Identity=66%"; Hit description =Tetratricopeptide-like helical
  Pfam annotation: Domain name=PPR; Domain location=150-184; Score =11.3; E_value=0.34; Accession=PF01535.11; Description=PPR repeat
  Pfam annotation: Domain name=PPR; Domain location=185-219; Score =10.5; E_value=0.42; Accession=PF01535.11; Description=PPR repeat
  Pfam module annotation: Pfam domain module=PPR::PPR; Domain location =150-184::185-219
  Subcellular localization annotation: CTP_CleavageSite=57; ConfidenceScore=5.54e-01
MARLAPPFSIFRQSHYWRPLLSSHNAKRTLTAATNFSITSLARTPKSRDEGTTTIVKLSSKARRKAFYESPEGVLLRKLNECSKDGNVAQALCHYDEARKLGVLLNLDHYNKLLYLCSIESAAGFPNLGLKRGFEVFQQMLNDRVQPNEATFTNAARLAAANEDPDMAFELLKQMKNVAIAPKLRSYEPALFGFCKRGDAEKAYLVDADMVESGIVAEEPELSALLEVSVNAKKEDKVYDILHRLRSTLRQVSESTLGIVEDWFNSEYAAKIGKEKWDVKKVREGIAQGGGGWHGQGWLGSGRWKVANTQVNEDGVCPLCGEKLVSIDIDPKETENFAASLSKLACQKEAKANFVHFQTWLEQHGPFDAVVDGANVGLANGHNFSFSQLNTVVEQLRQISPSKRLPLIILHISRVRGGPAQNPKNMRLIENWKKNGALYATPQGSNDDWYWLYAAVSCKCLLLTNDEMRDHLFQLLGSNFFPRWKEKHQVI

SEQ ID NO: 206481 - protein, 516 aa, Glycine max
  Coding DNA Sequence Number=SeqID_89703
  Gene Ontology: Mol. function=transferase activity, transferring nitrogenous groups; Cellular component=endoplasmic reticulum; Biological process=sphingolipid biosynthetic process
  Homolog annotation: Hit_ID=Q94IB8; Match level="QueryCoverage=95%, HitCoverage=99%, E-value=0.0, Identity=65%"; Hit description=Serine palmitoyltransferase
  Pfam annotation: Domain name=Aminotran_1_2; Domain location=142-504; Score=128.3; E_value=2.2e-35; Accession=PF00155.11; Description =Aminotransferase class I and II
  Pfam annotation: Domain name=Aminotran_3; Domain location=130-427; Score=-196.2; E_value=0.079; Accession=PF00202.11; Description =Aminotransferase class-III
  Pfam annotation: Domain name=Aminotran_5; Domain location=160-478; Score=-200.9; E_value=0.044; Accession=PF00266.9; Description =Aminotransferase class-V
  Pfam module annotation: Pfam domain module=Aminotran_1_2::Aminotran _3::Aminotran_5; Domain location=142-504::130-427::160-478
VLKVSLGIFDCDIDTVMASAVVNFLNATLDWMTFASDGPSARAVVFGVHIGGHLFIEVFLLVVILFLLSQKSYKPPKRPLTNKEIDELCDEWVPEPLIPSVNKELQYEPPVLERESSSALVRFPPWHDGVGAAGPHTIINGKEVVNFASANYLGFIGHPKLLDSCSSALAKYGVGSCGPRGFYGTIDVHLDCEARIAKFLGTPESILYSYGLSTMFSAIPAFSKKGDIIVADEGVHWGIQNGLYLSRSTVVYFKHNDMDALRETLENITSKYKKTKNLRRYIVVEAVYQNSGQIAPLDEIIKLKEKYRFRVLLDESNSLGVLGSSGRGLTEHCGVPVEKIDIITAAMGHALATEGGFCTGSTRVIDHQRLSSSGYVFSASLPPYLASAAITAIDVLEENPNLIKKLKKNIAFLRKGLSKIPGITIASNPESPIVYLRLEKSRGSVKDDLHLLENIAERVLNEESVFVVVSKRSTLDKCRLPVGIRLFVSAGHSESDLLKASESLKRVVASVLGGHN

SEQ ID NO: 206482 - protein, 47 aa, Glycine max
  Coding DNA Sequence Number=SeqID_89704
MVGCGGGGANDTIVEGVVCVEPWRLRFKFRAKMVSLDGGTVRGSGVM

SEQ ID NO: 206483 - protein, 74 aa, Glycine max
  Coding DNA Sequence Number=SeqID_89705
MDGLEHQQQQNISTRLFQRGWGPEPLELRLEFNGAAACGLVELLLDVVVEVLNGVVLVVEFEDLDEAVDESQEC

SEQ ID NO: 206484 - protein, 156 aa, Glycine max
  Coding DNA Sequence Number=SeqID_89706
  Gene Ontology: Mol. function=metalloendopeptidase activity; Biological process=proteolysis
  Homolog annotation: Hit_ID=Q5JKR1; Match level="QueryCoverage=99%, HitCoverage=16%, E-value=3e-54, Identity=65%"; Hit description =Chloroplast processing enzyme-like protein
MTSSCKRKGIIEALESMLIEVARVRLHGFSEREISVVRALLMSEIESAYLERDQIQSTSLRDEYLPHFLHNEPVVGIEYEAQLQKTLLPQVCKCSEKLRTSCSCVIKTIEPQPFAMLDDLKNVVKKVNPLEEEGRISPWDDEHVPQEIVTTKPNMG

SEQ ID NO: 206485 - protein, 239 aa, Glycine max
  Coding DNA Sequence Number=SeqID_89707
  Homolog annotation: Hit_ID=Q1SP02; Match level="QueryCoverage=33%, HitCoverage=16%, E-value=1e-09, Identity=44%"; Hit description=IMP dehydrogenase/GMP reductase
  Pfam annotation: Domain name=DUF1723; Domain location=83-132; Score =31.3; E_value=3.4e-06; Accession=PF08330.1; Description=Protein of unknown function (DUF1723)
DPSYKDSIPSHERDDAGERHRRLTVLACGWRHSLTKLEACPFDRIIGPPFGRGPVLPFPTEPTVRAIMLRLGLSDIVTVQYPVANKVFVDALVEKKHQETSSFHLPVREMTITLDDVSCLMHLPMISRPFDHVPSIFSKEVMKFLLMTRLGILIEKKAIEVSIAGPKPRIDALDELVASRWKPTQRHKGVRPFPQQTLFFDFIRCETNEGFNVGCNLERQRKRVVKDGGKGGRKGGKGR

SEQ ID NO: 206486 - protein, 361 aa, Glycine max
  Coding DNA Sequence Number=SeqID_89708
  Gene Ontology: Mol. function=receptor activity
  Homolog annotation: Hit_ID=Q1SQZ7; Match level="QueryCoverage=98%, HitCoverage=84%, E-value=1e-116, Identity=61%"; Hit description =SPla/RYanodine receptor SPRY
MGRVIHVAVVAASLGCVSTLLLVFIWRLCHHKKEHKDFVEANRITRMESLQAGIARLHQQPSIYHQFDHKNKNKGKFYVFHNGVSRRGHLFNWDDHPYLVVDAVENGWSRFAFSNYKSNMTSHLKRSTLLGACAAGEYGMKTNAEISWEVCNGSAEYMQKIRLNPGLKKVLHTNNSSNMSVASVIRTVLPLPGPPLGNYAFPQEAYFEITILFSHIDDHELVVAKREGEKTKLLIEDGSNGASELDTVEEMKLGQKEGGEKSGSVMFSLGLTAGGGVPLTVPGSYPRSIGFNSNGSVFLEGMKLVMESEKAQWIGTDRVIGCGFDPRQKKCIQICTCKCAKNTKSMLHSPTCEFPWCYPWL

SEQ ID NO: 206487 - protein, 129 aa, Glycine max
  Coding DNA Sequence Number=SeqID_89709
  Gene Ontology: Mol. function=transferase activity, transferring hexosyl groups; Cellular component=integral to membrane; Biological process=electron transport
  Homolog annotation: Hit_ID=Q5TIN3; Match level="QueryCoverage=56%, HitCoverage=22%, E-value=9e-30, Identity=90%"; Hit description=Alpha- 1,6-xylosyltransferase
  Subcellular localization annotation: CTP_CleavageSite=33; ConfidenceScore=5.31e-01
MAPSLYRPKPSKAMPVNIASLSIHQRNSTSGVQKSHVVENLNPVDLAVVNLVLDRFDKVVVSNRVFTRFRERTGYKEDAGFVGSDEVVVEIGNGFGLLFSPAPACELADADGAAEDNQREEEAEERHRA

SEQ ID NO: 206488 - protein, 81 aa, Glycine max
  Coding DNA Sequence Number=SeqID_89710
  Subcellular localization annotation: CTP_CleavageSite=68; ConfidenceScore=5.44e-01
MASMDTSAMVNSKIFPCNLGMRGSGEFVPFLDTTSRGSKMPQRTFLRRRHGPSVGLFTVGIKTEPICNAYAKRHNAGMYTV

SEQ ID NO: 206489 - protein, 268 aa, Glycine max
  Coding DNA Sequence Number=SeqID_89711
  Homolog annotation: Hit_ID=Q8TGM6; Match level="QueryCoverage=44%, HitCoverage=97%, E-value=1e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 206490 - protein, 107 aa, Glycine max
  Coding DNA Sequence Number=SeqID_89712
MEKWGLGTNECNQGASLQRLSEECEMRYKDMPPAPFISFKWVQLCQLRGCGGLLLKQELLSGKGCLVYRTYSARGRAVRTPKIAIVKCSKEIQEKEEVMVSSCVTSA

SEQ ID NO: 206491 - protein, 74 aa, Glycine max
  Coding DNA Sequence Number=SeqID_89713
MITSGPLLDLMHDWEIYRSEKPGQGISKILFNVSAEEPSSAVNVTTVEELPLQEATEEGYSTVTLTVEEPSSVS

SEQ ID NO: 206492 - protein, 66 aa, Glycine max
  Coding DNA Sequence Number=SeqID_89714
MGELGDDKHFLAHIQTYHQLLHQTVKSLASLLIYNCNCPIYKANEKYRPKNSLSQIPQKYIQMHHI

SEQ ID NO: 206493 - protein, 112 aa, Glycine max
  Coding DNA Sequence Number=SeqID_89715
  Gene Ontology: Mol. function=transferase activity; Cellular component= cytoplasm; Biological process=glutamine metabolic process
  Homolog annotation: Hit_ID=Q6ETL5; Match level="QueryCoverage=83%, HitCoverage=31%, E-value=2e-16, Identity=52%"; Hit description =Putative glutamine amidotransferase class-I domain-containing protein
MDKRSNTSALSISPRVHVLCRALGGRVGKSNRGWDIGFRQVHFMKDLARSYSYLEDHEMMTESLSIVEVHQYVVFEVPLGAQVIGSSDKTGVEMFAIADHTFLEFRVILSIA

SEQ ID NO: 206494 - protein, 153 aa, Glycine max
  Coding DNA Sequence Number=SeqID_89716
MPYHSARFINEMQHTILSESESESKYPSNFKPQDNTGSSESSIIHSVIAVIVARSSSDVVLDPLGDLVLFVVKALVESKPAESPSNSANGEASAEAHFGRLGHGVISGGVIKRSRRPTGPSVTVEEGSRGGRGRSARIVSGVVIRIGVSVRGV

SEQ ID NO: 206495 - protein, 79 aa, Glycine max
  Coding DNA Sequence Number=SeqID_89717
MFVLNSALKEFDDTLQSKPKVAARWIVVKCNRQKGSTECECYVMHWMSTIILGSFKNNWETYFNDTRLLELERLKALRI

SEQ ID NO: 206496 - protein, 385 aa, Glycine max
  Coding DNA Sequence Number=SeqID_89718
  Gene Ontology: Mol. function=transcription factor activity; Cellular component=nucleus; Biological process=regulation of transcription, DNA-dependent
  Homolog annotation: Hit_ID=Q1T072; Match level="QueryCoverage=98%, HitCoverage=98%, E-value=1e-125, Identity=63%"; Hit description =Pathogenesis-related transcriptional factor and ERF
  Pfam annotation: Domain name=AP2; Domain location=169-234; Score =100.6; E_value=4.6e-27; Accession=PF00847.10; Description=AP2 domain
  Pfam annotation: Domain name=AP2; Domain location=47-140; Score=91.8; E_value=2.1e-24; Accession=PF00847.10; Description=AP2 domain
  Pfam module annotation: Pfam domain module=AP2::AP2; Domain location =169-234::47-140
  Subcellular localization annotation: CTP_CleavageSite=35; ConfidenceScore=5.42e-01
MAKKSQLRTQKNNATNDDINLNATNTVITKVKRTRRSVPRDSPPQRSSIYRGVTRHRWTGRYEAHLWDKHCWNESQNKKGRQDYILITRVVISKFMVIKQVLYHPGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNTNSNNDQISINLTNINNNCTNNFIPNPDQEQEVSFFHNQDSLNNTIVEEATLVPHQPRPASATLALELLLQSSKFKEMVEMTSVANLSTQMESDQLPQCTFPDHIQTYFEYEDSNKYEEGDDLLFKFSEFSSIVPFYHCDEFES

SEQ ID NO: 206497 - protein, 244 aa, Glycine max
  Coding DNA Sequence Number=SeqID_89719
  Gene Ontology: Mol. function=binding; Cellular component=integral to membrane; Biological process=transport
  Homolog annotation: Hit_ID=Q8L9P5; Match level="QueryCoverage=86%, HitCoverage=54%, E-value=2e-43, Identity=49%"; Hit description =Putative peroxisomal membrane carrier protein
  Pfam annotation: Domain name=Mito_carr; Domain location=35-175; Score= 60.1; E_value=7.5e-15; Accession=PF00153.17; Description =Mitochondrial carrier protein
MAQGVYYYLYQIFRNKAEAAALQQKKMGVGDGSVGMLSSLVVAVLSGSVTVLLTNPIWVVATRMQNKEIIKTITEHFYFLSYKLKYFQKYFNFTHRKELNRTPADQGLLVSTEQPILSAVEHLPYGTSQVIQDIYSEAGILGFWKGVLPTLIMVSNPSIQFMLYEAMLVKLRKRRAWSKKGSNGVTALEIFLIGALAKLGATVVTYPILVVKDLGGNMVFYQLESFKPRAMNASLSALKSAGVE

SEQ ID NO: 206498 - protein, 341 aa, Glycine max
  Coding DNA Sequence Number=SeqID_89720
  Gene Ontology: Mol. function=receptor activity; Cellular component =integral to membrane; Biological process=response to sucrose stimulus
  Homolog annotation: Hit_ID=Q84N34; Match level="QueryCoverage=95%, HitCoverage=93%, E-value=1e-101, Identity=56%"; Hit description=HHP2
  Pfam annotation: Domain name=HlyIII; Domain location=56-323; Score =242.8; E_value=7.2e-70; Accession=PF03006.10; Description=Haemolysin- III related
MISLRRSVNKIPAKSKRFKCRLVKFEELPEYLKDSEFILDYYRSEWPVKEALWSIFAWHNETLNIWTHIGGFLIFAVLAAMSTTSELWNLLRSSTALGLSTTTAAEMNGSNSDAFPDLHFRHVLDPSILGEMKGSGVETVPRWPWFVFLAGGMGCLACSSLSHLLACHSKGFNLFFWRLDYAGISLMIVSSFFAPIYYAFFCNPNARLFYLASISVLGVLAIITLLAPSLSTPRFRPLRASLFLSMGFSGIIPAAHAVALYWGQPHIFVALGYELVMAILYATGAGFYVARVPERWKPGAFDIAGHSHQIFHVFVVLGALAHSVATLVILDFRLGSPTCAN

SEQ ID NO: 206499 - protein, 391 aa, Glycine max
  Coding DNA Sequence Number=SeqID_89721
  Homolog annotation: Hit_ID=Q00M75; Match level="QueryCoverage=7%, HitCoverage=5%, E-value=3e-09, Identity=100%"; Hit description=PPR -repeat containing protein
MEWMGFVWLGSENMVMGFRKLRSDLETVPFKLEIEEPLQEEHAPLNKRFKSSSTSQEQWNASNSASSSSPSQYNILDEPSPLGLRLRKSPSLLDLIEMKLSQGNVIIANTQNENFLSSGLKKESRGAAASDSVEKLKASNFPASLLRIGSWEYKSKHEGDLVAKCYFAKHKLVWEVLEGELKNKMEIQWSDIMALKANCPDTGPSSLTVVLARQPLFFKETNPQPRKHTIWQATSDFTEGEACKHRQHFLEFPQGLLAKHFEKLIQCDTHLNFLSQQPEIILDSPHFDTRPAAFENLDNPEDLDLHLVNCKGSTTSCLQDIGSPHSSLSPSFKIEHNDLLGIASDNLPCEAPFPSSGTPYPCICKEAVSGFEPMTNKSPRHNFTAAPGLAL

SEQ ID NO: 206500 - protein, 778 aa, Glycine max
  Coding DNA Sequence Number=SeqID_89722
  Gene Ontology: Mol. function=integrase activity; Cellular component =membrane; Biological process=DNA integration
  Homolog annotation: Hit_ID=Q1SL72; Match level="QueryCoverage=99%, HitCoverage=67%, E-value=0.0, Identity=80%"; Hit description =Ubiquitin
MNSCVTGSLVHQGQLLVHIAENGHSFELDCNENTLVESVMRSIESVTGINFSDQLVLCLDMKLESQRQLSAYKLPSDDREVFIFNKTRLQNNSPVPPPEQVDIPSHLEPPLPASSHDPHPLDDASDPALKALPSYERQFRYHYHQGHVIYTGTMMKYEHCERLLREQMVQERAVEVARGNLDQYYRMINQNYVDFMKRYMQQHRMHSDLLVNFGKDVEKLRSIKLHPALQTANRKCLLDLVKEENLRKSVENCTCSHRQFENKVTQFKQTFGEVKRRAEELLSSRAFLPIKNLEQVIKEHQRYINEQKSIMQSLSKDVNTVKKLVDDCLSSQLSSSLRPHDAVSALGPMYDVHDKNHLPKMQTCDRAISKLVEFCKENKNEMNLFVHNYMQNITYVSYLIKDQKLQFPVFKEAMARQDGLFVDLKLFHGIGPAYRACLAEIVRRKASMKLYMGMAGQMAERLAIKREAELRRREEFLRVHSSCIPKEVLASMGLFDTPNQCDVNIAPFDGGLLNIDISDVDHYAPEYLTGVTSKLEKQGSVKSSSALSSDSSHLAEAVDITGDSIERYDSEDLLDGSELIEIAGTCKMEVENAKLKAELAGRIALICSLCPELEYESLDDERVNNILKNATEKTEEALHLKDEYIKHVQSMLKMKQMQCVSYEKRIQELEQKLSDQYVQGQKMSSVNDTADFPLVAGKTDNYKSESISGEANMPCISTSEPMDEVSCISSSLDAKLGLFTEHTGKALDGVDENMLDSSGVQNPQLDSSMMEPHREEAQ

SEQ ID NO: 206501 - protein, 65 aa, Glycine max
  Coding DNA Sequence Number=SeqID_89723
MAVTVSLIIFIRLVSIEEIHAKNYMLDSLVLNENSHLSIFKAQIIPTHRVLLGAPSIIAGAPSIL

SEQ ID NO: 206502 - protein, 211 aa, Glycine max
  Coding DNA Sequence Number=SeqID_89724
  Gene Ontology: Mol. function=RNA-directed DNA polymerase activity; Biological process=RNA-dependent DNA replication
  Homolog annotation: Hit_ID=Q2HVE2; Match level="QueryCoverage=78%, HitCoverage=21%, E-value=3e-11, Identity=31%"; Hit description =Ribonuclease H
MARELISKLDDLWVKGLRVKYRVEIVSSLMLSSGQMTLKLGRELKTNVRKVNCGIAQDHTFPLCLTHVETNFHVLRDFSVVRPIWEAFNNNWNDKLSLFFSFYMKEWIFMSMLSRRQKGRITFGLALATIWYAENDFIFNSQNWNVQSIAFTSLDVDQTMRLNINCLLVRHESMVTWKFPPGGLVKFNVDGLVRNSRTLAGYGGVLRNDEG

SEQ ID NO: 206503 - protein, 100 aa, Glycine max
  Coding DNA Sequence Number=SeqID_89725
  Homolog annotation: Hit_ID=Q8L6J3; Match level="QueryCoverage=37%, HitCoverage=3%, E-value=2e-09, Identity=78%"; Hit description=DNA -directed RNA polymerase 2B, chloroplast/mitochondrial precursor
MIKAYLPLNQPSSVLSILVTGDFLPGLSPNASWVKVIMLPYKEAWRFHIKKPGDSRTFCNVQLKKYGDSRTFCKSKSPLLSGSGGKANPGYDVSKPSSNC

SEQ ID NO: 206504 - protein, 991 aa, Glycine max
  Coding DNA Sequence Number=SeqID_89726
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=70%, E-value=0.0, Identity=46%"; Hit description =Integrase, catalytic region
  Pfam annotation: Domain name=rve; Domain location=158-318; Score =155.6; E_value=1.3e-43; Accession=PF00665.16; Description=Integrase core domain
  Pfam module annotation: Pfam domain module=RVT_2::rve; Domain location=482-739::158-318
MPNGDTVTTTIAGSVLLYDSLVLHNVYYFPSFHANIISVTTLFDSTLYDVKLYPNCCKIVQLLHPKMTGFTTRRIGKLYVLDTTSPLVFSPTTGFVNTSISHDPATIWHFRLGHLSSHIHKCISSYFPFVTFNDNHKPCNTCHLAKQRNLPFAHSTTKFVAIFDLIHADIWGPLSSPSIFGHKYFLTLVDDYSRFTWTIFMRNKSETRTHLVNFISFIETQFNKKLKCIRSDNGPEFLMTSFYLSKGIIHHRSCVETPQQNGIVERKHQHILNVARALSFHSHLPHNLWHLSTQQAIHIINRLPTPLLNNLTPYQMLHSTPPSLHHLRVFGCLAYSSTLHNHRTKFAPRARKSIFLGYREGTKGYLLYDPITHEFYVSRNVIFHEIVFPFASPPPANNPVSVNLDITTLDTSDILLDLPLSLPPPNEPTSPPAPTRKSHRLTKPPAYLSEYHCNLLSSMLPASNPEPKTYKQACKFDCWNLAMKSELDALASTNTWFVVDLPEGKQPIGCKWVYKIKHHADGSIERYKARLVAKGYTQLEGVDYFDTFSPVAKLTTIRTLLSVAAIKDWHLEQLDVNNAFLHGDLHEEVYMDLPPGFLLPGSSSNKVCKLHKSLYGLKQASRQWFSKLSTALISLGYSPSSADHSLFTKLHNSHFTALLVYVDDIVLTCDDLQEIQSVKQFLDSTFKIKDLGKLKYFLGLEIARSMQGIFLNKRKYALELLEDSGLLATKPSTTPFDCSLKLHDSDSPPYEEEITYRRLVGRLLYLTTTRPDIAFIVQQISQFISQPLQVHHSAAIRVLKYLKSAPAKGLFYSSSSTLKLSGFADSDWASCPVTRRSVTGYCVFLGTSMLSWKSKKHSTVSRSSSEAEYRALASLTCELQWLQYLFKDLHISLDQPISVYCDNKSAIYLAHNPIFHERTKHIEIDCHVIREKIQTGLIHLLPVSSAAQLADVLTKPLPAPSFNSLISKLGLLDIHSPACGGLLHDVNSNSS

SEQ ID NO: 206505 - protein, 116 aa, Glycine max
  Coding DNA Sequence Number=SeqID_89727
  Gene Ontology: Mol. function=DNA-directed RNA polymerase activity; Cellular component=chloroplast; Biological process=transcription
  Homolog annotation: Hit_ID=P69243; Match level="QueryCoverage=71%, HitCoverage=11%, E-value=1e-20, Identity=61%"; Hit description=DNA -directed RNA polymerase 3A, chloroplast precursor
MNSYRWGRKDTGGKFCFTEISFYVLGCSCCNIASIAMLGFISSWKRLEVTRVQKLLKEEESGPWGRDIQAKLGSRLIELLIETAFVHSPVNQSADTPPDIRPAFSHRFKAISKNPE

SEQ ID NO: 206506 - protein, 931 aa, Glycine max
  Coding DNA Sequence Number=SeqID_89728
  Gene Ontology: Mol. function=protein kinase activity; Cellular component=integral to membrane; Biological process=protein amino acid phosphorylation
  Homolog annotation: Hit_ID=Q1T089; Match level="QueryCoverage=99%, HitCoverage=95%, E-value=0.0, Identity=73%"; Hit description=Protein kinase
  Pfam annotation: Domain name=LRRNT_2; Domain location=34-75; Score =31.8; E_value=2.3e-06; Accession=PF08263.3; Description=Leucine rich repeat N-terminal domain
  Pfam annotation: Domain name=LRR_1; Domain location=104-126; Score =17.9; E_value=0.037; Accession=PF00560.23; Description=Leucine Rich Repeat
  Pfam annotation: Domain name=LRR_1; Domain location=128-150; Score =12.1; E_value=1.5; Accession=PF00560.23; Description=Leucine Rich Repeat
  Pfam annotation: Domain name=LRR_1; Domain location=152-174; Score =15.1; E_value=0.26; Accession=PF00560.23; Description=Leucine Rich Repeat
  Pfam annotation: Domain name=LRR_1; Domain location=177-198; Score =7.6; E_value=11; Accession=PF00560.23; Description=Leucine Rich Repeat
  Pfam annotation: Domain name=LRR_1; Domain location=202-224; Score =4.7; E_value=37; Accession=PF00560.23; Description=Leucine Rich Repeat
  Pfam annotation: Domain name=LRR_1; Domain location=226-249; Score =10.5; E_value=3.1; Accession=PF00560.23; Description=Leucine Rich Repeat
  Pfam annotation: Domain name=LRR_1; Domain location=251-278; Score =12.6; E_value=1.2; Accession=PF00560.23; Description=Leucine Rich Repeat
  Pfam annotation: Domain name=LRR_1; Domain location=283-305; Score =10.6; E_value=2.9; Accession=PF00560.23; Description=Leucine Rich Repeat
  Pfam annotation: Domain name=LRR_1; Domain location=308-330; Score =11.0; E_value=2.5; Accession=PF00560.23; Description=Leucine Rich Repeat
  Pfam annotation: Domain name=LRR_1; Domain location=332-354; Score =16.8; E_value=0.08; Accession=PF00560.23; Description=Leucine Rich Repeat
  Pfam annotation: Domain name=LRR_1; Domain location=356-378; Score =15.1; E_value=0.25; Accession=PF00560.23; Description=Leucine Rich Repeat
  Pfam annotation: Domain name=LRR_1; Domain location=380-402; Score =15.3; E_value=0.22; Accession=PF00560.23; Description=Leucine Rich Repeat
  Pfam annotation: Domain name=LRR_1; Domain location=404-426; Score =15.8; E_value=0.15; Accession=PF00560.23; Description=Leucine Rich Repeat
  Pfam annotation: Domain name=LRR_1; Domain location=428-450; Score =19.5; E_value=0.012; Accession=PF00560.23; Description=Leucine Rich Repeat
  Pfam annotation: Domain name=LRR_1; Domain location=477-499; Score =1.4; E_value=1.6e+02; Accession=PF00560.23; Description=Leucine Rich Repeat
  Pfam annotation: Domain name=LRR_1; Domain location=501-523; Score =17.1; E_value=0.063; Accession=PF00560.23; Description=Leucine Rich Repeat
  Pfam annotation: Domain name=LRR_1; Domain location=525-547; Score =9.7; E_value=4.4; Accession=PF00560.23; Description=Leucine Rich Repeat
  Pfam annotation: Domain name=LRR_1; Domain location=549-573; Score =10.9; E_value=2.6; Accession=PF00560.23; Description=Leucine Rich Repeat
  Pfam annotation: Domain name=LRR_1; Domain location=80-102; Score =3.1; E_value=76; Accession=PF00560.23; Description=Leucine Rich Repeat
  Pfam annotation: Domain name=Pkinase; Domain location=671-922; Score =87.5; E_value=4.2e-23; Accession=PF00069.15; Description=Protein kinase domain
  Pfam annotation: Domain name=Pkinase_Tyr; Domain location=671-893; Score=42.8; E_value=4.3e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=34-75::104 -126::128-150::152-174::177-198::202-224::226-249::251-278::283 -305::308-330::332-354::356-378::380-402::404-426::428-450::477 -499::501-523::525-547::549-573:...
  Pfam module annotation: =:80-102::671-922::671-893
MMCLFRIFRSIVLLFFFLGTVQSRVLHGKENAGIVNGKNSLISFMSGIVSDPQNALKSWKSPGVHVCDWSGVRCNNASDMIIELDLSGGSLGGTISPALANISSLQILDLSGNYFVGHIPKELGYLVQLGQLSLSGNFLQGHIPSEFGSLHNLYYLNLGSNHLEGEIPPSLFCNGTSLSYVDLSNNSLGGEIPLNKECILKDLRFLLLWSNKLVGQVPLALAYSTKLKWLDLELNMLSGELPFKIVSNWPQLQFLYLSYNNFTSHDGNTNLEPFFASLVNLSHFQELELAGNNLGGKLPHNIGDLPTSLQQLHLEKNLIYGSIPPQIGNLVNLTFLKLSSNLLNGSIPPSLGHMNRLERIYLSNNSLSGDIPSILGDIKHLGLLDLSRNKLSGPIPDSFANLSQLRRLLLYDNQLSGTIPPSLGKCVNLEILDLSHNKITGLIPAEVAALDSLKLYLNLSNNNLHGSLPLELSKMDMVLAIDVSMNNLSGSVPPQLESCTALEYLNLSGNSFEGPLPYSLGKLLYIRALDVSSNQLTGKIPESMQLSSSLKELNFSFNKFSGRVSHKGAFSNLTIDSFLGNDGLCGRFKGMQHCHKKRGYHLVFLLIPVLLFGTPLLCMLFRYSMVTIKSKVRNRIAVVRRGDLEDVEEGTEDHKYPRISYKQLREATGGFSASSLIGSGRFGQVYEGMLQDNTRVAVKVLDTTHGEISRSFRREYQILKKIRHRNLIRIITICCRPEFNALVFPLMPNGSLEKYLYPSQRLDVVQLVRICSDVAEGMSYLHHYSPVKVVHCDLKPSNILLDEDMTALVTDFGISRLVQSDENTSINESASFSSTHGLLCGSVGYIAPDSLYILYYTFLDTEYGMGKHASTEGDVDAPQMYSAMKAQACVSGLKSNTHTNTNLKTLLNKHCKGSLLVACQTIVTKFGKMLY

SEQ ID NO: 206507 - protein, 141 aa, Glycine max
  Coding DNA Sequence Number=SeqID_89729
  Homolog annotation: Hit_ID=Q76FZ8; Match level="QueryCoverage=32%, HitCoverage=3%, E-value=3e-08, Identity=63%"; Hit description =Brassinosteroid receptor
MKLLKLRSSDSKVERAEEAVEGHLEFLEDGHLRENVHRQCATEEVAGDVEGLNIGARVERGREESGRGSRRRSSRRRGRGRDKAWKKKAASANGGIMGTASSNSGTSWLSRSEKWVPPFLLAGHAYVGSPAFGVGGIGAKK

SEQ ID NO: 206508 - protein, 486 aa, Glycine max
  Coding DNA Sequence Number=SeqID_89730
  Homolog annotation: Hit_ID=Q9ZUH9; Match level="QueryCoverage=39%, HitCoverage=50%, E-value=4e-15, Identity=33%"; Hit description =Expressed protein
  Pfam annotation: Domain name=DUF593; Domain location=6-99; Score =153.2; E_value=6.9e-43; Accession=PF04576.6; Description=Protein of unknown function, DUF593
MAESDIRAMKETLRAQQQLLQKLYAELDEEREASATAASEAMDMIVRLQGEKAAVKMEASHYKRMAEEKIGHAEATLEVFEELMYQKEMEITSLEYQVLAYKNKLLTLGSDFNASDFEFDEDLLLSRNDQQQNGENGQACSTVRRLSSLPPIPLKNNLRSARKRDRSPSPVPVPDMVHNIMESDTDQEVTSPSLDLPRKSVDYGHGTLDAYWNQIQTLDEKVKVISDCKESGGEKRTTLRSRRGRSCSVFSQASTKITCDLTDRVGPTCSDKVNHSEGTYDGEAVAIPSCSGNVHDVFEVPQTSEKHKASGNGKRRLERWSSDADNRLTKPDSVSEEVIESHVKHDMDKLKSMMISGNHEIKIPSPKDMKTIVWQRKEGMDGDCNAHAEFQKLHQRIDQLERETINARKEIMHEVNGKEHVRLLKDICSQLKLMESEMRSWKTQKAPPKSSKRDNCLDPLQEVMHTLVLLPSFEKNCLLHANISFI

SEQ ID NO: 206509 - protein, 169 aa, Glycine max
  Coding DNA Sequence Number=SeqID_89731
  Gene Ontology: Mol. function=calcium ion binding
  Homolog annotation: Hit_ID=Q1SL75; Match level="QueryCoverage=63%, HitCoverage=62%, E-value=3e-32, Identity=76%"; Hit description =Calcium-binding EF-hand
MKAWKVREASRGRVGGGRGMKFGKIVEFGVFARKKRNGMGGCAAIGVEVFMACSGSNVSAELVEDAGWVELQGICCLLVRLQSPATLHHKIESKQVYDSDCNGKVTFHDMLRALRDLSGPFMSDQQREEVLTQVLEEAGYAKDCSLVLSDFMKILGNSGLKMEVEVPVD

SEQ ID NO: 206510 - protein, 261 aa, Glycine max
  Coding DNA Sequence Number=SeqID_89732
  Gene Ontology: Mol. function=chromatin binding; Cellular component =chromatin; Biological process=chromatin assembly or disassembly
  Homolog annotation: Hit_ID=Q1SAV4; Match level="QueryCoverage=64%, HitCoverage=43%, E-value=6e-39, Identity=47%"; Hit description =Integrase, catalytic region
  Pfam annotation: Domain name=Chromo; Domain location=186-236; Score =24.8; E_value=0.0003; Accession=PF00385.14; Description='chromo' (CHRromatin Organisation MOdifier
MRCEIPHRCVRRKYRIRRHSPFRLRNCWEGRSVRASSLLRQLAKGGCAARRLSWVTPGFSQSRRCKTTASAKLACLQVDSRGSPKRLADDKCRDVNFTVGQWVYVKLRPFRQRTVAGLIHPKLSKRYFGPFQAIERVGQVSYRLKLPEEARIHPVFHCSLLREHHGPSPTPLDSLPLQFIAQKPVARPLCILDSKIETSSSPPTRLVLVQWEGQPPEDTTWEKWSEIRDLHHLEDKVVFAGEGIVSNHLQDLEDRVPSSNS

SEQ ID NO: 206511 - protein, 134 aa, Glycine max
  Coding DNA Sequence Number=SeqID_89733
  Homolog annotation: Hit_ID=Q51614; Match level="QueryCoverage=32%, HitCoverage=83%, E-value=1e-09, Identity=72%"; Hit description=, complete genome
GAGAYGKTPATRPFYGSWPFAGLLLTCSFLRYPLILWITVLPPLSELIPLAAAERPSAARNSYDHDYEFELGTLVKRGVWNVYEFLASFALLCEVEGVFSECRLIPLWLQGSAPWHLSKDAVNPLLNSLPSRMM

SEQ ID NO: 206512 - protein, 76 aa, Glycine max
  Coding DNA Sequence Number=SeqID_89734
  Gene Ontology: Mol. function=sedoheptulose-bisphosphatase activity; Cellular component=chloroplast; Biological process=reductive pentose- phosphate cycle
  Homolog annotation: Hit_ID=P46285; Match level="QueryCoverage=99%, HitCoverage=53%, E-value=6e-10, Identity=82%"; Hit description =Sedoheptulose-1,7-bisphosphatase, chloroplast precursor (EC 3.1.3.37) ...
  Homolog annotation: Hit description=(Sedoheptulose-bisphosphatase) (SBPase) (SED(1,7)P2ase)
MGCPVEGGFIVAFDPLDGFSIVDTNFTVGTIFAPLRFLIEKAEGYNSDVHQSVLDKVITNIDEITQVAYGSKNEII

SEQ ID NO: 206513 - protein, 80 aa, Glycine max
  Coding DNA Sequence Number=SeqID_89735
MNSETLKRVLSERDKNLPMHTSVMDLCSEPFVSFRKQCLRIMFGFHNSFMGMDNDRPCTWTSLSLPITQTTIPPSTSNFN

SEQ ID NO: 206514 - protein, 469 aa, Glycine max
  Coding DNA Sequence Number=SeqID_89736
  Gene Ontology: Mol. function=nucleoside-triphosphatase activity; Cellular component=membrane; Biological process=transport
  Homolog annotation: Hit_ID=Q6K4D2; Match level="QueryCoverage=99%, HitCoverage=64%, E-value=1e-135, Identity=54%"; Hit description =Putative ABC transporter
  Pfam annotation: Domain name=ABC_tran; Domain location=97-289; Score =129.1; E_value=1.2e-35; Accession=PF00005.17; Description=ABC transporter
MASNIHDESVSSAPTRAYETKPSSKSIPQQSVIDIEATTLEMEAFRGPRKINGSAGETQKEEIGICLTWKDVWVTASNRKSGSKSILHGLTGYAKPGQLLAIMGPSGCGKSTLLDSLAGRLGSNTRQTGEILINGHKQALCYGTSAYVTQDDTLLTTLTVREAVHYSAQLQLPDTMSKEEKKERADFTIREMGLQDAINTRIGGWGCKGISGGQKRRVSICIEILTRPKLLFLDEPTSGLDSAASYYVMKRIAALAQNDHIQRTVIASIHQPSSEVFQLFHSLCLLSSGKTVYFGPASAAKEFFASNGFPCPPLMNPSDHLLKTINKDFDQDIEAGLAGTENILTEEVIHILVNSYKSSERNQEVQNEVALLSKKDTSSLDMKKGNAGFLNQCLVLTKRSFINMYRDLGYYWLRLVIYIALAITLATVFYDLGTSYDSIKDRGSLVAFINGFITFMTIGGFPSFVEVMK

SEQ ID NO: 206515 - protein, 127 aa, Glycine max
  Coding DNA Sequence Number=SeqID_89737
  Homolog annotation: Hit_ID=Q1SL83; Match level="QueryCoverage=84%, HitCoverage=13%, E-value=9e-38, Identity=72%"; Hit description =Tetratricopeptide-like helical
MQTHAEVVVGGSVDGECIGEVVGGEGGVFAEMGVEGNGGGVGGEGEAFDEDVEEEDVGFGNGEEEGTCVARGADVEELLGELSDGGEAVLVTVADELRVGFGKVREETYCLLPLDFGVENDMICQGW

SEQ ID NO: 206516 - protein, 436 aa, Glycine max
  Coding DNA Sequence Number=SeqID_89738
  Gene Ontology: Mol. function=metal ion binding; Cellular component =intracellular; Biological process=protein kinase C activation
  Homolog annotation: Hit_ID=Q1SL83; Match level="QueryCoverage=99%, HitCoverage=93%, E-value=0.0, Identity=51%"; Hit description =Tetratricopeptide-like helical
  Pfam annotation: Domain name=PPR; Domain location=174-208; Score =41.8; E_value=2.3e-09; Accession=PF01535.11; Description=PPR repeat
  Pfam annotation: Domain name=PPR; Domain location=209-242; Score=3.7; E_value=2.7; Accession=PF01535.11; Description=PPR repeat
  Pfam annotation: Domain name=PPR; Domain location=245-278; Score =13.3; E_value=0.2; Accession=PF01535.11; Description=PPR repeat
  Pfam annotation: Domain name=PPR; Domain location=97-131; Score=37.9; E_value=3.5e-08; Accession=PF01535.11; Description=PPR repeat
  Pfam module annotation: Pfam domain module=PPR::PPR::PPR::PPR; Domain location=174-208::209-242::245-278::97-131
MISGLSCNGETECAVNFFRELLVSGQRVSSSTMVGLIPVSSPFGHLHLACCIQGFCVKSGTVLHPSVSTALTTIYSRLNEIDLARQLFDESLEKPVAAWNALISGYTQNGLTEMAISLFQEMMATEFTLNPLIKSKNLEQNIYVLTALIDMYAKCGNISEAWQLFDLTSEKNTVTWNTRIFGYGLHGYGHEALKLFNEMLHLGFQPSSVTFLSVLYACSHAGLVRERDEIFHAMVNKYKIEPLAEHYACMVDILGRAGQLEKALEFIRRMPVEPGPAVWGTLLGACMIHKDTNLARVASERLFELDPGNVGYYVLLSNIYSVERNFRKAASVREVVKKINLSKTPGCTVIEVNGTPNIFVCGDRSHSQTTAIYAKLEELTGKMREMGYQSETVTALHDVEEEEKELMFNVLSEKLAIALGLITTEPGTEIRIIKNL

SEQ ID NO: 206517 - protein, 64 aa, Glycine max
  Coding DNA Sequence Number=SeqID_89739
MWHNNSGVVRLRLETKFMFYEGTLRLVGFEPPPSTNTLLNGSTTSASLVFGSCTEHIASDDVIQ

SEQ ID NO: 206518 - protein, 767 aa, Glycine max
  Coding DNA Sequence Number=SeqID_89740
  Gene Ontology: Mol. function=DNA binding; Cellular component=beta -galactosidase complex; Biological process=DNA integration
  Homolog annotation: Hit_ID=Q1SFD6; Match level="QueryCoverage=99%, HitCoverage=58%, E-value=1e-146, Identity=41%"; Hit description =Integrase, catalytic region
  Pfam annotation: Domain name=RVP; Domain location=249-343; Score= -14.2; E_value=0.096; Accession=PF00077.10; Description=Retroviral aspartyl protease
  Pfam annotation: Domain name=rve; Domain location=452-612; Score =143.9; E_value=4.3e-40; Accession=PF00665.16; Description=Integrase core domain
  Pfam annotation: Domain name=zf-CCHC; Domain location=117-134; Score =12.0; E_value=0.01; Accession=PF00098.13; Description=Zinc knuckle
  Pfam annotation: Domain name=zf-CCHC; Domain location=152-169; Score =11.4; E_value=0.013; Accession=PF00098.13; Description=Zinc knuckle
  Pfam module annotation: Pfam domain module=RVP::RVT_2::rve::zf -CCHC::zf-CCHC; Domain location=249-343::720-767::452-612::117 -134::152-169
MKQGSLTVTEYFTRLRVIWDEIENFRPDPICSCNIRCSCNAFTIIAQRKLEDRAMQFLRGLKEQYANIRSHVLLVDPIPAISKIFSYVAQQERQLLGNTEPGINFEPKDISINAAKTVCDFCGRIGHVESACYKKHGVPSNHDARNKSNGRKACTHCGKIGHTVDVCYRKRGYPPGYKPYSGRTTVNNVVAVESKATDDQPQHYESHEFVRFSPNQYKALLALIQEPSAGNTTLTQPKQVASISSCTINTPTNPGMSLSFRASLTSWILDSGATDHVTCSLHNLHSHKQINPITMKLPNGQYVHATHSGTVQLSSNITLHDVLYIPSFTFNLISISKLVSSINCELIFSSTSCVLQEMNNHMKIGIVEAKHGLYHLIPNQLTTKAVNSTITHPRCNVIPIDLWHFRLGHPSAERIQCMKTYYSLLRNNKNFVCNTCHYAKHKKMPFSLSNSHASHVLDLLHMDIWGPCSKPSMHGHKYFLTIVDDCSRFTWVHLMKSKAETRQVIMNFITFIETQYNGKVKIIRSDNGIEFFMHHYYASKGIIHQTTCVETLEQNGIVERKHQHLLNITRALLFQASLPPSFWCYALPHATHLINCIPTPYLHNISPYEKLHKHPCDISNLRVFGCLCNINTLKANRQKLDARAHPCIFIAPSPGPFSGKSLDPQIENRSSQPTISIPSSNEPSNEQPLPHLRNFVMSISSTAEPTSYAKASRHDCWIKAMKVELQALQSNNTWRLTPFPPHKTAIGCRWIYKIKYRADGSIERHKA

SEQ ID NO: 206519 - protein, 919 aa, Glycine max
  Coding DNA Sequence Number=SeqID_89741
  Gene Ontology: Mol. function=nucleotide binding; Cellular component =chloroplast; Biological process=response to heat
  Homolog annotation: Hit_ID=P26413; Match level="QueryCoverage=68%, HitCoverage=97%, E-value=0.0, Identity=92%"; Hit description=Heat shock 70 kDa protein
  Pfam annotation: Domain name=HSP70; Domain location=8-617; Score =1382.2; E_value=0; Accession=PF00012.10; Description=Hsp70 protein
  Pfam annotation: Domain name=IF3_N; Domain location=885-919; Score= -27.5; E_value=0.012; Accession=PF05198.6; Description=Translation initiation factor IF-3, N-terminal domain
  Pfam annotation: Domain name=MreB_Mbl; Domain location=6-393; Score= -252.3; E_value=0.029; Accession=PF06723.3; Description=MreBMbl protein
  Pfam module annotation: Pfam domain module=HSP70::IF3_N::MreB_Mbl; Domain location=8-617::885-919::6-393
MATKEGKAIGIDLGTTYSCVGVWQNDRVEIIPNDQGNRTTPSYVAFTDTERLIGDAAKNQVAMNPQNTVFDAKRLIGRRFSDSPVQNDMKLWPFKVVAGPGDKPMIVVNYKGEEKKFSAEEISSMVLVKMREVAEAFLGHAVKNAVITVPAYFNDSQRQATKDAGAISGLNVLRIINEPTAAAIAYGLDKKASRKGEQNVLIFDLGGGTFDVSILTIEEGIFEVKATAGDTHLGGEDFDNRMVNHFVSEFRRKNKKDISGNARALRRLRTACERAKRTLSSTAQTTIEIDSLYEGIDFYATITRARFEEMNMDLFRKCMEPVEKCLRDAKIDKSHVHEVVLVGGSTRIPKVQQLLQDFFNGKELCKSINPDEAVAYGASVQAAILSGEGDEKVQDLLLLDVTPLSLGLETAGGVMTVLIPRNTTIPTKKEQIFSTYSDNQPGVLIQVFEGERARTKDNNLLGKFELTGIPPAPRGVPQINVCFDIDANGILNVSAEDKTAGVKNKITITNDKGRLSKEEIEKMLKDAERYKAEDEEVKKKVEAKNSLENYAYNMRNTIKDEKIGEKLSPDEKEKIEKAVEDAIQWLEGNQLAEVDEFEDKQKELEGICNPIIAKMYQGAAARPGGDVPTGDDDMPGAGGAGSGAGPKIEEVSGIVNKVFFASCDECNIRDGVEINRARRRCWQERSSSPNRRVIVDAKGALHLHPHEIPFESHNQIAHKIPLEKPALYRHCDITSAAAVVLSGSSSPAFKELDGANKGFSGGGEGKSIGDDGIVDGSAGVGVDDDEVVCDNGPRAMAGITTFPFKLSHCPLFSTSDSKLFGLPLSNPYSIKFDPSSLSSTSLPYVTARYYGGGGGASPRSPNDPRSRKSSDSDDDDKALDLSTLRSDTVRLIDQSQNMVGVVSIDDAIQMAEDVELDLV

SEQ ID NO: 206520 - protein, 569 aa, Glycine max
  Coding DNA Sequence Number=SeqID_89742
  Gene Ontology: Mol. function=nucleoside-triphosphatase activity; Cellular component=membrane; Biological process=transport
  Homolog annotation: Hit_ID=Q6K4D2; Match level="QueryCoverage=99%, HitCoverage=81%, E-value=1e-173, Identity=54%"; Hit description =Putative ABC transporter
  Pfam annotation: Domain name=ABC2_membrane; Domain location=266-478; Score=139.6; E_value=8.7e-39; Accession=PF01061.14; Description=ABC -2 type transporter
  Pfam annotation: Domain name=ABC_tran; Domain location=1-187; Score =106.2; E_value=9.8e-29; Accession=PF00005.17; Description=ABC transporter
  Pfam module annotation: Pfam domain module=ABC2_membrane::ABC_tran; Domain location=266-478::1-187
MGPSGCGKSTLLDTLAGRLGSNTRQTGEILINGHKQSLAYGTSAYVTQDDTLLTTLTVREAVHYSAQLQLPDTMSKEEKKERADFTIREMGLQDAINTRIGGWGCKGISGGQKRRVNICIEILTRPKLLFLDEPTSGLDSAASYYVMRRIATLAQNDLIQRTVIASIHQPSSEVFQFFNNLCLLSSGKAVYFGPASGVSEFFASNGFPCPVLMNPSDHFLKTINKDFDQDIEVDISGNRKIPTEEAIHILDISSIDWKRGHAGFLNQCLVLTKRSFVNMRRDLGYYLLRLAIFVALAIALATIFYDLGTSYVSIQDRGSLVAFINGFLTFMTIGGFPSFVEVMKVFQRERQNGHYGVTAFVIGNTLSSIPYLLLITIIPGAIAYYLPGLHNGCEHFLYFICVLFSSLMLVESLMMIVASVVPNFLMGIMTGAGILGIMLLLGGFFKLPHDIPIPVWRYPLHFVAFHTFANRGMFKNEYEGLRFASNEVGGGYISGEEVLRYAWQVDMSYSKWVDLAILIGMIFLYRVLFLVIIKVKEKVRPVVVSLSCMSASSKRTIQVMENPNATPLH

SEQ ID NO: 206521 - protein, 108 aa, Glycine max
  Coding DNA Sequence Number=SeqID_89743
  Gene Ontology: Mol. function=nucleoside-triphosphatase activity; Cellular component=membrane; Biological process=transport
  Homolog annotation: Hit_ID=Q6K4D2; Match level="QueryCoverage=87%, HitCoverage=13%, E-value=8e-19, Identity=53%"; Hit description =Putative ABC transporter
MSSILQPNASDCESNNSSKILPPLLEFDTSFEVELERIKSVETGKDGEEDQEEGVFLTWEDLWVTVSNGKNGRKPILQGLKGYAKPGKLLAIMGPSGCGKSTLLDALA

SEQ ID NO: 206522 - protein, 192 aa, Glycine max
  Coding DNA Sequence Number=SeqID_89744
  Homolog annotation: Hit_ID=Q9FJM6; Match level="QueryCoverage=88%, HitCoverage=46%, E-value=5e-45, Identity=53%"; Hit description =Arabidopsis thaliana genomic DNA, chromosome 5, P1 clone:MTI20
MQAHGQSPTLILKLLMSRILNLELVEGIINSLVTRLIRQMCSSLSETGSQHTGTNAQFCIQHLIRKLGSEPYIGQRAILSVCQRILVLAERLLFSDPFDDGFPNMHESMFIMIQLIEFLVTDYLSEWSKAEDFDNLLLEDWVTSIVQLRKALELLESRNGLYALYMDRVTGKTVTEKNEKTNVVPGNGTYVS

SEQ ID NO: 206523 - protein, 130 aa, Glycine max
  Coding DNA Sequence Number=SeqID_89745
MATPIEQSAKNPPTVSWNLEGRAYGSTCTEDTGDFRTSKPEQKEPKPMHGMIMGSSKPCSQRKFPELHAARYTRISRLGKAVYRGPSNLRPRNVRNASNSNSIKPPSLFMAALGHLVFGLLLVPCFYRIT

SEQ ID NO: 206524 - protein, 161 aa, Glycine max
  Coding DNA Sequence Number=SeqID_89746
  Gene Ontology: Mol. function=protein binding
  Homolog annotation: Hit_ID=Q1RZC4; Match level="QueryCoverage=66%, HitCoverage=36%, E-value=7e-43, Identity=74%"; Hit description =Cyclin-like F-box
  Pfam annotation: Domain name=F-box; Domain location=12-60; Score =30.0; E_value=8.6e-06; Accession=PF00646.23; Description=F-box domain
MKTETEPNETESDWSELTRECLINILSRLSVEDRWRGTMLVCKSWFSVFKEPSLHFVFNLDPQFDSPTESTRWWTPEFEAKIDNMLRSVVEWAQSSLTHIRIRHCSDRSLALVAQRFQLSPKFQYPFVFPSLIDGGPNWVSKLWSFKCVFGLSFAKLILQI

SEQ ID NO: 206525 - protein, 53 aa, Glycine max
  Coding DNA Sequence Number=SeqID_89747
MPISPCRCIGWDRAHKMPSGPEEVQQGLGVSSSGCGPLLVLQGARSPSEVMTS

SEQ ID NO: 206526 - protein, 434 aa, Glycine max
  Coding DNA Sequence Number=SeqID_89748
  Gene Ontology: Mol. function=nucleoside:sodium symporter activity; Cellular component=integral to membrane; Biological process=transport
  Homolog annotation: Hit_ID=P33021; Match level="QueryCoverage=72%, HitCoverage=80%, E-value=1e-119, Identity=71%"; Hit description =Inner membrane transport protein yeiJ
DKLVHHQFLTYQAARQRRIVPRHAHQPRQRGQREAEYSLQADVAVTKPAADAAEYAVEHRDNTDKRHHHRRQTSGYFHPGNRSAGGGFNQAACRRVAKRQVGKSHLRRFRCRTEQPGEQNAAGNSHQRGGQQIFNWYPQPGIAEHCGTGYRSHAAADGGEQFVAIETVDEGFDDGRDLILAEENGGDRHEGFDLTDIKRALKDAAQQANNGAHHANIVEHANQRGDKDDGRQNVKSKHKAGAVKHLVHLRSGQRAKQKRAARITVSQRLMHAAGDFFRQPFARRQIEDRAAEGNLNHRNAIASNTTIPRTLLIISIMIFPDVSLVRLHSEPGGIQRDAHFGVCRFPQHAERITHRAAIAGTAVDIDFDKHRLNVEGIRIDQIGDTGGVMHRAACQTVIVVLGFQRKIHHVTEQLSGRAAGLFHAANDVRRAHRL

SEQ ID NO: 206527 - protein, 642 aa, Glycine max
  Coding DNA Sequence Number=SeqID_89749
  Gene Ontology: Mol. function=nucleoside-triphosphatase activity; Cellular component=membrane; Biological process=transport
  Homolog annotation: Hit_ID=Q6K4D1; Match level="QueryCoverage=98%, HitCoverage=87%, E-value=0.0, Identity=53%"; Hit description =Putative ABC transporter
  Pfam annotation: Domain name=ABC2_membrane; Domain location=364-577; Score=137.4; E_value=3.8e-38; Accession=PF01061.14; Description=ABC -2 type transporter
  Pfam annotation: Domain name=ABC_tran; Domain location=72-264; Score =119.1; E_value=1.3e-32; Accession=PF00005.17; Description=ABC transporter
  Pfam module annotation: Pfam domain module=ABC2_membrane::ABC_tran; Domain location=364-577::72-264
MTNIPYPQPEVLQTNDKVLTTFEGDAIKLTEISESVQREDITGTWENLWVTVSSGKNKKPILQDLTGYARPGRILAIMGPSGCGKSTLLDALAGRLSSNMKQTGKILINGQKQALAYGTSGYVTQDDAMLSTLTTGETLYYSAQLQFPDSMSIAEKKERTDMTLREMGLQDAINTRVGGWGSKGLSGGQKRRLSICIEILTRPRLLFLDEPTSGLDSAASYYVMSRIATLNQRDGIRRTIVASIHQPSSEIFELFHDLCLLSSGETVYFGPASDANQFFASNGFPCPTLHNPSDHYLRIINKDFEQDAEKGLGTGVTSEKAIDTLVKSYKSSQIRKQVKKEVDKIGESDSDAIRNQRIHAAFPTQCLVLIRRASLQLFRDISNYWLRLIVFIVIAISIGSIFYDIGTSNGSIQGRGSLLIFFVSVLTFMTLVGGFSPLLEEMKVFERERLNGHYGVTAFLIGNIFSAVPYMLLISLIPGGIAYYLCGMHKGPERFFYFTSLLFAIVMWVESLMLVVGSICPNYVIGMFLAGGVEGLMILTGGFYRLPNDLPKPLWKYPLYYVSFLKYAFQGSFKNDFEGLTFSVDQDGGGIMSGREVLTDTWHLEMGYSKWVDLAIMFGMIVLYRVLFLVITKCKEKMKPFH

SEQ ID NO: 206528 - protein, 263 aa, Glycine max
  Coding DNA Sequence Number=SeqID_89750
  Homolog annotation: Hit_ID=Q6Z7V1; Match level="QueryCoverage=93%, HitCoverage=33%, E-value=4e-99, Identity=72%"; Hit description=LMBR1 integral membrane protein-like
MACSNTFGLVTGAFLLGFGLSEIPKGIWLSADWNIEQKVLSHKVAKMAVKLDDAHHDFSNAIVITQATSKQMSKRDSLRPYMNIIDKMLLQMLKEDPSFKPQGGRLGESDMDYDTDDKSMAALRRRLKRAREQYYRYRSEYTKFVVEALELEDTIKNYDRRDATGWKYFSCLRPERIGKVGALLDTIEFLWRCILWKQLEKSLAVILGCMSFAILLAEATILTSGVDLSLFSILVHAGGQQEVLVQDDCKICSTHFIQLSQSH

SEQ ID NO: 206529 - protein, 471 aa, Glycine max
  Coding DNA Sequence Number=SeqID_89751
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=P47924; Match level="QueryCoverage=99%, HitCoverage=84%, E-value=1e-167, Identity=66%"; Hit description =Riboflavin biosynthesis protein ribAB, chloroplast precursor [Includes: GTP ...
  Homolog annotation: Hit description=cyclohydrolase-2 (EC 3.5.4.25) (GTP cyclohydrolase II); 3,4-dihydroxy-2-butanone 4-phosphate synthase (DHBP synthase)]
  Pfam annotation: Domain name=DHBP_synthase; Domain location=122-319; Score=433.9; E_value=2.2e-127; Accession=PF00926.10; Description=3,4- dihydroxy-2-butanone 4-phosphate synthase
  Pfam annotation: Domain name=GTP_cyclohydro2; Domain location=324 -471; Score=229.9; E_value=5.5e-66; Accession=PF00925.11; Description= GTP cyclohydrolase II
  Pfam module annotation: Pfam domain module=DHBP_synthase::GTP _cyclohydro2; Domain location=122-319::324-471
  Subcellular localization annotation: CTP_CleavageSite=53; ConfidenceScore=5.08e-01
MASSLSLSTPPLYRPRVCKHFKLFNGLHKFSFNGYGLDLAVVLQNSNAAGRIRATLTFGGGDLGSYLKSSDVVTNRFGTGTQFDAVAFGTLGADTAVPAGSGFSDDESEHDFDSPTEGFASIPEAIEDIRNGKMVVVVDDEDRENEGDLIMAAQLATPEAMAFIVKHGTGIVCISMKEEDLERLELPLMVNSQYNDEKLRTAFTVTVDAKYGTTTGVSAHDRATTVLALASKDSQPSDFNRPGHIFPLKYKEGGVLKRAGHTEASVDLAILAGLNPVAVLCEIVDDDGSMARLPKLRQFAERENLKIVSIADLIRYRRKRDKLIERAGAALIPTMWGPFVANCYRSLLDGIEHIAMVKMRETKYENGKHTDMGDIGDGHDVLVRVHSECLTGDIFGSARCDCGNQLALAMQQIEAAGRGVLVYLRGHEGRGIGLGHKLRAYNLQDDGRDTVEANEELGLPVDSREYGIGAQ

SEQ ID NO: 206530 - protein, 114 aa, Glycine max
  Coding DNA Sequence Number=SeqID_89752
  Homolog annotation: Hit_ID=Q1SGB1; Match level="QueryCoverage=97%, HitCoverage=52%, E-value=8e-24, Identity=50%"; Hit description =Peptidase A11B, Ty1 A and B
MVLSLLLPFWKPYWKKLQIVEVEAEFVVEEAEAVAKMVEKVAMVTEKVSEDVAEMLPEDGKLRKAALVVERASKEAAHDAQLTEEFLHKVEELKNDLDDLEAFVEPVIDKIVKM

SEQ ID NO: 206531 - protein, 181 aa, Glycine max
  Coding DNA Sequence Number=SeqID_89753
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=85%, HitCoverage=31%, E-value=5e-77, Identity=94%"; Hit description=NADH -plastoquinone oxidoreductase subunit 2
  Pfam annotation: Domain name=Oxidored_q1; Domain location=23-181; Score=-36.6; E_value=2.3e-05; Accession=PF00361.10; Description=NADH- Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRCLDFSKLHGHAEEKCYSHSDQDITLLVQITIKVKQSQEQRIPL

SEQ ID NO: 206532 - protein, 195 aa, Glycine max
  Coding DNA Sequence Number=SeqID_89754
  Gene Ontology: Mol. function=hydrolase activity, hydrolyzing O -glycosyl compounds; Biological process=carbohydrate metabolic process
  Homolog annotation: Hit_ID=Q1S5H4; Match level="QueryCoverage=52%, HitCoverage=28%, E-value=3e-26, Identity=68%"; Hit description =Glycosyl hydrolases family 17, putative
MLEVRLVDLTPSWGSKGGKMSPIEGGVVRLNGGERGFGLGGIEGEENGFEDRKGQWLRGVDAREVEAGEEGDEGEDYQAKSFKLVSGDAGAQPTSFCGNNWHSLVADNDEDGDDSVNHDVEEVSISNPDGEVIAEVKRMFLKRHDSKRNLGVEAIKIVRVEVDEEEGGEKGEVSAVMNENEVETFMLWMSRSQMQ

SEQ ID NO: 206533 - protein, 109 aa, Glycine max
  Coding DNA Sequence Number=SeqID_89755
  Homolog annotation: Hit_ID=Q337S9; Match level="QueryCoverage=43%, HitCoverage=16%, E-value=2e-15, Identity=77%"; Hit description =Translin family protein, expressed
MELLEKAKSQVNLLKKQNKKLAKVVGGCLGQYYRYHGDWKSETQSVVSMLKFMHWLETRSLLEHKEAKEKLGSSACKLSSWQQAFYQAIKNNISLAELFDSNRGQLNEK

SEQ ID NO: 206534 - protein, 72 aa, Glycine max
  Coding DNA Sequence Number=SeqID_89756
MCKRLNVKVLPYFHFYRGAEGQNHFHVHMPSLKVQQMRVLGDQDKSNVDVTIDAYHRYKVKEKGGEWASGDH

SEQ ID NO: 206535 - protein, 61 aa, Glycine max
  Coding DNA Sequence Number=SeqID_89757
  Homolog annotation: Hit_ID=P93169; Match level="QueryCoverage=53%, HitCoverage=17%, E-value=5e-08, Identity=81%"; Hit description=Early light-induced protein
MAEEEQPSEPATPVTPPASIEGKPQPVSAPSAKFLLRILHGKVREVQLIFGSKGTFVHGND

SEQ ID NO: 206536 - protein, 58 aa, Glycine max
  Coding DNA Sequence Number=SeqID_89758
  Subcellular localization annotation: CTP_CleavageSite=47; ConfidenceScore=5.12e-01
MAKSKGHPHHCNPLFPPTPMSPIAHYKGEFASGGFPSNVLAPRVFLMVMSVNVDKEFQ

SEQ ID NO: 206537 - protein, 217 aa, Glycine max
  Coding DNA Sequence Number=SeqID_89759
  Homolog annotation: Hit_ID=Q1RZD6; Match level="QueryCoverage=99%, HitCoverage=83%, E-value=1e-62, Identity=58%"; Hit description=TRNA -binding arm
MRRKLQATKQKKFMLEDEVRFLRQRYNYLLKHPILKPQPKQQVVKPQKLKIQAPIISKGKNYNKKEPNLRPHHPASHLNSNGRISNVADVPLKKTGHLFDLNLNARSSSKKDASINISGPPVLNLNHKERINSSKEATKKSVTPFFDLNQISREEEELQGNSEPMGIEEPKRSSQRVATDEQHGDIKLSAACRSVGDGSNRAGKRKISWQDQVALRV

SEQ ID NO: 206538 - protein, 375 aa, Glycine max
  Coding DNA Sequence Number=SeqID_89760
  Gene Ontology: Mol. function=RNA-directed DNA polymerase activity; Biological process=RNA-dependent DNA replication
MVSTWSGLRRETPLAYSHPPLAAMTDTNILKACIRHPRDDEQSAHTLAKRTQGKSHPRRTGTIADDLSLFHMLRRVQTVRQHLFINCIMEGDIPLGVETTQPQVGVALTCYGGLPPRPIDNFDTLIERFSAQYATIKSHRMSSTALANLRQVDDESLRKFMDGFGLTTVQIRNLNPEISLHSMLLILRLDKFVDNLFKKPLGRMDELRERAKSYIQIEEMTRFRNEVWQAGQKCDKRKAHTKGPKYEHYTPLMTNHTTILKEALNLKVPIWLLQTKPPRSGLDVTKYYRYHRGIGHNIEYCWALKDKIKEIIQAGYLTQFVKRPDNHQVGPRLGGHPKEQHRNHEADKRRAEDQGRQRHQQQRRGRQPPPEQEPA

SEQ ID NO: 206539 - protein, 374 aa, Glycine max
  Coding DNA Sequence Number=SeqID_89761
  Gene Ontology: Mol. function=serine carboxypeptidase activity; Cellular component=cellulose and pectin-containing cell wall; Biological process=proteolysis
  Homolog annotation: Hit_ID=Q9M099; Match level="QueryCoverage=98%, HitCoverage=81%, E-value=1e-174, Identity=76%"; Hit description =Serine carboxypeptidase 2 precursor (EC 3.4.16.6) (Serine carboxypeptidase II) ...
  Homolog annotation: Hit description=(Carboxypeptidase D) (Bri1 suppressor 1) [Contains: Serine carboxypeptidase 2 chain A (Serine carboxypeptidase II chain A); Serine carboxypeptidase 2 chain B (Serine carboxypeptidase II chain B)]
  Pfam annotation: Domain name=Peptidase_S10; Domain location=4-368; Score=565.1; E_value=7.1e-167; Accession=PF00450.12; Description =Serine carboxypeptidase
MIWPGCSSVAYGASEEIGPFRINKTGSSLYLNKYAWNREANVLFLESPAGVGFSYTNTSSDLKTSGDKRTAQDALIFVIRWMSRFPQYKYREFYIAGESYAGHYVPQLAKKIHDYNKKNPQIINLKGFIVGNAVTDSYNDGIGTVTYWWSHSMISDQSYKSILKYCNFTAEETSKKCDDVYSYAVNYEFGNIDQYSIYTPTCTTSQNNTVRHMRFKNLHLISGYDPCTENYAEKYYNLPEVQIAMHANVTNIPYKWTACSDVLLKNWKDSEISVLPIYKELIAAGLRIWVFSGDTDSVVPVTATRFSLNHLNLRTRTRWYPWYSGGQVGGWTEVYDGLTFATVRGAGHEVPLFQPKRAYILFKSFLAGNELPKY

SEQ ID NO: 206540 - protein, 97 aa, Glycine max
  Coding DNA Sequence Number=SeqID_89762
  Subcellular localization annotation: CTP_CleavageSite=40; ConfidenceScore=5.34e-01
MVTISPVSVGNFIVRWSMDTTAPSSLSVFLPIKSKYNVFRSSSRYVMDINGTSLVDEDSGHYEDQNDDGDNHMVVLVDEVDALEVPVRKGDKRETSL

SEQ ID NO: 206541 - protein, 123 aa, Glycine max
  Coding DNA Sequence Number=SeqID_89763
  Homolog annotation: Hit_ID=Q1SSS8; Match level="QueryCoverage=29%, HitCoverage=5%, E-value=1e-12, Identity=100%"; Hit description=GTP -binding signal recognition particle SRP54, G-domain
MANLSIVVQGQGEAESLRELCFVVANVNAKHSGGIGKENESSHVGAFDVSRLQKLKGKKGNGKKKDALVVAAAAMEEPKKVDKRSRGKANLEKSDLEPALKALKDRLMTKNVAEEIAEKLCES

SEQ ID NO: 206542 - protein, 163 aa, Glycine max
  Coding DNA Sequence Number=SeqID_89764
  Homolog annotation: Hit_ID=Q1SM49; Match level="QueryCoverage=74%, HitCoverage=51%, E-value=1e-13, Identity=35%"; Hit description =Peptidase S1 and S6, chymotrypsin/Hap
CWIYEHFPSVQQCVTDDTYQETSPSASRWLTSKAHMKGITGAPYRACCDALAITYVSWFPYTEHRGVRAFEVISSFQGQLRWGPMVVTARPERLVSADYMEWFFRISHPFMIPTQAGDQPRDAPAADPEEYIQPPNPQVPVAFDPPRHAVDDYDGYEANCTRG

SEQ ID NO: 206543 - protein, 226 aa, Glycine max
  Coding DNA Sequence Number=SeqID_89765
  Gene Ontology: Mol. function=transposase activity; Biological process= transposition, DNA-mediated
  Homolog annotation: Hit_ID=Q75HL4; Match level="QueryCoverage=86%, HitCoverage=29%, E-value=4e-08, Identity=24%"; Hit description =Expressed protein
MERVLADVLRDQRNLGNKGDGGWKRSALNAAAAMLSTSFNVNVTSDNVKNRIKLWRSWYGIVSDILGQSGFDWDGTKHMITVENENAWNEYCTIGFDFFFVFQSHKSAKLFRFKVLQNWDDIVDLCAKDRATGHGAETAMDADEAMSRETNEVEFIGLGATAIDLEEPSSNTKGKRQCSTSSSTHPHKKKMGEKEGIAASLDKMANSFNRMVEKMDGKVDDEDIQE

SEQ ID NO: 206544 - protein, 108 aa, Glycine max
  Coding DNA Sequence Number=SeqID_89766
MAYGKSYLHIRYFQVNFSTSLVIISQSGCSFPHCEEPRGAQTVKIVNRVAWHPAHTALVAKERPPGGHLVWFLLFSGHNFLNIYVKSLERLLYNGLKVPYLLGSGQLG

SEQ ID NO: 206545 - protein, 57 aa, Glycine max
  Coding DNA Sequence Number=SeqID_89767
MGKRVYAREKVSTSYDDDLDEERSWVWRQKEASEKQSRGEKFFRTLTFSIPDLGRKL

SEQ ID NO: 206546 - protein, 90 aa, Glycine max
  Coding DNA Sequence Number=SeqID_89768
MVGGGRVNMEKAEAKMKEVSSAPQQHSTDVLHQRKKMPQCPMKMAIGGFVAISVLGYFVLYSNKKSEASAMDVAKVATGTSNPENTRPRN

SEQ ID NO: 206547 - protein, 642 aa, Glycine max
  Coding DNA Sequence Number=SeqID_89769
  Gene Ontology: Mol. function=transmembrane receptor activity; Cellular component=integral to membrane; Biological process=defense response to bacterium
  Homolog annotation: Hit_ID=Q1SI21; Match level="QueryCoverage=96%, HitCoverage=96%, E-value=0.0, Identity=75%"; Hit description =Nonaspanin
  Pfam annotation: Domain name=EMP70; Domain location=58-600; Score =1107.5; E_value=0; Accession=PF02990.7; Description=Endomembrane protein 70
  Pfam annotation: Domain name=Rab5ip; Domain location=476-551; Score= -44.5; E_value=0.064; Accession=PF07019.2; Description=Rab5 -interacting protein (Rab5ip)
  Pfam module annotation: Pfam domain module=EMP70::Rab5ip; Domain location=58-600::476-551
MAREPLARDLCICVCIYILLIAHQSTCFYLPGVAPEDFWKGDPLKVKVNKLTSTKTQLPYSYYSLPYCRPKHIFDSAENLGEVLRGDRIENSPYVFKMREPQLCNVACRLILDEKAAKEFKEMIDDEYRVNMILDNLPLVVPIRRLDQESSVVYLHGFLVGLKGQYSGIKEDKYFIHNHLAFVVKYHTDPELDLSRIVGFEVTPFSVKHEYEGKWNENTRLTTCDPHAKKLVTSSESPQEVEHKKEIIFSYDVEFEASDVKWAYRWDTYLLMANDQIHWFSIVNSLMIVLFLSGMVAMIMLRTLYRDISKYNQLETQEEAQEETGWKLVHGDVFRPPSNSDLLCVYVGTGVQFFGMILVTMMFAALGFLSPSNRGGLMTAMLLLWVFMGLFAGYASARLYKMFKGTEWKKISFGTAFIFPATAFAVFFVLNALIWGQRSSGAVPFQTMFALLLLWFGISFPLVFVGGFVGFNKKPAIEDPVKTNKIARQIPKQAWYMNHVCSILIGGILPFGAVFIELFFILTSIWLHQFYYIFGFLFIVFVILIITCAEITIVLCYFQLCSENYNWWWRSYLTSGSSALYLFLYAVFYFFTKLEISKPISGILYFGYMLLLSYTFFVLTGTIGFYACFWFTRLIYSSVKID

SEQ ID NO: 206548 - protein, 113 aa, Glycine max
  Coding DNA Sequence Number=SeqID_89770
  Subcellular localization annotation: CTP_CleavageSite=49; ConfidenceScore=5.18e-01
MNNNNNNTANFKLRFQLFITSLGVEVSDSNLEKLSCSTFNNKASLQHLTVSAKSSSRTPHNIINQEKTSVKNREQTVTGDRKFCRRLSKEGGKGGNEPRRREMSDAERNEKME

SEQ ID NO: 206549 - protein, 103 aa, Glycine max
  Coding DNA Sequence Number=SeqID_89771
  Gene Ontology: Mol. function=DNA-3-methyladenine glycosylase I activity; Biological process=base-excision repair
  Homolog annotation: Hit_ID=Q1SSR7; Match level="QueryCoverage=88%, HitCoverage=25%, E-value=2e-36, Identity=85%"; Hit description =Protein prenyltransferase, alpha subunit
  Pfam annotation: Domain name=Adenine_glyco; Domain location=3-62; Score=-63.3; E_value=3e-05; Accession=PF03352.4; Description =Methyladenine glycosylase
MVMITIATNFLQVPVKTPKADVISKDLVRRGFRGVGPTVIYSFMQVVGLTNDHLISCFRFQDCMAVAEGKEENAVKDDAQQKEGDHVESDLSIAIDNLSLSSE

SEQ ID NO: 206550 - protein, 171 aa, Glycine max
  Coding DNA Sequence Number=SeqID_89772
  Subcellular localization annotation: CTP_CleavageSite=30; ConfidenceScore=5.25e-01
MYPLLFSVTIAQVNVPSTCTTKDVPSNVLRQSSQAVSPLKLCEGETKDISGEQGLETRKLIKLLAKEEEEEEVQKDVQRDSKVVKEYVKSYFQETGNRLPESKNSGEVALKKWMTEIHWGVVDGERLSFLSWEMRGRCTMYPYVAITPNYHPHDFVRPPRPGRIGGSDWAL

SEQ ID NO: 206551 - protein, 104 aa, Glycine max
  Coding DNA Sequence Number=SeqID_89773
  Homolog annotation: Hit_ID=Q3N5B3; Match level="QueryCoverage=55%, HitCoverage=19%, E-value=8e-07, Identity=43%"; Hit description =Endonuclease/exonuclease/phosphatase
MSVSLTVMTFNLHDDEPQDSPNSWEKRRDMCISVITSYSPIILCTQQGVKAQLDFLQQGLPGEVPFELVVLQLLKRFIYGPQIHYMHNVVTSIFCILFDIMYVP

SEQ ID NO: 206552 - protein, 111 aa, Glycine max
  Coding DNA Sequence Number=SeqID_89774
  Homolog annotation: Hit_ID=Q19PP0; Match level="QueryCoverage=49%, HitCoverage=2%, E-value=6e-13, Identity=60%"; Hit description=TIR -NBS-LRR type disease resistance protein
MAISAARGLAFLHSSNNHVIFRDFKPLNILLDEANDGNEFDSNSSYSLHHFDHPGMVLVSKSLDGNNYSTWRRATTISWNAKSKFCFVDGTLKAPSAKTKPEDYTTWKKMQ

SEQ ID NO: 206553 - protein, 52 aa, Glycine max
  Coding DNA Sequence Number=SeqID_89775
MSQKNDDLRLIHRLIVVKLKHQSKEKLEESLETARDATVAVRRHVSPLKGKG

SEQ ID NO: 206554 - protein, 111 aa, Glycine max
  Coding DNA Sequence Number=SeqID_89776
MSCHITEALANLPTRRLLRHLKSNFFFSGFSFDEPSKGAYGTRRNEALWNQIVKPPDISFDAVTNYHSQWQAARTTTGSNQTPPALDQVIKWSPPPQNYIKCNLNAAGITD

SEQ ID NO: 206555 - protein, 198 aa, Glycine max
  Coding DNA Sequence Number=SeqID_89777
  Gene Ontology: Mol. function=sequence-specific DNA binding; Cellular component=nucleus; Biological process=regulation of transcription
  Homolog annotation: Hit_ID=Q1RWH4; Match level="QueryCoverage=91%, HitCoverage=31%, E-value=6e-49, Identity=53%"; Hit description=WRKY DNA-binding domain, putative
  Pfam annotation: Domain name=FLYWCH; Domain location=54-116; Score =3.5; E_value=0.03; Accession=PF04500.7; Description=FLYWCH zinc finger domain
  Pfam annotation: Domain name=WRKY; Domain location=24-118; Score =83.1; E_value=8.8e-22; Accession=PF03106.6; Description=WRKY DNA -binding domain
  Pfam module annotation: Pfam domain module=FLYWCH::WRKY; Domain location=54-116::24-118
MDSPVKPGKKPKFVVHAAGDVGISGDGYRWRKYGQKMVKGNPHPREDEISYLLKQRCVGGGVVLLLPCYAEKSSTLSGQNGKNRCTSAGCPVRKHIETAVDNSDAVIITYKGVHDHDMPVPKKRHGPPSAPLVAAAAPASMNSLQVKKPDSPQNKKISTQWSVDTEGELTGEALELGGEKAMESARTLLSIGFEIKPC

SEQ ID NO: 206556 - protein, 144 aa, Glycine max
  Coding DNA Sequence Number=SeqID_89778
MEEEEDLDEVDSTTEIEIVLENLGEGGLVGVVAVVGGGRSESPMEEGTRRWHAVFGGGSDLGVLGTHLDKDDVYWADLAGLVVSEVGVRRGGSDLADGGGVGGAGERERKKKKINMELHMSNFLVDRHETSDSSTPILALNKKL

SEQ ID NO: 206557 - protein, 78 aa, Glycine max
  Coding DNA Sequence Number=SeqID_89779
  Subcellular localization annotation: CTP_CleavageSite=52; ConfidenceScore=5.12e-01
MGPPSTIPGSHTKMQLNCEKMGHHRQTPGPAGFNSTSRINSPKSSKLDISLRISVYGTKIRFQQPWRLRHQKTEQTKG

SEQ ID NO: 206558 - protein, 108 aa, Glycine max
  Coding DNA Sequence Number=SeqID_89780
MDQRHGPQPLPESDTIGNDSHPKTQLTKETERVVESLSDAESRHRELRSSDKPCSDSNLETLGAGVTSSVETLAVQHRSDDLQGSSTAPNSGGKAESLLDDDGQVSFE

SEQ ID NO: 206559 - protein, 205 aa, Glycine max
  Coding DNA Sequence Number=SeqID_89781
  Gene Ontology: Mol. function=pyridoxal phosphate binding
  Homolog annotation: Hit_ID=Q9FGL6; Match level="QueryCoverage=99%, HitCoverage=33%, E-value=3e-20, Identity=32%"; Hit description =Arabidopsis thaliana genomic DNA, chromosome 5, P1 clone:MJM18
  Subcellular localization annotation: CTP_CleavageSite=53; ConfidenceScore=5.52e-01
MHPSRAEAAASQPCFNGCFPSPLLASEKSHRTTSSKPKVVNNNNVTSSHDDFVAATSSTLHPHTNFTNHESLPSLQDSYISFTKAFPQFSTTTSEVDQIRALEYHHLSNHSNACFDYTGYGLFSYYQQQRISYSYPTIASSSSSSFPYFRSDASFFDISYKSVNLQSQVLYGGHESELESRIRKRIMSFMNVSEAEYTLVFIANE

SEQ ID NO: 206560 - protein, 920 aa, Glycine max
  Coding DNA Sequence Number=SeqID_89782
  Gene Ontology: Mol. function=protein kinase activity; Cellular component=integral to membrane; Biological process=protein amino acid phosphorylation
  Homolog annotation: Hit_ID=Q1T5L7; Match level="QueryCoverage=87%, HitCoverage=100%, E-value=0.0, Identity=74%"; Hit description =Protein kinase
  Pfam annotation: Domain name=LRR_1; Domain location=114-136; Score =15.3; E_value=0.22; Accession=PF00560.23; Description=Leucine Rich Repeat
  Pfam annotation: Domain name=LRR_1; Domain location=138-160; Score =9.8; E_value=4.2; Accession=PF00560.23; Description=Leucine Rich Repeat
  Pfam annotation: Domain name=LRR_1; Domain location=162-184; Score =11.3; E_value=2.2; Accession=PF00560.23; Description=Leucine Rich Repeat
  Pfam annotation: Domain name=LRR_1; Domain location=186-208; Score =12.1; E_value=1.6; Accession=PF00560.23; Description=Leucine Rich Repeat
  Pfam annotation: Domain name=LRR_1; Domain location=211-232; Score =11.0; E_value=2.5; Accession=PF00560.23; Description=Leucine Rich Repeat
  Pfam annotation: Domain name=LRR_1; Domain location=234-253; Score =7.8; E_value=9.9; Accession=PF00560.23; Description=Leucine Rich Repeat
  Pfam annotation: Domain name=LRR_1; Domain location=256-278; Score =16.1; E_value=0.13; Accession=PF00560.23; Description=Leucine Rich Repeat
  Pfam annotation: Domain name=LRR_1; Domain location=283-306; Score =12.9; E_value=1.1; Accession=PF00560.23; Description=Leucine Rich Repeat
  Pfam annotation: Domain name=LRR_1; Domain location=307-328; Score =8.4; E_value=7.8; Accession=PF00560.23; Description=Leucine Rich Repeat
  Pfam annotation: Domain name=LRR_1; Domain location=329-352; Score =21.6; E_value=0.0028; Accession=PF00560.23; Description=Leucine Rich Repeat
  Pfam annotation: Domain name=LRR_1; Domain location=66-89; Score=4.5; E_value=41; Accession=PF00560.23; Description=Leucine Rich Repeat
  Pfam annotation: Domain name=LRR_1; Domain location=91-112; Score =20.1; E_value=0.0078; Accession=PF00560.23; Description=Leucine Rich Repeat
  Pfam annotation: Domain name=Pkinase; Domain location=498-796; Score =55.9; E_value=1.3e-13; Accession=PF00069.15; Description=Protein kinase domain
  Pfam annotation: Domain name=Pkinase_Tyr; Domain location=498-796; Score=30.7; E_value=2.4e-14; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=114-136::138-160::162 -184::186-208::211-232::234-253::...
  Pfam module annotation: Domain location=256-278::283-306::307 -328::329-352::66-89::91-112::498-796::498-796
MGLGVFGSVLVLALLFKHLASQQPNTDEFFVSEFLKKMGLASSQGYNFSASVCSWQGVSCDANGEHIVDLVFSGMDLSGTMPDNTIGKLSKLQSLDLSHNKITGLPSDFWSLSSLKSLNLSSNQISGSLTNNIGNFGLLESIDLSSNNFSEEIPEAVSSLLSLRVLKLDHNRFAHSIPSGILKCQSLVSIDVSSNQLNGTLPEGFGAAFPKLRVLNLSGNNMYGHVSDISGLKSIVNLNISGNSFQGSIVDVFQGRLEVLDLSRNQFQGHIPQKFPQIEILLKLEYLNLSKTSLVGEIPDEILQMSNLSALDLSMNHLSGKIPLLRNEHLQVLDLSNNNLTGAVPPSVLEKLPWMEKYNFSYNNLILCASEIKPEILTTAFFGSLNSCPIAANPRLFKRRDTGNKGMKLALALSFSMIFVLAGLLFLAFGFRRKTKMWEFKQTSYKEEQNISGPFSFQTDSTTWVADIKQATSVPVVIFEKPLLNITFADLLAATSNFDRGTLLAEGKFGPVYRGFLLGGVHVAVKVLVVGSTLTDEEAARELEFLGRIKHPNLVPLTGYCVAGDQRIAIYDYMENGNLQNLLYDLPLGVQSTDDWSTDAWEEADNNGIQNAGSEGLLTSWRFRHKIALGTARALAFLHHGCSPPIIHRAVKASSVYLDYDLEPRLSDSGLAKIFGSGLDDEIVRGSPGYVPPEFTRPELDTPTPKSDVYCFGVVLFELVTGKMPVGDDYPDDKEATLVSWVRGLVRKNQASRAIDPKIHDTGPDEQMEEALKIGYLCTADLPFKRPSMQQIVGLLKDIEPTASSGVRVTMLYSGGVSGMVVGWNSDSNGGDDDDSSDEMWWNGDGGSDNNSGGDNDNGERWNSDNDDNENDNNSDSGGGGECNKGEVRWRENDRGNSGCDDDSGSGDNNNDRMPRVVVL

SEQ ID NO: 206561 - protein, 111 aa, Glycine max
  Coding DNA Sequence Number=SeqID_89783
  Gene Ontology: Mol. function=transition metal ion binding; Cellular component=cytoplasm; Biological process=fucose metabolic process
MGDRLEDMICDLGQESFQQAHAPMYEGLQSDSKKPLYMGCKNSLTMLSAVLSLVSVKDRYGWSDKSFISLLQLVHDLLPEENTLPKSYYQAKKILCPMGMEYQKIHAFPND

SEQ ID NO: 206562 - protein, 173 aa, Glycine max
  Coding DNA Sequence Number=SeqID_89784
  Gene Ontology: Mol. function=ubiquitin thiolesterase activity; Biological process=ubiquitin-dependent protein catabolic process
  Homolog annotation: Hit_ID=Q1RWI2; Match level="QueryCoverage=56%, HitCoverage=11%, E-value=3e-17, Identity=50%"; Hit description =Ubiquitin carboxyl-terminal hydrolase, putative
MKIELTILRKVIPKLSSGSKPYSENSEASCFLATEPEGRGSEEEGFRVSMWKSLEKPLKGFLTGRNTMFLDNKGVAIVVDEEGSGGFGGSVWITMVSAIAGVREASKSGNEGKRGRGEEQSHRSRVEREWSGPGPAQNVVYVCGLENLGSVIEQLGHSSLNRVDRFLLIPTLY

SEQ ID NO: 206563 - protein, 163 aa, Glycine max
  Coding DNA Sequence Number=SeqID_89785
  Gene Ontology: Mol. function=oxidoreductase activity, acting on paired donors, with oxidation of a pair of donors resulting in the reduction of molecular oxygen to two molecules of water; Cellular component=chloroplast; ...
  Gene Ontology: Cellular component=Biological process=fatty acid biosynthetic process
  Homolog annotation: Hit_ID=P48628; Match level="QueryCoverage=95%, HitCoverage=45%, E-value=7e-86, Identity=96%"; Hit description=Omega- 6 fatty acid desaturase, chloroplast precursor
  Pfam annotation: Domain name=FA_desaturase; Domain location=9-163; Score=-48.7; E_value=0.0046; Accession=PF00487.14; Description=Fatty acid desaturase
MEICSDICHFLCTGSLHDFQSPLVSSSSGLGMDRDCNNWGHDCAHRSFSSNKLVEDIVGTLAFMPLIYPYEPWRFKHDRHHAKTNMLREDTAWHPVWKDEFESTPLLRKAIIYGYGPFRCWMSIAHCNWMAINYLQDWNHGMDKILVDAMVGLSLLGNFNSIL

SEQ ID NO: 206564 - protein, 446 aa, Glycine max
  Coding DNA Sequence Number=SeqID_89786
  Gene Ontology: Mol. function=voltage-gated potassium channel activity; Cellular component=voltage-gated potassium channel complex; Biological process=potassium ion transport
  Homolog annotation: Hit_ID=Q1RWI6; Match level="QueryCoverage=99%, HitCoverage=100%, E-value=0.0, Identity=87%"; Hit description=BTB/POZ
  Pfam annotation: Domain name=K_tetra; Domain location=8-103; Score =55.6; E_value=1.7e-13; Accession=PF02214.13; Description=K+ channel tetramerisation domain
MGVQKDRVKFNVGGRVMETTSTTLANAGRNSMFGAMFDDNWNLIPNNDDNNNNERFIDRNPDCFAILLDLLRTGELYVPPDIPEKLLYREALYYGLLDHVRAAKWGPFDGNRLRLSRSLQGQAPGDGTAIRAGPDGGCCVAHGSMVHVYDWMLDEHPPLNLDYQRVNDVGWVDSDNIVIGVSERLGRGDGGMGLFSSHTGELRYKFHVCHDNQVKSYTAGALSFSSDYKIFSSCKGRSNEYGVGVWDQVTGKQIDFFYEPLGWSLGDADKLQWMEGSNCLLVATMFPRKDNCYISLLDFRDKKMVWCWSDVGAPFAVDEKRVRDAIAMEDNNSICVVNEFEDLGFMDLRSSAANSIRWSSRSRLMKGKMPEEPCYPKLALHGGQLFSSMNDCISVFCGPEWVLTSRLRRSYGGSICDFSIGGDRLFALHSEENVVDIWETPTPPII

SEQ ID NO: 206565 - protein, 671 aa, Glycine max
  Coding DNA Sequence Number=SeqID_89787
  Gene Ontology: Mol. function=ubiquitin thiolesterase activity; Biological process=ubiquitin-dependent protein catabolic process
  Homolog annotation: Hit_ID=Q1RWI2; Match level="QueryCoverage=99%, HitCoverage=74%, E-value=0.0, Identity=55%"; Hit description =Ubiquitin carboxyl-terminal hydrolase, putative
  Pfam annotation: Domain name=UCH; Domain location=1-231; Score=117.9; E_value=2.9e-32; Accession=PF00443.19; Description=Ubiquitin carboxyl- terminal hydrolase
MRSGISRNFRNARQEDAHEYMVNLLECMHKCCLPSGIPSESPGAYEKSFVHKIFGGRLRSQVKCHQCSYCSNKFDPFLDLSLEIFKADSLQKALSNFTAAEWLDGGEKEYHCQRCKQKVRALKQLTIHKAPYVLTIHLKRFHAHDPGQKIKKKIQFGCALDLKPFVSGSYDGDVKYSLYGVLVHAGSSTHSGHYYCYVRTSNNMWYTLDDNRVSHVSEREVLNQQAYMLFYVRDRKNIVPRKPVDIAKKENMKTNVNGNRESSTSNHVLQEYPNGTIENKAEKDALVLQKHNVILAESLMQSKRHGSELSSKAQAQNDSPDGLSDHSGKDYSLPHNLKSLAAPVGEKNNLRYENVISKEGIKDSPSIVPSSTNPQNGELTTDGKCQSPKKNLVKIVDVAAPQDSSTNMTNGICPKTSLIHPKVNHQLGTSAIGSVCEKASSMTYEDLVGSQGLVLNESVNTSLNTASLNQKPVKKSKKKFLRYQVSWMHLRPIFHYMVYLGPRKKNHKRSKRRTLGMKNPNKDKMDKLAFSSEDAKPVVFPLLLSCSESKATKAGYRPGANFKSSDESLIENRAEGEFRKRIDHSCAVLASAAQIEIISGSGSIVSQFEARQADSAQDSRRDQMHNGLMSMLSRGLEETVVARWDDIELPSSQHLESKNDKLVSIGYVGDE

SEQ ID NO: 206566 - protein, 132 aa, Glycine max
  Coding DNA Sequence Number=SeqID_89788
  Gene Ontology: Mol. function=oxidoreductase activity, acting on paired donors, with oxidation of a pair of donors resulting in the reduction of molecular oxygen to two molecules of water; Cellular component=chloroplast; ...
  Gene Ontology: Cellular component=Biological process=fatty acid biosynthetic process
  Homolog annotation: Hit_ID=P48628; Match level="QueryCoverage=84%, HitCoverage=26%, E-value=4e-56, Identity=98%"; Hit description=Omega- 6 fatty acid desaturase, chloroplast precursor
  Subcellular localization annotation: CTP_CleavageSite=74; ConfidenceScore=5.19e-01
MACTLADSLLLFKGSYQKPVLRRDIAARYSPGIFSLNSNGLIQKRFRRQRNFVTRNKVTVIHAVAIPVQPAPVESAEYRKQLAEDYGFRQVGEPLPDDVTLKDVINSLPKEVLFFKIYVMFYSIITEQDFSV

SEQ ID NO: 206567 - protein, 391 aa, Glycine max
  Coding DNA Sequence Number=SeqID_89789
  Subcellular localization annotation: CTP_CleavageSite=70; ConfidenceScore=5.35e-01
MASTGGKSHSLITTSKRSVLLKDYLRDDLSSCSSNGFKSLTRQQCCTTVGFFMEKDLQLQRKRRNTFTPRSTTSSSSSTILALQRASGAIINAIKSLPLSQKSGVAGVLSRSFSRKVLSRRFFWRKAAAREEGSEGVPRRRKSFRELIMLDHEEHRKATSSLNEDTDTTVFAAHAPSVTTSSGRGSESWGDSEFTFASNAASSSSESSNENYLVLEDTKEGAPHHKLEQVVTKPVVLEKKFARLELEDEPHKHSTKQCSTVLAPTFRRDNNNNIEENARDLLNLVKRSIAPNVLITKAENLLFDFFKKSIEENKDIDYSKKLQLCKVAEDWIHGQPQEPYLGWEVQGGKCVYIREMDKCEEWKNSYQEIQQLGQELANELVATKDEMLQLA

SEQ ID NO: 206568 - protein, 823 aa, Glycine max
  Coding DNA Sequence Number=SeqID_89790
  Gene Ontology: Mol. function=actin binding; Biological process=actin cytoskeleton organization and biogenesis
  Homolog annotation: Hit_ID=Q1T5L0; Match level="QueryCoverage=99%, HitCoverage=74%, E-value=0.0, Identity=65%"; Hit description=Actin -binding FH2; Quinonprotein alcohol dehydrogenase-like
  Pfam annotation: Domain name=Extensin_2; Domain location=381-679; Score=-122.0; E_value=0.015; Accession=PF04554.4; Description =Extensin-like region
MAMLRKLFFRKPPDGLLEICERVYVFDCCFTTDAWNEENYRVYMDGIVGQLRENLPDASILIFNFREEDTKSQMANIMSEHDITIMDYPRHYEGVPVLKMELIHHFLRRNVALDWPPLDRALMLDCIILRFFPNFDGEGGCHPIFRIYGQDPFSADKNPKMLYSTPKRSKSVRAYKQGECELIKIDINCHIQGDVVIESINLNGNMDREKMMFRVMFNTAFVRSNILMLNRDEIDILWDAKDHFPKDFRAEILFSEMDAAAAVIADGTSCFEEKEGLPIEAFAKVQEIFSHVDWMNPKADAALNVLQQMSASAMNDRLDTVSDQCMENGTLLHETSPRIPQGNLSEARQSLSSTKRSPDNDMSRKEDKANKVEGIPQQPSTSNIIYQETAISSERTTESNKCPTGPTNVDIKLQAPHPALSSSVDTSFSPRTPPLRPQSTSAKEVHDSPRQTESPPSYLLPLQSKHQTQDRSSIPTPGTQLSSTFHSKSPADTISHPSASAITSTQPSPLLSSKNVNEIPPIRTRLESSPSRPPTPPPPPTPPLKDHRLVRAKPPPPPHPPPPPPKKELHVKAEPLPSPLSPMNVEPQVRGGPSPPPPPPPKEEQPVTFNAPPPPCLSGKVAGSTIAPPPPPPPSSDHINSSLQKSPPPPAAPAPPPPPGAPAPPPPPGAPAAPPPPAKGGLKSGSPFPLSLSVSGDGNNVSGPTSSKGRILSRTISSKNNTKKLKPLHWLKLSRAVQGSLWAETQKSGEVSKAPEIDMSELESLFSAAVPSGPAKKSNVQSSAGPKSDKVQLIEHRRAYNCEIMLSKVKVPLHDLMSLPRTY

SEQ ID NO: 206569 - protein, 563 aa, Glycine max
  Coding DNA Sequence Number=SeqID_89791
  Gene Ontology: Mol. function=phosphoprotein phosphatase activity; Cellular component=intracellular
  Homolog annotation: Hit_ID=Q1RY25; Match level="QueryCoverage=33%, HitCoverage=54%, E-value=1e-26, Identity=35%"; Hit description =Reticulon
  Pfam annotation: Domain name=Reticulon; Domain location=333-479; Score=-51.5; E_value=0.0025; Accession=PF02453.8; Description =Reticulon
MDVSRRRVGVRCSVVAGSVWESRMKSDEVGGGVKVFSGEQSAEEGGNDGTRLKRGQIGSVVASGKRKTWKSEGLENNLIQIARGKAEPQKNGSNSSSSQQCKDLNISSDSVKKSPIPARKKRSEVGEPFEKNVGKLRKNKSDSVKNVDDGNGGNAIQPRKDKPELDHVLNESRNDGLAGGSGRNVIDNGKNDSDGNCKDFGVCLEKVISSNSDNVGMIKCSPVHVDGDFDDVVVDDEEEDEEIDVEMEKGSFDVKEISVPESKVVNEPERKEVVNVPAKQKIVNEPEPKKVVTTNRQFHQKNERPVSIPIAVKPSPPIRKLSTIHQNFSKADSIDLIMWREVSRSAFIFGIGTFTIVSSSYAKDINLRGVIDVDDTNYVLGEEEAIWVLRLILPYLNEFLSKLRAMFSGDPGTTIKLAVLLFVLARCGSSITIWKMAKFGFFGVFTGPKICSSYSAQLTAFANFWIRRFRDAWVSCSHKKAVALGIFGLVWNLSSVVARIWSVFVLFVAFRYYQQHYLVRDGWVEDVAGCDETWQEPVGVKVGMQRQQSTYKIFETQKVKKVF

SEQ ID NO: 206570 - protein, 74 aa, Glycine max
  Coding DNA Sequence Number=SeqID_89792
MGHECLMDKRLSAEEMAVGGVPHWDLLVKQAHRERESRDCVWRGGTLLSMHRFLRSHITSTEEAKVIGLTLTCK

SEQ ID NO: 206571 - protein, 189 aa, Glycine max
  Coding DNA Sequence Number=SeqID_89793
  Gene Ontology: Mol. function=phosphoprotein phosphatase activity; Cellular component=intracellular
  Homolog annotation: Hit_ID=Q00IB6; Match level="QueryCoverage=91%, HitCoverage=35%, E-value=4e-28, Identity=46%"; Hit description =Carboxyl-terminal phosphatase-like 4
MQMSVVTDSPVHSSSSDDFIAFLDAELDASSPDSSPDKEVEKQDDDELESVRIKRRKFESIEETEGSTSEGIIKQSLEASMEVDVCTHPGSFGNMCIRCGQKLDGESGVTFGYIHKGLRLHDEEISRLRNTDMKSLLCRKKLYLVLDLDHTLLNSTHLAHLTSEESHLLNQTDSLRVNEDTVIKGAKKN

SEQ ID NO: 206572 - protein, 324 aa, Glycine max
  Coding DNA Sequence Number=SeqID_89794
  Gene Ontology: Mol. function=protein serine/threonine kinase activity; Cellular component=cytoplasm; Biological process=protein amino acid phosphorylation
  Homolog annotation: Hit_ID=Q1T5K7; Match level="QueryCoverage=70%, HitCoverage=51%, E-value=1e-102, Identity=82%"; Hit description =Protein kinase; NAF
  Pfam annotation: Domain name=Pkinase; Domain location=117-323; Score =221.7; E_value=1.6e-63; Accession=PF00069.15; Description=Protein kinase domain
  Pfam annotation: Domain name=Pkinase_Tyr; Domain location=117-324; Score=-8.6; E_value=6.1e-12; Accession=PF07714.7; Description =Protein tyrosine kinase
  Pfam module annotation: Pfam domain module=Pkinase::Pkinase_Tyr; Domain location=117-323::117-324
MVGCAEPSRRLEKDESVMEAEDGPYTCRSDPPLINEIRSIKEGNLGPLSLLEKKGKWRVALPNAEAPAEIATANTSKTGSNSTRFHSPTFPILSVKMSEKEKGNNSEGQSTLLHGKYELGRVLGHGTFAKVYHARNLNTGQHVAMKVVGKEKVIKVGMMEQVKREISVMKMVKHQNIVELHEVMASKSKIYIAMELVRGGELFNKVSKGRLKEDVARLYFQQLISAVDFCHSRGVYHRDLKPENLLLDEHGNLKVSDFGLTAFSEHLKEDGLLHTTCGTPAYVSPEVIAKKGYDGAKADIWSCGVILYVLLAGFLPFQDDNLVA

SEQ ID NO: 206573 - protein, 790 aa, Glycine max
  Coding DNA Sequence Number=SeqID_89795
  Gene Ontology: Mol. function=DNA-directed DNA polymerase activity; Cellular component=intracellular; Biological process=DNA replication
  Homolog annotation: Hit_ID=Q3LHS9; Match level="QueryCoverage=99%, HitCoverage=59%, E-value=0.0, Identity=63%"; Hit description=DNA polymerase
  Pfam annotation: Domain name=DNA_pol_A; Domain location=271-626; Score=-79.8; E_value=9.7e-10; Accession=PF00476.11; Description=DNA polymerase family A
NYGFKVSGFHADTMHMARLWDSSRHLDGGYSLEGLTGDRRVMSRAQLNHEKDLIGKVSMKTIFSKKKLKKDGSEGKTSIIAPVEELQRDERIPWICYSALDASSTLKLYESLKSHLSDMPWKFDGVPVYGKTMYDFYNEYWRPFGELLVMMESEGMLVDRAYLESIEKVAKEEQEVAVNRFRKWATRYCPDAQYMNVGSDSQLRQLLFGGIVNRKDSNQTLPTERIFKIPNVNNVIEEGKKAPKRFCDIKLTSLGYNLETEMYTATGWPSVSGHALKALAGSISADYDFFDEDCNLDLDDEDENPSQSQVAPVKIDKSAYGTAYAAFPTEEEGREACHAIAALCQGHNISGKDLRVHCSLNINTETGRLSARRPNLQNQPALEKDRYKIRQAFIAAPKNSLIVADYGQLELRILAHLADCKSMLEAFEAGGDFHSRTAMNMYPHIREALEKKEVLLEWHPQPGEDKPPVPLLKTPVGLSKDWKVSVKEAKKTVDLWYNDRKEVLQWQEERKKEARVLHCVYTLLGRARRFPLMAQANTYQKGHIERAAINTPVQQQLVANDEYVAFGGKKIIVDGFWKLVAGDTWMVLMVVRILKKIDLRAGDANERVGASCDVGVHMGERTHGDLDVLFSYMMDRCDWGRRLGDCGWWIGVAKIEKVDVGKIDFVATPASGKGTERRNFVVAETVATVAAVVVTVVTVAAIVVAVVGSAADVAMCAMLQISKNKRLKELGWKLLLQVHDEVILEGPTESAEVAKSIVIECMSKPFNGKNILKVDLSVDAKCAQNWYSGK

SEQ ID NO: 206574 - protein, 104 aa, Glycine max
  Coding DNA Sequence Number=SeqID_89796
  Subcellular localization annotation: CTP_CleavageSite=62; ConfidenceScore=5.56e-01
MPQSLCSFPSRTNPQTTLKSKDFAFSPTPTNKSMHKSTTLDSNDTKDKAEFPPVEIGTRGTVASLIMQEIEYFSRIGSNSQRNKSQITETVVGQMGPQPSVTGT

SEQ ID NO: 206575 - protein, 85 aa, Glycine max
  Coding DNA Sequence Number=SeqID_89797
MAKKIIHDTTRKMSQLCQKIVQVDVRPSHYRKLPLRDPSSSPPATVDDVFSSAATTTGGYDSDSDLVNLKISLLGDCHIGKTTFV

SEQ ID NO: 206576 - protein, 58 aa, Glycine max
  Coding DNA Sequence Number=SeqID_89798
MEVFELYTRLFATVIEGNSSNNLPYTVLRNLDSIAQKLVDVTKDCTVKNLKHYNHSDG

SEQ ID NO: 206577 - protein, 315 aa, Glycine max
  Coding DNA Sequence Number=SeqID_89799
LALVKEFYANLYSSKGPSPKQSKVRGHLVKIDADSLNTFLETPVVLAEGFILNTEGHPGKILRKDLTTLAQVWSVLSYSNLAPTSHTSDLTVDRARLIFGLVSHMDMNIGALISGQMTSIAQSNTSKLGFPALITALCRAREVVSDSLTFERLSPVINLAYIRKNCWNPEDLIVSIQGARRARARLAELPSTSGQIILLQSLQVVAPPGSIPSVEQFSEMDESFEATILETFVIREEVDETQVRQVAAATPERSLEATSVPPAPMVDLPSPHHTIDPSTPILEIPEDPTTPVLTIDTSPPATPILHLTNEEDVQT

SEQ ID NO: 206578 - protein, 298 aa, Glycine max
  Coding DNA Sequence Number=SeqID_89800
  Gene Ontology: Mol. function=calcium ion binding
  Homolog annotation: Hit_ID=Q9FFU7; Match level="QueryCoverage=91%, HitCoverage=56%, E-value=8e-30, Identity=32%"; Hit description =Similarity to heat shock transcription factor HSF30
  Pfam annotation: Domain name=F-box; Domain location=1-47; Score=27.8; E_value=3.8e-05; Accession=PF00646.23; Description=F-box domain
MSINSLPIELLITIVSLLPFKEAVRTSVLSKKWLELNVCKFTKNIEFDELFFVKPDQPNETREIQRRTFLDFINLWIENYKGTLVEKFSFRLSNPRNGGEIIDQCVAFATECEVKELELDFADPNWNENNIYYGNYEEALFKLPARVYQHGSLESLKLYSCSFVETEVLNFHALKEVSLGWMEVRLSAIKALLSNCNMLESLSFKRCWNSDKFDLGEEEHTGLRKLVLDKCRFEFDVFKVNAPDLKIFQYCGLMNFFITEIHSPAMEEANIDFSPEYGFEGLGHPLYNLVEIYLLLEF

SEQ ID NO: 206579 - protein, 151 aa, Glycine max
  Coding DNA Sequence Number=SeqID_89801
MTATCDSGSILPGTMEARTHFWEWVLVYSLISRFTIHMALEAYAAANPDKIHTDVLTKARDSCYKARDAFYACLEKESDKKPTEIASVGLLYPLECKECRNEYVKQCRSSWVKHFDRQYCQNKRVQRLLDDKGSRRGPLTLPQPYTFKPIA

SEQ ID NO: 206580 - protein, 40 aa, Glycine max
  Coding DNA Sequence Number=SeqID_89802
MSLLVDGLTKVTTDKWMDITDMGHVIALRYNIIIVSLSKQ

SEQ ID NO: 206581 - protein, 52 aa, Glycine max
  Coding DNA Sequence Number=SeqID_89803
MVEVRLALRQIMSKIKVEILDRDELYLFSDVARATSFITECVVHSKSNSIAG

SEQ ID NO: 206582 - protein, 1086 aa, Glycine max
  Coding DNA Sequence Number=SeqID_89804
  Gene Ontology: Mol. function=RNA-directed DNA polymerase activity; Biological process=RNA-dependent DNA replication
MEVEEESSARVFGVYSKEEDDLLSQSNRKVKRKAEEGDDDGVMEAEKGEEIQKKDLYMKKLLTKEGAMPFSAFDGGWSHRRRKSKKNGKSVNTKRANADKTRSIVGVSNHDNTEGLNMIHMLQEIGADFLGDKNGYNPGEKVVAMPDAETLEFVQNQKKGPLKGGSSSISPDSTKLEEPEVRFVENITNMETEIQVEDQKTSAIIDVNNEALGEDISREYESSLIFLIETHADASATDRVIDRLGFDKSFVVNARGHSGGLWCLWKASCWNVEIISSGVQKALWEVLSNIAETVIEAWAIMGDFNTILNDMDWVGCSTNPSWRGANDFQQFISDCNLIDVGFQGPAFTWGRGNLLERLDRVLKKQKLICNLQSISQKLSRSGLIELEETQLHIWEQYRDALRQEELLWHNTYEAIQDVDGIWVANDGDLERLVTEYFSNLFYDIMHFVPYCIHGAFPHLSENNFDMFKDRVMSEGARLGKLYFLWKISKLQDLCNLIKSVFENLIKIETINNMFIALIPKVEPELVNPCLSSFIPNRRMGDNVIIAQEVIHSMKHKKGNSGWMAIKVDLEKVYDRLKWRFVTDTLKDIVFHEKFIHLIHYSISSSREQILWNGEALERFKPYKGVRQAWTPIQLARGGPKLSHLAFTDDLLLFSEASISQANTIKKVLDTFCASSGQKGTPDLGKYLGVPLHHQKANAQSFRFIIDKLEQRLSCWKDKSLSFAGRLTLNKVVIQAMPTYIMQTNSIPESVCKDIVKYRNFIWGDSQNSRKLIPNVRWVIGNGRSTRFWSDNWVSGVGKLSEICNSGNQQGHDERSNPPDYIVWNTNSDGVFTICEACTQLAKELRDSDIRLFDFVWRKQLYIVLEIVVGYVKSGVISEQITGVCYSEWLWIEFGGEGTVSFLNTPSNLCRVCSITPCKLIVMGFGIIKLNYDATSIQGDLFVACGGLIRDDHDNFIHDFSQRIGRCSIVEVELWSILYGMRLVADRHMKKVIVESDSLAAINLIHEGCPTLHPCFGIVEEIKNLYNEFEHCSCKNILREANILANTFAKHGLSISTDCQFFCNVPTFALDPFQGDVSCIFGQLTLN

SEQ ID NO: 206583 - protein, 344 aa, Glycine max
  Coding DNA Sequence Number=SeqID_89805
  Gene Ontology: Mol. function=RNA-directed DNA polymerase activity; Cellular component=chromatin; Biological process=chromatin assembly or disassembly
  Pfam annotation: Domain name=Chromo; Domain location=244-298; Score =28.6; E_value=2.2e-05; Accession=PF00385.14; Description='chromo' (CHRromatin Organisation MOdifier
  Pfam annotation: Domain name=rve; Domain location=34-160; Score=35.6; E_value=1.8e-07; Accession=PF00665.16; Description=Integrase core domain
  Pfam module annotation: Pfam domain module=Chromo::rve; Domain location=244-298::34-160
MQQDIRDFVRKCIICQQAKVEQALSAGLLQPLPIPQRIWEDIAMDFIMHLPSSYGYSIVLVVVDRLSKFAHFIPLKADFTSKCVAYAFIVNIGTTLATSSTYHLQSDGQTEVLNKTLEIYLRCFVFDHPEAWFEMLPWAQFLYNTSFHHNIGMSPFKAIFGRDPPFPYRQHSVALRKNQKLRTKYFGPFEVVDRIGIVAYKLKLLETARIHLVFHISILKRFIGSSKQPYLPLPLTVGESGPMVQPIAILDSRVLLRDSSQVEQVLIQWEIAGPKEATWEDATWVKASYPHFNLEDNVVFKGEGNVTCRKQEGNLARESVTKERHMADDPHVGVRRAHSLGGRI

SEQ ID NO: 206584 - protein, 137 aa, Glycine max
  Coding DNA Sequence Number=SeqID_89806
  Gene Ontology: Mol. function=zinc ion binding
  Homolog annotation: Hit_ID=Q1S5Q3; Match level="QueryCoverage=81%, HitCoverage=77%, E-value=2e-10, Identity=33%"; Hit description=Zinc finger, GRF-type
  Pfam annotation: Domain name=zf-GRF; Domain location=20-65; Score =38.5; E_value=2.2e-08; Accession=PF06839.3; Description=GRF zinc finger
  Subcellular localization annotation: CTP_CleavageSite=27; ConfidenceScore=5.35e-01
MSQRSNASSSRTRVSSQVVLFCGCGKRAVRRVAGTNINRGRAFFTCSINKDEVGYCGYFIWVDQLIEVLGVDDSLGTFSMEQRRQFGREEDKTMWKAQVNSKLDCMGIEMKMFRTIVYGMFLIQLLSMVVFVYIHKY

SEQ ID NO: 206585 - protein, 548 aa, Glycine max
  Coding DNA Sequence Number=SeqID_89807
  Gene Ontology: Mol. function=pseudouridylate synthase activity; Cellular component=nucleus; Biological process=tRNA processing
  Homolog annotation: Hit_ID=Q6ESS0; Match level="QueryCoverage=81%, HitCoverage=87%, E-value=1e-156, Identity=57%"; Hit description =Putative pseudouridine synthase 1
  Pfam annotation: Domain name=PseudoU_synth_1; Domain location=326 -433; Score=16.0; E_value=0.00026; Accession=PF01416.10; Description =tRNA pseudouridine synthase
  Pfam annotation: Domain name=PseudoU_synth_1; Domain location=54-159; Score=35.9; E_value=1.4e-07; Accession=PF01416.10; Description=tRNA pseudouridine synthase
  Pfam module annotation: Pfam domain module=PseudoU_synth_1::PseudoU _synth_1; Domain location=326-433::54-159
MENSDTTLTSSSLPPPPPVSAEEPEPKKLKMSTTTSDDEETGTKKRYKRRKVAIFFAYCGVGYQGMQKNPGAKTIEGDLEEALYVSGAVPEQDRGVPKRYDWARSARTDKGVSAVGQVVSGRFYIDPPGLVDRLNSNLPSQIRIFGYKRVTASFNAKKFCDRRRYVYLIPVFALDPSCHRDRETVMASLGSGNELVKCLECSERGRKVVGLVGNRKQNLELEAVDVEAGISSNRDSGVTEDVEVSLSKGDDNHLNEESGNDNKGGMNCKTGLETVIPVQEEGTPLNGESVNNSDILEEEKVNGEDKPTNGSRFCYGEKERERFNKILKCFVGTHNFHNFTTRTKAEDPAARRYIISFNANTTLVVEGVEFVKCEVVGQSFMLHQIRKMIGLAVAIMRNCAPESLIDEALQQDVNINVPTAPEVGLYLDECFFTSYNQKWKDHEELSMKAYEKEADEFKMKYIYSHIASTEQKEGTVALWLHSLNHRNYPDLRVINEEAIPNNKSADPKEAITDNKSADPEDATTKNKGADLKEAITDNKSADPEVVTE

SEQ ID NO: 206586 - protein, 163 aa, Glycine max
  Coding DNA Sequence Number=SeqID_89808
  Homolog annotation: Hit_ID=Q2HTF3; Match level="QueryCoverage=76%, HitCoverage=98%, E-value=7e-41, Identity=68%"; Hit description=Auxin responsive SAUR protein
  Pfam annotation: Domain name=Auxin_inducible; Domain location=34-147; Score=91.0; E_value=3.5e-24; Accession=PF02519.5; Description=Auxin responsive protein
MTRMHLPPNNSQPTNVDVSSTEDNFFHDSCSLNCKMLGKKMVSLKKLAKRVKGVGGADHSDPPYQECLLKGYEEDKESPSSPTPTGFFALYVGEERQRYVVPTSYLSHPLFKMLLEKAYNEFGFAQRNGLVVPCSVSTFQEVVNAIECNNGNFDLGKIFEDFA

SEQ ID NO: 206587 - protein, 289 aa, Glycine max
  Coding DNA Sequence Number=SeqID_89809
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=33%, E-value=2e-74, Identity=61%"; Hit description=Chromo
MVENGNYMEAEGMINKLTIKAQNARFQLPVFLLPVSSADLILEASWLKTIGPHIADYDNVVFGTPTSLPLPRAHDHSIPLVDGYQPVKDHLSHLEFVLSILKQHQLFARFSKCAFGVREIDYLGHTLSGIGVAMETTKLQAILDWPLPNSLKQLRGFLGLIGYYRRFVKGYATIATTLIDILKKDSFKWSASAITALNKLKEVMTSAPVLAIPNFKEPFVLETDASGTGIGVVLSQSEHPIAYFFKKLSSRMQKQSAYIREFHAITEALAKFRHYLLGHKFIIRTDQKN

SEQ ID NO: 206588 - protein, 532 aa, Glycine max
  Coding DNA Sequence Number=SeqID_89810
  Gene Ontology: Mol. function=nucleic acid binding; Cellular component= chromatin; Biological process=DNA integration
  Homolog annotation: Hit_ID=Q1T2W1; Match level="QueryCoverage=94%, HitCoverage=65%, E-value=1e-154, Identity=56%"; Hit description =Integrase, catalytic region; Asp/Glu racemase
MADTSSPVQRRCRRPPLWMEEYETSEGLSEGSTEANLVMSASESDPTHFDAAVQIAKWRKAMDEEMEAINKNGTWKLKELPDGAKKIGVKWIYKTKFKENGEVDKYKARLVVKGYAQEYEVDYTEVFAPVAHMETIRLVVALAAQKGWTIYQLDVKSAFLHGELEETVYLDQPCGYVQKGDEHKVYKLKKALYGLKQAPRAWYSRIEAHFLKEGFEKCDYEHTLFVKREKKDIILIVSLYVDDLIFTPNDELMFAKFKSSMKHEFDMTDLGIEMLQRFGMDKSNLVQTPIIPGIKLTKDDTGAKVDKTYYKQIVGSLMYLTSTRPDMMFVVNLISRYMENPTELHLLAAKRLLRYLRGTTEFRIFYMKGGNKELLAYTDSDYARDLDDRKSTSGYVFLLCSAAVSWSSKKQPIVSLSTTEAEFIGAASCACQAIWLKRVLGKLCKMQNQATVICCDSSSAIKLSKNPVKHGRYKHIDVRFHFLRDLTKTGAIKMMHCGTQEQVVDIMTKPLKLDTLLKLRRSLGVCSEFDIN

SEQ ID NO: 206589 - protein, 170 aa, Glycine max
  Coding DNA Sequence Number=SeqID_89811
  Gene Ontology: Mol. function=nucleic acid binding; Biological process= DNA integration
  Homolog annotation: Hit_ID=Q1RWN2; Match level="QueryCoverage=77%, HitCoverage=10%, E-value=2e-41, Identity=63%"; Hit description =Peptidase S8 and S53, subtilisin, kexin, sedolisin; Integrase, catalytic region; Zinc finger, CCHC-type
MEKNYLFQALDRSVLETILNKDTAKDIWDSLKQKYQGTSQVKRAQLQALRKEFEILHMKEGESVNVYFARTLTIANKTKANGKNKGDVAVVEKILRSMTPKFDYVVCSIEESKDTDTLTIDELQSSLLVHELRMTSDINMQNRDEVVEALDDAEGDEVEDVADKDLTNPL

SEQ ID NO: 206590 - protein, 163 aa, Glycine max
  Coding DNA Sequence Number=SeqID_89812
MSKIFIREGRQQMSPMHKRSIERYNSICIKYVGGNQVCLTGQESEDTEALIFGGGFFVKPKPLQQKAMLGSFGSMGGDDEESISAFIGNGDEDDWSLCEDEFEMTRRSRRSLMEAPLELVGLGSSSSMDSFASWKMNGSGMEKEEREETPLQGEDESRRSSPP

SEQ ID NO: 206591 - protein, 68 aa, Glycine max
  Coding DNA Sequence Number=SeqID_89813
MSLPSAVHVFSIIQCEASGDWEARYSVVFQIGSFAKRKKAEVEMRVVIAKKGRTDEISVLSLLSSYLR

SEQ ID NO: 206592 - protein, 104 aa, Glycine max
  Coding DNA Sequence Number=SeqID_89814
MKTITKQFEELDVCGKVTLKSKLREIAYPDLNSTCAPLEKNSNSSVKHSASSSEQPIQRRSMSMLDQFHPCIHDSIVNIVDVKVDGHHDQVDEYNQHGICHCIK

SEQ ID NO: 206593 - protein, 154 aa, Glycine max
  Coding DNA Sequence Number=SeqID_89815
MLGRHILAERKVEIYHTELDEFKGGLERRNFHKCLTNLADSSIDLALVKEFYTNLYSLEGPSPKQVRNRGHLIRIDADSLNSFLETPVVLAEGESLPTYLRYCRIPTDIREIEGHPGKILRKDLTTLAQVWSVLSYSNLALTSHTSNLTVDRAR

SEQ ID NO: 206594 - protein, 207 aa, Glycine max
  Coding DNA Sequence Number=SeqID_89816
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q0YVV5; Match level="QueryCoverage=98%, HitCoverage=24%, E-value=1e-62, Identity=60%"; Hit description =ATPase, E1-E2 type:Copper ion-binding:Copper-translocating P-type ATPase:Heavy metal ...
  Homolog annotation: Hit description=translocating P-type ATPase
  Pfam annotation: Domain name=HMA; Domain location=17-80; Score=68.2; E_value=2.6e-17; Accession=PF00403.16; Description=Heavy-metal -associated domain
  Pfam annotation: Domain name=HMA; Domain location=84-145; Score=60.0; E_value=7.6e-15; Accession=PF00403.16; Description=Heavy-metal -associated domain
  Pfam module annotation: Pfam domain module=HMA::HMA; Domain location =17-80::84-145
MMRMSKKTLSDTIQAILIPIEGMTCASCAGRVEKALTKVPGVKSVSVNLATERATIQASGEVDRNALIEAIHKTGYEVPTSRVELNVMGMTCASCVGRVERALRSVPGVVEAAVNLANERASIAGSADPAALISAIKRIGYEATVIDSLSQLQGVAERQKETELLSLKWDLIVAAALSLPVFVMEMGAHLIPGVHELIMDTIGMKSS

SEQ ID NO: 206595 - protein, 197 aa, Glycine max
  Coding DNA Sequence Number=SeqID_89817
  Gene Ontology: Mol. function=ferric-transporting ATPase activity
  Homolog annotation: Hit_ID=Q46ZT5; Match level="QueryCoverage=35%, HitCoverage=28%, E-value=2e-26, Identity=80%"; Hit description=ABC transporter related
MTVKTSDTCSSRRRSQLVCKRMPGADKPVRARQRMRKEKIPHQAPFAIQAAQLLGRAIGAGLFAITPAGERGMCCKAIKLGNARVFPVTTLRVPLRDVHPIEFKLARAGLPQTHDGAQRGGLARAVTAEQHRHAAARHLKIHAVQDVIRPDMGLHVSQVQDRLALGISHGPPPSWLPLSLRPYGTELEFVIMVIAVS

SEQ ID NO: 206596 - protein, 349 aa, Glycine max
  Coding DNA Sequence Number=SeqID_89818
  Gene Ontology: Mol. function=nucleic acid binding; Biological process= transport
  Homolog annotation: Hit_ID=Q8H6Q8; Match level="QueryCoverage=99%, HitCoverage=49%, E-value=1e-40, Identity=37%"; Hit description=CTV.20
  Pfam annotation: Domain name=DUF755; Domain location=153-252; Score= -37.7; E_value=0.034; Accession=PF05501.2; Description=Domain of unknown function (DUF755)
  Pfam annotation: Domain name=zf-CCHC; Domain location=262-279; Score =30.4; E_value=6.5e-06; Accession=PF00098.13; Description=Zinc knuckle
  Pfam module annotation: Pfam domain module=DUF755::zf-CCHC; Domain location=153-252::262-279
MVATAYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKICQDDKIQRQLAKEKAQTKRDLGSFCEQFGLPACPKQKKKQTSRKEAQDHKPANRRRFSKRRYSQKPSTSREMENPKQKIKLKITCYNCGKQGHISKYCRLKKKLRNLNLEPSIEEQINNLLIETSKEETETETSSSVLSDENLNLIQQDDQLSSTNDDGQINTLTREQDL

SEQ ID NO: 206597 - protein, 245 aa, Glycine max
  Coding DNA Sequence Number=SeqID_89819
MTEKLLQYLWNFKVFKNFDFKDIEGNSVEIIHFGKWNTNAGPDFLLASIKINNLILSGNIELHVKSSDWIFHNHSGDPNYQNIILHVVFQNDIVIEEFNDKKIPTLELKNYIDENILWKYEKLIKENQFIPCESIFDQHNVPLHFHEENVLRKLNEKSEELEHALQQSKNNFEAILFHSLAYSFGLKVNAYIFRQIAESIDYSVINKIRQNPTHLEALFFGISGWLEYPEDEQMEIWKREFQFIN

SEQ ID NO: 206598 - protein, 185 aa, Glycine max
  Coding DNA Sequence Number=SeqID_89820
  Gene Ontology: Mol. function=RNA-directed DNA polymerase activity; Biological process=RNA-dependent DNA replication
MAELCIMPNVVIPPKFKVQDFNKYTGTTCPKNHLKMYCRKMGAYAKDEKLLMHSFQESLTGAVVTWYTNLEPSQYQYNFDMAPDRMQLQNMCKKEHESFKEYAQRCRDLATQVAPPMTEKKMITMIVDTLPVFYYEKMVGYTPSSFADLVFAGERIEVGLRRGKFVFPTLMNRKPGENGENEKEG

SEQ ID NO: 206599 - protein, 75 aa, Glycine max
  Coding DNA Sequence Number=SeqID_89821
  Gene Ontology: Mol. function=protein kinase activity; Biological process=protein amino acid phosphorylation
  Homolog annotation: Hit_ID=Q9SDX2; Match level="QueryCoverage=90%, HitCoverage=84%, E-value=4e-22, Identity=72%"; Hit description =Protein kinase HPK1
MDRAALTVGPGMDMPIMHDSDRYDLVRDIGSGNFGVARLMQDKQTKELVAVKYIEREFFSLRHSFGVSYSDEVAD

SEQ ID NO: 206600 - protein, 71 aa, Glycine max
  Coding DNA Sequence Number=SeqID_89822
  Subcellular localization annotation: CTP_CleavageSite=54; ConfidenceScore=5.25e-01
MVADTPKTLKLPPKSRSQKIVAKFSRSDNKCSHGHCKNVGNCGRGHSKNLDVVTKNSAANRFLNKTLEKYN

SEQ ID NO: 206601 - protein, 121 aa, Glycine max
  Coding DNA Sequence Number=SeqID_89823
  Gene Ontology: Mol. function=protein serine/threonine kinase activity; Cellular component=cytoplasm; Biological process=response to abscisic acid stimulus
  Homolog annotation: Hit_ID=Q940H6; Match level="QueryCoverage=66%, HitCoverage=19%, E-value=5e-30, Identity=95%"; Hit description =Protein kinase-like protein
MEYASGGELFEKICNAGRFTEDEARFFFQQLISGVSYCHAMSSYNMSLHEASMSSGLEAGKHFAGWKLGTSFKDMRFWVLQDLDCDDGNELLLKLLKDCFGNLGYWKRHISTRLLMVNFII

SEQ ID NO: 206602 - protein, 603 aa, Glycine max
  Coding DNA Sequence Number=SeqID_89824
  Gene Ontology: Mol. function=transporter activity; Cellular component= outer membrane-bounded periplasmic space; Biological process=transport
  Homolog annotation: Hit_ID=Q8D0Z9; Match level="QueryCoverage=72%, HitCoverage=93%, E-value=1e-168, Identity=61%"; Hit description =Putative periplasmic binding transport protein
  Pfam annotation: Domain name=SBP_bac_3; Domain location=72-294; Score= 103.5; E_value=6.1e-28; Accession=PF00497.10; Description=Bacterial extracellular solute-binding proteins, family 3
  Pfam annotation: Domain name=SLT; Domain location=276-388; Score =113.9; E_value=4.6e-31; Accession=PF01464.10; Description =Transglycosylase SLT domain
  Pfam module annotation: Pfam domain module=SBP_bac_3::SLT; Domain location=72-294::276-388
MGRNRENGRYYREMARTEACEPLRDNYLKRLKLNYLFIGLITVLLALALWPSIPWYGGGKDALSQIKSRGVLRISTVNSPLTYYTINNAPAGMDYELAKRFADYLGVKLEVTVRPNLGDLFDDLDDGKADLLAAGLIYNSERLSRYQSGPSYYSVSQQLVYRIDKPRPKNLGDLKGRLIVQSGSAYLSTLRSAKADSYPDLDWAISTDMGQKALLEAVADGKLDYTVGDSVTIGLLQRIHPQLAVAFDITDEEPVTWYLPRNDDDSLNAAMLDFYSQMGEEGTMARLEEKYLGHESHWNPQATSPTGVRGMMMLTRNTADSLDVNDRLDPEQSIRGGSEYLRRMMEKVPETIPEDERIWFALAAYNMGYAHMLDARRLTLKQGGNPDSWADVKLRLPMLSQKRYYAQTTYGYARGHEAYNYVENIRKYQISLVGYLQEQEKRLAQQSALEAELGAVAQQRGALFGQHAMRNLNLMIHARMADHIQQRTGGTGFLILRAIDQTGNPAVHHGTGTHHARLQRHRHNLGMRGGIALANRPVPALANHSVTLHQYRTDRHFALLPRTPRQFKRVAHPFTARRHAPAMLAEKQQRVILLAVAVAAVQL

SEQ ID NO: 206603 - protein, 169 aa, Glycine max
  Coding DNA Sequence Number=SeqID_89825
  Homolog annotation: Hit_ID=Q9SJZ6; Match level="QueryCoverage=31%, HitCoverage=24%, E-value=4e-18, Identity=77%"; Hit description =Expressed protein
MAENLLIGDPPIIFNWRGSGSEILLESVRVRSSRSRSLPLAFALFVPLIYSYLSTLSIVDMECVVQGIIETQHVEALEILLQGLCGVQRERLRIHEICLKSGPHLGSRETDIDTTKPSILIYKQAPENLRVHMIITVLRIEKKSTILHPTPPRQKKSASPQSLTQFPPS

SEQ ID NO: 206604 - protein, 130 aa, Glycine max
  Coding DNA Sequence Number=SeqID_89826
  Homolog annotation: Hit_ID=Q1T493; Match level="QueryCoverage=96%, HitCoverage=23%, E-value=2e-14, Identity=33%"; Hit description =Nucleic acid-binding, OB-fold, subgroup
FLKFLDDYEGDGPITVLLSHCRIKEAQGSYPALISNSFKASKLIINQPVMEIQEFNERLAELGIEARSGFKSHGEGSTQLSGSIQLSSKESIFGKAKAETIADINTIYEEIVCVTVGTITRIVLDNHSWC

SEQ ID NO: 206605 - protein, 730 aa, Glycine max
  Coding DNA Sequence Number=SeqID_89827
  Homolog annotation: Hit_ID=P68667; Match level="QueryCoverage=37%, HitCoverage=90%, E-value=1e-126, Identity=79%"; Hit description=SfII prophage-derived bactoprenol glucosyl transferase
  Pfam annotation: Domain name=Glycos_transf_2; Domain location=99-261; Score=102.8; E_value=1e-27; Accession=PF00535.16; Description =Glycosyl transferase
  Pfam annotation: Domain name=GtrA; Domain location=7-105; Score=25.9; E_value=0.0001; Accession=PF04138.4; Description=GtrA-like protein
  Pfam module annotation: Pfam domain module=Glycos_transf_2::GtrA; Domain location=99-261::7-105
MLKLISRYAGIGVINTAIHWTVFALILKLFESGQAMANFGAFCVAVTFSFFANARWTFSSAATPLRYLLYVSFMGGMAALVGWMADACTLSPGSKMKLSLVVPVFNEEETIPLFYQAVRHELAGYQVEIVFINDGSSDGSENIINALAISDPLVIALSFTRNFGKEPALFAGLEHATGDAVIPIDVDLQDPIAVIHQLVERWQAGADVVLAKRKDRSADGHVKRKTAEWFYHFHNQISSPKIEENVGDFRLLSRETVEHIKSLPERNLFMKGILSWVGGKTAIVEYDRAERVTGVSKFNGWKLWNLALEGLTSFSTFPLRIWSYIGGSVALLSFLYGFWMIIDKLLWGNPVAGYPSLLVSILFLGGVQLIGIVFERHPSAMYLILAVALLIGYSPVYLSTYGFSDDWFYLYASTTDAFSIFKWDILSGRPFYGAIRYFFAFLIDDVQDLTWLRALSLLSLILLGGYIIRFLERRSIFASAVQRLTFATLLSLCPVRTAGGHQLFNAGGKQRPGPAQRGDQADVDAGIWHGDGAGAGESSAARAAPDFKPRKAFLFLFFLLAAGIPNLLVSEDWAAYRTVIALSLITTSAFIAGLFVIFNKLKITTSASIVCLVIAVLSCMLNIQKGFSTPQQREYQLLSSAITESVPAEYSGQLYYRIDSDNLPAVAKSKKYDEFGSLSLGMPWTFAGMADAIKKEHAMKFSLPKAPVIYGSDQCPGDCLTLDATHVLAP

SEQ ID NO: 206606 - protein, 544 aa, Glycine max
  Coding DNA Sequence Number=SeqID_89828
  Homolog annotation: Hit_ID=UPI000016344C; Match level="QueryCoverage =85%, HitCoverage=77%, E-value=2e-53, Identity=31%"; Hit description =protein binding
  Pfam annotation: Domain name=Ank; Domain location=112-145; Score=1.7; E_value=18; Accession=PF00023.20; Description=Ankyrin repeat
  Pfam annotation: Domain name=Ank; Domain location=146-181; Score=9.8; E_value=1.2; Accession=PF00023.20; Description=Ankyrin repeat
  Pfam annotation: Domain name=Ank; Domain location=77-111; Score=10.8; E_value=0.86; Accession=PF00023.20; Description=Ankyrin repeat
  Pfam module annotation: Pfam domain module=Ank::Ank::Ank; Domain location=112-145::146-181::77-111
MAMAVRNTTNPEELQIVIHKVDSVQFRSPSCDLVQNTRDYVNKCAPIYNLAIKGDWKEAKTMLAKDRRLATAAISQGWATLLHVAAEANHLHFVEELVKLLSEKDLEIQDLKGNTAFCFAAAVGNVKIAEAMARKNRSLPTIRGGEGLTPLHLAALQGKGEMAWYLYHDTVHNLNHMFGDADWSLLFFLCINTGIYDLALKMLQENPRLAVAQNENKETGLHVLARKPSAFSCQGRRYPNQLINSRKNPTLALQLVRCFWKNLLSLDCTEIQMRIVISQLSQVIFIAAEVGNFEIIAELVRSYPDLSWEVDAKNRSIIHIAVLHRHAAIFNLIHEIRTIKNFVVAYEDADQNNLLHCAAKLAPPSQLNLVSGAAFQMMRELRWFEVVKKVMPPCFIEKRNSNGKTPRELFTEEHTELLTKAECWMKGMAKSCMIVSTLIATEVFTAAFSIPRGDGGDDNNNGNLNCNSIFIIFAISDATALISSSVSILIFLSMLVISRYAEDDFFKSLPMKLICGLTLSAQPIFVGLYFGQVNMFFTRKTEAV

SEQ ID NO: 206607 - protein, 156 aa, Glycine max
  Coding DNA Sequence Number=SeqID_89829
MEYVQLLSWKLMRFCTKGFIYPPSSWINNPLACMNGEVCLHLKIWCSSCRSGGGVGVFGAVAEGAGVYGSFGGSIVVVEQHGSDEGVERPLGAVDLVVTDMGLFKGRDGNLDEELEILNSVVAKGVDIIDLDDTIEREVQRWSEGSPQRLARVRAE

SEQ ID NO: 206608 - protein, 245 aa, Glycine max
  Coding DNA Sequence Number=SeqID_89830
MGCLLRRKASKIQVTIIKSVKWKHSICLIVVNSIVRLGVIAQINHAIGAVGVVSKECKVVVAQYGKTILDKLINEVLSVSAVRDNILEAVKVLIDGAYVSTVLESLLFSKTVCFYPSLKVNTFNDVSFYDGRRPSLYVAIASFTPHLPPILEEPTMTAGVDGLTSAPIRPNIAKTLQAENVSYSASLITLIKANQVHGLSHEDPYTQLANAVEICNTMKIAQANNLRTWEEVVFKFLKKYFPQPI

SEQ ID NO: 206609 - protein, 67 aa, Glycine max
  Coding DNA Sequence Number=SeqID_89831
MKTLKASSAGKFDQPAPHWIEVKSHTQIRGYKCDYYAMHWMWNIVSGGLKNEWSMEIYFHKFELLIE

SEQ ID NO: 206610 - protein, 104 aa, Glycine max
  Coding DNA Sequence Number=SeqID_89832
MRRDRSPHLYCLRAIPFSTSTNILSQIPMVKNLVTNILFKFHDDPTVNESKIVIFLRQIWWPAGKIEGFERRREKNENEEKMRHRQSETDLTSLFILRVHTTYY

SEQ ID NO: 206611 - protein, 817 aa, Glycine max
  Coding DNA Sequence Number=SeqID_89833
  Homolog annotation: Hit_ID=P0AFX9; Match level="QueryCoverage=36%, HitCoverage=93%, E-value=1e-111, Identity=65%"; Hit description =Sigma-E factor regulatory protein rseB precursor
  Pfam annotation: Domain name=MucB_RseB; Domain location=351-664; Score=473.5; E_value=2.6e-139; Accession=PF03888.5; Description =MucBRseB family
  Pfam annotation: Domain name=RseA_C; Domain location=278-346; Score =74.6; E_value=3.2e-19; Accession=PF03873.4; Description=Anti sigma-E protein RseA, C-terminal domain
  Pfam annotation: Domain name=RseA_N; Domain location=158-234; Score =96.6; E_value=7.6e-26; Accession=PF03872.4; Description=Anti sigma-E protein RseA, N-terminal domain
  Pfam annotation: Domain name=RseC_MucC; Domain location=644-775; Score=133.0; E_value=8e-37; Accession=PF04246.3; Description =Positive regulator of sigma(E), RseCMucC
  Pfam annotation: Domain name=Sigma70_ECF; Domain location=6-190; Score=-48.2; E_value=0.00011; Accession=PF07638.2; Description=ECF sigma factor
  Pfam annotation: Domain name=Sigma70_r2; Domain location=29-96; Score= 79.9; E_value=7.8e-21; Accession=PF04542.4; Description=Sigma-70 region 2
  Pfam annotation: Domain name=Sigma70_r4_2; Domain location=132-188; Score=34.8; E_value=3.1e-07; Accession=PF08281.2; Description=Sigma -70, region 4
  Pfam module annotation: Pfam domain module=MucB_RseB::RseA_C::RseA _N::RseC_MucC::Sigma70_ECF::Sigma70_r2::Sigma70_r4_2; Domain location= 351-664::278-346::158-234::644-775::6-190::29-96::132-188
TLPRMSEQLTDQVLVERVQKGDQKSFNLLVIRYQHKVASLVSRYVPSGDVPDVVQESFIKAYRALESFRGDSAFYTWLYRIAVNTAKNYLVAQGRRPPSSDVDAIDAENFESAGALKEISNPENLMLSDELKQIVFRTIEALPEDLRMAITLRELDGLSYEEIAAIMDCPDADLQKSWESYHLIRDTLRGDVGEVLHFDISARVAAAIENEPVRKVTSLIPEAQPEPSRWQKMPFWRRGGGWVAQVTQIGVAACVSLAVIVGVQHYNSSPAGSATETSDAPAFNTLPMMGKASPVSLGVPSDAFDTNSSNQQVQEQRRRVNAMLQDYELQRRLHADQVQFESNAPQQAQANVPGTQSLGTQQHLLWSSTAPAQTSASGALLQQMEQASQNLNYEFAYINVSRLGIESLRYRHAVIDNRVFAQLLQMDGPRREVIQRGNDISYFEPGLDPFSLPGKHIIDALPALMFADFSRLGDAYDFIPVGRSRMADQMCEVVRIVSRDGTRYSYVVWLDVDTKLPLRIDLLDRDGETLEQFRVISFAVDEGVRNLMQGLEKANLPPSLSLPAGDKVQLSWQPGWLPAGMKLISQSRRDIPAMNKTVESRLYSDGLFSFAINITPADKSSSPQSLRTGRRTVQTEVRDNREITVVGELPPTTAKRIADSIDSARKGCGSHALNQLGPKNAHVMTIASPEPLQPGQRIELGIRESSLLGSALLVYMTPLFGLFLVAGLFQMLFHSDLAAACGALLGGVGGFIVAKGVSSRFGDREAFQPVILSVALPPDALRFHSLTRGVNSVICVVINEADRVPGKAHLPECVCAH

SEQ ID NO: 206612 - protein, 707 aa, Glycine max
  Coding DNA Sequence Number=SeqID_89834
  Gene Ontology: Mol. function=nucleic acid binding; Cellular component= chromatin; Biological process=DNA integration
  Homolog annotation: Hit_ID=Q1S6N9; Match level="QueryCoverage=61%, HitCoverage=63%, E-value=1e-110, Identity=51%"; Hit description =Integrase, catalytic region; Zinc finger, CCHC-type; Peptidase aspartic, catalytic
  Pfam annotation: Domain name=Ank; Domain location=555-585; Score=0.0; E_value=31; Accession=PF00023.20; Description=Ankyrin repeat
  Pfam annotation: Domain name=Ank; Domain location=625-657; Score =14.2; E_value=0.28; Accession=PF00023.20; Description=Ankyrin repeat
  Pfam annotation: Domain name=Ank; Domain location=659-691; Score =10.2; E_value=1.1; Accession=PF00023.20; Description=Ankyrin repeat
  Pfam annotation: Domain name=rve; Domain location=206-342; Score =76.3; E_value=9.5e-20; Accession=PF00665.16; Description=Integrase core domain
  Pfam module annotation: Pfam domain module=Ank::Ank::Ank::RVT_2::rve; Domain location=555-585::625-657::659-691::277-450::206-342
  Subcellular localization annotation: CTP_CleavageSite=45; ConfidenceScore=5.76e-01
MDTVNANPAATSSPSQTQVVVPMASAYFSSPSVELTTSSPQAHVVQMASPQPRHPSRHILEDKNSGCTNHMTSNEELIRDLDKSQVSKVRMGNGDYITIKGKGIVIIESSTGTKQISNVLYAPDIDKNLLSVRQLLEKGFKIFFENKQCTIKDPYDNEVIRIKMRGKSFSLDPMAEEQAAYMVAMTNTKTWHKRPAKLPFQKGAWRANMKLRLIHTDVAGPHKNPSLNGSVFFKFKNWIENQSGFRIQVLRSNNGKEYTSNEFDKFCEEVGIEYQLIALYTPQQNGVNEWKNRTIMEMARCLLHEKELPREYWAEASNTVVFLLNRLPTKAVDGKTPFESWYDFKPQLKNLKVFDCLCFTNVPQVKRDKLDKRAKPDIFISNIELIQQFKEDMMRVFEITDLGEMSYFLGIEIEQRQNEIFISQQKHAEEILKKFRMGNCKSMRTPMCQKEKLCKDDGATKVDEFEYRTAKRVLRYVKGTVSFGVKFFLTPSFELQDVQKDGTVRLKYRKIEDQLADIFTKPFAKSRFEDLRERLEICTYRSMMQGGVFEWEYLEKCIPLYKLALRGDWNAARRMIDADTSLLNAAITKEWGTLLHVVAGTDQVHFVNQLVKLLSPDDLELQNFNGNTAFCYAAAFGSLQIAAMMIKKNACLPKIRGGEGATPLYMAALQGKGDMARHLYDLTSEILEEDEWTTLFFLCIKNGLYGE

SEQ ID NO: 206613 - protein, 311 aa, Glycine max
  Coding DNA Sequence Number=SeqID_89835
  Gene Ontology: Mol. function=transferase activity
  Homolog annotation: Hit_ID=UPI000016344C; Match level="QueryCoverage =84%, HitCoverage=43%, E-value=5e-39, Identity=34%"; Hit description =protein binding
MASLTSPIIVTGMKTTPFVQLVECLWNKLLQQDYDETEMRSFINLPSQITFDATQVGNFQFVATLMRSFPDLLWEMDEKNRSIIHIAVIHRHSSIYSLIHELGSFKDFISTFEDDEGNNILHYAAKLTPPDKLSLISGAALQMTHELRWFETEVKELMLLLDVEKKNVKGKTPREIFAEEHKELLIKAESWTKSTSINCMLVSALITAGVFTATFMIPGGNDKKLGTPNFLHKPAFLAFSLSVACALVSASASILMFLSIYISYAEEECFKLLPKKLLLGMVAQIISIISMMVAFSVAFYMSYSHGSKWTY

SEQ ID NO: 206614 - protein, 60 aa, Glycine max
  Coding DNA Sequence Number=SeqID_89836
WEITEEIRDQSWKIAESGSRKRIGRKIKELYMQLILCKGLVSFAYPRGEVEPTELSVAEE

SEQ ID NO: 206615 - protein, 87 aa, Glycine max
  Coding DNA Sequence Number=SeqID_89837
MATIWSLWLPRNEVIFKGTTVTDDVVLDPGPGFMPRLLIHIISFLNDIESDVVPSSLIVIGFQLGNNLLGYGPWVRGFVLKGYLRHV

SEQ ID NO: 206616 - protein, 69 aa, Glycine max
  Coding DNA Sequence Number=SeqID_89838
MVRNFKLPLLKLQEFGNIDLCFANENDAAELLRQDTTTPKSWLSCCKKIVVVPRCIMCIATTLLSYYCS

SEQ ID NO: 206617 - protein, 67 aa, Glycine max
  Coding DNA Sequence Number=SeqID_89839
MKFRGAVPFLIPMKRGIINCGNIKDEGGGHNPLFEDLPSECGSGAATVRYGLISNDTHEARYKCKAV

SEQ ID NO: 206618 - protein, 110 aa, Glycine max
  Coding DNA Sequence Number=SeqID_89840
MFEENPDPIVGGSHHLLCYGCRNLPFGRRANWGSRVHLPMEEGARSRHQRLFKENVRKIGSCGLRTLSVKGSGIVFTHREGMVDKSRVFAPTYPRFVMRNSDLRSSYEKR

SEQ ID NO: 206619 - protein, 127 aa, Glycine max
  Coding DNA Sequence Number=SeqID_89841
  Gene Ontology: Mol. function=nucleic acid binding; Biological process= DNA integration
MRGREGKERLHRDKTEGAYLTSTYQNKERKKTKDVVQGSSKQRKQKKVKKFTCYFYKKSGYMKKKCPKYATWHVMKVNLAFVPKDIWWVDCGATTYISMSLHMIALGADRQVMMKDSSLWVMTKRLQ

SEQ ID NO: 206620 - protein, 205 aa, Glycine max
  Coding DNA Sequence Number=SeqID_89842
  Gene Ontology: Mol. function=ion channel activity; Cellular component= integral to membrane; Biological process=hypersensitive response
  Homolog annotation: Hit_ID=Q94AS9; Match level="QueryCoverage=62%, HitCoverage=17%, E-value=4e-34, Identity=59%"; Hit description =Cyclic nucleotide-gated ion channel 4
TEQDPSSRAPHVLDYATTTSDEEAEQDEEEELVPEENGFGNGVRWFPAASGCGGRRSGGGALGRVLDPRAKWVQEWNRVFLLVCAAGLFVDPLFFYVLSVSDSCMCVFVDGWLAVTVTVLRCMTDALHVWNMVIRSKMAKRTFGLGAATASGRGSSSSIGLRDTRPCSVAIGYLKSRTGFFFDLFVILPLPQGLTQHSIRRGPTM

SEQ ID NO: 206621 - protein, 106 aa, Glycine max
  Coding DNA Sequence Number=SeqID_89843
  Gene Ontology: Mol. function=hydrolase activity
  Homolog annotation: Hit_ID=Q7N713; Match level="QueryCoverage=95%, HitCoverage=36%, E-value=4e-24, Identity=51%"; Hit description =Similar to metal-dependent hydrolases of the beta-lactamase superfamily II
MALTIRVLLENRLAAQADPALTAKAGLSLLLEDETSKVLFDTGPDGSFLKNAQRMGIKLDNLTAAVLSHGHYDHCGGVPWLPEGSRIICHPQLTQPRYAAISLGRH

SEQ ID NO: 206622 - protein, 266 aa, Glycine max
  Coding DNA Sequence Number=SeqID_89844
  Gene Ontology: Mol. function=trans-aconitate 2-methyltransferase activity; Cellular component=nucleus; Biological process=metabolic process
  Homolog annotation: Hit_ID=P76145; Match level="QueryCoverage=83%, HitCoverage=99%, E-value=7e-75, Identity=61%"; Hit description=Trans- aconitate 2-methyltransferase
  Pfam annotation: Domain name=Methyltransf_11; Domain location=40-132; Score=70.9; E_value=4e-18; Accession=PF08241.2; Description =Methyltransferase domain
  Pfam annotation: Domain name=Methyltransf_12; Domain location=40-130; Score=52.4; E_value=1.5e-12; Accession=PF08242.2; Description =Methyltransferase domain
  Pfam module annotation: Pfam domain module=Methyltransf _11::Methyltransf_12; Domain location=40-132::40-130
MRLSMADWNPSLYLKFADERTRPAAELTARIAQQPVKLAVDLGCGPGNSTALLRAAWPEARIIGVDNSAAMLAQAAQALPDCEFITANIEDWQPSEPADVIYANASLQWLTDHQTLFPRLAGQLSNGGVLAVQMPDNWQEPSHTLMRQVAEELGFPESGRQPLPRVQQYYDMLSNSGCEVDIWRTTYYHPLESHQAIVDWLQATGLRPVTERYCYCSRGCLLSRDAWLTRSRQFDINVKRIQLIYHTAAQPVIADDDIKLAQRQDQ

SEQ ID NO: 206623 - protein, 539 aa, Glycine max
  Coding DNA Sequence Number=SeqID_89845
  Gene Ontology: Mol. function=nucleic acid binding; Cellular component= nuclear pore; Biological process=DNA integration
  Homolog annotation: Hit_ID=Q1T4S3; Match level="QueryCoverage=99%, HitCoverage=65%, E-value=5e-40, Identity=46%"; Hit description=Zinc finger, CCHC-type
  Pfam annotation: Domain name=GRP; Domain location=71-152; Score= -28.6; E_value=0.064; Accession=PF07172.2; Description=Glycine rich protein family
  Pfam module annotation: Pfam domain module=GRP::RVT_2; Domain location=71-152::449-539
MQTKAHAHQLRTDLRSTSLDGKTMREFLSQIKNIVDKLTGVDNPVPHEEHVDAILEGLPHDYAPVISVIESKFETPPVVEVEALLLAHESRANRFHKQSFSPSINYTKGYVLPNSNDTSTHNNSSGGYGHNGGGRGNNGGRRGIGNGKGRGTLQPMQINPSQSNNRTSNTWVNPNLKNSNQDINVTLATPSAMLVNVSSTGAAHSAWIPDSDASFHVTDEPQNIHKLGHFEGPNQIFIGNCQGLHINGSGSSSFLSPINSHVCFRLNNLLHVPSITKNLLSVSKFAKDNYVFFEFHPHHCLVKSQGTHETLLLGVVGVDALYSFPNLKLQESSMLLSSAAKSPSSSADLSSRSRVVFNSSDQPSLSSNNSLHNNETSPTSVSQPKFDSSSPSESLEHGELVSRTTNAHPMQTRSKSGIYTPRIHHSLFLAHSEPKGVKQALTDPNWLSAMQLEYAALLKNHTWDLVPLPSNRRAVGCEWVFRIKENADGSINKYKARLVAKGIHQVHGFDFHETFSPVVKPITIRLIITLTLTNNWELF

SEQ ID NO: 206624 - protein, 1106 aa, Glycine max
  Coding DNA Sequence Number=SeqID_89846
  Gene Ontology: Mol. function=transmembrane receptor activity; Cellular component=membrane; Biological process=defense response
  Homolog annotation: Hit_ID=Q1SI46; Match level="QueryCoverage=99%, HitCoverage=93%, E-value=0.0, Identity=45%"; Hit description=Leucine Rich Repeat, putative
  Pfam annotation: Domain name=LRR_1; Domain location=608-629; Score =1.0; E_value=1.9e+02; Accession=PF00560.23; Description=Leucine Rich Repeat
  Pfam annotation: Domain name=LRR_1; Domain location=631-652; Score =6.0; E_value=22; Accession=PF00560.23; Description=Leucine Rich Repeat
  Pfam annotation: Domain name=LRR_1; Domain location=654-676; Score =11.2; E_value=2.3; Accession=PF00560.23; Description=Leucine Rich Repeat
  Pfam annotation: Domain name=LRR_1; Domain location=678-700; Score =12.0; E_value=1.6; Accession=PF00560.23; Description=Leucine Rich Repeat
  Pfam annotation: Domain name=LRR_1; Domain location=701-722; Score =6.1; E_value=21; Accession=PF00560.23; Description=Leucine Rich Repeat
  Pfam annotation: Domain name=LRR_1; Domain location=745-766; Score =9.9; E_value=4; Accession=PF00560.23; Description=Leucine Rich Repeat
  Pfam annotation: Domain name=LRR_1; Domain location=768-789; Score =8.1; E_value=8.7; Accession=PF00560.23; Description=Leucine Rich Repeat
  Pfam annotation: Domain name=LRR_1; Domain location=810-835; Score =6.6; E_value=17; Accession=PF00560.23; Description=Leucine Rich Repeat
  Pfam annotation: Domain name=LRR_1; Domain location=852-873; Score =6.8; E_value=15; Accession=PF00560.23; Description=Leucine Rich Repeat
  Pfam annotation: Domain name=LRR_3; Domain location=608-627; Score =31.1; E_value=3.8e-06; Accession=PF07725.3; Description=Leucine Rich Repeat
  Pfam annotation: Domain name=NACHT; Domain location=205-357; Score =18.3; E_value=2.1e-06; Accession=PF05729.3; Description=NACHT domain
  Pfam annotation: Domain name=NB-ARC; Domain location=165-461; Score =105.3; E_value=1.8e-28; Accession=PF00931.13; Description=NB-ARC domain
  Pfam annotation: Domain name=TIR; Domain location=13-143; Score =152.2; E_value=1.3e-42; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_3::NACHT::NB-ARC::TIR; Domain location=608-629::631-652::654-676::678-700::701-722::745 -766::768-789::810-835:...
  Pfam module annotation: Domain location=:852-873::608-627::205 -357::165-461::13-143
MSDNNSPETKYDVFVSFRGKDIRDGFLSHLTDTFLRKKINVFVDETNLKKGDEIWPSLAVAIEVSSISLIIFSQDYASSRWCLEELVKILECREKYGRIVIPIFYHVQPKNVRHQLGSYENIFAQRGRKYKTKVQIWKDALNISADLSGVESSRFQNDAELIQEIVNVVLNKLAKPSVNSKGIVGIDEEIANVELLISKEPKKTRLIGIWGMGGIGKSTLAEKVLNKLRSGFEGCYFLANEREQSNRHGLISLKEKIFSELLGYDVKIDTLYSLPEDIVRRISCMKVLLILDDVNDLDHLEKLLGTLDNFGSGSRIIVTTRDEQVLKANKVDEIYRLREFNHDKALEFFNLNTFNQSDDQREYSTLSEKVVDYARGIPLVLKVLAHLLRGRKKEIWESELDKLRRMPPTTVYDAMKLSYDDLDRKEQQLFLDLACFFLRSHIIVNVSNVKSLLKDGESDNSVVVGLERLKDKALITISEDNCISMHDCLQEMAWEIVRREDPESRSWLWDPNDDIYEALENDKCTEAIRSIRIHLPTFKKHKLCRHIFAKMRRLQFLETSGEYRYNFDCFDQHDILAEGLQFLATELKFLCWYYYPLKLLPENFSPEKLVILNMPGGRIEKLWHGVKNLVNLKQLDLGWSQMLKELPDLSKARNLEVLLLGGCSMLSSVHPSIFSLPKLEKLDLWNCRSLTRLASDCHLCSLCYLNLDYCKNLTEFSLISENMKELGLRFTKVKALPSTFGCQSKLKSLHLKGSAIERLPASINNLTQLLHLEVSRCRKLQTIAELPMFLETLDVYFCTSLRTLQELPPFLKTLNVKDCKSLQTLAELPLSLKTLNVKECKSLQTLPKLPPLLETLYVRKCTSLQTLPELPCFVKTLYAIYCTSLKTVLFPSTAVEQLKENRTRVLFLNCLKLDEHSLEAIGLTAQINVMKFANQHLSTPNHDHVENYNDYDYGDNHHSYQAVYLYPGSSVPEWMEYKTTKDYINIDLSSAPYSPLLSFIFCFVLDKYRDTALIERFYVNITVNDGEGERKKDSVRMHIGYLDSTIESNHVCVMYDQRCSHFLNSRAKNQTRLRIEVSMGVRIFYYETYKPLQRVLKGFGVSLISS

SEQ ID NO: 206625 - protein, 122 aa, Glycine max
  Coding DNA Sequence Number=SeqID_89847
  Homolog annotation: Hit_ID=Q1SRN1; Match level="QueryCoverage=76%, HitCoverage=6%, E-value=1e-09, Identity=36%"; Hit description =Integrase, catalytic region
EGLEVDKLQRFVVNPSIPQRYLTDEDRVANKVNPAYEAWEVQDQTLLTWLQSTLSKSVLSRVIGSIHSHQVWDKIHEYFHVQKKARAQSSSNKNVTRDSQHHLLTVNVKLWLGGLTLHDFRK

SEQ ID NO: 206626 - protein, 197 aa, Glycine max
  Coding DNA Sequence Number=SeqID_89848
  Gene Ontology: Mol. function=kinase activity; Cellular component =mitochondrion; Biological process=signal transduction
  Homolog annotation: Hit_ID=Q2MGQ9; Match level="QueryCoverage=98%, HitCoverage=98%, E-value=5e-71, Identity=72%"; Hit description =Histidine triad (HIT) protein
  Pfam annotation: Domain name=HIT; Domain location=93-192; Score =159.5; E_value=8.7e-45; Accession=PF01230.13; Description=HIT domain
  Subcellular localization annotation: CTP_CleavageSite=70; ConfidenceScore=5.82e-01
MAATIPFSLLRCAPFLAFVSSQSLASLTFVNCAPLKLATPFARKASNFNLLLPLQPRRLVSSTCAVNNEEAAAKTAAVNFDSEAPTIFDKIINKEIPSSIVYEDEKVLAFRDINPQAPVHVLVIPKLRDGLTQLGKADSRHGEILGQLLYAAKIVAEKEGIDDGFRVVINNGPSACQSVYHLHLHVLGGRQMNWPPG

SEQ ID NO: 206627 - protein, 91 aa, Glycine max
  Coding DNA Sequence Number=SeqID_89849
MRQASDVKEALTGRQPITGAKRANPHPLAEGAKQVSSLSATQHLAKRLSLFAWTLMSIGLSGSYPLSPHISLEWHCAKRSHLAKRNPTTAS

SEQ ID NO: 206628 - protein, 77 aa, Glycine max
  Coding DNA Sequence Number=SeqID_89850
MEDFMAQVAWPGVQPSPLGEGDAPTAQEPQLEAEVEVEETSEDTPIATPSEALEEGDGVADADYAVDMAAAQSTWNP

SEQ ID NO: 206629 - protein, 132 aa, Glycine max
  Coding DNA Sequence Number=SeqID_89851
  Gene Ontology: Mol. function=protein binding; Cellular component =cytosol; Biological process=meiotic chromosome segregation
  Homolog annotation: Hit_ID=Q8DCK8; Match level="QueryCoverage=69%, HitCoverage=59%, E-value=3e-13, Identity=48%"; Hit description =Uncharacterized conserved protein
  Pfam annotation: Domain name=UPF0047; Domain location=63-132; Score= -27.6; E_value=0.00014; Accession=PF01894.8; Description =Uncharacterised protein family UPF0047
  Subcellular localization annotation: CTP_CleavageSite=74; ConfidenceScore=5.12e-01
MQVSSICLPAKVPVRVKSLHTNPATVNDPTSTAKVAAPKWAQKTITLPPLKRGCHLITSKKMIIEATGIVKEVRQELSEYQCGLAHLFLHHTSASLTINENYDYDVRDDTETFLNGIVPEGPSAPWKHTLEG

SEQ ID NO: 206630 - protein, 191 aa, Glycine max
  Coding DNA Sequence Number=SeqID_89852
  Gene Ontology: Mol. function=nucleic acid binding
MASNAYNGTKDRRILKKSTGVHQVEVNSSSIDIGQKLDVLAKHMKTLMKENSNDDTYSPPISSGHIVFSTEANPEEDVNVVTTSSMRLITELKKKEKVDPSLEKEALIEESSRKEKGKKKEAIAQMPKYNKHIKKIISNKGKLANFVTIGLNKECSVVNLKELAPKLIDPGSFSIPRVIGNLSFDRALCDL

SEQ ID NO: 206631 - protein, 122 aa, Glycine max
  Coding DNA Sequence Number=SeqID_89853
MERARLVYDLVTKMDMDVGSFISGQISQMAQSNSSRLGFPALSTTLCIARGVVPDSMTFESLSLAINLAYIRKNCWNPDDPLITFLGTRKTRARGPDILLHPPLLLLLQLLHCTCISTSSSA

SEQ ID NO: 206632 - protein, 48 aa, Glycine max
  Coding DNA Sequence Number=SeqID_89854
MPAHIKSSMFGCALMIPISNGKLNMGTWQVTAKSTFCNDILVKINTDK

SEQ ID NO: 206633 - protein, 117 aa, Glycine max
  Coding DNA Sequence Number=SeqID_89855
MHIFMGGSPDLYASTSKSCFGDDSRLEEACDEDSTSVMNEEVGEFYVIYNLKFFCAVGYHTFSGSFILSLFSLLQQLLPKTSALVQLPTVVSGDCIGKEEEKEADDGAADAAGHSRG

SEQ ID NO: 206634 - protein, 107 aa, Glycine max
  Coding DNA Sequence Number=SeqID_89856
MSITKKIKQRTLGKDEFVVLLQRHNRRFGALKLLLKEDSRAYFIFKMEDANSIPNYFETLVLHMKTYEVKQIAVSYSSYSIKSDNNCTRCRIIPMLTKPYTLSKMEI

SEQ ID NO: 206635 - protein, 226 aa, Glycine max
  Coding DNA Sequence Number=SeqID_89857
MASRDNPSTRGSSMNKAILCYHEGKLRQLDHMDYVGPVESAWTPSRSSLVDKKTKAMVARVKAMKVQVSKTKQLVVELAKSRGLVRKLEEDSRLACWETLEEDRSNMCSPSAPQARSASRLSLLALSVPSSQVKDIGTRVEGNLETTEDKVADLKKRIEKLRSKLQKKEEAKCAVTVELDETQRQVKVLLLSFGPGQLDVNFDVVDGEIIRELQLCSESEGEEEKE

SEQ ID NO: 206636 - protein, 170 aa, Glycine max
  Coding DNA Sequence Number=SeqID_89858
  Subcellular localization annotation: CTP_CleavageSite=26; ConfidenceScore=5.07e-01
MYTKLVSSFDALINTCSLVLQGSTINNSMSSKAIMLIFLFNSSIDSRVWNRVGYELTSTETHLYQGMEDITHEAKNKGLKKKGTRPRSISSKKRKEIKSKGCRTKNTSIVGKREQRYVPPLQCRRLEILLRMRRTIQLVRSLSELSRSMSISLHEIELMLHMIGFMSTRD

SEQ ID NO: 206637 - protein, 430 aa, Glycine max
  Coding DNA Sequence Number=SeqID_89859
  Gene Ontology: Mol. function=protein serine/threonine kinase activity; Cellular component=cytoplasm; Biological process=protein amino acid phosphorylation
  Homolog annotation: Hit_ID=Q1RSV7; Match level="QueryCoverage=74%, HitCoverage=86%, E-value=1e-150, Identity=79%"; Hit description =Protein kinase
  Pfam annotation: Domain name=Pkinase; Domain location=57-326; Score =132.7; E_value=1e-36; Accession=PF00069.15; Description=Protein kinase domain
  Pfam annotation: Domain name=Pkinase_Tyr; Domain location=57-325; Score=88.8; E_value=1.7e-23; Accession=PF07714.7; Description =Protein tyrosine kinase
  Pfam module annotation: Pfam domain module=Pkinase::Pkinase_Tyr; Domain location=57-326::57-325
MKYIRSNSLKRLFSFGRHGFGEENDVGLVVFPCEEHPPRPSWKCFSYEELFDATNGFSSENVIGKGGYAEVYKGILNGGEEVAVKRLTRTSRDERKEKEFLLEIGTIGHVRHSNVLPLLGCCIDNGLYLVFELSNVGSVASLIHDEHLPHLDWKTRYKIALGTARGLHYLHKGCKRRIIHRDIKASNILLTADFEPKISDFGLARWLPSQWTHHSIAPIEGTFGHLAPEYYLHGVVDEKTDVFAFGVFLLEVISGRKPVDGSHQSLHSWAKPILNKGEIEKLVDPRLGGAYDVTQFNRVAFAASLCIRASATCRPTMSELCLGDLLVMGSNPETASLHMQGASPGAAVKLCLGDLLVMGSNPETASLHMQGEEPPGNGVLEVMEEWEMDKGKWEMPEEEEQEEELWGFEDLEYEYDSSFSMSLPDSVGST

SEQ ID NO: 206638 - protein, 101 aa, Glycine max
  Coding DNA Sequence Number=SeqID_89860
  Gene Ontology: Mol. function=zinc ion binding; Cellular component =integral to membrane
  Homolog annotation: Hit_ID=Q06A73; Match level="QueryCoverage=55%, HitCoverage=22%, E-value=3e-21, Identity=84%"; Hit description=PHD1
MACKKKTLDWLSLVDVHSDAWLLVIAFYFGARFGFDKVDRKWIFNMINELPTIFKVVTGSTNKQVKEKSSVSNHSGSKSKSNSKRYNIDVFKEFCELETYD

SEQ ID NO: 206639 - protein, 100 aa, Glycine max
  Coding DNA Sequence Number=SeqID_89861
MRKGVEERKGVNETPRRGGSMVLSEVELEVEPKRLWSLPLLKETLEKEKEVLEEEELSSWIEQAEMVLEEKEKQMEAKEEKMKRIYEENKELKWHVEAQT

SEQ ID NO: 206640 - protein, 197 aa, Glycine max
  Coding DNA Sequence Number=SeqID_89862
  Homolog annotation: Hit_ID=UPI000051021C; Match level="QueryCoverage =72%, HitCoverage=58%, E-value=6e-12, Identity=34%"; Hit description =COG1309: Transcriptional regulator
  Pfam annotation: Domain name=TetR_N; Domain location=53-99; Score =47.7; E_value=3.9e-11; Accession=PF00440.13; Description=Bacterial regulatory proteins, tetR family
MTDRGRRTSQIRAGDLSPRLTVHSKKESAILHSMDDSAESLREQRKRETSRALTEAARRLTAERGFAGFTIEELCADAGVSRRTFFNYFESKENAVFGFTTIDSRQQALEEEFASQPGDLLDDFVQLTIRRFELFNPVEDAPALFAVIEQEPRLLKAAFEQMSKNEQHDRGLILRRMQGTAEAELRAEVIVHTVGAL

SEQ ID NO: 206641 - protein, 147 aa, Glycine max
  Coding DNA Sequence Number=SeqID_89863
  Homolog annotation: Hit_ID=UPI0000526936; Match level="QueryCoverage =81%, HitCoverage=78%, E-value=3e-27, Identity=51%"; Hit description =protein of unknown function DUF322
  Pfam annotation: Domain name=DUF322; Domain location=22-131; Score =69.3; E_value=1.2e-17; Accession=PF03780.4; Description=Protein of unknown function (DUF322)
MANVTGGAQPKAQAPAAPSGTAAGKTTIEDAVVAKIAGIAAREVSGVYALGGGAARMVGAIRDALNTTDLSQGINVEVGETEVAVDVTIVAEYPVALQQVADDVRAAIHRAMVELVGMQVAEVNVTVNDVHIPSEDDASDAHEARVQ

SEQ ID NO: 206642 - protein, 54 aa, Glycine max
  Coding DNA Sequence Number=SeqID_89864
  Gene Ontology: Mol. function=nucleic acid binding
  Homolog annotation: Hit_ID=Q00M91; Match level="QueryCoverage=76%, HitCoverage=6%, E-value=9e-12, Identity=80%"; Hit description =Poly(A)-binding protein
  Subcellular localization annotation: CTP_CleavageSite=51; ConfidenceScore=5.18e-01
MNKVRLSSLLLWIPSLQPGFPTRFRSNFQGRGHPTIPWLRLRQFQQLSRCRESN

SEQ ID NO: 206643 - protein, 572 aa, Glycine max
  Coding DNA Sequence Number=SeqID_89865
  Gene Ontology: Mol. function=nucleic acid binding; Cellular component= nuclear pore; Biological process=DNA integration
  Homolog annotation: Hit_ID=Q60DN3; Match level="QueryCoverage=70%, HitCoverage=50%, E-value=8e-45, Identity=26%"; Hit description =Integrase core domain containing protein
  Pfam annotation: Domain name=rve; Domain location=289-449; Score =81.4; E_value=2.8e-21; Accession=PF00665.16; Description=Integrase core domain
WQQQVLATIRGLKLSKYLHEEHVSKKFESKEYEEAGTISEAFLNFEQQDQLLVAWLLASMSAPILTKMVQLRMIKKDKSISEYLLTIKKIVDSLSVIGSAISDDDHIEAILDGFPEDYDSFVTSITSRLDPDTVDYIEAFLLAQEEHFEKHKKADSNLILANTVSGPSYTSGRGSGDKSNSKGEYNNRGGPLQENHSQYQRVSQFDQAFMSTLTTVMDSLWYPDRGASHHISNDESNFSVKTDYTGNDRVKIGNGSDSSFIVLELWHSRLAHASLKAARQLPFFTSQSVYASPLDLVFTDIWGPAPLNSSNGSRYYIIFVYAFSRYTWMYLLQNKSQAFTAFLQFKSLVEKQLGTTLKALQSDNAKEYFTFTPYLTEQGIHHRLTCPYTHEQNGTPERKHRHLIETGLTLLASSSLPSTFGEILSTRVINVSHLLANATFLDMPSFMSQFFPYKLPGSPLVSASSPPSSNSTSSNPLLVLFPTAQNFQNANDTTDLLPNASLQCDTTNSSAVAVSSPIVGSIPQNTHPMTTRAKAGVFKPKTYASYKEGSYDYTFEPHTVKESMAKPECSKL

SEQ ID NO: 206644 - protein, 74 aa, Glycine max
  Coding DNA Sequence Number=SeqID_89866
  Gene Ontology: Mol. function=DNA binding; Cellular component =mitochondrion; Biological process=DNA integration
  Homolog annotation: Hit_ID=Q1T4S3; Match level="QueryCoverage=89%, HitCoverage=4%, E-value=1e-15, Identity=56%"; Hit description=Zinc finger, CCHC-type
MLDSKSQPTPMVSGLKLTADGSDPDDRKSTTGYCVYLGPNLVSWSFRKQTVVSRSSIEAEYRGLAVVAADILWL

SEQ ID NO: 206645 - protein, 126 aa, Glycine max
  Coding DNA Sequence Number=SeqID_89867
  Pfam annotation: Domain name=SLR1-BP; Domain location=7-74; Score =18.4; E_value=9.9e-06; Accession=PF07333.3; Description=S locus -related glycoprotein 1 binding
MAKGGCSLYTILFLLFTLGALMAMVVGDRCNEDLGVCHAEHACKAKCTKIHRGGQGICENNGSAKNHCLCYHDCEICEVGLNGLGDCNETQCNSDCAIKFPGKGATGYCFSIPETNYINCYCRYNC

SEQ ID NO: 206646 - protein, 50 aa, Glycine max
  Coding DNA Sequence Number=SeqID_89868
  Homolog annotation: Hit_ID=Q9SD67; Match level="QueryCoverage=90%, HitCoverage=5%, E-value=3e-11, Identity=73%"; Hit description=FtsH metalloprotease-like protein
GIEEKTAKLKGSEKALVTRHEPSHAVVGTAVANLLAGQPHVEALVIRLLV

SEQ ID NO: 206647 - protein, 55 aa, Glycine max
  Coding DNA Sequence Number=SeqID_89869
MKGCIIGAKSTGKFNRENLDTKDSTRPRTCTRPILGVKQPSGGTPCRAQSTSSTN

SEQ ID NO: 206648 - protein, 66 aa, Glycine max
  Coding DNA Sequence Number=SeqID_89870
MGSSQMPSLKKRFYQVKVKSLGTTSLKELGQLMGQLQRQAFREDYGKIWDLAMVEVSTYCLPCPVL

SEQ ID NO: 206649 - protein, 123 aa, Glycine max
  Coding DNA Sequence Number=SeqID_89871
MEKAFPSQPDTSHLPFLADTSGQVFITAVVSPAKPPPKLDDPLYLMTLTIPELFSRPYQVRWDATVFGVFNPDFPLYIKHEDLSEIAHGGQCLSISVLQLHLTETCMRAGNSDIYGFLEPQSI

SEQ ID NO: 206650 - protein, 161 aa, Glycine max
  Coding DNA Sequence Number=SeqID_89872
MALKHKVQSLIDAGWLTFQEDGPNMNTNLLANHGGSTVNAIEAGELERPKQMKDIATFRRFILEALKPVLFPYRSDKAVPWKYAPQKPSKRKEEATSIDLLSAKVTNITDLSGVTRSGRVFAAPNPSVRLADVKGKVKVVVEETSEEGPSLEKDVPAGVSR

SEQ ID NO: 206651 - protein, 152 aa, Glycine max
  Coding DNA Sequence Number=SeqID_89873
  Gene Ontology: Mol. function=transcription corepressor activity; Cellular component=nucleus; Biological process=regulation of transcription, DNA-dependent
  Homolog annotation: Hit_ID=Q1EPA1; Match level="QueryCoverage=92%, HitCoverage=10%, E-value=2e-34, Identity=50%"; Hit description =Paired amphipathic helix repeat-containing protein / transcription regulator-related
  Pfam annotation: Domain name=PAH; Domain location=18-64; Score=50.3; E_value=6.4e-12; Accession=PF02671.11; Description=Paired amphipathic helix repeat
  Pfam annotation: Domain name=PAH; Domain location=97-143; Score=27.2; E_value=5.7e-05; Accession=PF02671.11; Description=Paired amphipathic helix repeat
  Pfam module annotation: Pfam domain module=PAH::PAH; Domain location =18-64::97-143
MDALQYIKEVQCAFHDSREKFDKFMDAMKDYKFHRIDVGIVVEKMEEILKDNGDLILGFNKFLPKGYEILLLDEGKDGFGNASKYLKKIQDRFENKDHVYKSFLNILLKYKNNGVTLYDTYHEAATLFEGHCDLVRDFTKFLPSVHLRGKST

SEQ ID NO: 206652 - protein, 77 aa, Glycine max
  Coding DNA Sequence Number=SeqID_89874
LSTLSSRSSVTENESDHADFYDNSLALVPVTVTAKSQATNNPKPIMSVLEALDALRHARERLQSSMRTRQMIHVGPI

SEQ ID NO: 206653 - protein, 241 aa, Glycine max
  Coding DNA Sequence Number=SeqID_89875
  Homolog annotation: Hit_ID=Q10N63; Match level="QueryCoverage=94%, HitCoverage=29%, E-value=9e-39, Identity=44%"; Hit description =Expressed protein
MSWVRSAVNKAVEGGQSNFGRAVRTYADSVVLHASNAVAGGARIIQDRIVARNMQSFKHTVKRLEEVSVSCRGIERVQLLRRWLVALREVERLTVTCNGTKAKDQDNEFLHDESKDSPTPQPTLIYYVDPAAPDELKNFRDVFLSSQALEGITMSMRLSFIFADLWNLTAGYLFCVTQILDAPNEEEVSLLSEIYGLCIKGGKEEHTALLSSVQDLAKAFSGYEVEVLNVSGAKRRGSCSP

SEQ ID NO: 206654 - protein, 229 aa, Glycine max
  Coding DNA Sequence Number=SeqID_89876
  Homolog annotation: Hit_ID=Q8H7X5; Match level="QueryCoverage=38%, HitCoverage=21%, E-value=3e-07, Identity=45%"; Hit description =Putative retroelement
  Pfam annotation: Domain name=Chromo; Domain location=160-212; Score =23.4; E_value=0.00079; Accession=PF00385.14; Description='chromo' (CHRromatin Organisation MOdifier
METLQTDPTTLLDYLLRDGLVFFKGRLMLGSSSVLIPTLLAEFHESILGGHSGPFLSPKVVWEDISMDFIIDLPCSHGHFCVVSLLNNQQGGPYGYHGQSSVEYVASVLLDRDEALRQLKFHLHRAQQSMKKVVDARHHQSGVVIANLPPSMEVRDLDPLTLEAILDTRDNHCNGALFPEWLILWKSQPVEEATWESATAIQTKYPSFYLKDKANFREGGNDGIQPKEK

SEQ ID NO: 206655 - protein, 105 aa, Glycine max
  Coding DNA Sequence Number=SeqID_89877
MMTHLDNVESKLSNLKSVLKSHNLMFKEHSIQLNSLLTSVNELSKTVSSLSKEMRNGFQDNPIPPNPMSSFDDASQPLSKQVELPSFIDKDPVEWLVKAKLYFSI

SEQ ID NO: 206656 - protein, 35 aa, Glycine max
  Coding DNA Sequence Number=SeqID_89878
MVILRLVSAKRNKFDSIGMMCRKVHWPKGVSLERN

SEQ ID NO: 206657 - protein, 242 aa, Glycine max
  Coding DNA Sequence Number=SeqID_89879
  Homolog annotation: Hit_ID=Q1SJI4; Match level="QueryCoverage=34%, HitCoverage=16%, E-value=9e-12, Identity=48%"; Hit description =Peptidase aspartic, catalytic
MVKEGIKVDLLILGYLNNVKVLKIPLIVSLLSVELRDYVSTMKRVLQEVAIDRGELTHVDGNETSKVMVLDKYLIPTIHELLDDLHDSRFFSKIDLKSGFHQIQSTWTPLRFKLFLNGHDPKLRRMSGDSWALWAITIDSSVGVSLSEACALSENHALSETLNPLSELGESRGEIEKHLRAQFVISSLSETLRGQKALFKAEVGKIKGVPELGRREQNRSAKQSKDAKNLSFQEDLRFRSNF

SEQ ID NO: 206658 - protein, 62 aa, Glycine max
  Coding DNA Sequence Number=SeqID_89880
MAMGRVGYGYCLPNPLSRLLNISPCPYPIRDGFEFIVPSPYPSGTRWILSGGAGSGSRSGRV

SEQ ID NO: 206659 - protein, 77 aa, Glycine max
  Coding DNA Sequence Number=SeqID_89881
  Subcellular localization annotation: CTP_CleavageSite=37; ConfidenceScore=5.11e-01
MTKARQKKGTENRRTTNNERRTMKNGGKSSRNRPRKRLESVREKREVVAAQLTQASWVASTRRHRLLLEHPGRPKWA

SEQ ID NO: 206660 - protein, 79 aa, Glycine max
  Coding DNA Sequence Number=SeqID_89882
  Homolog annotation: Hit_ID=Q1SPJ5; Match level="QueryCoverage=70%, HitCoverage=2%, E-value=1e-16, Identity=80%"; Hit description=TPR repeat
MKPVAQHRFWNGSRVILKVHSLEFHLSQTYHEGFLKLQAKEYEKARELLEFVLKDPLMANAQVLVDSSANDGHLLQLKF

SEQ ID NO: 206661 - protein, 91 aa, Glycine max
  Coding DNA Sequence Number=SeqID_89883
  Subcellular localization annotation: CTP_CleavageSite=43; ConfidenceScore=5.32e-01
MSRNLTDYGIVPSLASGMLRNFTDCALTLPFNSRMSRNFTDCLTMSVKYLEVSSEGRIPPNRWSPDEIRVIGVVVADTHENAKIAARRVHV

SEQ ID NO: 206662 - protein, 167 aa, Glycine max
  Coding DNA Sequence Number=SeqID_89884
MWQWGVDRITKGADNYKARLPLVDKGADDDVSHCMLPDPLIRQALENVVFHLLAKPICWLNERPLSATLLGYARGRIQKTMSYTGSLSASLQVIKRTASAHPLSERSALSQNPVMCTKRTSTNKATYLSLKLDFVNRVWTGIQSFACLGFLERERSKFQRVLRDFAV

SEQ ID NO: 206663 - protein, 45 aa, Glycine max
  Coding DNA Sequence Number=SeqID_89885
VDEQYVNKLIYTSSSQVKEGAITCFIAVGCTMEVSSFQQWLGVHR

SEQ ID NO: 206664 - protein, 50 aa, Glycine max
  Coding DNA Sequence Number=SeqID_89886
MWDRHRLKGALKSGVFTPKVYTLKSPSGTFPPDSDTTHELYNTHDLTLVS

SEQ ID NO: 206665 - protein, 435 aa, Glycine max
  Coding DNA Sequence Number=SeqID_89887
  Gene Ontology: Mol. function=lyase activity; Cellular component =anchored to membrane; Biological process=pathogenesis
  Homolog annotation: Hit_ID=Q9M3D5; Match level="QueryCoverage=90%, HitCoverage=98%, E-value=1e-117, Identity=73%"; Hit description =Pectate lyase-like protein
  Pfam annotation: Domain name=Pec_lyase_C; Domain location=109-275; Score=122.0; E_value=1.7e-33; Accession=PF00544.9; Description =Pectate lyase
  Subcellular localization annotation: CTP_CleavageSite=53; ConfidenceScore=5.49e-01
MGNSHGHRHRKHGNSVPPNTVPPPHKYNPHPTTSNSTMLSLPYTHVDTTLRSLAAQAEGFGRFAIGGLHGPLHPVTSLADDGPGSLRDACRRKEPLWIVFEVSGTIQLSSYLNVSSHKTIDGRGQRIKLSGKGLRLKECEHVIICNLEFEGGRGHDVDAIQIKPNSKHIWIDRCTLSDFDDGLIDITRESTDITISRCHFSQHDKAMLIGADPTHVGDRCMRVTIHHCFFNGTRQRQPRVRFAKVHLYNNYIRNWGIYAVCASVESQIFSQHNIYEAGQKKVAFKYLTEKMLLLLSMPQSLHYLLLDMPVKVLHIAKTIPSLSSYPYQISEFLGLAPVHFTLSTLVHLHGALFTSIVTVAADKEVGATGTIRSEGDIFLNGAQKGLMTEDVGCNMFHPSEHYPSWTVEAPTDDLKQILHHCTGWQSLAKPADQTL

SEQ ID NO: 206666 - protein, 168 aa, Glycine max
  Coding DNA Sequence Number=SeqID_89888
  Gene Ontology: Mol. function=RNA-directed DNA polymerase activity; Cellular component=exocyst; Biological process=exocytosis
  Homolog annotation: Hit_ID=Q1S1D5; Match level="QueryCoverage=99%, HitCoverage=26%, E-value=5e-48, Identity=55%"; Hit description=Exo70 exocyst complex subunit
MADLKSIADCMISNGYAKECISVYTTMRKSIVDEGIYRLNVEQLSASKVNKMHWDVLEFKIKSWLEAVKIAVRTLFARERILCDHVFGASQSIREACFADVSRSGASLLFGFPELVVKTKKSPPEKIFRMIDMYAAIATLWLEIESIFSLDSTTAVKSQAYGLLLRLS

SEQ ID NO: 206667 - protein, 253 aa, Glycine max
  Coding DNA Sequence Number=SeqID_89889
  Homolog annotation: Hit_ID=Q1SFL1; Match level="QueryCoverage=24%, HitCoverage=5%, E-value=1e-12, Identity=59%"; Hit description =Integrase, catalytic region; Peptidase aspartic, catalytic
MSDEYPVKAMQEELDQFQKNNVWKLVELPKGKSAIRVKWVFRNKLDKIGNVVRNQARLVAKAPPSPIHLDHFQYQGAPTFDPNLTTDDISRLHFPGPFFYSMKTRHGIPTFGGLDIAPIEIEVLPPPTLKQLHPKVSKPSSTVVSIRASLDGIHIRPTSTIKFMPNRIAPRLPPLDLRKKKGKVPPHSKHMPHPGLKDNIALRPIPYNWSWYFTRDSAKKTIALKTNTKFDKNAPCSFILKTCTKTLIMLPLQ

SEQ ID NO: 206668 - protein, 200 aa, Glycine max
  Coding DNA Sequence Number=SeqID_89890
YGVFSGHHTGKFHGDLLDLQYKDGDVDAHHKTVEEKGKEVDGFVVDNDHVVDDYDDLEGVAEKKLVKMKNHPYTEKNKNNVAGVEFHGDNDGDVNDQGNTDDNYSSEELISDNTDSGEEDNPRPIYVMYRSEDVRKEFQFKADMEFKSLKEFKAAIQEHSALNGKERARLERKSLTESRLVEVSTDVAEYFITKMLTLIG

SEQ ID NO: 206669 - protein, 85 aa, Glycine max
  Coding DNA Sequence Number=SeqID_89891
MTSIILVEKHRNNTRDSREAKFRIHLIVRSACEMARGICTLRQLEKWQWHQHLIKQNFIFSFISMQPDAFNLSKLSPLAVVQCHL

SEQ ID NO: 206670 - protein, 95 aa, Glycine max
  Coding DNA Sequence Number=SeqID_89892
MEEDQWMYEGIMLEEVDTDENEEECGVNELHVDCSDAFNTSQVFDNRDDVLQWARFIAYENRFVTMMELWVSLQASWQANGWRIRLDGKVDLWDS

SEQ ID NO: 206671 - protein, 173 aa, Glycine max
  Coding DNA Sequence Number=SeqID_89893
DEDPQLDDIVNSDSEEDLKKTNQAHLVDFVLETTSAGDLQDNFVCKEVKTLLDEKVSSGRKILLKDYRDLEERELPPEIEKQYKEIGTLRDNLGKFVGGDEALHKIIKVQRNPKDKFSHGFKGKKGLHNVGRVSQPTLRRKGDARLMGASSKKGKYAESPPIFILGKCRKNRK

SEQ ID NO: 206672 - protein, 110 aa, Glycine max
  Coding DNA Sequence Number=SeqID_89894
  Gene Ontology: Mol. function=structural constituent of ribosome; Cellular component=intracellular; Biological process=translation
  Homolog annotation: Hit_ID=Q1S1E1; Match level="QueryCoverage=85%, HitCoverage=77%, E-value=1e-41, Identity=93%"; Hit description =Ribosomal protein L29
  Pfam annotation: Domain name=Ribosomal_L29; Domain location=6-64; Score=84.6; E_value=3.1e-22; Accession=PF00831.13; Description =Ribosomal L29 protein
MIEDKVYELRNKTKAELLNQLKDLKAELALLRVAKVTGGAPNKLSKIKVVRLSIAQVLTVISQKQKAALREAYKKKKYLPLDLRPKKTRAIRRRLTKHQIDKQLTRVVPI

SEQ ID NO: 206673 - protein, 734 aa, Glycine max
  Coding DNA Sequence Number=SeqID_89895
  Gene Ontology: Mol. function=binding; Cellular component =intracellular; Biological process=protein amino acid phosphorylation
  Homolog annotation: Hit_ID=Q6Z0F9; Match level="QueryCoverage=89%, HitCoverage=83%, E-value=7e-76, Identity=25%"; Hit description=PPR -repeat protein-like
  Pfam annotation: Domain name=PPR; Domain location=112-146; Score =32.6; E_value=1.4e-06; Accession=PF01535.11; Description=PPR repeat
  Pfam annotation: Domain name=PPR; Domain location=256-290; Score =12.4; E_value=0.25; Accession=PF01535.11; Description=PPR repeat
  Pfam annotation: Domain name=PPR; Domain location=357-391; Score =11.6; E_value=0.31; Accession=PF01535.11; Description=PPR repeat
  Pfam annotation: Domain name=PPR; Domain location=460-493; Score =28.2; E_value=2.9e-05; Accession=PF01535.11; Description=PPR repeat
  Pfam annotation: Domain name=PPR; Domain location=561-595; Score=8.7; E_value=0.7; Accession=PF01535.11; Description=PPR repeat
  Pfam annotation: Domain name=PPR; Domain location=671-705; Score =13.5; E_value=0.19; Accession=PF01535.11; Description=PPR repeat
  Pfam module annotation: Pfam domain module=PPR::PPR::PPR::PPR::PPR::PP R; Domain location=112-146::256-290::357-391::460-493::561-595::671 -705
  Subcellular localization annotation: CTP_CleavageSite=34; ConfidenceScore=5.06e-01
MVLHYLFTTRLSLFFRTQLPNKPMLTRTQQFHSKAALQNNRGFCFHDCVSLFQHLRDLKDLNFGKTLHSLFVKTALDKDVIVQNNMIRFYGDIGQVQNAHKLFDEIPQPSLVSWTSLVSCYVHVGKHEIGLSLFRGLCQSGMCPNEFGFFVALRACRVMCDPVMGKVIHGLILKSGFDLHSFCSASILLMYAECGDIENSRKVFDGVCLGERSVHDQTGIENDAVVGGAIIDCYVKLQLLEDARKVFQILGEKDNVAMCALLAGFNQIGKSKEGLALYVDFLCEGNKLDPFTSARVVSLCSNLETELSGTQIHCGVIKLGFKMDSYLGSAFINMYGNFGMISDAYKCFLDVCNKNEICGNAMMNTLIFNSNDLKALELFCRMREVGIAQSSSSISYALRACGNLFMLKEGRSFHSYVIKNPLEDDCRLGVENALLEMYVRCRAIDDAKLIFKRMLIRNEFSWTTIISGCGESGHFVEALGIFCDMLQYSKPSQFTLISVIQACAEIKALDVGKQAQTYIIKVGFEYHPFVGSALINMYAVFKHETLNALHVFLSMKEKDLVSWSVMLTAWVQNGYHKEVLKHFAEFQTVPIFQVDESILSSCISAASGLAALDIGKCFHSWVIKVGLEVDLHVASSITDMYSKCGNIRDACKEAIDLFNKAKEAGLEPDGVTFTGVLAACSHAGLVEEGCEYFRYMRNEYNSEVTINHYACMVDILGQAAKLEEAEALIKEAPF

SEQ ID NO: 206674 - protein, 69 aa, Glycine max
  Coding DNA Sequence Number=SeqID_89896
MGNQLVSLRPSEATGKIITWDGSVHEIEQSLTVAELMLEHPEQVVVELHSAVNNKRPTPLPADNKLERI

SEQ ID NO: 206675 - protein, 88 aa, Glycine max
  Coding DNA Sequence Number=SeqID_89897
METLLIISSNPSQKLLYKELANIIEKLSRHMTKASLDHFFLSNRKNLVSHGRNRRLKNFVEPTRERSSYCHFKGFEYMIHKQKNLSTS

SEQ ID NO: 206676 - protein, 81 aa, Glycine max
  Coding DNA Sequence Number=SeqID_89898
  Subcellular localization annotation: CTP_CleavageSite=55; ConfidenceScore=5.53e-01
MTQMGLPSPSSAGRFGKQASHKSSSKNLFLIGFQGTTSRKGSSTEHCEHGNTHPNAAVITKIHSLHVNLSHTLREGNKCVY

SEQ ID NO: 206677 - protein, 276 aa, Glycine max
  Coding DNA Sequence Number=SeqID_89899
  Gene Ontology: Mol. function=metal ion binding; Biological process =metal ion transport
  Homolog annotation: Hit_ID=Q7XZS3; Match level="QueryCoverage=94%, HitCoverage=94%, E-value=1e-29, Identity=34%"; Hit description =Putative chloroplast-targeted copper chaperone
  Pfam annotation: Domain name=HMA; Domain location=197-256; Score =53.7; E_value=6e-13; Accession=PF00403.16; Description=Heavy-metal -associated domain
  Subcellular localization annotation: CTP_CleavageSite=59; ConfidenceScore=5.05e-01
MKRIDIFCASQASTAICLSMDQASCSSSNTILLGGRTIDRHNPIINDSRRSTSKSLTAPCSSSQSPINPKPYHELHKAKKNSSSKNATKGHDNQKKRSTAEKLTEHVTNTSKPIDDIVPRSWLKPPADLITPPGSTRSLLSDTALLDGSSDYDPVLALTTMINNKTSQAVHQDEANPVSKLSSSSHPKSGSSDQVVVLRVSLHCKGCEGKVRKHLSRMQGVTSFNIDFASKKVTVVGDVTPLSVLASISKVKNAQLWPASASAVESGTVETEKKYI

SEQ ID NO: 206678 - protein, 128 aa, Glycine max
  Coding DNA Sequence Number=SeqID_89900
MTGELFSYFLCRCLVFVERSVSSLKTDKNKGRSNLESLFCYDKAIPEEIIEKPVGLSLEEKAIGNNSRCTDCQAKGAVLCATCAGSGLYVDSIMESQGIIVKVRCLGCGGTGNIMCAECGGRGHLGPK

SEQ ID NO: 206679 - protein, 115 aa, Glycine max
  Coding DNA Sequence Number=SeqID_89901
MAWILNWPSPRGKEQILTSLFAQKLNPSVPNNEHAHLNLFTQQNSTTTSYKSLVHSHQQQLGSRSRSSRRGSTGPGSTEFYIRTGIRVQYMDFIRPIYSINNIGLGSPITKKSMK

SEQ ID NO: 206680 - protein, 443 aa, Glycine max
  Coding DNA Sequence Number=SeqID_89902
  Gene Ontology: Mol. function=hydrolase activity, acting on acid anhydrides, catalyzing transmembrane movement of substances; Cellular component=proton-transporting two-sector ATPase complex; Biological process=proton transport
  Homolog annotation: Hit_ID=Q10FY4; Match level="QueryCoverage=77%, HitCoverage=78%, E-value=6e-52, Identity=33%"; Hit description =Expressed protein
  Pfam annotation: Domain name=DUF580; Domain location=114-434; Score =151.6; E_value=2.1e-42; Accession=PF04515.3; Description=Protein of unknown function, DUF580
  Subcellular localization annotation: CTP_CleavageSite=66; ConfidenceScore=5.42e-01
MAMLNNSDTTTPPQIIQIPPQAPQQRLPFTVPIKAQVSSFPNTTTVAGQTARRVFKILFYLHLFLVAALVTLLTIYGLVSDSHTHHFHPKKWYPQLLASAACAGIVGFTWQWITARHSTRVVRLVFWLSPLLICAMGIMFVCIGTAVSLAVGVIALVCALVQSLYFCWVNPRFEYATRILSVSIAFPPNRTQGLTLYSILIGTLYCCFLVAGIGGGRAIENRTKLAAFFIFLILLSLGWTMQFLKNAMYVTISRVKYMNFAGGVDMDTRVAFCDTIKHLTGSVSMGSILVPVIVLFRGFARTTSLVGGDTDEFMFSCVSCYMGVASFLVVRGNRWGFVHVGVYNKGFVQASTDTWEMFIRVGLEQLIDLDLTGAFCFLSGVGTGAICSLCRLAIAWVQACVSAYYVAYAENPQSTQFDSTIPVRLEQLNRSQALQIFRGNNLS

SEQ ID NO: 206681 - protein, 144 aa, Glycine max
  Coding DNA Sequence Number=SeqID_89903
MGKRKLELGFEDQKIDFDLFVEDKPAPEHNVCLQVMEGGWPEAQLPLVRPNEAAPPEPAPVQVNPEPTNPQSPVVNPHSSLELEAVPSSPPFIVISDVSSDEAVAPPDSPAAEAADPPASPIGGIADLSDSSSGEVVALIDSPV

SEQ ID NO: 206682 - protein, 123 aa, Glycine max
  Coding DNA Sequence Number=SeqID_89904
  Homolog annotation: Hit_ID=Q1S1N3; Match level="QueryCoverage=73%, HitCoverage=27%, E-value=1e-15, Identity=46%"; Hit description =Calcineurin-like phosphoesterase family protein, related
  Pfam annotation: Domain name=DUF1723; Domain location=47-96; Score =64.9; E_value=2.6e-16; Accession=PF08330.1; Description=Protein of unknown function (DUF1723)
MTSTIVHLLWKQHLHISGEVMPSPVPIVKPLLVQVEFSDVAKLRKVKIDDVLVTILVERWRPESYAFHLFVGECTITLEDVTLQLGLHVDGRPVTGPTYYDWEQMCAKYIGVVPLENTSGINT

SEQ ID NO: 206683 - protein, 182 aa, Glycine max
  Coding DNA Sequence Number=SeqID_89905
  Gene Ontology: Mol. function=ribonuclease H activity; Cellular component=nucleus; Biological process=DNA replication
MDFWRKNNLRAHLMEVDEERRSLFVVRLNIIWLAPKKLVFRNEDFDVDNIAYTIKAQGSSSSVLLSELWGILFVAQVAWNANISHLWIERDSKLAVQFVSEGVNREHPFKAMVDLIRGWLGKEWHVKVSQVYQEQNVVADYMENVFHGVAYGLHLLSHPLAGTDVFLICDAIGLSMTRSIRV

SEQ ID NO: 206684 - protein, 223 aa, Glycine max
  Coding DNA Sequence Number=SeqID_89906
  Pfam annotation: Domain name=zf-CCHC; Domain location=134-151; Score =17.7; E_value=0.0012; Accession=PF00098.13; Description=Zinc knuckle
DIPITIPKAEWTDGDLAIMKTEESRDSDRHYKSFMMKDEEFVDNVLDNFPMVWEPKTITIQEAKDLKNLAWDELLVQMKESDGLDNYDGSTDDEVALMPKKFKQIKKKKENFQHSSRREDFRFKKKNKEENNEIICFKCRKPGHMKDDLDNEKSNSSDNKQAKICLMANTDDKVYVKTSSKSDTSSSASSNDEEDMPYDDHALLKFNSRQEAKKFKIYDQDNL

SEQ ID NO: 206685 - protein, 345 aa, Glycine max
  Coding DNA Sequence Number=SeqID_89907
  Gene Ontology: Mol. function=lithium ion binding; Cellular component =integral to membrane; Biological process=calcium ion transport
  Homolog annotation: Hit_ID=Q1SQ50; Match level="QueryCoverage=73%, HitCoverage=43%, E-value=7e-72, Identity=53%"; Hit description =Sodium/calcium exchanger membrane region
  Pfam annotation: Domain name=Na_Ca_ex; Domain location=192-335; Score= 126.5; E_value=7.6e-35; Accession=PF01699.14; Description =Sodiumcalcium exchanger protein
MVLLDSTASLEATHLIYGGDRMNERQYQYSTFSDEESLEASIPLLGYVDEEKQSLAEIVVVVDDKDQNQKQDSAIFLGNNSLFDCIYMGKILQVLELPLGLPRRLTIPVVSEEKWSKPYAVISVTLAPVLLAILFNTQSENVGSRSGLVTYIVAALIGIVLGNMACVTTERCTPPRKSLFPWLAGGFAMSVTWTYIIAEELVSLLVSIGSIIGVSPSILGLTVLAWGNSLGDLIANGAMAMNGGPDGVQMAISGCYAGPMFNTLMGLGLPLVLSAWSEHPDPYVTPKDTSLYETLLFLMGGVLWALVILPKKNMRLDKSLGAGLLSVYLCFLVIRIAMAVGIVKF

SEQ ID NO: 206686 - protein, 90 aa, Glycine max
  Coding DNA Sequence Number=SeqID_89908
MESDQCFETLDSNQMLPHQRILGQDIWDQEFDEIERERSTRYAVHQMKIVYTMTRRVELVSGMLRWLRDEILIGWNERESKMMKNGLCGR

SEQ ID NO: 206687 - protein, 368 aa, Glycine max
  Coding DNA Sequence Number=SeqID_89909
  Homolog annotation: Hit_ID=Q10N06; Match level="QueryCoverage=64%, HitCoverage=29%, E-value=2e-19, Identity=30%"; Hit description =Expressed protein
MVPKDAHRRERRRSGHKKSRSLHSSIQNKMKISLKDSPKLEVLASESSSEIVRHAVADVDNDVTNGSKVWSEPSTKVLPESSSHLLIKDNSSADLDNSKQQDLSACSSCGSSVLPEPPVPVPGLEASCCKDADQPSPVSVLEPSFTDDASSCSDNFESLNNDLQGLRMQLQLLKLESDEYVEGPMIVSDEDGGEGSTGMLEDKGLRRTEDSWECSYIIDVLSESGIDGAQPDTISELWHSLECPVSLSVFDELEKRYGDWTTCSRSQRRLLFDRINLGIVKINEQCTHALPWVGPVTKNVIGSNLIENGFRDGLLRMLVSDGKVKDDALGKVLVMESEWLDLRDDIDVIGREVERLLLDDLVAEIIGA

SEQ ID NO: 206688 - protein, 506 aa, Glycine max
  Coding DNA Sequence Number=SeqID_89910
  Homolog annotation: Hit_ID=Q10N70; Match level="QueryCoverage=85%, HitCoverage=43%, E-value=4e-33, Identity=27%"; Hit description =Expressed protein
  Subcellular localization annotation: CTP_CleavageSite=84; ConfidenceScore=5.41e-01
MDKSRHSKSNAAPSSTHQPQPPLPQGNKEVHRQRQPLNLSPDPGSSSGGVAYKDSFSSKFGWRSSKQLFGTPIKKLLAEEMSPKAESKRRSPGVIARLMGLDGLPFQQPINKQHKALSENQQKTAQLERTRGKGVPYDGQSSRRSSKDHQEFKDVFEVSEIPKVESHRYPSQGCADLMTTDAEISFIEQKFMDAKRLATHQDLQSSKDFCDTLEVLDSNKDLLLKYFKRPDSLFKKHLNDLQAAPVQSHYGYVKPMDIEKYEHDFNLRSDWEKTRSNYNRSSHEKHHDGYPCHFDKRHVMHSSPKSSKLQFKAKYEQKAVTSQIVLLKPNLGKVQNGTRIVSSPCSSHNFLAGCENDTELCQATNLPESARSWRQDSFESREIAKEVTRQMKISLNNGSMKLSTSRIRGYAGDDSSCSVSGNESPEESEETTATLGNSIDLNNRSRRSSRSSESSVSREAKKRLSERWKMTHKSQELQGISRSSTLAEMLAIPDMKLKASNSDSMA

SEQ ID NO: 206689 - protein, 67 aa, Glycine max
  Coding DNA Sequence Number=SeqID_89911
MEIPEVKEIQYLAARDGDGIESERCGCGDGYTHSARASGGGVMRVRVQLSPPSSHVSRTLDTTFVSL

SEQ ID NO: 206690 - protein, 152 aa, Glycine max
  Coding DNA Sequence Number=SeqID_89912
  Homolog annotation: Hit_ID=Q1SQ53; Match level="QueryCoverage=33%, HitCoverage=11%, E-value=4e-09, Identity=60%"; Hit description=ENT
MVQSRIQFLHSSSCFFFCLLVFICGESLPFLFLQSILGLSVNVNGFKNKIYCKVKKMLFSRGKPDPVDIERAKRTLTEQEIAITEALGKVANVLERGDAPNQMQRYELSKNTPGGQEMMIHANFRELIGNVRVMISWHRYGAFNSDEAIQLI

SEQ ID NO: 206691 - protein, 43 aa, Glycine max
  Coding DNA Sequence Number=SeqID_89913
MKMDLRRQDQSGERWSSEKLTMTELGTKQLRTSNKLGTMLSIY

SEQ ID NO: 206692 - protein, 176 aa, Glycine max
  Coding DNA Sequence Number=SeqID_89914
  Homolog annotation: Hit_ID=Q1SQ53; Match level="QueryCoverage=79%, HitCoverage=68%, E-value=2e-35, Identity=58%"; Hit description=ENT
  Pfam annotation: Domain name=ENT; Domain location=24-97; Score=88.8; E_value=1.6e-23; Accession=PF03735.5; Description=ENT domain
MHYVTGVLLTLATEPHGIRGVMDLEHQIHYLETEAYSSILKAFIAQSDLLTWGKEGLMTELRKELNVTDIEHGEILLKINSDQLIKQIREQRKLASQAKDYIKPSAPDCVCASMGNSVIRMKTPSSAAFYTQKKMSHCQASLISTPIPSPMPVRKSSLIQILNSYCFLAAFRVYLI

SEQ ID NO: 206693 - protein, 180 aa, Glycine max
  Coding DNA Sequence Number=SeqID_89915
  Gene Ontology: Mol. function=RNA-directed DNA polymerase activity; Biological process=RNA-dependent DNA replication
MYLKECVRKICMFLAFLKLKPLRLCVTWSPSKGVARLEILEGFQTPRSEVFLGGRNILDVLVANEVMDEARRKKKKCLLFKIDYEKVYNSMSSGTFCYTCSQGLVLVINGLDGLDNEFGSQRGLRQRDSLPFIFTIVTKGLSGMMREAMDKKLLFMGYSISREEVKMELLQYVNDSTKKQ

SEQ ID NO: 206694 - protein, 198 aa, Glycine max
  Coding DNA Sequence Number=SeqID_89916
MKFVDVDMTRCGCIIRSIHGLPCACELARYDLSSIPLQALYLYLTRLSFNDLGFTYKNKEFFVQQEFDAIIQRLKEVDIVGNIIIKNIVDVRSDGHYGYMTVRALLCMVEDFWSLVCNNLHKELGQWHDEYANIFGGYDHFYQIKQSLLINHVSMGKWKEGAGVGMVDDEVVVVTGERGVVATLREMLGLGKRGEGYK

SEQ ID NO: 206695 - protein, 52 aa, Glycine max
  Coding DNA Sequence Number=SeqID_89917
MPEKANKVANTTMLKAKEDTPLSPRLHKPSIYLWAKCVLDFFGNSISLSPYH

SEQ ID NO: 206696 - protein, 139 aa, Glycine max
  Coding DNA Sequence Number=SeqID_89918
MELIIDRLPTVDNLSKRNIQLNDEEKKGVFCLELEESAGHCRAHFQQLPWVMKSAAEKSRWQVVWGYLECLDLGILLPNGVFVLVPACALSLVKAMHKCRIMYCFAGSAVLPGFIIYERVCVRGWLVCSIKFMMIAFTL

SEQ ID NO: 206697 - protein, 119 aa, Glycine max
  Coding DNA Sequence Number=SeqID_89919
  Subcellular localization annotation: CTP_CleavageSite=31; ConfidenceScore=5.22e-01
MSITDGNLHGIRLQATTVANTNRLRHLRRVRGSSDGGTATGFSIVERVEAVASQFQGVESVREKREWDAEDKGEKEKALPLSASAILFRRALRFWAVGLFLIQLWAVASQGFESYTPVP

SEQ ID NO: 206698 - protein, 376 aa, Glycine max
  Coding DNA Sequence Number=SeqID_89920
  Gene Ontology: Mol. function=alcohol dehydrogenase activity; Cellular component=mitochondrion; Biological process=retinoid metabolic process
  Homolog annotation: Hit_ID=Q43169; Match level="QueryCoverage=97%, HitCoverage=98%, E-value=1e-99, Identity=48%"; Hit description =Alcohol dehydrogenase
  Pfam annotation: Domain name=ADH_N; Domain location=34-160; Score =117.2; E_value=4.7e-32; Accession=PF08240.2; Description=Alcohol dehydrogenase GroES-like domain
  Pfam annotation: Domain name=ADH_zinc_N; Domain location=191-333; Score=101.0; E_value=3.5e-27; Accession=PF00107.16; Description=Zinc- binding dehydrogenase
  Pfam module annotation: Pfam domain module=ADH_N::ADH_zinc_N; Domain location=34-160::191-333
MPNTSQVISCKAAICWGAGKPVTVEEIQVDPPKATEVRVKMLCASLCHTDISSIQGFPYINFPLALGHEGVGVVESVGDQVRNLKEGDVVIPTYIGECQECENCVSGKTNLCLTYPIRLTGLLPDNTSRMSIRGQRLHHVLSCATWSEYMVSDANYTLKVDPTIDPAHASFISCGFSTGYGAAWKEAKVESGSSVAVFGLGAVGLGAISGAKMLGATKIIGIDKNEMKREKGEAFGMTDFIKAGDSAKSVSELVKEMSGGMGVDYSFECSGVAPLLTESVEATKVGTGKTIAIGTGTEPIIPFGLTSIMYGRTLKGSVFGGLKAISDLSIVANKCQKEEFPLQELFTHEVPLTDINKAFELLKKPNCVKVVIKMSH

SEQ ID NO: 206699 - protein, 41 aa, Glycine max
  Coding DNA Sequence Number=SeqID_89921
MAKRLFPGMNPWAQFTTEPGFIQITEGKVPEDVEAYQSIYK

SEQ ID NO: 206700 - protein, 67 aa, Glycine max
  Coding DNA Sequence Number=SeqID_89922
MACNLCLTASRYMAPFVAQYVKFRDMPEIKRKHCYEIREIPPTWALQNVPPEGGCFWRKQPGSPGRA

SEQ ID NO: 206701 - protein, 96 aa, Glycine max
  Coding DNA Sequence Number=SeqID_89923
  Homolog annotation: Hit_ID=Q10N71; Match level="QueryCoverage=70%, HitCoverage=87%, E-value=1e-18, Identity=61%"; Hit description =Uncharacterized plant-specific domain TIGR01589 family protein, expressed
MEDSSSAAYIHLVHRLIEECILFHMSQEECMEALSKHANIKPVITSTVWKGLEKENKEFFKAYSKSKAERASKTEVRQKIHKMVSESHSSSSNERV

SEQ ID NO: 206702 - protein, 313 aa, Glycine max
  Coding DNA Sequence Number=SeqID_89924
  Gene Ontology: Mol. function=nucleic acid binding; Cellular component= intracellular
  Homolog annotation: Hit_ID=Q1SU87; Match level="QueryCoverage=41%, HitCoverage=71%, E-value=5e-26, Identity=52%"; Hit description=Zinc finger, C2H2-type
  Pfam annotation: Domain name=zf-C2H2; Domain location=41-63; Score =9.2; E_value=1; Accession=PF00096.16; Description=Zinc finger, C2H2 type
  Pfam annotation: Domain name=zf-C2H2; Domain location=94-116; Score =19.1; E_value=0.016; Accession=PF00096.16; Description=Zinc finger, C2H2 type
  Pfam module annotation: Pfam domain module=zf-C2H2::zf-C2H2; Domain location=41-63::94-116
MKRQRENEVTTLESWDMQICSTSITPDTSVSSSTISPEDVFECKTCNRKFNSFQALGGHRACHNKRVKMEGEEQQLKTRAKYLGLGKHSEPKMHNCSICGQGFSLGQALGGHMRRHRASTNDVFSSINQALGNDSTQNASSSSVNGDLWRKLWKIPTAPKYVAKNLKLSYMLYYYVKNRTWHGVYRLEIWNLWLVSVNFCGPSGLEVETNGCFNKGKSPCDLVVPAIEVVSNDNVQIHKWKKPTVCLMKANLDASVKKNMGTWKPHVAEVVALKWPIEMTKDQIFDSVQYETDCKRLVHAWNGNHFHDSSYFS

SEQ ID NO: 206703 - protein, 524 aa, Glycine max
  Coding DNA Sequence Number=SeqID_89925
  Homolog annotation: Hit_ID=Q8GZQ3; Match level="QueryCoverage=13%, HitCoverage=7%, E-value=2e-27, Identity=89%"; Hit description =Polynucleotide phosphorylase
  Pfam annotation: Domain name=RNase_PH; Domain location=12-141; Score=- 11.6; E_value=0.038; Accession=PF01138.11; Description=3' exoribonuclease family, domain 1
GGKRSDGRTPDGIRPIYSRCGLLPRAHGSTLFTRGETQALAVVTLGDKQMAQRIDSLDGVDEFKRFYLQVSLEIDYFNVLLYLCGCYLFSEIWAMFEKPNWTDAKSQDKPTELPFSWSNQFSVDDLALTASNAPWRRTRTKQDCLDQMGGSGSSYNKGNYGPVLPWVGRLKNLAMFDRVEDDLLWDIGADVTPKYMGDDLILLLGLTDAKAEQMIQEEIEGGESLFYSLEKWNPRIHMVEVDDDVEEIRRVDRAQVLIKISWRPTIQHTVNLHIQGEVYGVHVVEECGCSFDAYHGRHRRDMGSLEEIESDDSDVGTWVPEETHGLEKEGDLQLMEKRKTVNRRQKPNPLGKVSTTWVQVAKQKRGMSEHEVGTQEEQMARQSMAVDRDDQTCKEGGEQIVGNNDDAERDSFFHENGKNESYKQVKAKTLQHGKFIHVEEGTKSKGIWAGDIKAHVETTSAQDEADDANPANIQLQEAMELWKVAKKLGVTGGPAQGKIIDNIRAMEERDKKEAERLGNRSSTP

SEQ ID NO: 206704 - protein, 375 aa, Glycine max
  Coding DNA Sequence Number=SeqID_89926
  Gene Ontology: Mol. function=RNA-directed DNA polymerase activity; Cellular component=nucleus; Biological process=RNA-dependent DNA replication
MGESNLREFNEWIDEMEVDEVPWVGRKFTWFRPDGTARSKLDRFLVSPKWIAKWPRSTQFVLDRNFSDHCPILLRYKHNSLQGIMVAGSWIEESGEVKEVVRQFFMQRFQESDQDRPRLDGIHFQTIGHPQNEMLVGRFQEDEVKQAVWDCGSEKSPGPDGLNFKFIKEFWHLIKPDVLRFLDEFYVNGIFPRGCNASFLALIPKVSDPQMLNDYRPISLIGSMYKIVSKLLAQRLKKVMPIIIDERQSAFIGGRHLLHSVIIANEVVEEAQRSQKPCLVFKVDYEKAYDSVSREFLIYMLRRMGFCSKWIQWIEGCLRSASISLLVNGSPSVEFIPQRGLRQGDPLAPLLYNIVAEALNGLMRVAIEKNLFRGF

SEQ ID NO: 206705 - protein, 227 aa, Glycine max
  Coding DNA Sequence Number=SeqID_89927
  Gene Ontology: Mol. function=amino acid transporter activity; Cellular component=membrane; Biological process=amino acid transport
  Homolog annotation: Hit_ID=Q1SQ57; Match level="QueryCoverage=98%, HitCoverage=34%, E-value=1e-83, Identity=69%"; Hit description=Amino acid permease-associated region
MVAISVLILRYIPPDEVPLPPSLQDSIASVLKRYRLSNAETNVEYADANVVSSEYRKPLIIKEDVSIDFPKHLAVGNHLNEGDKRRVVGWIIAFICLGEFVLIYATSDFTLLSSVRFALCGIGGATLLCGFVLLTCIDQDDARHDFGHSGGFICPFVPLLPIACILINSYLLVNLGDGTWFRVSIWLATGLLVYVFYGRTHSSLKDAIYVPAKQVDEIYQNYRSCLA

SEQ ID NO: 206706 - protein, 102 aa, Glycine max
  Coding DNA Sequence Number=SeqID_89928
  Homolog annotation: Hit_ID=Q1S7C5; Match level="QueryCoverage=74%, HitCoverage=6%, E-value=3e-11, Identity=36%"; Hit description =Integrase, catalytic region
MGKKEAKEKRKVKVMTESGSAGGVCFVVNPVVPPHYLTEDDHISDRVNPKYEAWEVQDQRLLVCLQSTFSKPVLSRVLDSNHSYQVWEKIHEYFNLYTKSRA

SEQ ID NO: 206707 - protein, 284 aa, Glycine max
  Coding DNA Sequence Number=SeqID_89929
  Gene Ontology: Mol. function=structural constituent of ribosome; Cellular component=large ribosomal subunit; Biological process =translation
  Homolog annotation: Hit_ID=Q2PYX6; Match level="QueryCoverage=78%, HitCoverage=95%, E-value=3e-66, Identity=53%"; Hit description =Putative 60S ribosomal protein L7-like protein
  Pfam annotation: Domain name=Ribosomal_L30; Domain location=76-128; Score=27.2; E_value=5.7e-05; Accession=PF00327.10; Description =Ribosomal protein L30pL7e
  Pfam annotation: Domain name=Ribosomal_L30_N; Domain location=15-73; Score=21.3; E_value=2.7e-05; Accession=PF08079.2; Description =Ribosomal L30 N-terminal domain
  Pfam module annotation: Pfam domain module=Ribosomal_L30::Ribosomal _L30_N; Domain location=76-128::15-73
MAEDDSKPLNYISEVILKKRKSTEAWALRKKEQFQQKKFQSIRKPEDFIHEYRNKEVDLIRMKRRVKRKVPEANSNTMIIIRIQGKKDMHPRTRKVLYSLGLRRRFSAVFVKPSEGIMAKLQRVEPYVTYGYPNLKSIKELIYKKGHARMEQRKVPLTDNNIIEQELGKFGIVCIEDMVHQIYNAGPHFKEVARFMWPFELNKPAEGLKGSKTIFKEGGDTGNRIGMGWGGEERDGHGVLWGLNLNSQYIFNVMNDDSSPNVIFIKVDRNGISEYMKNIIVEGS

SEQ ID NO: 206708 - protein, 169 aa, Glycine max
  Coding DNA Sequence Number=SeqID_89930
  Gene Ontology: Mol. function=polyribonucleotide nucleotidyltransferase activity; Biological process=mRNA catabolic process
  Homolog annotation: Hit_ID=Q1SQ54; Match level="QueryCoverage=34%, HitCoverage=8%, E-value=4e-25, Identity=94%"; Hit description =Polyribonucleotide nucleotidyltransferase
  Pfam annotation: Domain name=RNase_PH; Domain location=37-169; Score =13.8; E_value=0.00033; Accession=PF01138.11; Description=3' exoribonuclease family, domain 1
MEEAAGHLFFHCNKIIPIWWESLSWVNILVAFPENPRLHFLQHVLGLADGIGATRWKCWWLALTWTILQQRTTILFSSGTFNANKLLDDAVFLLWTWLRNLEPAFYSFPPSCVGEVGRIGAPSRREIGHGMLAERSLEPILPSEDDFPYTIRVESTITESNGSSRFSKA

SEQ ID NO: 206709 - protein, 249 aa, Glycine max
  Coding DNA Sequence Number=SeqID_89931
  Gene Ontology: Mol. function=polyribonucleotide nucleotidyltransferase activity; Cellular component=membrane fraction; Biological process =mRNA catabolic process
  Homolog annotation: Hit_ID=O24288; Match level="QueryCoverage=82%, HitCoverage=24%, E-value=6e-80, Identity=75%"; Hit description =Polynucleotide phosphorylase
  Pfam annotation: Domain name=KH_1; Domain location=19-77; Score=41.1; E_value=3.8e-09; Accession=PF00013.19; Description=KH domain
  Pfam annotation: Domain name=S1; Domain location=83-156; Score=56.2; E_value=1e-13; Accession=PF00575.13; Description=S1 RNA binding domain
  Pfam module annotation: Pfam domain module=KH_1::S1; Domain location =19-77::83-156
MMNSSPPPAKRLSKYAPLIHVMKVRPDRINLIIGSGGKKVKSIIEESGVDTIDTEDDGTVKIFAKDLPSLEKSKAIINSLTMVPTIGDIYRSCEIKSIASYGVFVEIAPGREGLCHISELSSGWLPKAEDVFKVGDRIDVKLIEINEKGQLRLSHRALLPDTEASPKDGLVEEKTEQSKDKSSTPNVTASSKRSSEDDSVLPSKKFVRRLVSSSLDKPFTNKDKTKKSSNKAVGSVSGKDESSLVSGEA

SEQ ID NO: 206710 - protein, 113 aa, Glycine max
  Coding DNA Sequence Number=SeqID_89932
  Gene Ontology: Mol. function=DNA binding; Biological process=DNA integration
  Homolog annotation: Hit_ID=Q1S7C5; Match level="QueryCoverage=48%, HitCoverage=4%, E-value=9e-20, Identity=81%"; Hit description =Integrase, catalytic region
MGQCKSENNTNGDRLDHRRKGLMKVKAMNLMKSLGYQPCFELVDGTINIFLYSENSILTVRSKASYSFAWQQANLHFPGPASQFWVQNGNRGKTRGKEGQKENDKEIAEKIEA

SEQ ID NO: 206711 - protein, 259 aa, Glycine max
  Coding DNA Sequence Number=SeqID_89933
  Gene Ontology: Mol. function=amino acid transporter activity; Cellular component=membrane; Biological process=amino acid transport
  Homolog annotation: Hit_ID=Q1SQ57; Match level="QueryCoverage=98%, HitCoverage=41%, E-value=1e-117, Identity=81%"; Hit description =Amino acid permease-associated region
  Pfam annotation: Domain name=AA_permease; Domain location=8-258; Score=-144.7; E_value=0.069; Accession=PF00324.11; Description=Amino acid permease
AALFGGADNLPIFLARQHIRGIDIVVDPCAAILVLLVTGLLCVGIKESTVVQGIVTAVNVCALLFVIAAGGYLGFKSGWVGYELPIGFFPFGINGMLAGSATVFFAYIGFDAVASTAEEVKNPQRDLPLGIGGALFICCGIYMMVSIVVVGLVPYYAIDPDTPISSAFANQGMEWAAYIINAGAFTALCSALLGGILPQPRILMSMARDGLLPPFFCDINKQTQVPVKGTIATGVVASFLAFSMEVSQLAGMVSLGLVC

SEQ ID NO: 206712 - protein, 481 aa, Glycine max
  Coding DNA Sequence Number=SeqID_89934
  Gene Ontology: Mol. function=binding; Cellular component=nucleus; Biological process=metabolic process
  Homolog annotation: Hit_ID=Q8H8U1; Match level="QueryCoverage=87%, HitCoverage=98%, E-value=1e-117, Identity=37%"; Hit description =Putative PPR repeat containing protein
  Pfam annotation: Domain name=PPR; Domain location=153-187; Score =33.3; E_value=8.7e-07; Accession=PF01535.11; Description=PPR repeat
  Pfam annotation: Domain name=PPR; Domain location=20-54; Score=30.7; E_value=5.2e-06; Accession=PF01535.11; Description=PPR repeat
  Pfam annotation: Domain name=PPR; Domain location=254-288; Score =37.9; E_value=3.5e-08; Accession=PF01535.11; Description=PPR repeat
  Pfam annotation: Domain name=PPR; Domain location=289-323; Score =20.4; E_value=0.0065; Accession=PF01535.11; Description=PPR repeat
  Pfam annotation: Domain name=PPR; Domain location=325-358; Score=8.0; E_value=0.83; Accession=PF01535.11; Description=PPR repeat
  Pfam annotation: Domain name=PPR; Domain location=391-425; Score =11.1; E_value=0.36; Accession=PF01535.11; Description=PPR repeat
  Pfam annotation: Domain name=PPR; Domain location=56-90; Score=10.6; E_value=0.41; Accession=PF01535.11; Description=PPR repeat
  Pfam annotation: Domain name=PPR; Domain location=91-124; Score=13.1; E_value=0.21; Accession=PF01535.11; Description=PPR repeat
  Pfam module annotation: Pfam domain module=PPR::PPR::PPR::PPR::PPR::PP R::PPR::PPR; Domain location=153-187::20-54::254-288::289-323::325 -358::391-425::56-90::91-124
CDEVWLARHVFDGMSERDIVTWNAMIGGYSQRRLYDECKRLYLEMLNVSAVAPNVVTAVSVMQACGQSMDLAFGMELHRFVKESGIEIDVSLSNAVVAMYAKCGRLDYAREMFEGMREKDEVTYGAIISGYMDYGLVDDAMGVFRGVENPGLNMWNAVISGMVQNKQFEGVFDLVRQMQGSGLSPNAVTLASILPSFSYFSNLRGGKEVHGYAIRRGYEQNVYVSTSIIDAYGKLGCICGARWVFDLSQSRSLIIWTSIISAYAAHGDAGLALGLYAQMLDKGIRPDPVTLTSVLTACAHSGLVDEAWNIFNSMPSKYGIQPLVEHYACMVGVLSRAGKLSEAVQFISEMPIEPSAKVWGPLLHGASVFGDVEIGKFACDHLFEIEPENTGNYIIMANLYAHAGKWEQAGEVRERMKVIGLQKIRGSSWIETSGGLLSFIAKDVSNGRSDEIYALLEGLLGLMREEGCVLQEELDYENVFS

SEQ ID NO: 206713 - protein, 145 aa, Glycine max
  Coding DNA Sequence Number=SeqID_89935
  Gene Ontology: Mol. function=amino acid transporter activity; Cellular component=membrane; Biological process=amino acid transport
  Homolog annotation: Hit_ID=Q1SQ57; Match level="QueryCoverage=94%, HitCoverage=21%, E-value=3e-56, Identity=79%"; Hit description=Amino acid permease-associated region
  Subcellular localization annotation: CTP_CleavageSite=37; ConfidenceScore=5.02e-01
MGVSVDSPSQKGSWDFLKFLTRRKQVDSPRRNSQPLLAKELTVLHLIAVGVGSTIGAGVYVLVGAVAREHAGPALAISFLIAGLAAGLSAFCYAELASRCPSAGSAYHYTYICLGEGVAWLIGWSLLLEYTIGSAAVARGVTPNL

SEQ ID NO: 206714 - protein, 135 aa, Glycine max
  Coding DNA Sequence Number=SeqID_89936
MKLVKHSDQVIPLPTKPTVRVISPSYDAVAITLDDVMSLAQPVTSRPIDHVPSTFTKETVKVLLITCLGISIEEEAIVMTTASANSGLYMWAATTYLLNLVDITIFVSKSLTHVHVTYLIYLSNLDDCHPGESLH

SEQ ID NO: 206715 - protein, 270 aa, Glycine max
  Coding DNA Sequence Number=SeqID_89937
YGEVIGGGVGGCGESERPEEVERVAEHAVEGVAEEHGVPREGVSVGGRVEHLTREDEASVELLALAEEAVVGAVLEGRAIGGEVDAGGGEPSSEVTGYCRLCLKLKGGCHQKMPNPAEHVDLARVVTPRDDSHSGEGHVVFLAVVLPFMGKLGLEREMVYAMFRAFLQLSIIGLTCVLECHVACDEYFVHPRQYISPPSFGLACEKKRLSDVKGSSLDKWEGCEFIEPPSINKCYSVSRVVTLTSARVIGLSSPLSWTSVVQAASIKLSR

SEQ ID NO: 206716 - protein, 512 aa, Glycine max
  Coding DNA Sequence Number=SeqID_89938
  Homolog annotation: Hit_ID=Q84ST1; Match level="QueryCoverage=95%, HitCoverage=85%, E-value=2e-92, Identity=39%"; Hit description =Expressed protein
MLSLITTLFLLDVIITTTAGVDIERPVLEFSPSVLPGISGSLGVKDALRCERVRVSGISRVKLGSYANSYHVTLAPSVSIPEKLHSKIQVCFHRNETVGWCQCEKDEWRGVQKGVWNAVMSPYETRYVDVRINGEILGSVTVAIEEVGLILLLLAPTVSRWVPFYYSTSMAIGIFLVIIILLFQGMKLMPTGRKNIFYLTIYGSVVGAGSFLLHQFSLILNSIFQSLGMSEEMHNPVAVFVILGIILAGAALGYLIVRRFVISKEDGSVDAGVAQFVKWAMRIIGSTFILQSTLDPLLAIGALISCGAACKLISAIKWLCGWASPGATVKLCLGDLLVMGSNPETASLYMQGYETSNDDYSLQWMRGRRGRAEFLSKSTPKGKHWSSPKGKLWNSPRRSAWSDSPVRGVVSPSSGISSQSSGTQAGQNYYSTFHKTRNRKKFTKQEWDEFTRESTKQALAEWAASPEFTDWIVEHADRIQVLPSESSDETMGSESDSTDRGSGRGFGLFNWQ

SEQ ID NO: 206717 - protein, 221 aa, Glycine max
  Coding DNA Sequence Number=SeqID_89939
  Gene Ontology: Mol. function=structural constituent of ribosome; Cellular component=intracellular; Biological process=translation
  Homolog annotation: Hit_ID=Q2HVB5; Match level="QueryCoverage=63%, HitCoverage=56%, E-value=4e-49, Identity=68%"; Hit description =Ribosomal protein L25
MRKRWHHAASEYHKFRPCSDTLLHKHLIREENELLKKVSILRKYEERANRAGQDAYGLDEVILGVEVGADLEVEEAGEEEGAAEVVDEFSDLVSADGDEALVAAVLAVFLLEHDARKPPGAAFLGGDVLAGVGAGDGEDRLVVLGIGAGEAVQVGEGLRPRRPEDGGGGVGEVAAIRGESGEDVVAGKIHDGLGLEKERVEERFWVGKVAGEPHLLAHSLH

SEQ ID NO: 206718 - protein, 143 aa, Glycine max
  Coding DNA Sequence Number=SeqID_89940
  Homolog annotation: Hit_ID=Q10L09; Match level="QueryCoverage=64%, HitCoverage=39%, E-value=6e-32, Identity=62%"; Hit description =Uncharacterised protein family containing protein, expressed
  Pfam annotation: Domain name=UPF0153; Domain location=49-136; Score =54.2; E_value=4.4e-13; Accession=PF03692.5; Description =Uncharacterised protein family (UPF0153)
  Subcellular localization annotation: CTP_CleavageSite=26; ConfidenceScore=5.12e-01
MSPALTTLSPPLSLSVTSAARRPRLTAMVKTEKKQSLGFGSDKKETKWHCVEGCGSCCKLQKGPSFPSPEEIFDDPSDVQLYKSLIGPDGWCIHYEKSTRKCSIYPERPYFCRVEPEVFKSLFGVKEKNFHKEACRNREILFR

SEQ ID NO: 206719 - protein, 238 aa, Glycine max
  Coding DNA Sequence Number=SeqID_89941
  Homolog annotation: Hit_ID=Q10N48; Match level="QueryCoverage=83%, HitCoverage=81%, E-value=6e-38, Identity=42%"; Hit description =Expressed protein
MSLMPNSRVPLLLFISSIFFTSFPGLTFGAIVSLRSIEIFKTHEWLKATTTVYFLCKGENETVLPDVKKPHAIYAFNGQESWQGTVFVILSPGNGNFGCSNANPLSSFSSKKCKRCGFYEEDSITSDDAFDEWEFCPSDFAAPNGEYIRFKEKEFNATFLCPECLSLAGVDEHDDGKGMHIAVVVLLSILVSVTLILGVVGAYKFWRKKLREQDQARLLKLFEDDDDIGDELGLGSAI

SEQ ID NO: 206720 - protein, 522 aa, Glycine max
  Coding DNA Sequence Number=SeqID_89942
  Pfam annotation: Domain name=IncA; Domain location=302-518; Score= -7.2; E_value=0.016; Accession=PF04156.5; Description=IncA protein
MSFIFDSTIGMGDGDSKGSIQQPMVDRKVIQIGDSSEEETRHEASDSESSSSKTLTVSSRVGGGTSRLHRRTQLSTAFLDEEPVPITMIFPLSISGEELCVIAIEVASKSCVIATVLASVATLERQVKLANLEDSCKIVIQACGIDDIPFLRVMSGSSPFFFMYRCLFKVLGLIPPLSSFQCALLEYLNVAPSQLHPNSWAMIGCVSLNNVSKKLFEFNSNVFRRLKDHFFKVLATDVVVEPTGGTMPPSVDPPFGEGDQPTVRVDPNDDEVVEVSPNVPFSILAKRKRDDNTGTAGLMPGSGHPSSSQGPPIAPPTEVSASPTVVVTALISLVGLVVAPLSTIVTSLLSVGVTITSAPKMLHLSSSAPSILPSIVLTSALPSSFSHPNVSLCHMYTSCNSNSLWGLPPKKFSDSGGKWIAALGSFEQVKRLKVANATIAFTEIVKSNHQLSSKREKNDLIGKVESIVVEKDEFTKVVADLEAHLKDSESRLEEFELKASKEMEANKELEEELLVYKKEDVE

SEQ ID NO: 206721 - protein, 140 aa, Glycine max
  Coding DNA Sequence Number=SeqID_89943
MSSVCISKCVNDARVPVRATYVNLYKWPESDAEFVRRRGGGSHVCGGHPRVVDSISCRQMYLRSYKFSRKESVPEKTQKCFGRVKERVKKQGSSQHNHGVGRRKCLVWRKMREISCAALFRIFHRFLSCGASVDVVHAKS

SEQ ID NO: 206722 - protein, 301 aa, Glycine max
  Coding DNA Sequence Number=SeqID_89944
  Gene Ontology: Mol. function=receptor activity; Cellular component =integral to membrane; Biological process=ion transport
  Homolog annotation: Hit_ID=Q8S1S0; Match level="QueryCoverage=75%, HitCoverage=55%, E-value=4e-95, Identity=63%"; Hit description =Putative lung seven transmembrane receptor 1
MDEDAAKVWKICGTEASYGCSYMYDEYACNIKTKKNIDAAWGVVGESGHSDIASKLKFFIPKRNLGSLFFLFVEHKVLILLHRPKHIEHDNIKRETSSLLGEITNPLVFVSGNGLQRKDHNAGEIQVPNDNNVELPEEGQLGQVPGCLPVGLGGLPERPDGPHNRENDGAAADNVNKQEDLVPSNPILDEGTGFADDDGGNVGEDLERDDDHEDLLLALLEEGFEEGPASADQDDDGEEEDDADELEDVEEDVPAVRGAGDLYVVLVLGGAEELVGVADVNPQGKEGEVGDGEEREESGEM

SEQ ID NO: 206723 - protein, 491 aa, Glycine max
  Coding DNA Sequence Number=SeqID_89945
  Gene Ontology: Mol. function=metalloendopeptidase activity; Cellular component=chloroplast thylakoid membrane; Biological process =proteolysis
  Homolog annotation: Hit_ID=Q9LHR6; Match level="QueryCoverage=69%, HitCoverage=61%, E-value=1e-152, Identity=79%"; Hit description =Arabidopsis thaliana genomic DNA, chromosome 5, TAC clone:K3D20
  Pfam annotation: Domain name=Peptidase_M50; Domain location=314-491; Score=55.0; E_value=2.5e-13; Accession=PF02163.12; Description =Peptidase family M50
  Subcellular localization annotation: CTP_CleavageSite=17; ConfidenceScore=5.19e-01
MGTLTSCSFMPLNSEFRSNPVRRAFRERIQCHKLTRLRGASSCFFSRARVPKWGKSKLSNFDSLRCFATNNDNNSDDGDKDSNNVGAAGEESGGDDSKSNVTTTMPEEERGFTSQKSTPPSTSQRSSLSSLGPAYNTFQVDSFKLIELLGPEKVDPADVKLIKDKLFGYSTFWVTKEEPFGDLGEGILFIGNLRGKREDVFAKLQNQLVEVTGDKYNLFMVEEPNADSPDPRGGPRVSFGLLRKEVSEPGPMTLWQYVIALLLFLLTIGSSVELGIASQINRLPPEVVKYFTDPDAVEAPDMELLFPFVDSALPLAYGVLGVLLFHEVGHFLSAFPKQVKLSIPFFIPNITLGSFGAITQFKSILPDRSTQVDISLAGPFAGAVLSFSMFAVGLLLSSNPDITGDLVQVPSLLFQGSLLLGLISRATLGYAAMHAETVPIHPLVIAGWCGLTIQAFNMLPVGCLDGGRAVQMPFLGVKAPFISLSYLANNL

SEQ ID NO: 206724 - protein, 72 aa, Glycine max
  Coding DNA Sequence Number=SeqID_89946
MVYLNELRFCLELPKTFFHSLTIGILKIRTFDVSLSAKGALSAIPTQEGIALIIHVTLLDIPGGGNKVVKEF

SEQ ID NO: 206725 - protein, 253 aa, Glycine max
  Coding DNA Sequence Number=SeqID_89947
  Homolog annotation: Hit_ID=UPI0000E451C7; Match level="QueryCoverage =71%, HitCoverage=63%, E-value=3e-84, Identity=85%"; Hit description =conserved hypothetical protein
  Pfam annotation: Domain name=DUF548; Domain location=1-185; Score =386.1; E_value=5.2e-113; Accession=PF04445.4; Description=Protein of unknown function (DUF548)
MAHRRKFGGGRGEAVAKAVGIKGDYLPDVVDATAGLGRDAFVLAALGCRVRMLERHPVVAALLEDGLRRGYEDAEIGGWLRERLTLLHVVSQQALSDITPAPDVVYLDPMYPHRQKSALVKKEMRVFQSLVGPDEDADALLEPARRLAKKRIVVKRPDYAPPLAGVATQSAVVTKSHRFDIYPPLSCFATVKNGKPVKIKAIANGKYILAESEKGVAPENITVKRVGKISGVILEDGDLDNPDLIIEIFLSTL

SEQ ID NO: 206726 - protein, 59 aa, Glycine max
  Coding DNA Sequence Number=SeqID_89948
NEDKGYVGVCELNLKVGNWGCGTWRYVAGVRRPWGRQGDRALVIDYQFGVIDYTVLPAT

SEQ ID NO: 206727 - protein, 684 aa, Glycine max
  Coding DNA Sequence Number=SeqID_89949
  Gene Ontology: Mol. function=molecular_function; Cellular component =nucleus; Biological process=regulation of fat cell differentiation
  Homolog annotation: Hit_ID=Q6L4Z4; Match level="QueryCoverage=91%, HitCoverage=100%, E-value=4e-55, Identity=48%"; Hit description =Putative lipin 2
  Pfam annotation: Domain name=LNS2; Domain location=614-681; Score= -34.5; E_value=8.7e-05; Accession=PF08235.3; Description=LNS2 (LipinNed1Smp2)
  Pfam annotation: Domain name=Lipin_N; Domain location=1-105; Score =194.5; E_value=2.5e-55; Accession=PF04571.5; Description=lipin, N -terminal conserved region
  Pfam module annotation: Pfam domain module=LNS2::Lipin_N; Domain location=614-681::1-105
MNVVGKVGSLITQGVYSVATPFHPFGGAVDVIVVQQQDGTFRSTPWYVRFGKFQGVLKGAEKFVRINVNGVEANFHMYLDNSGEAYFLKEVDDDKGVDSIEAVQDSIDKKNGYLINVHRLDHSISDSGVLRLKDESDSLVVSQLQRAESDIDRRFYEFPDDRSSLEDSVELSEYESNSYESLEGDNFGESQGSHPEMVLVSVDGHILTAPISESEQAEENVQLKTPQFHLGPGEETDLCEGNGEFSTGENAWAAGYINQLGAQTTNVQPRLCDTNGDDNTSKLLLKLCQGEEAHICEAQDTLEIKNQDHIKTDSKGAASGIKRENVFKSYLELQDFGQQARNAYLQDIVDKNEQESIAISKNGDELSPHSDESQQTPALKDVRATSEVVEPQTETSNKGDQSHLGLGFEMSLCGHELKVGMGSIAAAEVFEAHRISVVDFTSSAPSIIKNQNLVIKFKERYMTWEKAAPLVLGMAVYGLDLPVESKDTIPVEQDHALKSRDDDLGSSSSGRRWRLWPIPFRKVKTFEHTNSNSSNEEVFLDSESGSLIEPTPTSSTQGSSHKQFLRTNVPTTEQIASLNLKEGQNLVTFSFSTRVLGTQQVDAHIYLWKWNARIVISDVDGTITKSDVLGQFMPLVGKDWTQSGVARLFCAIKLRLEIALQMSLELAQVIFAQSTSIVDSKAND

SEQ ID NO: 206728 - protein, 187 aa, Glycine max
  Coding DNA Sequence Number=SeqID_89950
  Subcellular localization annotation: CTP_CleavageSite=88; ConfidenceScore=5.27e-01
MGKNKGRQLHSAAKQIMVKGITSGSGKSQTSATSGLAGCLDVVQANQNVHTASQDNLVGKVLVKKAGTSSAKTDDVTHQVFDNLSECSAEFESSPEVSCTLGDNDSTTYDDSSHSYGSKSSPQLDDNKAPTHWVNLFKDNRNPSKVFGMKFSPPPSDDEVLLEETDLQPLEEAWGHSLIGYVAGRFP

SEQ ID NO: 206729 - protein, 47 aa, Glycine max
  Coding DNA Sequence Number=SeqID_89951
MEAQNLYISHEMQRVAPLIGQTNLDWGELCEELLGVRPQEGDFKAVW

SEQ ID NO: 206730 - protein, 464 aa, Glycine max
  Coding DNA Sequence Number=SeqID_89952
  Gene Ontology: Mol. function=hydrolase activity, hydrolyzing O -glycosyl compounds; Cellular component=cell outer membrane; Biological process=carbohydrate metabolic process
  Homolog annotation: Hit_ID=Q8ZPF2; Match level="QueryCoverage=99%, HitCoverage=66%, E-value=0.0, Identity=76%"; Hit description =Putative glycosyl hydrolase
  Pfam annotation: Domain name=Alpha-amylase; Domain location=168-464; Score=-46.5; E_value=0.00016; Accession=PF00128.14; Description =Alpha amylase, catalytic domain
  Pfam annotation: Domain name=Isoamylase_N; Domain location=15-103; Score=116.3; E_value=8.9e-32; Accession=PF02922.8; Description =Isoamylase N-terminal domain
  Pfam module annotation: Pfam domain module=Alpha-amylase::Isoamylase _N; Domain location=168-464::15-103
MISRNSRILAGDHRQLGATVDRDGVNFALFSAHAERVELCLFSSDGTAEIERLELPEYTNEVWHGYVPGLKEGALYGYRVYGPFEPESGHRFNPNKLLLDPYAREVVGDIEWGQPQFAYVTDSSDKDLSFDDTDSASFVPKARVVARSDAPRSQQRPDVPWSKTIFYETHVKGFTQLHPAVPEALRGTFEGLGEKEIVDYVKSLGVTSIELLPVHWFPDDAHLLEKGLKNYWGYNTLAFFAPANRYMGPRGIQGFRDIVRAFHGAGIEVILDVVYNHTAEGNEMGPTLSFRGIDNFSYYRTMPDEPRYYINDTGTGNTVNTSHPRVLQMVTDSLRYWAQEMEIDGFRFDLGTILGREPEGFDQRGGFFDAVGQDPVLSRLKLVGEPWDIGPGGYQVGGFPPGWAEWNDKYRDTVRDYWRNRDGTTRDFAARILGSGDVYDLRGRRPWSGVNFLTAHDGFTLNDL

SEQ ID NO: 206731 - protein, 132 aa, Glycine max
  Coding DNA Sequence Number=SeqID_89953
  Gene Ontology: Mol. function=transition metal ion binding; Cellular component=cytoplasm; Biological process=fucose metabolic process
MGICLEDMICDLGQMPFQQAYAPMYDTLQTNSKKPLYPGCKNSLTLLSVVLSLVNVKAIYGCGVSRYKVKDDDECSSDENSKKGLPAKVLWYLPIIPRFKHLFANGDDEKDLTWHVNGRNCDGMLCHPADSF

SEQ ID NO: 206732 - protein, 79 aa, Glycine max
  Coding DNA Sequence Number=SeqID_89954
NVGGDSARIPFLEDAPVSLASPSRRRTFGGDSARIPFLEDAPVSLASPSRRRVGCDNGSWVKKGARPIDDEGHLHGGED

SEQ ID NO: 206733 - protein, 111 aa, Glycine max
  Coding DNA Sequence Number=SeqID_89955
  Homolog annotation: Hit_ID=Q5XM22; Match level="QueryCoverage=58%, HitCoverage=37%, E-value=3e-19, Identity=69%"; Hit description =Resistance-like protein HAAS-2
MELLEDIYLSRCEARRWIVAARAYLLHLVGCTLFANKSATHVHVVHLEAFQDLGESGSARYMSTFLVFMTASLTMYTMRHPHVPAGGLRRRLISRDYEQRVPDTFGCFDDH

SEQ ID NO: 206734 - protein, 556 aa, Glycine max
  Coding DNA Sequence Number=SeqID_89956
  Gene Ontology: Mol. function=protein transporter activity; Cellular component=membrane; Biological process=protein secretion
  Homolog annotation: Hit_ID=Q3BPY8; Match level="QueryCoverage=56%, HitCoverage=88%, E-value=3e-96, Identity=55%"; Hit description =Membrane fusion protein precursor
  Pfam annotation: Domain name=HlyD; Domain location=250-517; Score =20.9; E_value=0.00038; Accession=PF00529.10; Description=HlyD family secretion protein
MPPLEARLSANWEGQRWSAGALLRAVTHQHRVADGQGNVVAQDLGPSAGFATFALNAAYRFSSQLQLSAGVDNLFDRAYSEHLNLAGSADFGFPADPVRINEPGRSLWMKDPPPPDALRRAASTLRWLSPPWAAGYTSTHADTAATSLAWNGFKALSRHWFHAGKRLAHTAFAGPCLHSAAVDQSGPFMLARIASTLALGLSLAVLAGCAGKQEAAARRQGEAVPVTAQVVQSRQWSDTLQALGTAKARESISVTAKVSEIVEKVHFESGQHIAAGAPIVTLRGQAQEAALVQAQATFHEADQLYKRQRELATQRLVSSATLDTQKSIRDAAEARVAQMQSDIGDRRVRAPFAGVLGIRQVSPGTLLTPTTVIATLDDIEHMHIDFQVPEVELAALGVGDKVSATSVAWPGRTFEGVVSTIDARIDPATRAVTVRADFANGDHALRPGMLLDVRLFRPERPALVIPEIAVVQVGRDTFVYRITADDSVERVDVITGARRAGVVEIKQGLEAGQRIVVDGTGKLRPGLKVAAKDAAPASGAKPADAAAPVAAEGHGG

SEQ ID NO: 206735 - protein, 193 aa, Glycine max
  Coding DNA Sequence Number=SeqID_89957
  Gene Ontology: Mol. function=helicase activity
  Homolog annotation: Hit_ID=Q1SRJ5; Match level="QueryCoverage=99%, HitCoverage=23%, E-value=6e-51, Identity=48%"; Hit description =Probable helicase [imported]-Arabidopsis thaliana-related
YICPCESTWRIFGFPIHGRKLVVERLHFHLLGQHSIVYEDHDDIDDVLSKPSISDSKFISWMNTNQNSVGNLTYAEFVSKFVYSKKKRCWHLRKKGYTIGKLLWVPPITGELFYLRMMLTVCKGPASFEDLRTIGNVQYPTYREACFAMGFLQDDKEFIEAIKEAKDWGSAHYIRKLFVLLLLTAIMNKPEQV

SEQ ID NO: 206736 - protein, 340 aa, Glycine max
  Coding DNA Sequence Number=SeqID_89958
  Gene Ontology: Mol. function=protein transporter activity; Cellular component=membrane; Biological process=protein secretion
  Homolog annotation: Hit_ID=Q57PJ4; Match level="QueryCoverage=63%, HitCoverage=72%, E-value=4e-84, Identity=72%"; Hit description =Putative multidrug resistance efflux pump
  Pfam annotation: Domain name=HlyD; Domain location=179-340; Score =11.6; E_value=0.00097; Accession=PF00529.10; Description=HlyD family secretion protein
KPAWEGADKAMYEAKETGRNRFMDVLLKACNEADEHFQLRRFVGRSVPSLPADQVCAPATVAQCRSLLPVEFVTDRAAADEYCAARSGGLYALAHCTSSASRLDVLRRNLASHVDGSLPVCPLRMSGPCCLAGVVTIPMKTLKYFSTLFVLALALVAGWWLWNFYMQSPWTRDGKIRAEQVSITPQVSGSITMLRVKDNQYVKKGEVLFRIDDTPYHIAILNAEAQLAKAQSDLAKANNEANRRRHLSQNYISAEDLDTANINVKAMQANVRVAEATLKQAQWALTQTVITAPVDGWVTNLSARVGNYATTGQPVFALVDSHSFYVVGYFEETKLRHIRA

SEQ ID NO: 206737 - protein, 146 aa, Glycine max
  Coding DNA Sequence Number=SeqID_89959
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=4e-15, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLPFRELHALAFRGLHVLPFRGLHVLTIRGLHALAFRGLHVLPFRELLAFAFARDLPFRERHTLALRGLLVLTIRGLHVVAFRGQHVLAFRRLHVLAIRGLNVLVFRGLHVLPFRELHAVAFRGLQVLAFRGLHVLTFRGLHVLLF

SEQ ID NO: 206738 - protein, 33 aa, Glycine max
  Coding DNA Sequence Number=SeqID_89960
MDMVEWGLELYTSARRGVFDGRGDLQNKRLRQS

SEQ ID NO: 206739 - protein, 89 aa, Glycine max
  Coding DNA Sequence Number=SeqID_89961
MVAPPDSIPSIEQFNEEDEGPTAQVPQHMEDESSKTTTPNPLVRRKKEDEAQEAAATSEKSLEATSEPSEPVANTASPQQAADPSTPED

SEQ ID NO: 206740 - protein, 255 aa, Glycine max
  Coding DNA Sequence Number=SeqID_89962
  Homolog annotation: Hit_ID=Q47522; Match level="QueryCoverage=24%, HitCoverage=83%, E-value=8e-22, Identity=75%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSINLQWPPNGGRLLVAEYVDPEEVKMKLEPPPTQAASDSTDRAVPPAPPFSQPEPSPHLHREQHPVPVILPPPPPLSKPPPVAREIKLIDTVDLEGGPVGKPVVPAALMNRPTRGERRFAYWALAECILAYYVGTDEGVSEVLHVAGEKRLH

SEQ ID NO: 206741 - protein, 97 aa, Glycine max
  Coding DNA Sequence Number=SeqID_89963
MRSDTDTGVRGRASFLLIACERRGEYRPKKHNLVRTCTGSRKCGCPLKFHAKPVSGGGGWMVKFRKMKKENEEGGWKNHSSGIGVTHKVVFLDKPIS

SEQ ID NO: 206742 - protein, 228 aa, Glycine max
  Coding DNA Sequence Number=SeqID_89964
MMEAVMSMRKMMEVNTATVVVASTTTGLDPTHPSSIKQASHPVPDMNKHSFPPYGLSPNYTPPNVVHTHNFAPIPIESQQPQFGQAHVSQPMEETHEAPRDHNLVNFEPHLGYAAEGQAFCSVPLTNTLGGPQYRPQPQTLHFEVGRAPSAMVERERFDHIEERLRAIEGGGDYAFADMAELCLVPDVVIPPKFKVPNFDKYKGTTCPKNHLKMYNRKMGAYLKNENY

SEQ ID NO: 206743 - protein, 286 aa, Glycine max
  Coding DNA Sequence Number=SeqID_89965
  Homolog annotation: Hit_ID=Q47522; Match level="QueryCoverage=14%, HitCoverage=53%, E-value=8e-19, Identity=100%"; Hit description=LacZ protein
  Pfam annotation: Domain name=SseB; Domain location=99-286; Score= -116.8; E_value=0.012; Accession=PF07179.2; Description=SseB protein
YDGVFEVLQWLLFLSAVPPVQLLTGWCVTAKAPPDISAGKCSGRVPFAIQAAQLLGRAIGAGLFAITPAGERGMCCKAIKLGNARVFPEFDSRPRGRGTTSAETALEASFERARDSAAEERAFFKRLMDAIVYVHAPISDDAQTLRLVQFRHPDGFDAIPFFTSLDKAQAASSSAVRILGVSGRELLTGTRGATLMLNPNYGGVVLYPEEVATLLDTGFIKLIDTVDLEGGPVGKPVVPAALMNRPTRGERRFAYWALAECILAYYVGTDEGVSEVLHVAGEKRLH

SEQ ID NO: 206744 - protein, 271 aa, Glycine max
  Coding DNA Sequence Number=SeqID_89966
  Homolog annotation: Hit_ID=Q47522; Match level="QueryCoverage=19%, HitCoverage=64%, E-value=1e-23, Identity=100%"; Hit description=LacZ protein
MKHFTDTLISANIGTKAGTGPPLEVDGIDKLDKARIQQCRNLFRVQDNAAVVGIEHQRRAASTADELAACALSSEVKKGIASKPSGWRNWTSRSVCASSEMGACTYTIASISRLKNARSSAALSRARSKEASSAVSADVVPLPRGLLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 206745 - protein, 79 aa, Glycine max
  Coding DNA Sequence Number=SeqID_89967
  Gene Ontology: Mol. function=transporter activity; Cellular component= outer membrane-bounded periplasmic space; Biological process=transport
  Homolog annotation: Hit_ID=Q2KA68; Match level="QueryCoverage=98%, HitCoverage=29%, E-value=2e-23, Identity=60%"; Hit description =Probable amino acid ABC transporter, substrate-binding protein
MLQDRADEWKDYGILIPTDLIPSDSVIWLRKGESDTQAALDKIVKELHASGKMLEFAKANRLPSIGYMEEQQKKLSAAQ

SEQ ID NO: 206746 - protein, 326 aa, Glycine max
  Coding DNA Sequence Number=SeqID_89968
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=1e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTRPPFRGLHVLAIGGLHVLTFRELHALAFRGLHALAFRGLHILGFRGLHVLAFRGLHALAFRGLHVLSFRGLHALTFRGLHVLALRGLHAIAFRGLHALPFRGLHVFAFRGMHVVAFKGLHMFAFRGLHALTFRGLHVLTFKGLHVLTFRGLHVLALRGLHVLAFRGLHILAFRGLQALAFRRLHILAFRALHTLAFRGLHVLAFKGLHVLVFRGLHALAFRGPDVLTFRGLRAFTFKGVHVFALRGLHAIAFRGYHVLPSEDYTSSPSEGYTSSPLEGYTPSPLEDDTSSPSEDYTSSPSEDYTSSPSEGYTSSPSEGYTPSP

SEQ ID NO: 206747 - protein, 259 aa, Glycine max
  Coding DNA Sequence Number=SeqID_89969
  Gene Ontology: Mol. function=structural constituent of ribosome; Cellular component=ribonucleoprotein complex; Biological process =translation
  Homolog annotation: Hit_ID=Q8UDA0; Match level="QueryCoverage=74%, HitCoverage=96%, E-value=1e-104, Identity=98%"; Hit description=50S ribosomal protein L25
CVFFNACCRGNDRCDREVTVGDNGRDVLRQLDVRDVNAVADLQAGEVNRDGFRNVVGRAVEFHRVANDVQNAADLDVRLFFVFEVNRNFDVDERVARNAQEVDMHGEVADRIKLVILRENLDLLAVDVDRRNRRHETAGVDTLGDFVGGQGDRNGGLLVTIDDSGNQTVAAKFTRGPLTNSFARLGLELIRFFAHGNSFRGYMESSCPRALNWGGGKRHPTRVASKGVYTGAGAIIQTGDKDKRGLLFDRTPCGFIRLY

SEQ ID NO: 206748 - protein, 194 aa, Glycine max
  Coding DNA Sequence Number=SeqID_89970
  Gene Ontology: Mol. function=chitin binding; Cellular component =extracellular region; Biological process=chitin metabolic process
  Homolog annotation: Hit_ID=UPI000044A8F0; Match level="QueryCoverage =70%, HitCoverage=99%, E-value=7e-19, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLHALAFRGLHVLAFRGLHALSFKGRHVLAIRGLHALSFIGLHALTFRGLHVLAFRGLHALAFRGLRILAFKGLHILAFRGLHVLAFRGLHVLTFRGLHALTFRGLHALAFRERHVLDFRGLHTLAFRGLRVLTFSGLHIRTLREFKGSRPQDTQWTRRSPTGPWGFQLWLRASISPIGCPSPPQQGHAIVT

SEQ ID NO: 206749 - protein, 318 aa, Glycine max
  Coding DNA Sequence Number=SeqID_89971
  Gene Ontology: Mol. function=transporter activity; Cellular component= integral to membrane; Biological process=transport
  Homolog annotation: Hit_ID=UPI00005F8F42; Match level="QueryCoverage =95%, HitCoverage=44%, E-value=1e-130, Identity=70%"; Hit description= COG1289: Predicted membrane protein
RADNAAAFAFVRTGAQDLKRQPGQQHADDFSDVVIDKGLVVIARRIADGQERAHKDDQLPPERGIRRILQLEHLHGHQDREQEGAEHPEVVNLDHQTEFHHKAGDREQQHRLEQGADAVDRRRRGRVEHAADGGERQRRAAGVPLRVDPVGAADHDAQKGAQAVVGGFVAVGMARQRSDARRLEVADRRGAFQPPQPAVAAQVKPTEIAQPQPEGAMAVVRSLLRGDLLKQARQTVFVGGGIAQLVQQLCQHRYQIGGAIRPFHQHAAQAGDNAGHAQLLVQHIVEQVILPPQPVVAPECLNAQHVHGQDLADDFFVR

SEQ ID NO: 206750 - protein, 130 aa, Glycine max
  Coding DNA Sequence Number=SeqID_89972
PDNKFPKQVRVRGHLIKFDIDSLNTFLETPVVVEQWESFPSYSRFARLRPDLQELAAQLCILGRGFVLNVEGLLWKLLRKDLTTLAQTWSALPYSNLAPTSHTSDLNLDRAKLVYRLIMKMNMNLGSLIS

SEQ ID NO: 206751 - protein, 247 aa, Glycine max
  Coding DNA Sequence Number=SeqID_89973
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q6PUG0; Match level="QueryCoverage=90%, HitCoverage=42%, E-value=3e-74, Identity=65%"; Hit description=3 -dehydroquinate dehydratase / shikimate dehydrogenase isoform 2
  Pfam annotation: Domain name=Shikimate_DH; Domain location=52-179; Score=54.1; E_value=4.8e-13; Accession=PF01488.10; Description =Shikimate  quinate 5-dehydrogenase
  Pfam annotation: Domain name=Shikimate_dh_N; Domain location=1-29; Score=-29.6; E_value=0.073; Accession=PF08501.1; Description =Shikimate dehydrogenase substrate bin
  Pfam module annotation: Pfam domain module=Shikimate_DH::Shikimate_dh_ N; Domain location=52-179::1-29
VGIPYKEEVLRFCDEVHPLAQSIGAVNTIIRRPRDGKLVGYNTDCEAAITAIEDALIEHGCNDGEASLGSPLAGRLFVLVGAGGAGKALAFGAKSRGARLVIFDIDFDRAKSLACAVFGEAQPFKELVNFQPEKGAILANATPVGMHPNTDRIPVAEATLEDYRLVFDAVYTPRRTRLLNEADAAGAITVAGVEMFLRQAIGQFNLFTGLEAKEVLLDILVLPKIMTIADRTRITLDWIGLDWIRLD

SEQ ID NO: 206752 - protein, 291 aa, Glycine max
  Coding DNA Sequence Number=SeqID_89974
  Gene Ontology: Mol. function=protein serine/threonine kinase activity; Cellular component=cytoplasm; Biological process=vesicle -mediated transport
  Homolog annotation: Hit_ID=Q5XQC7; Match level="QueryCoverage=86%, HitCoverage=41%, E-value=6e-79, Identity=58%"; Hit description=BON3
  Pfam annotation: Domain name=C2; Domain location=101-188; Score=29.9; E_value=9.2e-06; Accession=PF00168.20; Description=C2 domain
MGGCFSDVKGGKQAVGVGGNGAHNDALDLFYKSHQMFTQLETLKLGDQDFLGMASCTLSEIVTKPSRSLSLRLKNKSRHDVLRNLGEITVHAEETVASRSAVEMVLRCTHLDNKDFFSKSDPFLRISRMVETGGYVPICKTEVIDDNLNPKWKPLCLSVQKFGNKDNPLLIECFDFNSSGNHDAKRIDVKFIAISKMQKSVADLEKLYKERTGANFVIPSTRHRQEKVLKGQLFVDQYCVKEQISFIDYISSGFELNFMVAIDLTASNGNPHHSDSLHYIDAYGRLNSYQK

SEQ ID NO: 206753 - protein, 1067 aa, Glycine max
  Coding DNA Sequence Number=SeqID_89975
  Gene Ontology: Mol. function=heat shock protein binding; Cellular component=integral to membrane; Biological process=protein folding
  Homolog annotation: Hit_ID=Q2R254; Match level="QueryCoverage=99%, HitCoverage=99%, E-value=1e-136, Identity=31%"; Hit description=DnaJ domain containing protein, expressed
  Pfam annotation: Domain name=DnaJ; Domain location=67-128; Score =117.0; E_value=5.5e-32; Accession=PF00226.21; Description=DnaJ domain
  Pfam annotation: Domain name=zf-MYM; Domain location=185-222; Score =16.5; E_value=0.01; Accession=PF06467.5; Description=MYM-type Zinc finger
  Pfam module annotation: Pfam domain module=DnaJ::zf-MYM; Domain location=67-128::185-222
MECNKDEAIRARQIAENKMQAGDFEGGLKFATKAQRLFPEIQNILQILAVCEVHCAAQKKHSGSDMDWYGILKIEKSADEATIKKQYRKLALLLHPDKNKSDGAEAAFKLIGEANRVLSDQTKRALYDLKFGVPVGNTAAKVPPRHPNGNASGMGCDGTARNYQNSFSSQYQAWNSYHRTDNQTFWTCCPHCNTRYQYVITILNHTIRCQHCSKSFTAHDMGNHNVSPGYWSPFNNQKEPPKHASSKEASKSNGGKSSGREQEGVSMSKCSAGIGTHSKVAKRRDSHAAAGVTKAGVGMSNPTNTKAKESQASTKVGHKRARQSTSDDDNKAANGKGVKDAKVQKNRVDPNRRSSRKKQHVSYTENDKDGDFGNSSKRPRHHESSNNNPASFTDGVGGQNGKIRNKASAPPEETVLRNKTKVEQTNVLRKEASNSDLNDRKSKADNCSPLKSNLPPSSEICCPDPDFSDFERDKAEGCFAVNQLWAIFDNTDSMPRFYALVKKVYFPFKLRITWLEPDSDDQGEIDWHEAGLPVACGKFKLGQSQRTSDRFMFSHQVHCIKGSDSGTYLVYPKKGETWAIFRHWDLGWSSDPEKHSEYQFEYVEVLSDFDENAGIKVAYLSKLKGFVSLFQRTVLNRISLFCILPNELYKFSHRIPSYKMTGAERQDVPRGSFELDPAGLPNSLSEVGDPGVVKMDGVNCSHHEYSKCKVEEAMSNDSIHKAKLRESIGSERVAQILRRSPRSSQKSMDNGQANTSQYTVRKDDINIGHRDDSPPEGNTAAFQTIKRKVKTPQKHEKNNYEGEALKARKSPRDLSKKNAQGDAGEWTAGKKTDNHSSNSKNVKVSNIPQSVGASCYGFKKEKSEEMFQCGQIWAIYGDRDHMPDTYAQIRMIECTPNFRLQVYMLEPCPPPNDLKRTISCGTFSVKEAKLRMLSLSAFSHQLKAELVANNRYEIYPRKCEIWALYKDQNYELTSSNQGRGECHIVEVLADSYQSIQVVVLVPHGNSGTIFKAPRIQRSKTGVIEILRKEVGRFSHQIPAFQHSDNVHLRGCWELDPSSVPGSFIPID

SEQ ID NO: 206754 - protein, 842 aa, Glycine max
  Coding DNA Sequence Number=SeqID_89976
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98204; Match level="QueryCoverage=98%, HitCoverage=67%, E-value=0.0, Identity=64%"; Hit description =Phospholipid-transporting ATPase 1
  Pfam annotation: Domain name=Hydrolase; Domain location=83-529; Score= 12.0; E_value=0.0049; Accession=PF00702.16; Description=haloacid dehalogenase-like hydrolase
MDVSEGEEDSYKYYGWVLEIVFTFLMSIIVFQIMIPISLYISMELVRVGQAYFMIRDSRMYDKATDSGFQCRALNINEDLGQIKYVFSDKTGTLTENKMEFQCASILGFDYSSAKMGPENEQVEYSVQEDGKVFKPKMRVKINQELLQLSKIGFANREGKQIYDFFLALAACNTIVPLVVDTSDPMVKLIDYQGESPDEQALAYAAAAYGFMLIERTSGHIVVDIHGEKQRFNVLGLHEFDSDRKRMSVILGYNNNSVKLFVKGADTSMLSVIDKSLNTDILQATETHLHSYSSVGFRTLVIGVRDLDASEFEQWHSAFEAASTALIGRAAMLRKVAINAENNLCILGATAIEDKLQQGVPESIESLRTAGIKVWVLTGDKQQTAISIGYSSKLLTSNMNLITINTNNRESCRRRLQDALVMSRKDMTVPGVSHNSEGRSDAVSTPLALIIDGTSLVYILDSELEEELFQLANRCSVVLCCRVAPLQKAGIVALVKNRTDDMTLAIGDGANDVSMIQMAHVGVGISGQEGRQAVMASDFAMGQFRFLVPLLLIHGHWNYQRLGYMIIYNFYRNAIFVLVLFWYVLFTAFTLTTAINEWSSVLYSIIYSAFPTIVVGILDKDLSKRTLLKYPQLYGAGLRQEAYNKKLFWLAMADTLWQSIAVFFTPLIAYWETTVDVTSIGDLWTLSVVILVNLHLAMDVIRWNWITHAAIWGSIVATFICVIIIDAIPALPGYCFQETLTNSTGCVRSSVIESVLLALLYVLSLGDKTMAIFHAAGTGLFWLCLLGTVIAALLPRLVVKYMYQYYFPSDIQISRETEKFGNPRDNGGGQIEMLPVSDGPPR

SEQ ID NO: 206755 - protein, 422 aa, Glycine max
  Coding DNA Sequence Number=SeqID_89977
  Gene Ontology: Mol. function=protein serine/threonine kinase activity; Cellular component=cytoplasm; Biological process=vesicle -mediated transport
  Homolog annotation: Hit_ID=Q5XQC7; Match level="QueryCoverage=96%, HitCoverage=75%, E-value=1e-151, Identity=62%"; Hit description=BON3
  Pfam annotation: Domain name=C2; Domain location=62-150; Score=34.0; E_value=5e-07; Accession=PF00168.20; Description=C2 domain
  Pfam annotation: Domain name=Copine; Domain location=192-339; Score =285.4; E_value=1.1e-82; Accession=PF07002.6; Description=Copine
  Pfam module annotation: Pfam domain module=C2::Copine; Domain location=62-150::192-339
MTLKLGDQEFLGMTSCTLSEIATKPSKSLSLRLQNKSGHGGLIRNLGEITVHAEETVASKSAVEMVLRCSHLDNKDVFSKSDPFLRISRMVESGGYIPICKTEVIDDNLNPKWKSVCLGAHKFGSKDNPLVIECFDFNSSGDHVLKGQLFVDQYCEKEQFSFIDYISSGFELNFMVAVDFTASNGNPQHSDSLHYIDAYGRLNSYQKAIMEVGEVIQFYDSDRQFPAWGFGGKIPGGTVSHCFNLNGNPGASEVVGVEGIMDAYVSALSSVTLSGPTLFGPVINMAAQTAAQSLTSVNSTKYYVLLIITDGVVTDLQETINALVKASDLPLSILIVGVGSADFTSMEVLDADNGRQLESSTGRVATRDMVQFVPMREVQSGQISVVQVLLEELPDQFLSFMRSRGISPLPSHFPKASTSTMQ

SEQ ID NO: 206756 - protein, 346 aa, Glycine max
  Coding DNA Sequence Number=SeqID_89978
  Gene Ontology: Mol. function=zinc ion binding
  Homolog annotation: Hit_ID=Q10L01; Match level="QueryCoverage=91%, HitCoverage=90%, E-value=2e-87, Identity=49%"; Hit description=Zinc finger family protein, putative, expressed
MGVEWLLVCHGLVTAVVVVSFLCGRWPIFEGTFIQRIHYFLTFGAYDYFLRFVGAVFGPKCTDSVLSVEYYCCDRPNPLLQIIYIVIIGVTYYFVAKSCFAYIPGYYLSGIHRYTSFLAVAVGILLFLLTSFSDPGTINTENRKNVQLAKFQNLLGQNTAAFVIAVLHDLIITVDGWHFLICLYGTVAIVLVLAGRLRELRVVDILTVYYGIENSFLDLAPNVVQWLLGSYNTQILLMVFLAIVGMLLAGFFGYHAKLCLTNTTTNETFKWQDYMDWQRKLKEAKVSAEALKQSIGGMSGEKQPLLSKCRAFFRKSPLEDVVVVKNNVYDKGFFLNIQEILVASCT

SEQ ID NO: 206757 - protein, 365 aa, Glycine max
  Coding DNA Sequence Number=SeqID_89979
  Gene Ontology: Mol. function=calcium ion binding; Cellular component =extracellular region; Biological process=pathogenesis
  Homolog annotation: Hit_ID=Q8XQP2; Match level="QueryCoverage=85%, HitCoverage=88%, E-value=6e-42, Identity=33%"; Hit description =Probable hemagglutinin/hemolysin-related protein
IIEAIEDHVAGGVEDGNSIRRNGYTNDDQPVVRGQAEANALIYLYDGNQLLASVRADAQGNWQAQLDLPQDGTYNLTAQAEDRADNRSQPSPKWTFHLDTLTPETPMFSYYDDNRGLYQGQFGRGKPTDDVRPELHGEAEPGSVVRIQYAAPGGKWVVGGTATVDSSGHWHWTPPQDLLPDGDWRFRSRSSDKAGNVSQWSDSWTLTIDTRINTPAILQAIDDVGTIQPVLPGQTTDDKRLDFSGQAEPYSQVTLYQNGVAAGSATVGADGRWQITPDRDMQPGSNNFTVKAVDVAGNVSDYAPNWAINYDSGVKHSSGEENWNCRANTSWQTGRVYQYGGLKVTELKHGTSNNCFYTGIMNRPD

SEQ ID NO: 206758 - protein, 150 aa, Glycine max
  Coding DNA Sequence Number=SeqID_89980
  Gene Ontology: Mol. function=protein binding; Biological process=two -component signal transduction system (phosphorelay)
  Homolog annotation: Hit_ID=Q94KS0; Match level="QueryCoverage=96%, HitCoverage=96%, E-value=9e-36, Identity=50%"; Hit description =Histidine-containing phosphotransfer protein
  Pfam annotation: Domain name=Hpt; Domain location=45-130; Score=56.5; E_value=8.5e-14; Accession=PF01627.13; Description=Hpt domain
MYGVSQLQRQLAQYTSSLFEEGFLDDQFNQLQQLQDESNPEFVVEVVTLFFEDAERLLNELAKALGQENIDFKRVEAHVRQLKGSSSSIGAQRVQKVCIAFRNYCEEKNVEGCLKSLQEIKQECSLVKSKFETLFKMEQQLFAAGGSVTR

SEQ ID NO: 206759 - protein, 69 aa, Glycine max
  Coding DNA Sequence Number=SeqID_89981
MDAFSLHLTLHHDLLPLPPSRTPLQPPFPTLILRVLVQEPILHAGDMPNSFIGRSYEDRILSLKFLLKI

SEQ ID NO: 206760 - protein, 433 aa, Glycine max
  Coding DNA Sequence Number=SeqID_89982
  Gene Ontology: Mol. function=zinc ion binding; Cellular component =nucleus; Biological process=regulation of transcription
  Homolog annotation: Hit_ID=Q84PD2; Match level="QueryCoverage=84%, HitCoverage=79%, E-value=3e-62, Identity=37%"; Hit description=AOBP -like protein
  Pfam annotation: Domain name=zf-Dof; Domain location=69-131; Score =135.7; E_value=1.3e-37; Accession=PF02701.6; Description=Dof domain, zinc finger
WTEESTNNEVDVPLNEVSNKLIDPHKYGYGTPNLNKNTTLKLVPKVVHRTNEHRNAKREIDHQEKVFKKPDKVLPCPRCNSLETKFCYFNNYNVNQPRHFCKNCQRYWTAGGTIRNIPVGTGKRKNKHSAQYCQIPMTPDAASVIQTDSKPASDMLLLSNELPVTSRPIKGGEETPLSESLETVLSLNGLTKIEVDSSTLKDDDDEEPSSSSMRSSEIEQLGLPQHSNGLVPLHSFHYYHVPSWPYQWNPCWNVKEFRPSNISSRAVYTDSSTMMAVPGFSIPTVILPGVPYSYLGFMSSWAEQKEEASLVGSAFSGISLSSCSVSNSTCSGNRSPTLGKHPRDGSTPGEDAMKQNLWVPKTVRINDPEEAANSSIWSTLGTKSEQNKFIMKGSVFKSFEPKSQASPHILDDNQILRANPAAFSRSESFQERM

SEQ ID NO: 206761 - protein, 731 aa, Glycine max
  Coding DNA Sequence Number=SeqID_89983
  Gene Ontology: Mol. function=protein kinase activity; Cellular component=integral to membrane; Biological process=protein amino acid phosphorylation
  Homolog annotation: Hit_ID=Q2HVC0; Match level="QueryCoverage=93%, HitCoverage=84%, E-value=7e-92, Identity=49%"; Hit description =Protein kinase
  Pfam annotation: Domain name=LRR_1; Domain location=107-129; Score =3.3; E_value=68; Accession=PF00560.23; Description=Leucine Rich Repeat
  Pfam annotation: Domain name=LRR_1; Domain location=131-153; Score =14.8; E_value=0.31; Accession=PF00560.23; Description=Leucine Rich Repeat
  Pfam annotation: Domain name=LRR_1; Domain location=155-177; Score =11.3; E_value=2.2; Accession=PF00560.23; Description=Leucine Rich Repeat
  Pfam annotation: Domain name=LRR_1; Domain location=179-201; Score =9.1; E_value=5.6; Accession=PF00560.23; Description=Leucine Rich Repeat
  Pfam annotation: Domain name=LRR_1; Domain location=203-224; Score =21.4; E_value=0.0031; Accession=PF00560.23; Description=Leucine Rich Repeat
  Pfam annotation: Domain name=LRR_1; Domain location=226-245; Score =6.9; E_value=15; Accession=PF00560.23; Description=Leucine Rich Repeat
  Pfam annotation: Domain name=LRR_1; Domain location=247-269; Score =8.6; E_value=6.9; Accession=PF00560.23; Description=Leucine Rich Repeat
  Pfam annotation: Domain name=LRR_1; Domain location=271-293; Score =9.3; E_value=5.2; Accession=PF00560.23; Description=Leucine Rich Repeat
  Pfam annotation: Domain name=LRR_1; Domain location=295-317; Score =7.8; E_value=9.9; Accession=PF00560.23; Description=Leucine Rich Repeat
  Pfam annotation: Domain name=LRR_1; Domain location=319-338; Score =5.7; E_value=24; Accession=PF00560.23; Description=Leucine Rich Repeat
  Pfam annotation: Domain name=LRR_1; Domain location=74-93; Score=0.6; E_value=2.2e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =107-129::131-153::155-177::179-201::203-224::226-245::247-269::271 -293::295-317::319-338::74-93
MASKPVSLSHLLLLTLFLATIQLSEQLEFSQSQTLLKVQQLLGYPSALGTLSSTTDFCNIEPTSYLTLVCYEDSLTQLHVVGNNEYNPLPQNFSSDTLFATLGTLSSLKVISLVSLGLWGNLPESIAQMSSLEILNITSNHFSGAIPSQLSLLRNLQSVVLDDNNFNGEVPNWVGSLQGLAMLSMRNNWLSGSLPTSLNALHTLRVLDLSNNQLSGELPHLKNLPNLQVLNLENNTFGPHFPSLPTKLVSLVLRNNSFRLSVPSNLSSFYLLQRLDLSLNGFVGPFPPSLLSLPSINYLDISSNKFTGMLLNNLSCNDDLHFVNLSSNLLKGELPTCLEPKTRVVLYARNCLSNKNQDQHPSDFCSNEALAVTIITHQQKHKRTTSKAIIVSSMGGLVGGVLIVGVVILVVSRVHKKQVVKIPSKSTLEHAISQEHNEDEVKTTTRSIMEHIIKRVPDKRAVETLTRSIKEHVMSRVNSKRVVRASTRSIIEHVSSANTAKLLNDARYISETMKMGASLPAYRTFALEELKEATNNFDESSFISEGPRGQIYKGVLSDGMQIAIRGLKMRKKHGPQTYMHHVEMISKLRHPHLVSALGHAFESNQDDSSVNNRITAAIGVVKGIQFLHTGIVPGLYSNNLKITDILLDNNHNVKISSYNLPLSAENKRMISNGTSPGFKGNVQARIKDEDKNDVYDIGVILLEIILGRPIMFHNEVGTLKDLVSITFKFHA

SEQ ID NO: 206762 - protein, 145 aa, Glycine max
  Coding DNA Sequence Number=SeqID_89984
  Homolog annotation: Hit_ID=Q8RXC8; Match level="QueryCoverage=97%, HitCoverage=29%, E-value=1e-07, Identity=28%"; Hit description =Putative serine/threonine protein kinase
MVPIDPAFNDKHKKRGIVYTCPASVSAQDLGEFDLEKEKSVVTLKELLEDCIRDTDNSQQLSELAVSCPSLRTQFYWSKFLKLWKRRSFKHLPSFPPSCVPNITKTKNRTIQEISVVCNSYCSRTLMNFSLDNLRNATNNFSNGL

SEQ ID NO: 206763 - protein, 41 aa, Glycine max
  Coding DNA Sequence Number=SeqID_89985
MEHELPRKKNQSLLMSSGCGVVVKPPQLVVLVDLTPTGSVT

SEQ ID NO: 206764 - protein, 182 aa, Glycine max
  Coding DNA Sequence Number=SeqID_89986
  Gene Ontology: Mol. function=oxidoreductase activity; Cellular component=membrane; Biological process=metabolic process
  Homolog annotation: Hit_ID=Q2HTL8; Match level="QueryCoverage=98%, HitCoverage=61%, E-value=2e-78, Identity=79%"; Hit description=Short- chain dehydrogenase/reductase SDR
  Pfam annotation: Domain name=adh_short; Domain location=1-104; Score=- 45.8; E_value=0.0057; Accession=PF00106.15; Description=short chain dehydrogenase
MKRVVDEVIKAYGRIDILVNNAAVQYESDSLEEIDDATLQMVFRTNIFSYFFMTKHGLKHMKEGSSIINTTSVTAYKGYATLVDYASTKGAILGFTRSLALQLVSKGIRVNGVAPGPIWTPLQVASFREEEIVRFGSDVTPMKRAGQPIEVAPSYVFLASNQCSSYVTGQVLHPNGGIIVNA

SEQ ID NO: 206765 - protein, 495 aa, Glycine max
  Coding DNA Sequence Number=SeqID_89987
  Gene Ontology: Mol. function=sugar porter activity; Cellular component=integral to membrane; Biological process=carbohydrate transport
  Homolog annotation: Hit_ID=Q3ECP7; Match level="QueryCoverage=88%, HitCoverage=91%, E-value=1e-152, Identity=62%"; Hit description =Sugar transporter ERD6-like 5
  Pfam annotation: Domain name=MFS_1; Domain location=42-448; Score =80.8; E_value=4.3e-21; Accession=PF07690.6; Description=Major Facilitator Superfamily
  Pfam annotation: Domain name=Sugar_tr; Domain location=45-488; Score =263.4; E_value=4.5e-76; Accession=PF00083.14; Description=Sugar (and other) transporter
  Pfam annotation: Domain name=Tetraspannin; Domain location=36-207; Score=-57.7; E_value=0.058; Accession=PF00335.10; Description =Tetraspanin family
  Pfam module annotation: Pfam domain module=MFS_1::Sugar _tr::Tetraspannin; Domain location=42-448::45-488::36-207
  Subcellular localization annotation: CTP_CleavageSite=51; ConfidenceScore=5.66e-01
MDNKTDFSTPLLPTSYGPVDSQGKGHTGPSSSSSFSSIPTTLILTTLVAVFGSYVFGSAIGYSSPTQSRIMLDLNLGVAQYSIFGSILTIGAMIGAVVSGRIADYAGRRVAMGFSQVFCILGWLAITFSKVAWWLYVGRLLVGCGIGLLSYVVPVYVAEITPKNLRGAFTAVHQLMICCGMSLTYLIGAYVNWRILATIGIIPCLVQLLSLPFIPDSPRWLAKVGRLKESDSALQRLRGKNADFYQEATEIRDYTEAFQKQTEASIIGLFQIQYLKSLTLLFYAFIHCMTSNKMNMRISDFTQKQKLLSMTGFSESIGTIAIVAVKIPMTTIGVLLMDKSGRRPLLLVSAVGTCVGCFLAALSFILQVLLITESDLDLHKWKGVSPILALVGVLVYVGSYSIGMGAIPWVIMSEIFPINVKGSAGSLVTLVSWLCSWIISYSFNFLMSWSSAGTFLMFSSICGFTVLFVAKLVPETKGRTLEEIQASLNSFSSKR

SEQ ID NO: 206766 - protein, 217 aa, Glycine max
  Coding DNA Sequence Number=SeqID_89988
  Gene Ontology: Mol. function=sugar porter activity; Cellular component=integral to membrane; Biological process=carbohydrate transport
  Homolog annotation: Hit_ID=Q3ECP7; Match level="QueryCoverage=88%, HitCoverage=43%, E-value=2e-27, Identity=38%"; Hit description=Sugar transporter ERD6-like 5
MTGSIVSGKIADYAGRRVTMGFSELLTLPFIPDSPRWLSQHISLDKPSTSDKCNLLLAKDYTEALQHQTEASIIGLFQSQYLKTLTVSILISKLTPFVQPILTFCRLLWKLVTWLGWSRLDDTATIWRGFWDSLGTIATVAVKVPLTTLGVLLMDKCGRRPLLLACLIQDLHKWNGISPIMALVGVVVYMGSFSLGLAGIPWVIMSEIFSINAKGSA

SEQ ID NO: 206767 - protein, 180 aa, Glycine max
  Coding DNA Sequence Number=SeqID_89989
  Gene Ontology: Mol. function=structural constituent of ribosome; Cellular component=ribonucleoprotein complex; Biological process =translation
  Homolog annotation: Hit_ID=O22584; Match level="QueryCoverage=93%, HitCoverage=92%, E-value=2e-55, Identity=72%"; Hit description=40S ribosomal protein S14
  Pfam annotation: Domain name=Ribosomal_S11; Domain location=28-176; Score=192.4; E_value=1.1e-54; Accession=PF00411.9; Description =Ribosomal protein S11
MSRRKVREPKEENVTLGPAVRDGEHVFGVARIFASFNDTFIHVTDLSGRETLVRITGGMKVKADRDESSPYAAMLAAQDVAARCKVMLCEIIVVYVVIFCEVVKLNALFQIIVEQELGITALHIKLRATGGNKTKTPGPGAQSALRALARSGMKIGRIEDVTPIPSDSTRRKSGRRGRRL

SEQ ID NO: 206768 - protein, 62 aa, Glycine max
  Coding DNA Sequence Number=SeqID_89990
IQQPCATLEGATVIFTYVKGARGQGSECTLEIIKKAKAEDAKDPLAIPVHDLGYEENCKSGG

SEQ ID NO: 206769 - protein, 58 aa, Glycine max
  Coding DNA Sequence Number=SeqID_89991
MASIGEQELKLMGKQEKSSAIKYCERMFTRKGQEQPKLLESATATKDVGACRIVPKDV

SEQ ID NO: 206770 - protein, 139 aa, Glycine max
  Coding DNA Sequence Number=SeqID_89992
  Gene Ontology: Mol. function=glutathione synthase activity; Cellular component=chloroplast; Biological process=glutathione biosynthetic process
  Homolog annotation: Hit_ID=Q9M426; Match level="QueryCoverage=57%, HitCoverage=18%, E-value=8e-24, Identity=61%"; Hit description =Homoglutathione synthetase
MALILLLFAMALSEPLTLTPVQDSPLFDCHRLDQQFLHTLAYDALVWSPLHGLLVGDKSVQRSGSVPGVGLVHAPLALLPTPFPEKQCREATELDAKFLQESLSRLITWLFLNAELKTRMSTKVRGELIPVLNFALRNK

SEQ ID NO: 206771 - protein, 186 aa, Glycine max
  Coding DNA Sequence Number=SeqID_89993
  Gene Ontology: Mol. function=catalytic activity; Cellular component =cytoplasm; Biological process=metabolic process
  Homolog annotation: Hit_ID=Q99288; Match level="QueryCoverage=54%, HitCoverage=33%, E-value=5e-13, Identity=53%"; Hit description =Putative phosphoglycerate mutase YDR051C
MAPPLGKSAAFESRTCAISRSSTKLANASEDSSFADVFDRVSSFLESLWRDVDMNRLNHHPSDDLDLIIVSHGLASRVFLMKWFKWTVEQFELLNNFGNGEFRVIQLGVVEIGEYSLAVHHTDEELLEWGLSPDMVADQKRRASAGKGDWNDQYSWYLDAFFYHLPDSDDENVDKHDETDSLSECS

SEQ ID NO: 206772 - protein, 169 aa, Glycine max
  Coding DNA Sequence Number=SeqID_89994
  Homolog annotation: Hit_ID=Q9ZQ38; Match level="QueryCoverage=67%, HitCoverage=71%, E-value=7e-17, Identity=39%"; Hit description =Expressed protein
  Pfam annotation: Domain name=DUF1068; Domain location=13-169; Score =92.8; E_value=1e-24; Accession=PF06364.3; Description=Protein of unknown function (DUF1068)
  Subcellular localization annotation: CTP_CleavageSite=44; ConfidenceScore=5.04e-01
MRVWRVHPQEQKLCPNGVLRWVLVWMSVCFLVFTVGPPSRSRVRKSVSSQLSCPPCDCFCSSAEYLLDPLDCGKHDPILNEEMNKGLLTMLSEELNLQKIVANETMEHTKQLIMDARKTFSHYQKEAEKCNIGVETCEEARERAEAELIEEHKLTTLWENRASEYGWVE

SEQ ID NO: 206773 - protein, 523 aa, Glycine max
  Coding DNA Sequence Number=SeqID_89995
  Gene Ontology: Mol. function=glutathione synthase activity; Cellular component=chloroplast; Biological process=glutathione biosynthetic process
  Homolog annotation: Hit_ID=Q9M426; Match level="QueryCoverage=89%, HitCoverage=100%, E-value=0.0, Identity=80%"; Hit description =Homoglutathione synthetase
  Pfam annotation: Domain name=GSH_synth_ATP; Domain location=75-523; Score=799.7; E_value=1.6e-237; Accession=PF03917.8; Description =Eukaryotic glutathione synthase, ATP binding domain
  Pfam annotation: Domain name=GSH_synthase; Domain location=244-323; Score=54.8; E_value=2.9e-13; Accession=PF03199.6; Description =Eukaryotic glutathione synthase
  Pfam module annotation: Pfam domain module=GSH_synth_ATP::GSH _synthase; Domain location=75-523::244-323
  Subcellular localization annotation: CTP_CleavageSite=61; ConfidenceScore=5.75e-01
MGSRSGGLVCSTCSYTGIRTRRFYTNNNTFPSFSFTFPHQPQSFSFPKPLRLMSQPLTTNSADGDSSVAAPPILFDYHLIDQKLLQNIVYDALVWSTLNCLLVGDKSVQRSGTVPGVGLVHLPLSLLPGPFPENHWKQACELAPIFNELVDRVSLDGKFLQESLSRTKNADEFTSRLLDIHSKMLQINKKEDIRMGIVRSDYMIDEKTKSLLQIEMNTISTSFALIGCLMTGLHKSLLSQYGKFLGLDSNRVPANNAVDQSAEALAKAWSEYNNPRDGQEISVVYFRAGYTPKDYPSESEWRARLLMEQSSAIKCPTISYHLVGTKKIQQELAKPGVLESLGSWSICYQKLVLSKGIKTSYPIAQRLFAMRRFVENKDHIAKLRACFAGLWSLEDSDIAKKAIENPELFVMKPQREGGGNNIYGDELRETLLKLQEAGSEEDAAYILMQRIFPATSPAILVRDGNWDMGHVISEAGVFGTYLRNKDKVIINNESGYMVRTKISSSYEGGVLPGFGVVDTVYLT

SEQ ID NO: 206774 - protein, 494 aa, Glycine max
  Coding DNA Sequence Number=SeqID_89996
  Gene Ontology: Mol. function=sugar porter activity; Cellular component=integral to membrane; Biological process=carbohydrate transport
  Homolog annotation: Hit_ID=Q3ECP7; Match level="QueryCoverage=91%, HitCoverage=95%, E-value=1e-180, Identity=69%"; Hit description =Sugar transporter ERD6-like 5
  Pfam annotation: Domain name=MFS_1; Domain location=54-447; Score =93.0; E_value=9e-25; Accession=PF07690.6; Description=Major Facilitator Superfamily
  Pfam annotation: Domain name=Sugar_tr; Domain location=50-487; Score =322.0; E_value=1e-93; Accession=PF00083.14; Description=Sugar (and other) transporter
  Pfam module annotation: Pfam domain module=MFS_1::Sugar_tr; Domain location=54-447::50-487
MDETKSTEPSEFSSPLLPIGAQGYGGNHGNDYEEKRQKETWSVPPILILTTLVAVSGSYVFGSAVGYSSPAQTGIMDDLNVGVAEYSLFGSILTIGAMIGAIISGRIADYAGRRTAMGFSEVFCILGWLAIAFAKVGWWLYVGRLFVGCGMGLLSYVVPIYIAEITPKNLRGGFTTVHQLMICCGVSLTYLVGAFLNWRILALLGIIPCIVQLLGLFFIPESPRWLAKFGHWERSESVLQRLRGKNADVSQEATEIRDFTEALQRETESIIGLFQLQYLKSLTVGVGLMILQQFGGVNGIAFYASSIFISAGKKFLSITGFSGSIGMIAMVAVQIPMTALGVLLMDKSGRRPLLLISASGTCLGCFLAALSFTLQDLHKWKEGSPILALAGVLVYTGSFSLGMGGIPWVIMSEIFPINVKGSAGSLVTLVSWLCSWIVSYAFNFLMSWSSAGTFFIFSSICGFTILFVAKLVPETKGRTLEEVQASLNPYSTKT

SEQ ID NO: 206775 - protein, 276 aa, Glycine max
  Coding DNA Sequence Number=SeqID_89997
MIKLFKRNTTNTDKCHHHRYHHHPVLGLGLATREACRPPNVLESAMLRLNTPPPSWKRVNNTGSLHNVVTGLASCTESLGFESSDEIHNNNDNNCSDQKDNYDDEIWRRRTMKAEGRGKVQSFPPPPLSSLNRNGKPSFYLRPVRRDGRLQLTEVRIQRSEILHASRHNGRLTLHLVPDLEEEEEEEEEVEEEEEEKRVEEWKLRGVGGSEGLKRCHEMVKQHHHHNVHGNLRMCGISIVTEQNKGLRMLRCAALHCMHPPCMAACGVVSLRENDM

SEQ ID NO: 206776 - protein, 232 aa, Glycine max
  Coding DNA Sequence Number=SeqID_89998
  Gene Ontology: Mol. function=microtubule motor activity; Cellular component=microtubule associated complex; Biological process =microtubule-based movement
  Homolog annotation: Hit_ID=Q69UI4; Match level="QueryCoverage=83%, HitCoverage=37%, E-value=3e-37, Identity=49%"; Hit description =Kinesin 1-like
  Pfam annotation: Domain name=Kinesin; Domain location=1-204; Score= -92.9; E_value=2.1e-08; Accession=PF00225.13; Description=Kinesin motor domain
MGKMALALTIDLLFIDISLYIYVCLPINETDAVDAINGTIITYGQTGAGKTYGMEGSGIFECDEQKKGLLPRVVKGLFDFLNSLDEEKTYSIKLSMGGKVVVGARKQEFSRDNKGHASSKICGTTYASFLNTETLNRMRSVKLILVDLAQSEKVEKTGAEGRVLEEAKAINKSLSALGNEMLELHCSVVAHPGLLMHPRVCSLFVSVPGWVTLLQDNCSNCSFIYHAVHALS

SEQ ID NO: 206777 - protein, 158 aa, Glycine max
  Coding DNA Sequence Number=SeqID_89999
MTMTCRKETKIQTRLGADVIYDPVCLPHLVRVLAMVLMNQTNLGSCRQHASCKGHSPNIEHENGEHNHEDAINKSDGGCKAIYNDGSNSLSKEAPVAYIAYVIRNIETFNYFLSLGIQANLDIGDLTDSLKPVNLLCCMKSYNQATVRLLRITSSNIQ

SEQ ID NO: 206778 - protein, 400 aa, Glycine max
  Coding DNA Sequence Number=SeqID_90000
  Gene Ontology: Mol. function=transaminase activity; Biological process=metabolic process
  Homolog annotation: Hit_ID=Q1STG7; Match level="QueryCoverage=91%, HitCoverage=63%, E-value=1e-164, Identity=78%"; Hit description =Aminotransferase, class IV
MAESEVEVIHSWSAPRSLSTSLMYSFSQRDDIEVLDEPLYANFLRVTGLDRPYREELLSKMEADGDKVTNDIIFAPGKKKYRFCKHISKQRLQGLTDDLMKKGKHFILIRNPLDILPSFDKVVPPSFYELGLAELVCIYNELREIGKAPPVIDAAELQQDPEATLRSLCNDLEIPFQSAMLKWEAGPKPIDGLWAPWWYKSVHKSTGFEKPRKYPQPFPFSLYDLLEQSLPLYNMLRRHVKKKSSLLSPPLPNPDLPVPANEKLLAWVGDEIVTRDSAKVSVFDSVVQGGDSVWEGLRVYNGKIFKLEEHLDSTQSFPDSAIPVWLFDSAKALAFENVPTQDEIKEAIFRTLIRNGMFDNSHIRLSLTRGKKTICTKRTLNLLLDIMQCPDYYIDQKSQS

SEQ ID NO: 206779 - protein, 329 aa, Glycine max
  Coding DNA Sequence Number=SeqID_90001
  Homolog annotation: Hit_ID=Q2NNE0; Match level="QueryCoverage=96%, HitCoverage=62%, E-value=1e-37, Identity=37%"; Hit description =Calmodulin binding protein IQD22
MTFSAHPSWARKALRALKGLVKLQALVRGHIERKRTAEWLQRVQALLRVQAQIRAGRAQILHSPSSTSHLRGPATPDKFEIPIRSESMKYDQYSSPLLKRNSSKSRVQINGGNQERCRSRSSDSRIDEQPWTQRRSWTRGCSMDEERSVRILEIDSVKPHVTSKRRNLFYSPSQAMVVSDHYSGCNLTTTSPSSYNSPLKINELEESSFCAADNSPQALSLSSSSKDGASKRSPLTPTRSDGSRSFLSGYSEPNYPSYMAYTESSKAKLRSLSAPKQRPQYERCSSSNRYSLHGLATQRIAALHASFTNKAYPGSGRLDKLGMHVPYKY

SEQ ID NO: 206780 - protein, 275 aa, Glycine max
  Coding DNA Sequence Number=SeqID_90002
  Gene Ontology: Mol. function=monooxygenase activity; Cellular component=membrane; Biological process=electron transport
  Homolog annotation: Hit_ID=Q1SB83; Match level="QueryCoverage=97%, HitCoverage=55%, E-value=1e-131, Identity=85%"; Hit description=E -class P450, group I
  Pfam annotation: Domain name=p450; Domain location=1-275; Score= -131.1; E_value=5.3e-05; Accession=PF00067.12; Description=Cytochrome P450
MVLNLFGPESLKKMLPELEQTTCRTLEQWSCENSVELKEATARMIFDLTAKKLISYDSTKSSENLRENFVAFIQGLISFPLDIPGTAYHKCLQGRKRAMKMLKNMLQERRRMQRKEQTDFFDYVVEELKKEGTILTEAIALDLMFVLLFASFETTSLALTYAIKLLSDNPVVLKRLQEEHEAILKQREDPNSGVTWKEYKSMTFTFQFINETVRLANIVPGIFRKALREINFKGYTIPAGWAVMVCPPAVHLNPAKYHDPLAFNPWRWEVRLRHV

SEQ ID NO: 206781 - protein, 576 aa, Glycine max
  Coding DNA Sequence Number=SeqID_90003
  Gene Ontology: Mol. function=oxidoreductase activity; Cellular component=membrane; Biological process=electron transport
  Homolog annotation: Hit_ID=O48923; Match level="QueryCoverage=75%, HitCoverage=91%, E-value=0.0, Identity=71%"; Hit description =Cytochrome P450 71D10
  Pfam annotation: Domain name=p450; Domain location=44-473; Score =285.1; E_value=1.3e-82; Accession=PF00067.12; Description=Cytochrome P450
  Subcellular localization annotation: CTP_CleavageSite=3; ConfidenceScore=5.19e-01
MVMELHSQNNPFSIYLITSFLFLLFLLFKLVKKSSSNNSTSKLPPGPKTLPLIGNLHQLVGSKSHHCFKKLADKYGPLMHLKLGEVSNIIVTSKELAQEIMRTQDLNFADRPNLISTKVVSYDATSISFAPHGDYWRQLRKLCTVELLTSKRVQSFRSIREDEVSELVQKIRASASEEGSVFNLSQHIYPMTYAIAARASFGKKSKYQEMFISLIKEQLSLIGGFSIADLYPSIGLLQIMAKAKVEKVHREVDRVLQDIIDQHKNRKSTDREAVEDLDMFIGGGETSSSTVEWSMSEMVRNPRAMEKAQAEVRKVFDSKGYVNEAELHQLTYLKCIIREAMRLHPPVPMLIPRVNRERCQISGYEIPAKTRVFINAWAIGRDPKYWTEAESFKPERFLNSSIDFKGTNYEFIPFGAGRRICPGITFATPNIELPLAHLLYHFDWKLPNNMKNEELDMTESYGATARRAKDLCLIPITDSPRQPQDLGRNIPMWMLLERVRFTLDGIECNKIGVNYEAFNQLWNFREYESLSSLNFGHSEKFSPKNFIDRVLDNEPHAFSEVEQSMDQLFGSNDGKQ

SEQ ID NO: 206782 - protein, 843 aa, Glycine max
  Coding DNA Sequence Number=SeqID_90004
  Gene Ontology: Mol. function=protein serine/threonine kinase activity; Cellular component=membrane; Biological process=regulation of transcription, DNA-dependent
  Homolog annotation: Hit_ID=O82754; Match level="QueryCoverage=96%, HitCoverage=98%, E-value=7e-91, Identity=40%"; Hit description =Putative serine/threonine kinase
  Pfam annotation: Domain name=PAS; Domain location=94-205; Score=22.9; E_value=0.0011; Accession=PF00989.14; Description=PAS domain
  Pfam annotation: Domain name=PAS_3; Domain location=117-208; Score =12.9; E_value=0.0054; Accession=PF08447.1; Description=PAS fold
  Pfam annotation: Domain name=PAS_4; Domain location=100-210; Score =4.5; E_value=0.073; Accession=PF08448.1; Description=PAS fold
  Pfam annotation: Domain name=Pkinase; Domain location=603-827; Score =148.6; E_value=1.7e-41; Accession=PF00069.15; Description=Protein kinase domain
  Pfam annotation: Domain name=Pkinase_Tyr; Domain location=608-826; Score=160.3; E_value=5.1e-45; Accession=PF07714.7; Description =Protein tyrosine kinase
  Pfam module annotation: Pfam domain module=PAS::PAS_3::PAS _4::Pkinase::Pkinase_Tyr; Domain location=94-205::117-208::100 -210::603-827::608-826
MPMRIAHLTSRTPATSMSSGEERETAAFRALADRCRSLEEKQTKLREEFDELLQKNNLTVRDDNDHVSGNGNNNEVIADSTTDGFLSGFIFSGNPYATVLKCMGHAVHVLRVPSSEIVYWNHSAETLYGWKDYEIIGQRVAKVLIAEENYASLQKILEGLVTGVPWSGQFPFKKRSGEVFMAMVTKTPLYEDGELVGVIAVSSDAAILNTTNSENQRTYQSGNNGQPGVQRLNLKRIQWPPRPMIASMPQIASSVSDLASKLLPVLNTTDDTVSQNTSTDANDEKLEKRGIYETKPHSRHHHKENTTVTEASEKDESTTEFGQPSNIAARVLAKLQIGAHAKCGKDNGNIKNNCTADNSGSNRVNNENDLLGDLLSLNRHQDVANGADKEENLHKCNSLFAMKRADTKVCACRASNVVKDSSGKPFSGEWCECFGSPIPHDPLLRLRCQFDQKKLEPEAMNMATGDEVQKQQEGLQLPSSRESIGSHESSSSKGDNESNSVSKCEIHWEHLQLREEIGQGNYFYCNVINDGWQKAKILPYKHAIVAFGAAIVGIPSQIVNGGWVKKYHVIALWRRYNGYLTTLFCCAFYNSSMLRSLNAKNAFICSCAVVYHGIWNGSDVAVKVYFGNEYTEETLQDYRKEIDIMKRLRHPNVLLFMGAVYSQERLAIVTELLPRGSLFKNLHRNNQTLDIRRRLRMALDVARGMNYLHHRNPPIVHRDLKSSNLLVDKNWTVKPQWMAPEVLRNEPSNEKSDVYSFGVILWELMTQSIPWKNLNSLQVVGVVGFMDRRLDLPEGLDPHVASIIDDCWRSDPEQRPSFEELIQRTLFLVNRVTAVSIRRISES

SEQ ID NO: 206783 - protein, 127 aa, Glycine max
  Coding DNA Sequence Number=SeqID_90005
  Gene Ontology: Mol. function=RNA-directed DNA polymerase activity; Biological process=RNA-dependent DNA replication
  Homolog annotation: Hit_ID=Q1T251; Match level="QueryCoverage=72%, HitCoverage=31%, E-value=5e-13, Identity=40%"; Hit description =Multicopper oxidase, copper-binding site
MAVSFIQEVEGYKIQSHIGDQWVWAADPSGQYSIRSAYSVLREDISEEAQDGEFKELWKLKVPPKVAVFAWRLLKDRLPTRDNLRRKQESTSSMVGIAVLGESGGNMEDIARDAGSVDIEDVLYSML

SEQ ID NO: 206784 - protein, 101 aa, Glycine max
  Coding DNA Sequence Number=SeqID_90006
MGFLSEKGGVQSEVLVTKYGRWKRLKREEATQHASFWQRDLCKICGGCCNLKWFDDMVRRKVRRGNNTKFWSDIWVGDQAWECGGGISHEGGSGLCEKRKW

SEQ ID NO: 206785 - protein, 141 aa, Glycine max
  Coding DNA Sequence Number=SeqID_90007
  Gene Ontology: Mol. function=zinc ion binding
  Homolog annotation: Hit_ID=Q1SG77; Match level="QueryCoverage=87%, HitCoverage=7%, E-value=1e-65, Identity=92%"; Hit description=Zinc finger, TAZ-type; Zinc finger, ZZ-type; Transcriptional coactivation; Zinc finger, FYVE/PHD-type
  Pfam annotation: Domain name=C1_1; Domain location=56-105; Score= -4.9; E_value=0.099; Accession=PF00130.12; Description=Phorbol estersdiacylglycerol binding
  Pfam annotation: Domain name=C1_3; Domain location=67-97; Score=13.0; E_value=0.015; Accession=PF07649.3; Description=C1-like domain
  Pfam annotation: Domain name=ZZ; Domain location=63-107; Score=27.7; E_value=4.1e-05; Accession=PF00569.8; Description=Zinc finger, ZZ type
  Pfam module annotation: Pfam domain module=C1_1::C1_3::ZZ; Domain location=56-105::67-97::63-107
MVEITDVPADTKDKDEILESEFFDTRQAFLSLCQGNHYQYDTLRRAKHSSMMILYHLHNPTAPAFVTTCNICRLDIETGQGWRCEVCPEYDVCNACYQKDRGADHPHKLTNHPSMADRDAQNKEARQLRVLQQQQQRLYIY

SEQ ID NO: 206786 - protein, 149 aa, Glycine max
  Coding DNA Sequence Number=SeqID_90008
  Gene Ontology: Mol. function=nucleic acid binding; Biological process= DNA integration
  Homolog annotation: Hit_ID=Q1S1X7; Match level="QueryCoverage=98%, HitCoverage=11%, E-value=8e-31, Identity=44%"; Hit description =Integrase, catalytic region; Zinc finger, CCHC-type; Peptidase aspartic, catalytic
MTYEKKSGGNVSMGNNAPCKTVGIGSIQIKMHDGIVRTLTNVHHVPKLKKNLISMRAMDSKGFNFNVEGGVMQIKGKGKSDVMQGTKQGNLYILQGSTVTDSASTISQAGSPASNDNSLWHTRLGHTSENGLKILRKQGLLANHKMEPL

SEQ ID NO: 206787 - protein, 521 aa, Glycine max
  Coding DNA Sequence Number=SeqID_90009
  Gene Ontology: Mol. function=DNA binding; Cellular component=beta -galactosidase complex; Biological process=DNA integration
  Homolog annotation: Hit_ID=Q1SD84; Match level="QueryCoverage=56%, HitCoverage=33%, E-value=7e-40, Identity=50%"; Hit description =Integrase, catalytic region
MARRPTVLPQDSMAHFWKHARAANGNRRKGAWQQMNSFHHLFMSGKWIRAGYTFYSGSRLVSRCGSFYGAYKGLCLCKAGCPLFDLDRFIQPLVASHGENMRQKGNSKSLPFTREQLEHLSKFLSARMSVNPTSSLAQQGHKKIRIAGGALSTIAGVGSIPISKSLTLYNVLHVPNLSWRMIGSAKEVDGHYLFEDEVVFKEKKLRNDKSQRIEPNDPQDCHDSENPSELTKKEIPKDIQAALKVPEWKEAVLEEMRALEKNQTWKKVDLPRGKTIRVLLSLSANLDWPLQQLDVKNAFLNGDLEEDVYMDAPPGLAFRWSIETARNMLFQQVLYESDCKCLADNWRSGTFGQRDYFTDTRMMGCRPAETPIDPNKKLGNEDKGDPVDMAGKPGSKASKYSHMEIGLDPLLTKSPLPAIVHFFGLKRILEELQLSMTLSIKLYCDNKVAISISQNPVQHDRTKHVEINRHFIKEMVDGGLICMPFVPTSQQLADILTKGLFRPNFEFFVSKLGMLDIYAPT

SEQ ID NO: 206788 - protein, 869 aa, Glycine max
  Coding DNA Sequence Number=SeqID_90010
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=96%, HitCoverage=61%, E-value=0.0, Identity=59%"; Hit description=Zinc finger, TAZ-type; Zinc finger, ZZ-type; Transcriptional coactivation; Zinc finger, FYVE/PHD-type
  Pfam annotation: Domain name=DUF906; Domain location=579-814; Score =514.2; E_value=1.5e-151; Accession=PF06010.2; Description=Domain of Unknown Function (DUF906)
  Pfam annotation: Domain name=PHD; Domain location=526-577; Score =23.5; E_value=0.00025; Accession=PF00628.19; Description=PHD-finger
  Pfam module annotation: Pfam domain module=DUF906::PHD; Domain location=579-814::526-577
  Subcellular localization annotation: CTP_CleavageSite=66; ConfidenceScore=5.31e-01
MASTLWQKAWLLLFVGVTISLSGDRYGLLNADTFTSVSFYASATSSGSMMNTQNMNAVKLPSIPITSSLISGHSNLNSMHQTSHQKSQAINSLKNLKYQSSLTSRDGHVHTQQQYEQRPQQCHQSERYTPQQFQLKLQGQQPQHLVNNDAFSQSQLSSNLDNIVKSESGVEPHKEVLDSQLSEQFRVSKMQNQFQQISSNDCSKVAQHFSLGQNDSSSSPPQISQQMLHPHRLLSESQNNFSCLSAGSQSTSILINQWPRSLDGHHIPQGMPHEQHLPMDFHRRISGQDVAQCNTLSSDGSIIGQAVAPRSSTEQIDPSSNIKKSHRNQQRLISKSPLVVETSEDLPSLKRMKTEQCTQSINPEYDNSSSSVLNCDSRDSKDTQCQVYLSGEMSISTKSEPTEVKEEVLVHSIHENLSETKMDEDSAHDKMPTGKPVTHTEPANIARPENIKTEKQNGQDKQENVDQPSDHGAGTKSGKPKIKGVSLTELFTPEQVREHITGLRRWVGQPRGDTIVVDGTPFPKSRLEKKKNDEETEEWWVQCDKCEAWQHQICALFNGRRNDGGQADYTCPNCYIQEVERSERKPLPQSAVLGAKDLPRTILSDHIEQQLFRRLKHERQERARLQGKSYDEVPGAEALVIRVVSSVDKKLEVKQRFLEIFQEENYPTEFPYKSKVILLFQKIEGVEVCLFGMYVQEFGSECQFPNQRRVYLSYLDSVKYFRPEVKAVTGEALRTFVYHEILIGYLEYCKKRGFTSCYIWACPPLKGEDYILYCHPEIQKTPKSDKLREWAKVTAARLPYFDGDYWPGAAEDLIYQLRQEEDGRKQNKKGTTKKTITKRALKASGQSDLSGNASKDLLLMHKVICHFDL

SEQ ID NO: 206789 - protein, 317 aa, Glycine max
  Coding DNA Sequence Number=SeqID_90011
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=96%, HitCoverage=17%, E-value=2e-84, Identity=54%"; Hit description=Zinc finger, TAZ-type; Zinc finger, ZZ-type; Transcriptional coactivation; Zinc finger, FYVE/PHD-type
MPEKRYQHPVTEAHRRKVKDLAKRLEEGMFKTAISKEDYMNLDTLESRLSNFLRRSSMTNQNQQHPQLVSSSPIGTMIPTPGMSHVTNSTMIIASSVDASMIAAGGCNSIASSSVNSVSMLPAGNMLGSSLNRSDGNSSCFDSLVLSVCFSFPAFVGLLIAGGNMSSVGVPRATSQMIPTPGFSVSNNRSYTNLDPSTNSSSFSAVDSTKLSQSQSQPQRHQKLQDSGHNNHALHNLGSQMDGGMRSDLLQNSFAYPNDSINNGLGLIGNSIQLANEPGTDDYSSAYTNSPKHLQQHFDQNQQLVVQGNLSKSFCLI

SEQ ID NO: 206790 - protein, 51 aa, Glycine max
  Coding DNA Sequence Number=SeqID_90012
MEFSKDCRQRDGSSGVDDNARRAATWDACWCRSTADEGIVLRGDMVVCCNM

SEQ ID NO: 206791 - protein, 116 aa, Glycine max
  Coding DNA Sequence Number=SeqID_90013
  Gene Ontology: Mol. function=nucleic acid binding; Cellular component= oxygen evolving complex; Biological process=DNA integration
MHARVPYVSAIGSLTYVMVCTRPDLAQTASIVSSIRYLKGTTDIGLIYQGDTSCALTGYLDSNHAGDLSARQSVTGYALTGGNSLVGRKATLQPIVALSTTEAEYMALAKAAKEEI

SEQ ID NO: 206792 - protein, 131 aa, Glycine max
  Coding DNA Sequence Number=SeqID_90014
  Homolog annotation: Hit_ID=Q4QXS6; Match level="QueryCoverage=42%, HitCoverage=35%, E-value=3e-07, Identity=62%"; Hit description=MLL
MEKWQGGHLWSITDTEKQRHIVHKNHIEMEGTSWEVYHPKQVKGLDIAVENAFSWFCDITSSAILFITSRAAGGVAENHGWRNEGNDGVLRGEGERDCFQIEGVARGDDQTDKIFSIEVEATHDVGGGWQG

SEQ ID NO: 206793 - protein, 121 aa, Glycine max
  Coding DNA Sequence Number=SeqID_90015
  Gene Ontology: Mol. function=membrane alanyl aminopeptidase activity; Biological process=proteolysis
  Homolog annotation: Hit_ID=Q9VJ39; Match level="QueryCoverage=98%, HitCoverage=17%, E-value=6e-45, Identity=75%"; Hit description =CG10602-PA, isoform A
  Pfam annotation: Domain name=Leuk-A4-hydro_C; Domain location=1-118; Score=126.1; E_value=9.8e-35; Accession=PF09127.1; Description =Leukotriene A4 hydrolase, C-terminal
KISIHQLIDFLGKLIEHQDIVDLNERKIELLEDTYNLKQSKNAEVRFRLNRLIIRARLIKRLDEIIEFANSNFRMKFCRPIYRDLAAWPEAKPIAVRNFVSVRDQMMAVCSHTIEKDLGLK

SEQ ID NO: 206794 - protein, 509 aa, Glycine max
  Coding DNA Sequence Number=SeqID_90016
  Gene Ontology: Mol. function=protein serine/threonine kinase activity; Cellular component=ubiquitin ligase complex; Biological process=protein amino acid phosphorylation
  Homolog annotation: Hit_ID=Q1PF03; Match level="QueryCoverage=98%, HitCoverage=66%, E-value=1e-106, Identity=44%"; Hit description =Protein kinase family protein
  Pfam annotation: Domain name=Usp; Domain location=17-169; Score=43.2; E_value=8.7e-10; Accession=PF00582.16; Description=Universal stress protein family
MWLPNPKASGIRKGGGGNGLVAVAIDKNKGSQYALKWAVDCLLTRGQTVILIHVLHGTSSPVSRGKEVIICNISNSSASPGSYQLDNTIKDLFLTFHCYCTRKDIQCLDVLLEDTDVVKAITEYVSYAAIENLVVGATSRHGFIRFKSSSASSSISKGAPDFCTVFVISKGKVSSVRNATRPAAHTSPLLSHIHDLISQVQTQPAEISSRRMNLRDRTSIKPHSQADESFKSPFVRGRGMGGMSCVDFPESDTDISFVSSERPSSGRSSSVYDYIDTGRTSRLSTNSDHSFGSTRLGLKFNPYSPDTSFSHESCTTSFSYSSQSVDEVVEADMRRLKLELTQRMEMYSTACREAYISQQKFMELTHQRLEEEKKIDEARLAQEAAMAIAEKEKARCRAAMETAEASKKIAEVETHRRASVEVKALKEAEEMRKLLENLAQTDVRYRRYCIEEIETATNFFSESQRIGEGGYGLVYKCYLDHTPVAVKVLRPDAAQGKSQFQQEVINQWT

SEQ ID NO: 206795 - protein, 629 aa, Glycine max
  Coding DNA Sequence Number=SeqID_90017
  Gene Ontology: Mol. function=protein-tyrosine kinase activity; Cellular component=integral to membrane; Biological process=protein amino acid phosphorylation
  Homolog annotation: Hit_ID=Q1S3M0; Match level="QueryCoverage=96%, HitCoverage=95%, E-value=1e-149, Identity=47%"; Hit description =Protein kinase
  Pfam annotation: Domain name=LRRNT_2; Domain location=1-47; Score =22.1; E_value=0.002; Accession=PF08263.3; Description=Leucine rich repeat N-terminal domain
  Pfam annotation: Domain name=LRR_1; Domain location=123-145; Score =17.2; E_value=0.06; Accession=PF00560.23; Description=Leucine Rich Repeat
  Pfam annotation: Domain name=LRR_1; Domain location=147-168; Score =9.8; E_value=4.1; Accession=PF00560.23; Description=Leucine Rich Repeat
  Pfam annotation: Domain name=LRR_1; Domain location=170-192; Score =16.1; E_value=0.13; Accession=PF00560.23; Description=Leucine Rich Repeat
  Pfam annotation: Domain name=LRR_1; Domain location=75-96; Score=5.5; E_value=27; Accession=PF00560.23; Description=Leucine Rich Repeat
  Pfam annotation: Domain name=LRR_1; Domain location=98-121; Score =19.9; E_value=0.0093; Accession=PF00560.23; Description=Leucine Rich Repeat
  Pfam annotation: Domain name=Pkinase; Domain location=328-599; Score =18.8; E_value=1.1e-09; Accession=PF00069.15; Description=Protein kinase domain
  Pfam annotation: Domain name=Pkinase_Tyr; Domain location=327-599; Score=12.1; E_value=3.2e-13; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=1-47::123 -145::147-168::170-192::75-96::98-121::328-599::327-599
MSSDAEALLKFRDSLRNVIALSSWDPSINRKPPCSGNIPNWVGLFCMNDKVWGLRLENMGLTGNIDVKSLGSIPALRTVSLMNNTFVGPLPDVKMLPNLKALYLSYNHFSGQIPDDAFTGLNRLRKLYMSNNEFTGQIPSSLATLPSLLILRLDSNKFQGQIPQFQRNKSLKIINLSNNDLEGPIPANLSTFDASSFSGNPGLCGPPLTNEYCQRGAPEASKMRLLKILLAVIAIALIIAIILVAVLLVICRLRSQKHHTLQGQASQNYAPPIYVKTKSLADHYAASPRLVSSSDRGGHGHSRRGEQAGKLTFLSHHQPKFDLQDLLKASAEILGSAGFGSSYKAVVLDGQAVVVKRYKHMNNVPRDEFHEHMRRLGNLNHPNLLPLLAYYYRKDEKFLLTSFVDNGCLASHLHGNRDYQRPGLDWPTRLKIVKGVARGLAHLYSSLPSVIVPHGHIKSSNVLLDESFEPLLTDYALSPVINLDHAQQIIMPYKSPEYAQLGRITKKTDVWSFGILILEILTGKFPENYLTLRHNTDSDIASWVNTMITEKRTTDVFDVEMGGIGNSKAELLKLLKIGLSCCEENVERRLDIKEALEQVEDLKETENDAIIGEYSSTLITTERNAYIAV

SEQ ID NO: 206796 - protein, 150 aa, Glycine max
  Coding DNA Sequence Number=SeqID_90018
MKGCLESLEKSESLRKEIEAEQGLQEAWLKKIEEILESLRKCGPQSKLLQWKIFRTKFELYAEPIFPKCLGIGSLSIFFLKGHKLFGKSFGLCFMAYMGLQYRNGIVFNDAVLAFENILVRFRTLTWLKVRVRGFPCSFFEWVNSLGLYL

SEQ ID NO: 206797 - protein, 49 aa, Glycine max
  Coding DNA Sequence Number=SeqID_90019
ANEEKVFEMLLKDSLSKPDWLSEAFSLSEAASSLRECKTLENVKPENSA

SEQ ID NO: 206798 - protein, 146 aa, Glycine max
  Coding DNA Sequence Number=SeqID_90020
MENVFMQFMETSHASFKANQNSTQNLEIEVGKNYSMENCWREQELQPCNQYEDERIYNLDNLLMQLMKTSEATQHAIQNIEIQVEVESHKESLVEEYDSREKDKEKSEQRTQQQREKCSQVEIQQESILQVNTPPHQLIGKEERHG

SEQ ID NO: 206799 - protein, 259 aa, Glycine max
  Coding DNA Sequence Number=SeqID_90021
  Gene Ontology: Cellular component=membrane; Biological process =protein complex assembly
  Homolog annotation: Hit_ID=Q88RM0; Match level="QueryCoverage=99%, HitCoverage=77%, E-value=7e-74, Identity=60%"; Hit description =Membrane protein, putative
MVHRYFAGTLAMVIALLALQALRRHARDGQPYRLPLLLLGVVLAQAAFGMWTVTLKLWPQVVTAHLLGGFTTLSLLFLLSLRLSRAFAPLPKLPLSLRRIAALALLVVIGQIALGGWVSANYAAVACIDLPTCHGQWWPAADFSNGAHGHPHQPPPGCTAGDLRAADAQLEAAPLRPPWPGAAGAAGAGDASRPGHQQCAAAPAAGRGRGAQRWWGAVAVEHGAGELPHPRGRQGSRGCRPWLAPAARGWRGHLPPHEE

SEQ ID NO: 206800 - protein, 398 aa, Glycine max
  Coding DNA Sequence Number=SeqID_90022
  Gene Ontology: Mol. function=calcium ion binding; Cellular component =extracellular region; Biological process=pathogenesis
  Homolog annotation: Hit_ID=Q8XQP2; Match level="QueryCoverage=99%, HitCoverage=88%, E-value=2e-94, Identity=42%"; Hit description =Probable hemagglutinin/hemolysin-related protein
  Pfam annotation: Domain name=HYR; Domain location=111-184; Score= -6.7; E_value=0.077; Accession=PF02494.7; Description=HYR domain
PVVSGDTTDDNTPTLSGKAEPGSTVNIIDNGQVIGTAKVNPDGTWSYTPDQPLANGAHDLTTTVTDPSGNTGPEGSHVVITVDVVPGKVEITAVTDDTGSVTGSLSQNAVTDDTRPQISGTAKAGSTVTIMDGSNVLGTTTAGADGTWSFTPSVDLGRGDHTFTATAKDPMGNESSSSSWTVTIDTDAPVKPTIDAALDDVGSVQGALSNGSSTDDPTPTLSGKAEAGSTVKIYDQNGLLGEVTAKADGTWSFSPVAKLPEGEHRFHVTATDRAGNTSAASDDFVLNLEFTAPDASKVSITDVVDDFGSVTGTIASGGKTEDNTPLIKGTGAEPGNTITVYNGDKVIGTAKVQADGTWELQVTKALPDGTYNLTVKETDSVGNTTAASQEYIIQIDAG

SEQ ID NO: 206801 - protein, 263 aa, Glycine max
  Coding DNA Sequence Number=SeqID_90023
  Gene Ontology: Mol. function=galactosyltransferase activity; Cellular component=membrane; Biological process=protein amino acid glycosylation
  Homolog annotation: Hit_ID=Q10BV0; Match level="QueryCoverage=63%, HitCoverage=25%, E-value=4e-53, Identity=61%"; Hit description =Galactosyltransferase family protein, putative, expressed
  Pfam annotation: Domain name=Gal-bind_lectin; Domain location=153 -261; Score=-2.2; E_value=0.0017; Accession=PF00337.12; Description =Galactoside-binding lectin
MKRGSSTSSKVEPFVLPNRLTLLQIFMVVMLLYLLFMSFEIPLAFRAENGVVFLTDALPMPMPLMLEESRNSVKIRAPTGLKLEKVSTLRFNESFTEGSELHKVARHAWVAGEKLWGEVESGKVKSFAKIKVKNGSDSCPNSVSVAGTEFRDKGVLVLPCGLTLWSHVTVVGTPRWAHAESDPKIAVVRDGGEAVMVSQFMMELQGLKAVDKEEPPRILHFNPRLRGDWSGKPVIEQNTCYRMQWGSAIRCDGWKSRADEETG

SEQ ID NO: 206802 - protein, 240 aa, Glycine max
  Coding DNA Sequence Number=SeqID_90024
  Gene Ontology: Mol. function=galactosyltransferase activity; Cellular component=membrane; Biological process=protein amino acid glycosylation
  Homolog annotation: Hit_ID=Q10BV0; Match level="QueryCoverage=98%, HitCoverage=36%, E-value=1e-102, Identity=71%"; Hit description =Galactosyltransferase family protein, putative, expressed
  Pfam annotation: Domain name=Gal-bind_lectin; Domain location=2-65; Score=-18.0; E_value=0.025; Accession=PF00337.12; Description =Galactoside-binding lectin
  Pfam annotation: Domain name=Galactosyl_T; Domain location=111-240; Score=-66.5; E_value=0.043; Accession=PF01762.12; Description =Galactosyltransferase
  Pfam module annotation: Pfam domain module=Gal-bind_lectin::Galactosyl _T; Domain location=2-65::111-240
MMVDWPYPFAEGKLFVLTISAGLEGYHVSVDGRHVTSFPYRTGFALEDATGLSINGDVDVHSIFAASLPTSHPSFAPQMHLELLPQWKAPPLQNVNVELFIGILSAGNHFAERMAVRKSWMQHKLIQSSRVVARFFVALHARKDINVDIKKEAEYFGDIIIVPYMDHYDLVVLKTIAICEYGIRTMTSKYIMKCDDDTFVRVDSILNEARQVRSRSLYMGNMNYHHRPLRHGKWAVTYEV

SEQ ID NO: 206803 - protein, 72 aa, Glycine max
  Coding DNA Sequence Number=SeqID_90025
  Gene Ontology: Mol. function=galactosyltransferase activity; Cellular component=membrane; Biological process=protein amino acid glycosylation
  Homolog annotation: Hit_ID=Q10BV0; Match level="QueryCoverage=97%, HitCoverage=10%, E-value=3e-28, Identity=74%"; Hit description =Galactosyltransferase family protein, putative, expressed
MVQLFKMEDVSMGMWVEHFNSTRPVEYMHNLKFCQFGCIEEYYTAHYQSPRQMTCMWEKLQHQGKSLCCNMR

SEQ ID NO: 206804 - protein, 232 aa, Glycine max
  Coding DNA Sequence Number=SeqID_90026
  Gene Ontology: Mol. function=glutathione transferase activity; Cellular component=cytoplasm; Biological process=metabolic process
  Homolog annotation: Hit_ID=Q9FQF3; Match level="QueryCoverage=95%, HitCoverage=94%, E-value=1e-90, Identity=74%"; Hit description =Glutathione S-transferase GST 5
  Pfam annotation: Domain name=GST_C; Domain location=99-203; Score =27.6; E_value=4.4e-05; Accession=PF00043.15; Description=Glutathione S-transferase, C-terminal domain
  Pfam annotation: Domain name=GST_N; Domain location=4-77; Score=67.5; E_value=4.2e-17; Accession=PF02798.10; Description=Glutathione S -transferase, N-terminal domain
  Pfam module annotation: Pfam domain module=GST_C::GST_N; Domain location=99-203::4-77
MAQRDLRLLGAWFSPFVLRVQIALNLKGLDYEVVEETLNPKSELLLKSNPVHKKIPVFFHGDKVICESAIIVEYIDEVWSNNALSILPQNAYDRANARFWVSYIDDKWVTSLKSVLLAGDDDEAKKSHFVEMEEALERMEEVFNKCSEGKTYFGGDTIGIVDIVFGSLWSWMRVIEEMNGRKVFDEAKNPSLAKWAETFSADAAVKGVLPETHKLVEYAESLKKRWAAAAAK

SEQ ID NO: 206805 - protein, 242 aa, Glycine max
  Coding DNA Sequence Number=SeqID_90027
  Homolog annotation: Hit_ID=Q9FGR6; Match level="QueryCoverage=89%, HitCoverage=65%, E-value=3e-17, Identity=30%"; Hit description =Arabidopsis thaliana genomic DNA, chromosome 5, TAC clone:K6A12
MDFTNPSLLLSIFLLLLPSLISSQICQRNCGKETLKYPFGSGPGCGDPRFQPHVTCSNQKLTFTTHTGSYPITSIDYTNQIIHISDPTMSTCSCTVPSKGFGLNWDAPFTFADSTIFALVDCSMNSSSICQSNGYDDGSNSNSKLLCDQETPICSLLYSCRPISTTINLPISTCCVYTPVNLGPAFEMDLQKLQCPSYTGFYNFNDQEMDPEKWNYGIALKYKFSVTNDYPGSCDACERSHG

SEQ ID NO: 206806 - protein, 88 aa, Glycine max
  Coding DNA Sequence Number=SeqID_90028
  Gene Ontology: Mol. function=glutathione transferase activity; Cellular component=cytoplasm; Biological process=metabolic process
  Homolog annotation: Hit_ID=Q9FQF3; Match level="QueryCoverage=94%, HitCoverage=35%, E-value=2e-36, Identity=89%"; Hit description =Glutathione S-transferase GST 5
  Pfam annotation: Domain name=GST_N; Domain location=4-77; Score=66.0; E_value=1.2e-16; Accession=PF02798.10; Description=Glutathione S -transferase, N-terminal domain
MAKNDLWLLGAWFSPFALRVQIALNLKGLDYEVVEETLNPKSELLLKSNPVHKKIPVFFHGDKVICESAIIVEYIDEVWFNNAPSLLP

SEQ ID NO: 206807 - protein, 225 aa, Glycine max
  Coding DNA Sequence Number=SeqID_90029
  Gene Ontology: Mol. function=glutathione transferase activity; Cellular component=cytoplasm; Biological process=metabolic process
  Homolog annotation: Hit_ID=Q9FQF3; Match level="QueryCoverage=52%, HitCoverage=50%, E-value=3e-47, Identity=81%"; Hit description =Glutathione S-transferase GST 5
  Pfam annotation: Domain name=GST_N; Domain location=4-77; Score=68.6; E_value=2e-17; Accession=PF02798.10; Description=Glutathione S -transferase, N-terminal domain
MAERDLRLLGAWFSPFALRVQIALNLKGLDYEVVEETLNPKSELLLKSNPVHKKIPVFFHGDKVICESAIIVEYIDEVWSNNALSILPQNAYDRANARFWVSYIDDKLKTKHTVSKASDTEASTGVITGNHTEKVLDPRSPGSVLLTFWCSRAMSDPLHSTTSTKKLEDAILKLTSLNLTLGESIHSMNLRFDASCNDYLPLPHYHLRLSPLCPFLPPHLSPTTE

SEQ ID NO: 206808 - protein, 94 aa, Glycine max
  Coding DNA Sequence Number=SeqID_90030
MGVAVRAHVDRDGRSVIPEDHNVIENTRTLFPEYLIELGWQQQVGDGLMISFQLHQLTRIEELHAQAVIVSEYWSKRLEPLNTKHDIGIGDGRM

SEQ ID NO: 206809 - protein, 331 aa, Glycine max
  Coding DNA Sequence Number=SeqID_90031
  Gene Ontology: Mol. function=RNA-directed DNA polymerase activity; Cellular component=chromatin; Biological process=chromatin assembly or disassembly
MMLQKGLIQPSTSPFSSPVLLVRKNDGSWQFCMDYRALNALTVRDHFPIPTIDELLDELGHARWFLELDLLQGYHRIRMHAGDIPKTAFRTHHGHYEFKVMSFGLWNASSSFQATMNQIFRPFLWRFIIVFFDDILIYSASFHEHLQHLETTFQSQVEYWGHIVSQGGVASVAAKIGIIDQWRTPQTTRALRSFLGLAGFYRRFIQGYATIAAPLVKATTTEPLKWSAEAQSAFDQLKRVLSQAPVLPNFQLPFTMETDASGVGMGAVLSQQGHPIAFFSKPFTPKLLRASTYVRELFAITATVKKWKQYLLGQRITILTDHRSLKELLTQ

SEQ ID NO: 206810 - protein, 75 aa, Glycine max
  Coding DNA Sequence Number=SeqID_90032
MVLACHRVRRLWMTKGKSVGPNGSRMSSDPPPLDDKGKSAGSNGSRMSLGSPPLDDKRAQNDHNLSLRAIGHDCV

SEQ ID NO: 206811 - protein, 334 aa, Glycine max
  Coding DNA Sequence Number=SeqID_90033
  Gene Ontology: Mol. function=transcription factor activity; Biological process=regulation of transcription, DNA-dependent
  Homolog annotation: Hit_ID=Q6YUW7; Match level="QueryCoverage=98%, HitCoverage=48%, E-value=9e-58, Identity=46%"; Hit description =Chromosome structural maintenance protein-like
  Pfam annotation: Domain name=RINT1_TIP1; Domain location=1-334; Score= -34.1; E_value=1.9e-07; Accession=PF04437.4; Description=RINT-1  TIP -1 family
MVTSLTTYLAKEIFPSYISQLDEERVTGIQSSARVLWLHVIDLMIAFDKRIKSLVDHSGITSLMIYNAFLCHLASVIDRCRSLPSVFLRSKFLRFASICIIRNFFDSILIHCQEAEGLTALTDDDVVIKVTISINVAHYFESVLKEWSKDVFFLEMGMDEDDKIEMESNSNSYGEFLPESSKRVIFYDEIKKLEEYRTQWVEKIYLVILRGFDCHSRDYVKNKRQWQKGIEGWIVSKTLIEALDYLQSKMSVVEVSLDGGDFVGVWRSLAAGIDRFIFNGILISNVKFHNFGVEKFGSELEVLFGIFRAWCLRPEGFFFPKSSLNRGVKMRLQQ

SEQ ID NO: 206812 - protein, 137 aa, Glycine max
  Coding DNA Sequence Number=SeqID_90034
  Subcellular localization annotation: CTP_CleavageSite=50; ConfidenceScore=5.23e-01
MYKDKWAHTKPMGPKSTLRLMRTLGPSLASLAQSSWSLLSNALGGIQSCSCTTAEVGGTEEEAGDSHAPRRRRQEILAQLEDHVLQEGFTFCAPSTIEFMQSESHGAVTTENDVELVTEVGDAGGQGKRKRKKLKGL

SEQ ID NO: 206813 - protein, 70 aa, Glycine max
  Coding DNA Sequence Number=SeqID_90035
MAILLGLNLRNQGGERGAVGEIRITSFVPVELDSGLEELFEEAEDVGLAGGGLVGVGGGVVVGGSAVVEE

SEQ ID NO: 206814 - protein, 522 aa, Glycine max
  Coding DNA Sequence Number=SeqID_90036
  Gene Ontology: Mol. function=binding
  Homolog annotation: Hit_ID=Q6AVK0; Match level="QueryCoverage=69%, HitCoverage=86%, E-value=1e-120, Identity=56%"; Hit description =Expressed protein, having alternative splicing products
MAEGVKLEDRWGYYVATSSQACVSAINSYYHQVLIYGRERSVILEAVAHDKHCVLANILAAHFLHSSGSSRALTCLHAAKSNLEHATLYEKLVFDAISYMLSEDRDDDVAVELHSKDDVPTYTEGGSARILHWLYSNAQEVHPLGHWIVDRVGAIRLGSSRDLLVQISFLLLKEFPRDLVSLKRAQVICFYMGLPGLSLSLIQKVLPHNEGENFIYGMLAFPLLELGRMEEAEKAAKRGFEINKQDSWAQHALCHVLQYKCCFREAVKFMEECSSSWGSSSFMLTHNWWHVALCYLEGNAPRQRVLEIYDNYIWKELDRNDSMSAEVYLNAAGLLLRLYVRGELDIIGDRLKMLAECLTNQENWYMEWHFDVLIVWTLAKTGEISKAEDLLKGLKNRFLRMTKKKQQRMQRGMMLAEALYAYGIADDRRGLELLDPDFDATDYKIIGASDEQVDVFNEVWYNMLLNIGNALKAIEVLEKQIKKRDGVPYLWRLLERAYKLANKPEERIANEKATALESRYFN

SEQ ID NO: 206815 - protein, 486 aa, Glycine max
  Coding DNA Sequence Number=SeqID_90037
  Gene Ontology: Mol. function=RNA-directed DNA polymerase activity; Cellular component=chromatin; Biological process=chromatin assembly or disassembly
  Pfam annotation: Domain name=GST_C; Domain location=333-456; Score =23.7; E_value=0.00066; Accession=PF00043.15; Description=Glutathione S-transferase, C-terminal domain
  Pfam annotation: Domain name=rve; Domain location=72-228; Score=96.9; E_value=6.2e-26; Accession=PF00665.16; Description=Integrase core domain
  Pfam annotation: Domain name=zf-H2C2; Domain location=13-54; Score =8.0; E_value=0.032; Accession=PF09337.1; Description=His(2)-Cys(2) zinc finger
  Pfam module annotation: Pfam domain module=GST_C::rve::zf-H2C2; Domain location=333-456::72-228::13-54
GLPIILTLLTEYHSTPTGGPTGIAKTLARLSENFYWSSMRVDVTQFVTTCIDCQHTKYETKRIVGLLCPLLVPHRPWENLSLDFITSLPPYHGHTVILVVVDRFSKGIHLGMLTPSHTAHTVACLFIEIVAKLHGIPRSLVSDCDPLFVSNFWQELFRLSGTKLQMSSAYHPQSDGQTEVLNRVIEQYLRAFVHRRPGTWGKLLSWIEWSHNTSWNVGTSTTPYEIMFGRKPCTIPDYITDISDIAVFETMLTDREDTFKYIRKKLLKAQGLMKHHADTRRRDVEYQSALVKLLTDSNFWQERAYIQFFNEVLVQWQGLPLDDTSWEDWSTFFQDYHLEDKVLLQGSWSVSKASDTEASTRWLTSLKSVLATEDDEAKKLHFEQAEEVLEKVEEVFNKCSEGKAYFGGDTIGFVDIGFGSFLSFIRVSENMNERKLLDETKHPGLTLWAETFAADPAVKGLLPETEKLVEFAKILQLKWAAAAAAK

SEQ ID NO: 206816 - protein, 83 aa, Glycine max
  Coding DNA Sequence Number=SeqID_90038
MEGRCGEEEEGEENDGEDGWRHGLGREDSSMNGRGGGMRESNLGEQYCICTQNSHELCFGTNPNKNLERGNWCAPLPLVGPSS

SEQ ID NO: 206817 - protein, 59 aa, Glycine max
  Coding DNA Sequence Number=SeqID_90039
MGRGSQQWRLWGITRLDARGELRVGGKRYEGGIMGIDDHSHEVLGTYVGAWECIIASSS

SEQ ID NO: 206818 - protein, 489 aa, Glycine max
  Coding DNA Sequence Number=SeqID_90040
  Gene Ontology: Mol. function=transmembrane receptor activity; Cellular component=membrane; Biological process=defense response
  Homolog annotation: Hit_ID=Q1SWT3; Match level="QueryCoverage=97%, HitCoverage=89%, E-value=2e-89, Identity=67%"; Hit description=TIR
  Pfam annotation: Domain name=TIR; Domain location=20-152; Score =149.2; E_value=1.1e-41; Accession=PF01582.10; Description=TIR domain
  Pfam annotation: Domain name=TIR; Domain location=251-383; Score =157.2; E_value=4.3e-44; Accession=PF01582.10; Description=TIR domain
  Pfam module annotation: Pfam domain module=TIR::TIR; Domain location =20-152::251-383
  Subcellular localization annotation: CTP_CleavageSite=6; ConfidenceScore=5.06e-01
MAWSSSSSSTSNTPPQKHEVFISFRSEDTRKTFTSHLNAALERLDIKTYLDNNNLDRGEEIPTTLVRAIEEAKLSVIVFSKNYADSKWCLDELLKILEFGRAKTLIIMPVFYDIDPSDVRNQRGTYAEAFDKHERYFQEKKKLQEWRKGLVEAANYSGWDCDVNRTESEIVEEIAKDVLEKLNRANVSDLDRQITKYEQLAQLQHQYFMCIPSLENCQNHRATVQRITELKMERRSSSSSTSNTTPQKHEVFVSFRTEDTGKTFTSHLSGALERVDIKTYVDNNNLERGEEIPTTLVRAIEEAKLSIIVFSKNYAASKWCLDELLKILECGRAKRQIIVPVFYDIDPSDVRSQRGTYAEAFAKHERNFNEKKKVLEWKNGLVEAANYAGWDCKVNRTEFEIVEEIVKDALEKLDRANVSDLDRHINKMEQLARLQHQFYEDIRTYENMLKRDATVQRVTELKMERSIRLLRLTPDMLSHLGNSSTNDFF

SEQ ID NO: 206819 - protein, 140 aa, Glycine max
  Coding DNA Sequence Number=SeqID_90041
  Homolog annotation: Hit_ID=Q1SWT6; Match level="QueryCoverage=86%, HitCoverage=45%, E-value=2e-43, Identity=64%"; Hit description =Putative small multi-drug export
  Pfam annotation: Domain name=Sm_multidrug_ex; Domain location=61-138; Score=36.4; E_value=3.5e-08; Accession=PF06695.2; Description =Putative small multi-drug export prot
ASSSSDECFDPADEAQRDANAAVESSIKASGFSLNIANWLRKFGLPDWVGVFTLATLPVLEFRGAIPVGYWMQLNPVTLTVLSILGIPSASQFLDMLFENAKEKAGPAEEFQWLGLMLFVAVPFPGTGAWTGWSLYSIHS

SEQ ID NO: 206820 - protein, 165 aa, Glycine max
  Coding DNA Sequence Number=SeqID_90042
MMSNYKDVKEALLGGNLMDPKKLASKRARKTTAREGSSIAPTIQFEFDGHCFHSEEHQHRFEVIKDWSFLKERMELRANAWPTKEGVMDKRSKVRGQWIPYDTDAIIQFLGNPLILEEGQQCEYIARRGQTTGFDEEAIGQILCFLGRDFVWSTEFHYFHNFVIP

SEQ ID NO: 206821 - protein, 79 aa, Glycine max
  Coding DNA Sequence Number=SeqID_90043
  Subcellular localization annotation: CTP_CleavageSite=33; ConfidenceScore=5.49e-01
MLALNHSLRQTQPHQSGAYVKQSVPQTPFCFVSLAAIKSVCSCASKIPRWQLQGFKRLQQFEKQLLENGVFLVLMTRKA

SEQ ID NO: 206822 - protein, 93 aa, Glycine max
  Coding DNA Sequence Number=SeqID_90044
  Homolog annotation: Hit_ID=Q10FT7; Match level="QueryCoverage=64%, HitCoverage=24%, E-value=2e-08, Identity=38%"; Hit description =Hsp20/alpha crystallin family protein, expressed
MQTRNCLLDKKTGFPRENVKIIGERPLQGNRWNRMDQSYPIPDYCEPQALQGKFEIPILTLTMPKKTTSQVAPKQQELGTSQENGEAKPTENV

SEQ ID NO: 206823 - protein, 521 aa, Glycine max
  Coding DNA Sequence Number=SeqID_90045
  Gene Ontology: Mol. function=oxidoreductase activity; Cellular component=intrinsic to endoplasmic reticulum membrane; Biological process=electron transport
  Homolog annotation: Hit_ID=Q69NJ7; Match level="QueryCoverage=98%, HitCoverage=99%, E-value=1e-151, Identity=48%"; Hit description =Flavin containing monooxygenase 3-like
  Pfam annotation: Domain name=FMO-like; Domain location=2-511; Score= -298.7; E_value=4.2e-10; Accession=PF00743.9; Description=Flavin -binding monooxygenase-like
  Pfam annotation: Domain name=Pyr_redox_2; Domain location=4-372; Score=-31.3; E_value=0.024; Accession=PF07992.4; Description =Pyridine nucleotide-disulphide oxidor
  Pfam module annotation: Pfam domain module=FMO-like::Pyr_redox_2; Domain location=2-511::4-372
MERRVAIIGAGTSGLVACKYLLEFGFNPIVFEVEDGVGGLWRHTIESTKLQNKKQMYQFLDFAWPSSVKEDNPSHEQVLDYLNSYAEHFSLIPYIRFNSKVIDIDYVGGESSEEMKSWELWGGNGRPFCSKGTWHIALQHTKNLSIEVYKAEFVILCVGKYSGFPNIPEFPPGKGPEVFNGRVMHYMDYSNLDNETAAELIKGKRVTIIGSQKSGLDLAAQCSNANGVTYPCTIIQRTAHWFLPDFDTWGVIVGFLFLNRFAELLIHKPGEPFLLGLVATLLSPLRWGISKLVETILKWKLPLKKYGLVPNHNFLQDLSTCLLSLLPDNFFDKLKEGSILIKKSQSFSFSREGVIIDGEAKVLETDVVIFATGYKGDQKIKNMFKSPIFQNYIIGPTISTVPLYRQVIHPRIPQLAMVGYAEGISNIFASEMKSMWLVHFLDGNIGLPSIREMEKDVKLWEDNMKQYGGRYYWKSCIANCCIWYQDQLCKDMKHNPRRKKSLFAELFEPYSLADYVGLTRN

SEQ ID NO: 206824 - protein, 84 aa, Glycine max
  Coding DNA Sequence Number=SeqID_90046
  Subcellular localization annotation: CTP_CleavageSite=48; ConfidenceScore=5.29e-01
MVDLQLAQATCFFNLKQPCSPRQAGYFTPKLFGGPSEPEASLGKPGVRKSSKMTFLPSHLSIYRMFCRNVKKPFVLHDNWCQAA

SEQ ID NO: 206825 - protein, 256 aa, Glycine max
  Coding DNA Sequence Number=SeqID_90047
  Homolog annotation: Hit_ID=Q42150; Match level="QueryCoverage=31%, HitCoverage=10%, E-value=3e-17, Identity=55%"; Hit description=Beta -galactosidase like protein
MEIVIFEVLDHIPPLHGVRIGILQAMLIFNNSTQISNCRGNLTGKAQILRRGIGDWRAQPIFVVAVVVPWRWSRWPLTIKDERSCTEAIRDWDRDAKYNPLYFVGFRILCGCTKIFFFFLRMLVGAFMMINVCRIAIYLIGLFGSTHQGTISVLNRHHDGWLIVGMMKSERLYESQGGPILLSQHRVNLLGLVGQNYVNWAAKMVMEMGTGVPWVMFKEDDAPDPVVSTLILPHSYVLNKDYAQQQQIHFNHRFLN

SEQ ID NO: 206826 - protein, 178 aa, Glycine max
  Coding DNA Sequence Number=SeqID_90048
  Gene Ontology: Mol. function=dimethylaniline monooxygenase (N-oxide -forming) activity; Cellular component=intrinsic to endoplasmic reticulum membrane; Biological process=electron transport
  Homolog annotation: Hit_ID=Q69NJ7; Match level="QueryCoverage=97%, HitCoverage=60%, E-value=3e-19, Identity=42%"; Hit description =Flavin containing monooxygenase 3-like
MESTKLQNTKPTYQFIDFPWPSSVKEHNPSHNQVLDYLNSYAEHFPLIPYIRFNSNVIDIDYAGESSEEMKSWELWGGNGRPFCSKGTWHIAMQDTKNLSIERSGISKLVETILKWKLSLKKYGLVPNHSFLQDLFTCLLGVFPDNFFDKLKEGSILMKKSQSFSLCREGVIIDGESP

SEQ ID NO: 206827 - protein, 544 aa, Glycine max
  Coding DNA Sequence Number=SeqID_90049
  Gene Ontology: Mol. function=nucleic acid binding; Cellular component= beta-galactosidase complex; Biological process=DNA integration
  Pfam annotation: Domain name=zf-CCHC; Domain location=246-263; Score =9.3; E_value=0.029; Accession=PF00098.13; Description=Zinc knuckle
  Pfam annotation: Domain name=zf-CCHC; Domain location=282-299; Score =12.8; E_value=0.0078; Accession=PF00098.13; Description=Zinc knuckle
  Pfam module annotation: Pfam domain module=Retrotrans_gag::zf -CCHC::zf-CCHC; Domain location=77-192::246-263::282-299
MNEASINNAESYLYLHPSESPTIALVSPVLDSINYHSWSRSMVTALSAKNKVEFIDESAPEPLKMDRTYGAWRRCNNMVVSWIVHSVATSIRQSILWMDKAEEIWRDLKSRYSQGDLLRISDLQQEASTMKQGSLSVTEYFTCLRVIWDEIENFRPDSICSCNIRCSCNAFTIIAQRKLEDRAMQFLRGLNDQYTNIRSHVLLMDPIPAISKIFSYVAQQERQLLGNTGPSINFEPKDISINAAKTICDFCGRVGHVESVCYKKHGAPATYDGRNKNNNGRKTCTHCGKIGHTVDVCYRKHGYPPGYKSYGGRTTVNNVVAVEGRATDDHAQQHESQEVVHFSPEQYKALLALIQQPQAGNTAPNQPKQETNNHMKIGIVEAKHGLYHLIPTKAVNSIITHPQCNIIPIDLWHFRMGHPSVERLQCMKNYYPLLRNDKKFVCNTCHYAKHKRMPFSSSKSHASHPFDLLHMDIWGPCSKLSMHGHKYFLTIVDDHSRFTWIYLMKSKAETRHIITNFIAFIETQYNGKIKIIRSDNGIEFFMHD

SEQ ID NO: 206828 - protein, 163 aa, Glycine max
  Coding DNA Sequence Number=SeqID_90050
  Gene Ontology: Mol. function=transmembrane receptor activity; Cellular component=membrane; Biological process=defense response
  Homolog annotation: Hit_ID=Q1SWT3; Match level="QueryCoverage=88%, HitCoverage=52%, E-value=1e-60, Identity=76%"; Hit description=TIR
  Pfam annotation: Domain name=TIR; Domain location=18-149; Score =150.8; E_value=3.6e-42; Accession=PF01582.10; Description=TIR domain
MECSSSSSSSTTSQKHEVFINFRSEDTRKTFTSHLNGALERVDIKTYVDNNNLERGEEIPITLVRAIEEAKLSVIVFSKNYADSKWCLDELLKILECGRTKRHIIVPVFYDIDPSDVRNQRGSYAEAFVNHERNFDEKKVLEWRNGLVEAANYAGWDCYNKVT

SEQ ID NO: 206829 - protein, 113 aa, Glycine max
  Coding DNA Sequence Number=SeqID_90051
  Gene Ontology: Mol. function=DNA binding; Biological process=DNA integration
  Homolog annotation: Hit_ID=Q2HRM8; Match level="QueryCoverage=88%, HitCoverage=10%, E-value=9e-24, Identity=61%"; Hit description =Polynucleotidyl transferase, Ribonuclease H fold
MDVYHSQLGTKVLEDGWGQSFSENIRELQRGRNWKKLDETRSDFVTNKMAIDLNMLDPEEDMSAIVSHRWWMQEPDTQPRRSCGRQWIASLTAMKQVKSLTVEAFDVDEAKFL

SEQ ID NO: 206830 - protein, 103 aa, Glycine max
  Coding DNA Sequence Number=SeqID_90052
MDRDFDGSECRYAKSVSSVLWFGRWLWTGWGEVEGDWMQNPIVCLGCRNYEKAPTLQERLEFCSVIIDVNDWFVETSGAGCYVDGVWKGYVLVTYGLFWNSKQ

SEQ ID NO: 206831 - protein, 309 aa, Glycine max
  Coding DNA Sequence Number=SeqID_90053
  Gene Ontology: Mol. function=protein dimerization activity; Cellular component=chromatin; Biological process=DNA integration
  Homolog annotation: Hit_ID=Q1S735; Match level="QueryCoverage=96%, HitCoverage=68%, E-value=2e-95, Identity=49%"; Hit description =Probable transposase [imported]-Arabidopsis thaliana-related
  Pfam annotation: Domain name=DUF659; Domain location=101-207; Score =45.6; E_value=4.7e-11; Accession=PF04937.6; Description=Protein of unknown function (DUF 659)
MYEDPVRIVEELRGIQKPISSKSQKGKNTPHVDDHFMPRTIPEAQPNLKSVLQNMQIVEKCDKAIAKWMIDALVPFNVVSSAYYQPMIDAISSISLGYKAPNFYRICDPLLNMWVDDVRNLIESYKEVWKETGCTLMANGWTDRSRRTLINFLIYCLKGTVFLRLLEKEFPKLYLSSCAAHCINLMLQDFGKFEEVCEIVLHASKITKYIYNHCYALFLMRHHTGGRDILHPAPTQFATNFIALQIILAQKNALMAMVTSKDWIGSTYAKYSKAKKFVEQILDSGFWKQCANIVKLTKSLVIHKAREEM

SEQ ID NO: 206832 - protein, 229 aa, Glycine max
  Coding DNA Sequence Number=SeqID_90054
  Gene Ontology: Mol. function=nucleoside-triphosphatase activity; Cellular component=nucleus; Biological process=RNA-mediated posttranscriptional gene silencing
  Homolog annotation: Hit_ID=O82303; Match level="QueryCoverage=96%, HitCoverage=26%, E-value=6e-85, Identity=57%"; Hit description =Putative pre-mRNA splicing factor RNA helicase
  Pfam annotation: Domain name=DUF1605; Domain location=104-204; Score =123.3; E_value=6.7e-34; Accession=PF07717.6; Description=Domain of unknown function (DUF1605)
MGDNTVPEIQRTNLANVGLTLKSLGIDNVMQFDFMDPPPDEALLKAHELLYALSSLNKFVASEKYKCSDDIISIAAMLSVGKSIFYRPKDKQVRSMRQTRDIRDQLAGLLERVEIELTSNSSDVDAIKKSITSGFFPHSARLQKFGLYKTIKHLQNVRIHPGSGLAQVLPRWVVYHELVLTTKEYMRQVTEINPEWLVEIAPHYYQLKDVEDSYSKKMPRGAGRAYLDR

SEQ ID NO: 206833 - protein, 238 aa, Glycine max
  Coding DNA Sequence Number=SeqID_90055
  Gene Ontology: Mol. function=nucleic acid binding; Biological process= DNA integration
  Pfam annotation: Domain name=rve; Domain location=62-215; Score=62.3; E_value=1.6e-15; Accession=PF00665.16; Description=Integrase core domain
MACMGNEISEDNRWYQDIGASNHMCRKKSMFMELDESMSSNVAFGDESKKFKKSFPKESSSKAKKPLELIHTDVCGLIKPSSLEKHGYILKHKSEVFENFKKFKAFVEKENGLKIEAMPSDHGGELTSNEFQKYCRDHGIRRLLTVLRSLQQNAVVERKNKKILDMARSMLKSKRLKKQSCMNNSRFQDKNQEESLESRIKIHGSRSQESRSRFKTQDSRIKRRLNQDKYEKVFSKIE

SEQ ID NO: 206834 - protein, 355 aa, Glycine max
  Coding DNA Sequence Number=SeqID_90056
MDRQQVSQVHLYVLTNTTEVIPYIDAKKENVAASHPNMNMMRVLQEHNKTFINWFRKTIFANDSASKKLRLLAVGPNLNVLTWKGYDIKNYSFYTKSQDDKSTMQNSGVTVDAHSDNFSSALDNNLIQASMSYFGGKTSGIPYDFDASTLDVNEMPMFSLQMPSKNAENEDNDVYANRIDHDEGLWENTATAMATPPSSPPPSDAPSATTKRKTRKTTRLRRLTGRSLDQPRPTINVNPITGRGSDSRKEKLHSYLGVVAREKIPIVHSSWKVVPESLKNLIWDGILVSALKINCQEEVMLTVATRWRQFKSSLTTKYVYADKDSEDNHDPSAKYEHPGRVRVAGHGVTIGHYFG

SEQ ID NO: 206835 - protein, 491 aa, Glycine max
  Coding DNA Sequence Number=SeqID_90057
  Homolog annotation: Hit_ID=Q1SJP5; Match level="QueryCoverage=40%, HitCoverage=59%, E-value=3e-87, Identity=72%"; Hit description =Cyclin-like F-box; Serine/threonine protein phosphatase, BSU1
  Pfam annotation: Domain name=Kelch_1; Domain location=188-234; Score =32.5; E_value=1.5e-06; Accession=PF01344.15; Description=Kelch motif
  Pfam annotation: Domain name=Kelch_1; Domain location=236-282; Score =25.7; E_value=0.00017; Accession=PF01344.15; Description=Kelch motif
  Pfam annotation: Domain name=Kelch_2; Domain location=188-234; Score =8.5; E_value=2.9; Accession=PF07646.5; Description=Kelch motif
  Pfam annotation: Domain name=Kelch_2; Domain location=236-282; Score =15.8; E_value=0.16; Accession=PF07646.5; Description=Kelch motif
  Pfam module annotation: Pfam domain module=Kelch_1::Kelch_1::Kelch _2::Kelch_2; Domain location=188-234::236-282::188-234::236-282
MRAYNFLEVGAATLLEGDIGAKMKGQAWKVFGTDDMPYLDQLLQGSLVTSFTNFASACPYLRAITTSKHTKAGPHQLWHVLLSDKFLLTYFLFSFYMRLCFPINVPDGYHRFEGKNMEIEISGMHFVGKDFVAVGCLFKFLLGFTEEKESLAVGSEILVLDRELMDFSIWKYNLISCNWVKCKEMNSPRCLFGSGSLGSIAIVAGGTNKYGNFLELAELYDSNSGTWELLPNMHTPRTLCSGFFMDGKFYVIGGMSSPIVSLTCGEEYDLKTRNWRKIEVVDNQLYVVEHRSNMVNKYDKERNTWSELGRLPIRADSSNGWGLAFKACGEKLLVVNGQRGPEALAILRPQEIAEHHALLTLLGWPPPLFALTSLDSDARTANQVVNPLLIMQVDLKVQSCNDKGNIDNLRAVTGKLLYDNHFGDYVDSMDELLQPLVDEAELVAVATYPSAGGRRVTCGGVFQERNTRGVATNIYLRKTSEKPKKDVVCEL

SEQ ID NO: 206836 - protein, 82 aa, Glycine max
  Coding DNA Sequence Number=SeqID_90058
MMKALTSSCSKAMVETLGPFSPRVPLCVSDRPEFCFTLRSKNEKKGWNLLLLKLVRNNDLYPVHAVPPKDQLGTILSSIFRV

SEQ ID NO: 206837 - protein, 327 aa, Glycine max
  Coding DNA Sequence Number=SeqID_90059
  Homolog annotation: Hit_ID=Q8TGM6; Match level="QueryCoverage=36%, HitCoverage=97%, E-value=1e-09, Identity=43%"; Hit description =Protein TAR1
ICTDDRSARARALGFAATAAPSYSSGLGPCPDGRSFAPIPKSDERFARQYRCGPPQSSSGFARSGIVHHLSGPDRYALTRTLHRRSGSVGGATHRVDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSLFSSAY

SEQ ID NO: 206838 - protein, 99 aa, Glycine max
  Coding DNA Sequence Number=SeqID_90060
  Homolog annotation: Hit_ID=Q09JM0; Match level="QueryCoverage=50%, HitCoverage=91%, E-value=6e-07, Identity=58%"; Hit description=10 kDa putative secreted protein
MNRKLGYGAQLRANLDPTKGVGRLRQQDGGHGSRNPLRRRGGRCKTQGASPGGAVVGADLGGTGEARLIALCARTPKGNRVKFLNRDVAADGNVRESGD

SEQ ID NO: 206839 - protein, 147 aa, Glycine max
  Coding DNA Sequence Number=SeqID_90061
  Gene Ontology: Mol. function=pseudouridylate synthase activity; Biological process=tRNA processing
  Homolog annotation: Hit_ID=Q5ZBZ5; Match level="QueryCoverage=93%, HitCoverage=20%, E-value=2e-14, Identity=37%"; Hit description =Potential U2 snRNA pseudouridine synthase-like
MVVDVEDLNSGYYTIDDVILPMPGELLTYSDSNKQLVETDLDKVNKSKPMGTVKQMGAANGKNEEAFDCIRELESSNDVVKVENYSEIAGEEIKLPHDESLSGSSSQDSQIALKLSFTLPASCYATMAIRELLKTSTSVAYHKTLNQ

SEQ ID NO: 206840 - protein, 623 aa, Glycine max
  Coding DNA Sequence Number=SeqID_90062
  Gene Ontology: Mol. function=DNA binding; Cellular component=nucleus; Biological process=porphyrin biosynthetic process
  Homolog annotation: Hit_ID=Q0WU91; Match level="QueryCoverage=91%, HitCoverage=90%, E-value=1e-83, Identity=36%"; Hit description=GTL1 -like protein
MFDGAPDQFHQFIAPTRTTLPLHMSFPLHHHASSTPPPNTFLPFDPYNPSSHHHHLPSLQTNHLLHPLHPPTTIISPTPTHKHEQDKVAPINNNNDVEIQRDQRQLPDQLTDSWTNDEVLALFRIRSSMENWFPELTWDHVSRKLAEVGFKKSAEKCKEKFEDESRYFDNINNNYGKNNFRFLISELEELCQNPDPGGGGDNHNGVEKTHPLGGDNMGHHALEENKRDIEITTATKQCDDIVVEKSNISKVRKRKRRDRFEMFKGFCESVVNKMMAQQEEIHNRLLEDMLKRDQEKFAREEAWKKQELDRMNKELEIMAQEQAIAGGRHATIIEFLKKCATTTTSLSSPPSQNAKYYKTNGSNLPNCALHPQNPNDPSNEDNNLEPTPSPKMIQNHDQATLLGAENPSASDTLLQVPSSSNSSPTPGHNPSSSLNSHNNIIPLDSNSVSTYKPTSTTPMASTSENSKDDIGRRWPRDEVLALINLRCTSLSSSNNNNNNNEEKEGNNKGPLWERISQGMSELGYKRSAKRCKEKWENINKYFRKTKDNVNKKRSLNSRTCPYFHQLSCLYGQGKIVPQSDEREGKNYLNPTANSGDQVPPDHDQVQADESYQVGSAALVQYAC

SEQ ID NO: 206841 - protein, 287 aa, Glycine max
  Coding DNA Sequence Number=SeqID_90063
  Gene Ontology: Mol. function=oxidoreductase activity; Cellular component=membrane; Biological process=electron transport
  Homolog annotation: Hit_ID=O48923; Match level="QueryCoverage=99%, HitCoverage=55%, E-value=1e-131, Identity=85%"; Hit description =Cytochrome P450 71D10
  Pfam annotation: Domain name=p450; Domain location=41-287; Score= -191.2; E_value=0.029; Accession=PF00067.12; Description=Cytochrome P450
MEVHDHTSYLIYFISSIIVFALFKLVQRSDSKTSSTCCKLPPGPRTLPLIGNMHQFVGSLPVHHCLKNLADNYGPLMHLKLGEVSNIIVTSQEMAQEIMKTRDLNFSDRPNLVSSRIVSYNGSNIVFSQHGEYWRQLRKICTVELLTAKRVQSFRSIREEEVAELVKKIAATASEAEGSNIFNLTENIYSVTFGIAARAAFGKKSRYQQVFISNIDKQLKLMGGFSVADLYPSSRVLQMMGASGKLEKVHKVTDRVLQDIIDEHKNRTRSSSNEECEAVEDLVDVLL

SEQ ID NO: 206842 - protein, 52 aa, Glycine max
  Coding DNA Sequence Number=SeqID_90064
MALSEGKVKCNVDATFFKETNPMCIGVCLRDHQGFELLPPRSPAGFSIDGSY

SEQ ID NO: 206843 - protein, 183 aa, Glycine max
  Coding DNA Sequence Number=SeqID_90065
  Gene Ontology: Mol. function=pseudouridylate synthase activity; Cellular component=nucleus; Biological process=tRNA processing
  Homolog annotation: Hit_ID=Q5ZBZ5; Match level="QueryCoverage=100%, HitCoverage=28%, E-value=4e-52, Identity=54%"; Hit description =Potential U2 snRNA pseudouridine synthase-like
MHNFFKENFKFLVTDVVDGPDASSKCIRVRLNSAEPNNKGKNSKKRKERGDKPFDSRGSENWPKNVGKFLRFHLYKENKDTHEALGVIGNMLSVQPKSFGFAGTKDKRAVTTQRVTVYKQRASRLASLNKRLFGIKLGDFCFIFVSIALTYFLRGIVADSEDIIKASADALGRHGFINYFGLQ

SEQ ID NO: 206844 - protein, 133 aa, Glycine max
  Coding DNA Sequence Number=SeqID_90066
EEIYPQEEGQPLVVKEKCKEALARIATPLGLEFIPQVKKLLDEGLVHKSLNPCALLVPKIGVPMNPKRIKVIPEWPSPPTPLIELVRNHVPSWEDAQEMGVEGRSPEYEEPRDLRSNPFQGGGNDAILSCKGI

SEQ ID NO: 206845 - protein, 70 aa, Glycine max
  Coding DNA Sequence Number=SeqID_90067
MENNVPVLMYKLEQIFPASFFDSMEHLRVRLPYETRLGGPVQYHWMYPFESIYENFLREMNPTTSDAQLN

SEQ ID NO: 206846 - protein, 142 aa, Glycine max
  Coding DNA Sequence Number=SeqID_90068
MHYEDHIVSAGEVCVVPGACSSDYIDWFFRISHPFMTPGHTVDPLPHGHAPQPRVVPQAPQTDIPRVPEPEASSTSTEEPRHAVEVCDDIAERLERHLSLGVVTPGSSTHEVIEECLRLARSVTQDHLVYVRCRRRRHTDQA

SEQ ID NO: 206847 - protein, 156 aa, Glycine max
  Coding DNA Sequence Number=SeqID_90069
  Gene Ontology: Mol. function=chitin binding; Cellular component =extracellular region; Biological process=chitin metabolic process
  Homolog annotation: Hit_ID=UPI000065F7CF; Match level="QueryCoverage =94%, HitCoverage=17%, E-value=2e-07, Identity=29%"; Hit description =Homolog of Homo sapiens "Leucine-rich repeats and IQ motif containing 1
HHQRSSRPHLQRTTRPHLERTTCPHHQRAARPHLQRTTRPRLERATRPRPRLGGLHVLAFKGSCTFNFRGLHVLAVKGSCAFTFVGLHALTFRGLHVLTFRGLHVLAIRGLHVPHFQRGACPHLQRIARPCHHRTTLPRLRKATRPELHKATRPRL

SEQ ID NO: 206848 - protein, 74 aa, Glycine max
  Coding DNA Sequence Number=SeqID_90070
DCARKTPSGPEEGQQGRGVASSKYGSLSVLGSACRPQQSHQAPIPIELSSRSTVPPGRRRAKHHSSIGMASSGQ

SEQ ID NO: 206849 - protein, 345 aa, Glycine max
  Coding DNA Sequence Number=SeqID_90071
  Gene Ontology: Mol. function=transferase activity; Cellular component= thylakoid; Biological process=photosynthesis
  Homolog annotation: Hit_ID=Q9FSF7; Match level="QueryCoverage=51%, HitCoverage=87%, E-value=2e-70, Identity=72%"; Hit description=O -linked GlcNAc transferase like
MVTKSEETQLSRLENQVDNGGGGAWEYLCLVRKLKVRRSEKVLKHGLSILNDPKHRSSLGSDEWTLYEQVAVAAMDCQCLDVAKDCTKVLQKRFPESKRVVTVMFTCSITQVIACPTLIVDAQFLFSWNKHLDWWMTDLDDLHSILSGGMLCRLEAMLLEAKGSWELAEKAYTSLLEDNPLDQAIHKRRVAMAKAQGKISVAIDWLNKYLETCLYFLPFRPPVRYKQAAFCYEELILSQPTVPLYHLAYADVLYTLGGLENLQTAKKYYSSTIDLTGGKNTRALFGICLCTSAVTQLTKGKSKEDKEGSQLQSLAAKVLEKDYKQRAPDKLPQLTTALKSLTLSS

SEQ ID NO: 206850 - protein, 67 aa, Glycine max
  Coding DNA Sequence Number=SeqID_90072
MATQKITEVKRMEKRGHYTTEENGNWVLCETKFLPDTNKRAFCSRAAASFVKKSNETLFICTIHSLM

SEQ ID NO: 206851 - protein, 133 aa, Glycine max
  Coding DNA Sequence Number=SeqID_90073
  Gene Ontology: Mol. function=pseudouridylate synthase activity; Biological process=tRNA processing
  Homolog annotation: Hit_ID=Q5ZBZ5; Match level="QueryCoverage=86%, HitCoverage=17%, E-value=6e-24, Identity=49%"; Hit description =Potential U2 snRNA pseudouridine synthase-like
MAMKTAEEHEVGISCFISDLPGFRGILKQRYSDFIVNEVDRDGTVVQLSSLDAPQEEPESSQENGTNTSDNVVSYASQIESFKSLAGDSDAVLLEEFINKINAGGEDGVSPIVLSPDSDKSHRKIQETFVYIG

SEQ ID NO: 206852 - protein, 299 aa, Glycine max
  Coding DNA Sequence Number=SeqID_90074
  Homolog annotation: Hit_ID=Q2PEP7; Match level="QueryCoverage=23%, HitCoverage=28%, E-value=1e-25, Identity=67%"; Hit description =Putative DNA-damage-repair/toleration protein DRT102
  Pfam annotation: Domain name=DUF868; Domain location=2-205; Score= -40.9; E_value=1.2e-09; Accession=PF05910.3; Description=Plant protein of unknown function (DUF868)
GSKSINKRKIKLHWNFTRAEFIQNSAEPESRFYLAISHNDKLQFFLGDLLRDLNRRNKRVDVEANNVVDPVLLSRREHVFGRRCYVSRAVFMGSKHVIEIECGGGVLGVKVDGETRLVVKRLAWKFRGYEKIFINGVQVEFYWDVLSWVVNSNKGNGHGVFVFQVGDGTVWPEMVGAEKKLMNKSVSASSVLQWPEDTCDFLVRSVCLKRGEQLIAIQGCNQKLANRSISSSHHHTFGHDLVVIEGKKSVWNLTKEQRYDLTVGDYLFTPPGDVHRVKYYDEDIETAKNAIHKELGLIN

SEQ ID NO: 206853 - protein, 288 aa, Glycine max
  Coding DNA Sequence Number=SeqID_90075
  Gene Ontology: Mol. function=phosphoric ester hydrolase activity; Cellular component=chloroplast; Biological process=carbohydrate metabolic process
  Homolog annotation: Hit_ID=P46276; Match level="QueryCoverage=98%, HitCoverage=79%, E-value=1e-126, Identity=76%"; Hit description =Fructose-1,6-bisphosphatase, cytosolic
  Pfam annotation: Domain name=FBPase; Domain location=1-283; Score =464.8; E_value=1.1e-136; Accession=PF00316.10; Description=Fructose -1-6-bisphosphatase
VEEQKKLDVLSNEVFVKALISSGRTCLLVSEEVEEAIFVPSSHRGKYIVVFDPLDGSSNIDCGVSIGTIFGIYMVKNEAEVSLEDALQPGNQMLAAGYCMYGSSCTFVLSTENGVNGFTLDPSLGEFILTHPNIKIPSKGKIYSVNEGNARNWDEPTTKIPFINVKILDTFHSRYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 206854 - protein, 149 aa, Glycine max
  Coding DNA Sequence Number=SeqID_90076
MPPKTITPPAKNVPKEPYKSDVARNQHAKAFLLDHRGRTYNQSRRDLACYPKTNEGDEAPVPGPVPVPAEEVKVEQQENKAEETPVASADNSLVTLLNENEEKKEEQVEAEEEAKTEEVKAEAQKEEKAQTEEAKPETNEEKPAAKADN

SEQ ID NO: 206855 - protein, 117 aa, Glycine max
  Coding DNA Sequence Number=SeqID_90077
  Gene Ontology: Mol. function=ribonuclease H activity; Biological process=DNA integration
GKPWYHDIKGYVECKEYPQGASDNDKGTLRSLATDAKEAEWMLIEVHEGSFGTHANGHALVKKILRAGYYWLTIESDYCIYVRKCHKCQTFTDNVNAPPMPLNVLAAPWPFSMWGID

SEQ ID NO: 206856 - protein, 96 aa, Glycine max
  Coding DNA Sequence Number=SeqID_90078
MELAKVDTRLPCGTIVVEENDKLAKESKIIHYEKELEEMKNMARVQSKYLNFQLLITIAVLLHTEPPNPIFPTKKLRIEVLNDDDDDEYFTVFDLS

SEQ ID NO: 206857 - protein, 267 aa, Glycine max
  Coding DNA Sequence Number=SeqID_90079
  Gene Ontology: Mol. function=protein serine/threonine kinase activity; Cellular component=cytoplasm; Biological process=protein amino acid phosphorylation
  Homolog annotation: Hit_ID=O81637; Match level="QueryCoverage=99%, HitCoverage=37%, E-value=3e-93, Identity=64%"; Hit description =Mitogen activated protein kinase kinase
  Pfam annotation: Domain name=Pkinase; Domain location=2-179; Score =22.6; E_value=6.6e-10; Accession=PF00069.15; Description=Protein kinase domain
  Pfam annotation: Domain name=Pkinase_Tyr; Domain location=1-179; Score=-131.2; E_value=0.0002; Accession=PF07714.7; Description =Protein tyrosine kinase
  Pfam module annotation: Pfam domain module=Pkinase::Pkinase_Tyr; Domain location=2-179::1-179
YRQKHKRVNIRAVKHWCRQILRGLLYLHSHDPPVIHRDLKCDNIFINGNQGEVKIGDLGLAAILRKSHAAHCVGTPEFMAPEVYEESYNELVDIYSFGMCVLEMVTFEYPYSECSHPAQIYKKVISEWQDINRILHFQGKKPDALYKVKDPEVRQFVEKCLATVSLRLSARELLDDPFLQIDDYEYDLGPVDSGAFDDLGPLTHQPFFDLHQSFSNMSTEYSNGFEYGDWYSHPADIEPSGIELFECHDEEASEDVDISIRGKRKDD

SEQ ID NO: 206858 - protein, 52 aa, Glycine max
  Coding DNA Sequence Number=SeqID_90080
MSIVILNLDVRTDDSNDGDKAYWWLIQLELYFASIGMCEEERLSKIAKALRD

SEQ ID NO: 206859 - protein, 329 aa, Glycine max
  Coding DNA Sequence Number=SeqID_90081
  Gene Ontology: Mol. function=protein serine/threonine kinase activity; Biological process=protein amino acid phosphorylation
  Homolog annotation: Hit_ID=O81637; Match level="QueryCoverage=29%, HitCoverage=12%, E-value=2e-15, Identity=46%"; Hit description =Mitogen activated protein kinase kinase
MVAELDITDQDVTSIADMIDGEIASLVPEWKPGPGIEETNHHLNNFFCHNCVSIHTSGGNVMEFLSHNQCGKNSQLPQCCRHGCTSMHGRFEEITFPSECDNHVRGDAPIKSSQSDCLQRQESWNHHESCELSPVESDESHSGEQFDKPVLAEDKGKKGIWENKFAHDPGNPPRSLSGNYFSAIRFLCCGPEIEYEKEVRQEMRWIKAKHNRESRELGDKRFGIATESSHTSNREHKTEQCIMPPLPQTANGVHNGIHLKPLGNIWNYESSCRSQVQKNHPNLDTQRAQNCEVMCSHKEGMVTEKSFYTGSLRDTLHRTVSLPVDAVDV

SEQ ID NO: 206860 - protein, 54 aa, Glycine max
  Coding DNA Sequence Number=SeqID_90082
MERRSVLPFNVRAAAVAALFHETIMPRLSAPSPNRYWQLLTVMKHIRVILDTQT

SEQ ID NO: 206861 - protein, 654 aa, Glycine max
  Coding DNA Sequence Number=SeqID_90083
  Gene Ontology: Mol. function=exonuclease activity; Cellular component= intracellular; Biological process=regulation of transcription, DNA -dependent
  Homolog annotation: Hit_ID=Q9FQ04; Match level="QueryCoverage=99%, HitCoverage=72%, E-value=0.0, Identity=66%"; Hit description=XRN4
  Pfam annotation: Domain name=XRN_N; Domain location=1-247; Score =460.1; E_value=2.8e-135; Accession=PF03159.8; Description=XRN 5'-3' exonuclease N-terminus
  Pfam annotation: Domain name=zf-CCHC; Domain location=254-271; Score =28.3; E_value=2.1e-05; Accession=PF00098.13; Description=Zinc knuckle
  Pfam module annotation: Pfam domain module=XRN_N::zf-CCHC; Domain location=1-247::254-271
MGVPAFYRWLADRYPLSIADVVEEEPSVGSGAVDVSKPNPNGMEFDNLYLDMNGIIHPCFHPDGKVTICFASPHFHSIHFFLVTQNIATDGVAPRAKMNQQRSRRFRAAKDAAEKDAAEAEAEIERLREEFEGEMKLLSSKVKPETYDSNVITPGTPFMGVLSVALQYYIQTRLNYNPGWRNTKVILSDSNVPGEGEHKIMDYIRLQRNLPGFNPNTRHCLYGLDADLIMLSLATHEVHFSILREVITFPGQQEKCFQCGQVGHFAAECRGKPGEKAEDWNPVDDTPIHKKKYQFLNIWVLREYLQYEMEIPNPPFEIDFERIVDDFVFLCFFVGNDFLPHMPTLEIREGAVNLLMHIYRKEFTAMGGYLTEAGEATEINEEMKARARGEMPGEPRASVLDKVKLGEPGYKERYYAEKFGALDLEKIEKIKKDTVCPVLKYVEGLCWVCRYYYQGVCSWQWYYPYHYAPFASDLKDLADLEITFFLGEPFKPFDQLMGTLPASSSSALPEKYRDLMIDPSSPILQFYPADFEIDMNGKRFAWQGVAKLPFIDEKKLLSATSKLEATLTEEEQLRNSKMLDLLYVSSAHNLAPHILSYHQYSCQLPLHERPALPIDPRASDGMNGYLWLYERNVLRTTVSSPIKGLQDIEFNQVL

SEQ ID NO: 206862 - protein, 74 aa, Glycine max
  Coding DNA Sequence Number=SeqID_90084
  Homolog annotation: Hit_ID=Q01DI1; Match level="QueryCoverage=60%, HitCoverage=21%, E-value=3e-08, Identity=64%"; Hit description =Homology to unknown gene
MGRTLQRDLNRIAAVADTSPSEGLHYVLTETTLALLRHPDYCISAYSSVSDFNLKSSWISRCYCRRHSLVLLCC

SEQ ID NO: 206863 - protein, 355 aa, Glycine max
  Coding DNA Sequence Number=SeqID_90085
  Gene Ontology: Mol. function=transferase activity; Cellular component= nucleus; Biological process=paclitaxel biosynthetic process
  Homolog annotation: Hit_ID=Q5I2Q5; Match level="QueryCoverage=97%, HitCoverage=75%, E-value=1e-118, Identity=59%"; Hit description =Putative alcohol acyl-transferases
  Pfam annotation: Domain name=Transferase; Domain location=1-347; Score=222.9; E_value=7.3e-64; Accession=PF02458.6; Description =Transferase family
MVDCTGEGVLFIEADADVTLDQLGDALQPPFPCFEQLLYNVPDSEEITDTPLLLIQVTRLKCGGFIQALRLNHTMSDAAGLVQFLNAWAEMAGGAKSPSIAPVWRRELLMARDPPRITCKHHEYMEFVDTEIEEGSLTLHDDDMVLRSFFFGPSQIASLRRLVPHYCATFDLITACLWRCHTKALKIDADKDVRMMVAVNARAKFNPPLPVGYYGNAIAYPAAVTTAGKLCGNPFGYAVELINKVKGKATQEYMHSVADLLAIKGRYIPRMVRSLTVSDLRGFDPRQIDFGWGHALYAGPAQGGLGPFPGVTFITPFKNAKGEDGLVLPIWLPTEAMNRFSKELDGMFGFICSSL

SEQ ID NO: 206864 - protein, 139 aa, Glycine max
  Coding DNA Sequence Number=SeqID_90086
  Gene Ontology: Mol. function=transferase activity; Biological process= paclitaxel biosynthetic process
  Homolog annotation: Hit_ID=Q2PF15; Match level="QueryCoverage=84%, HitCoverage=25%, E-value=2e-40, Identity=69%"; Hit description =Benzoyl CoA benzoic acid benzoyltransferase
MASSSSFPSLMFAVRRCQPELVAPAIPSTPHELKPPLSDIDDQEGLRFLVPMIQIYRNEPSMAEKDPAKVIRQALAKTLVFYHPFEGRLREEPDRKLMVDCAGDGALFIEAHVDITLDQIGDALQPPLTIPMLPRIYIV

SEQ ID NO: 206865 - protein, 321 aa, Glycine max
  Coding DNA Sequence Number=SeqID_90087
  Gene Ontology: Mol. function=beta-pyrazolylalanine synthase activity; Cellular component=chloroplast; Biological process=cysteine biosynthetic process from serine
  Homolog annotation: Hit_ID=Q43317; Match level="QueryCoverage=99%, HitCoverage=100%, E-value=1e-130, Identity=75%"; Hit description =Cysteine synthase (EC 2.5.1.47) (Beta-pyrazolylalanine synthase) (Beta-PA/CSase) (EC ...
  Homolog annotation: Hit description=2.5.1.51) (L-mimosine synthase) (EC 2.5.1.52) (O- acetylserine sulfhydrylase) (O-acetylserine (Thiol)-lyase)
  Pfam annotation: Domain name=ADH_zinc_N; Domain location=68-236; Score=-12.9; E_value=0.06; Accession=PF00107.16; Description=Zinc -binding dehydrogenase
  Pfam annotation: Domain name=PALP; Domain location=12-289; Score =408.7; E_value=8.6e-120; Accession=PF00291.15; Description=Pyridoxal- phosphate dependent enzyme
  Pfam module annotation: Pfam domain module=ADH_zinc_N::PALP; Domain location=68-236::12-289
MAVEKLSIAKDVTELIGKTPLVYLNRIVDGCVAKVAAKLEMMEPCSSVKDRIGYSMIVDAEEKGFITPGESVLIEPTSGNTGIGLAFMAAAKGYKLIITMPSSMSLERRTILRAFGAELVLTDPAKGMKGAVQKAEEIRDKTPNSYILQQFENPANPKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIVSLSAVHLAVFPSFGERYLSSVLFESVKREAESMVFEP

SEQ ID NO: 206866 - protein, 89 aa, Glycine max
  Coding DNA Sequence Number=SeqID_90088
MEKAKLVGVLEYLYDERVGGKGSRGLHVITPTLEELQQAHLYILNNSNEALVKETNPKMTKNRVLKEHNKTFLNWFKDIIFDDHNAFET

SEQ ID NO: 206867 - protein, 139 aa, Glycine max
  Coding DNA Sequence Number=SeqID_90089
  Gene Ontology: Mol. function=metallopeptidase activity; Cellular component=cytoplasm; Biological process=amino acid metabolic process
  Homolog annotation: Hit_ID=Q47336; Match level="QueryCoverage=34%, HitCoverage=53%, E-value=5e-20, Identity=97%"; Hit description=LacZ -alpha peptide
MLALDELEGLGFEAQALGLGFEEGDRGGVVRRWVGCVNAEVALEVRDGSVLFFEERLLGCGCGEEERDMDDRDGRHRGGAPIRPIVSRITIHWPSFYNVVTGKTLALPNLIALQHIPLSPAGVIAKRPAPIALLNSCAA

SEQ ID NO: 206868 - protein, 239 aa, Glycine max
  Coding DNA Sequence Number=SeqID_90090
  Homolog annotation: Hit_ID=Q47522; Match level="QueryCoverage=21%, HitCoverage=62%, E-value=8e-21, Identity=92%"; Hit description=LacZ protein
RVPFAIQAAQLLRRAIGAGLFAITPAGERGMCCKAIKLGNARVFPVTTLANWSSTAVAAALELVDPPGCRNSIAFSLSIIHISLFLSTTATQQPLLEEQDTPITHFQRYLRINTAHPTPDYTSAVSFLKAQAQSLGLKTQTLEFVQGKHQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 206869 - protein, 111 aa, Glycine max
  Coding DNA Sequence Number=SeqID_90091
MENKDATRKQRLKCLNKKCSRERKLQAHSRYLIKDPNGQIMEKFPVKLQTKFREDPTVNKSWAAFLPRKLHVASSRSFIKRLPQKASLRGFLKKLPRGFFEKLSQEVSLRS

SEQ ID NO: 206870 - protein, 82 aa, Glycine max
  Coding DNA Sequence Number=SeqID_90092
MKSWMQSSKCDDCLGVYLNGPDNYLKGKINSALKGLDNTPQPKSKAGARWIIVKTIESREIEGVSHPVGTILSQSEKSNLGC

SEQ ID NO: 206871 - protein, 222 aa, Glycine max
  Coding DNA Sequence Number=SeqID_90093
  Gene Ontology: Mol. function=ribonuclease activity; Cellular component=intracellular; Biological process=RNA processing
  Homolog annotation: Hit_ID=Q6D5W0; Match level="QueryCoverage=99%, HitCoverage=99%, E-value=1e-101, Identity=80%"; Hit description =Ribonuclease T
  Pfam annotation: Domain name=Exonuc_X-T; Domain location=19-194; Score=129.0; E_value=1.3e-35; Accession=PF00929.14; Description =Exonuclease
MSESNALNALHQRFRGFYPVVIDVETAGFNAQTDALLEIAATTLKMDEDGWLHRDETLHFHVEPFEGAILNPEALAFTGIDPSNPLRGAVSEYEALHAIFKMVRKGTKDSGCNRAIIVAHNATFDHNFLMAAAERTGMKRNPFHPFATFDTAALSGLVLGQTVLAKACKAAGIDFDSTQAHSALYDTEQTATLFCELVNRWKRLGGWPLAVSEEPAEDDASA

SEQ ID NO: 206872 - protein, 73 aa, Glycine max
  Coding DNA Sequence Number=SeqID_90094
MVAITPAKVHQPPFLRGYDSNAMCAYHGGAPGHSTEHCRALKHKVQGESLVEILTLTSDTTHGAILKAVIRCL

SEQ ID NO: 206873 - protein, 468 aa, Glycine max
  Coding DNA Sequence Number=SeqID_90095
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-49, Identity=27%"; Hit description= UPI00006A17C9 related cluster
LHILAFRRLHALAVRGMHVLPFRGLHALANRGLHILAFRGLHALAFRRLHILSFKGLHPLNFRGLHVLTFCVQHAFAFGGLHILTFRGLHALIFRGLHALAFIGLHALAIKGLHALACRGLLTLAFIRLHALTIRGLHILAIRGLHVLAIRGLYTLTFRGLHALTSKGQHVLPFRGLHALTYRGLHVHSTRGLRGLATRGLHVLGTSGLPDYTHSPIEDYKPSPSRGYMPSPYLQSATRPRHAFREVHTLTFRELHVLAFTGVHALAFRGLHVIAFRRLDVLTLRGQHDLTLRGLHVLTFRGLDILAFRGLHVLAFRGLHLLTFRGLHLLTFRGLHALDFRGQHVLAFIGLDTLAFVGLHPLDFRGLHVLTFRGLNILASRGLQVIAFRGLHVLAFRGLHFVAFRGQHALAFRRLHVLDFRGLHALTFRGLHFLAFRGLQTINFRGLHIFAFRGVDALPFRGLHVLAF

SEQ ID NO: 206874 - protein, 143 aa, Glycine max
  Coding DNA Sequence Number=SeqID_90096
  Homolog annotation: Hit_ID=Q6D939; Match level="QueryCoverage=92%, HitCoverage=36%, E-value=8e-34, Identity=49%"; Hit description =Putative exported protein
VKPKLIASLTDDDSCDNLAPSDDQPEEGAEPPTLTPVDAQQVLIAALCWRGAYNEGYGFWLLDNALQGTPQLITDSGSDYHDGVISEAQKGRGIGDCWSTAAWVWDGRQFVQSSEATTGMCRAIRAGGAWQLPTLVTEVKPAG

SEQ ID NO: 206875 - protein, 341 aa, Glycine max
  Coding DNA Sequence Number=SeqID_90097
  Gene Ontology: Mol. function=transporter activity; Cellular component= integral to membrane; Biological process=transport
  Homolog annotation: Hit_ID=Q4ITL6; Match level="QueryCoverage=44%, HitCoverage=43%, E-value=1e-37, Identity=58%"; Hit description =Probable MFS transporter
MAAGLGISTALAGQTVTVYALGSLLAAIPLTIATQGWRRRNVLLLAIVGFLIFNSITTGGTRLEPAGRLCAAHGAGPSAGQSARRGDGRYADCAGAGRSRRHLAGHGGGLAHGVRHHVGADAAADRLGAAAASAAAHGVHDARRASGAGRGGQRAAGVWHRGAGGYRPGRSPRRSPPARRRARQSGAVCAGLAAVHLAGALAAAGLCRRGAVGTDVWRGGHAAANGAGGCGRRGRGCGAVDECGGVEQRDCRRRSGRWRVAYPLGRGVFPAGAAVAAGGWLPHRTAGASARFPGRRAAPARTSTDADEFPLPGRFHQQLSNCGWRTPCIIVTGGSGPAGVS

SEQ ID NO: 206876 - protein, 326 aa, Glycine max
  Coding DNA Sequence Number=SeqID_90098
  Gene Ontology: Mol. function=transporter activity; Cellular component= integral to membrane; Biological process=transport
  Homolog annotation: Hit_ID=Q4ZSB2; Match level="QueryCoverage=95%, HitCoverage=77%, E-value=5e-82, Identity=54%"; Hit description =General substrate transporter:Major facilitator superfamily
MGKQHATGQTAAGNRAVPHHHIHRQRHIRALACRIRQRRLQQRGRPAKRQSPQRHADINQQRQARQPDEQQRDQRKQRQTAEHGDAQVVIDEATGQADSRQRRDAKHQQHAVHLPGEARLANERRNVGVENVVRRHPRQHHAQHRTHAWRHEHRAQRQTLIAALSRIVRHPQQHPADQQQRQRRHDAERRAPAHRRAQPGADGNAQRQRNRRTDHRHGERFALLMDRHHAPRIAGQQAPGESRRCAGEKARHQRQCEVGRERGDGVENQETDDSQQQHVTAAPALGGNGQWNRRQQRAKRIDGYGLPGQRGGNTEARRHLRQQSGR

SEQ ID NO: 206877 - protein, 338 aa, Glycine max
  Coding DNA Sequence Number=SeqID_90099
  Gene Ontology: Mol. function=oxidoreductase activity; Cellular component=integral to membrane; Biological process=protein amino acid phosphorylation
  Homolog annotation: Hit_ID=Q3KDS9; Match level="QueryCoverage=92%, HitCoverage=89%, E-value=1e-114, Identity=65%"; Hit description=2OG -Fe(II) oxygenase
  Pfam annotation: Domain name=2OG-FeII_Oxy; Domain location=174-275; Score=108.5; E_value=2e-29; Accession=PF03171.10; Description=2OG -Fe(II) oxygenase superfamily
MADTLPVLDLALLELPDAEQAAYLAQLRETARDVGFFYLVNHGINPQLLHNVQSITRAFFALPQAEKQRVAMIHSPHFRGYNHAGVEYTRDQRDQREQFDIGAERAALTLQPGDPAWKRLQGPNLWPEALPQLRPVMHAWQQAMTAIALRLLRAFAKALALPPDAFDALYGTQPNEHIKLIRYPGQAAEASQQGVGAHKDSGFLTFLLQDDQPGLQVEVSPGHWVDALPKPGAFVVNIGELLEIASNGYLRATVHRVVSPPANRERVSIAFFLGAQLDAEVPLYQLPPQLAAEAHGPTSDPDNPLLREVGWNYLKGRLRSHRDVAQRYYADALSTVKS

SEQ ID NO: 206878 - protein, 322 aa, Glycine max
  Coding DNA Sequence Number=SeqID_90100
  Gene Ontology: Mol. function=hydrolase activity; Cellular component =membrane; Biological process=aromatic compound metabolic process
  Homolog annotation: Hit_ID=Q9HZR3; Match level="QueryCoverage=90%, HitCoverage=92%, E-value=1e-106, Identity=61%"; Hit description =Probable hydrolase
  Pfam annotation: Domain name=Abhydrolase_1; Domain location=85-316; Score=29.6; E_value=1.1e-05; Accession=PF00561.10; Description =alphabeta hydrolase fold
MEINHVFKKLLLTLLLASAALFSAAGTAADEFPLPAGFTSSYQTVDGVRLHYVKGGSGPLVYLVHGFGQTWYEWHQLMPELAKNHTVVAVDLPGLGQSDVPHSYRATDVAPLLYQLAQQFAGGKKFDLVAHDIGIWNTYPLLVKHQDSIRRAIFMEAPIPDESIYQFPAFTPEGESLVWHFSFFAAQGQLAEQLIAGKERLFFEHFIKEHAANKAVFTPALLDLYSKSYAKPHSLNAAFEYYRVLNQGVADNKVLSREKIAVPMLAIGGGGHGGLGAYEQQVVSRYASQVTGKVLPGCGHWLPEECPAPLNAAVMAFLASGK

SEQ ID NO: 206879 - protein, 77 aa, Glycine max
  Coding DNA Sequence Number=SeqID_90101
  Subcellular localization annotation: CTP_CleavageSite=59; ConfidenceScore=5.75e-01
MRKPIASSNSSASGKDATPQWVSNTPPARPPPAIALFHTTTFIDSATSAPSPAASASAVCSSVAAPPNVSPHSATPT

SEQ ID NO: 206880 - protein, 206 aa, Glycine max
  Coding DNA Sequence Number=SeqID_90102
  Gene Ontology: Mol. function=beta-lactamase activity; Cellular component=outer membrane-bounded periplasmic space; Biological process=beta-lactam antibiotic catabolic process
  Homolog annotation: Hit_ID=Q6DB25; Match level="QueryCoverage=83%, HitCoverage=49%, E-value=1e-34, Identity=42%"; Hit description =Putative exported protein
MEAAAGHAERTKQLMLRQRFNVLMQAMLQNIAQQRIAEIGVLRRRVRGGAEIGQITQHGIAIQIAVKIFAAAQLQQRDAFCILTQRHAARQQRGQRVAPVQLAAIHQPDNDLCGNALAQRAQRKQRIRRDGITLARIGDAIAVKLRRAALVNNGDADARYLLLLHVVAHNVIDVFMEGGMGKIDAIAHRRGRLRQRSAAAEQQTQG

SEQ ID NO: 206881 - protein, 1016 aa, Glycine max
  Coding DNA Sequence Number=SeqID_90103
  Homolog annotation: Hit_ID=Q2L1L4; Match level="QueryCoverage=33%, HitCoverage=84%, E-value=3e-82, Identity=50%"; Hit description=GntR -family transcriptional regulator
  Pfam annotation: Domain name=Acetyltransf_1; Domain location=820-902; Score=35.6; E_value=1.7e-07; Accession=PF00583.14; Description =Acetyltransferase (GNAT) family
MVAAASLYSNARDLIRYLDAHLHSDAHGALGQALAQVNYPYEQHGNQAQNIAWVTDTYGQQQITYQVGYIGGYASFIGYDRAHGNAIVVLQNAFNWSNYLGIALLRDLARKDRRDMNTVACNFAAQQSAPPEVCCGAKFDAQSAAREPSARGACHLTPAALAEGEQTDSVPMPPQVQQTAPDASAPAATSDAPASSEPAESSGDVAPIRPSQNGPGEAPSAANNYDLHTIIIDYKEYKVGDVVPDEYRKKQYTIVEWQPRHLPAPQEGTHWAYINANYILITDDSGKIVMGKSGDIFFKGAPTAPRLPLSDWCWYYRIPAPVPAVFARPDKSRTARQAHSHGETAAPSAPHHPPYPPAATPDAYRTHRPAAAPEYQMSPVAQPAVWPAADDTDGAFCSADAQRRKQGLAEGADVNHRRRLRHALHRGDGLAAVAKIAVVIIFDNPRLMPLCRRQQCQPARGAHDRAGGILMRRRGVNQPRRALLPVLRCRCQSLCIHRNRLDLQIAEAHRRFGAAIARLLHPAGVTTIGEQRDAQRQRLLRAFGNHNLLRRTAHAARQRQMLRQCLTQRQLTQRIAVAQQLCLLRGLIERATPLRQREMRQRRRARAQRQLLTGEAMQRVQSGSARGNRPVGAVVGRLRGQRRVRQPADAASLAPPAGGSPAGACPPPADHSVSPGAAADTAAVAVSGCRRPLAVPAAAIAGLMHASAPPKVARCTLSLSHRRNRRMSSQTNRYGQPIGPALEAWQPRPLPQGQIFTGQYCRLEPLDAARHGRELYAAYALAEDDRDWTWLPVGRFDDEASYLAFAQQCQQSPDYLHFAVIDRQSGQAIGSLALMRIEPQHGVMEVGFVVFSPLLKQTRMATEAHYLLMRYAFEQLGYRRYEWKCDSCNQPSYNAALRLGFRYEGTFRQVVVYKNRSRDTAWFSIIDSEWPQVKLGFERWLAADNFDARGQQRARLETLRTGHRHHQPPMPEIIAFELIETELHAMVEIQQALIHFFKAFIDFSELCIYFFKALID

SEQ ID NO: 206882 - protein, 268 aa, Glycine max
  Coding DNA Sequence Number=SeqID_90104
  Gene Ontology: Mol. function=DNA-directed RNA polymerase activity; Cellular component=nuclear envelope-endoplasmic reticulum network; Biological process=aromatic amino acid family biosynthetic process
  Homolog annotation: Hit_ID=Q3RD79; Match level="QueryCoverage=83%, HitCoverage=84%, E-value=3e-16, Identity=41%"; Hit description=Phage- related protein
  Pfam annotation: Domain name=Osmo_CC; Domain location=128-173; Score =7.6; E_value=0.83; Accession=PF08946.1; Description=Osmosensory transporter coiled coil
  Pfam annotation: Domain name=Osmo_CC; Domain location=174-215; Score =5.8; E_value=1.7; Accession=PF08946.1; Description=Osmosensory transporter coiled coil
  Pfam annotation: Domain name=Osmo_CC; Domain location=72-117; Score =7.1; E_value=1; Accession=PF08946.1; Description=Osmosensory transporter coiled coil
  Pfam module annotation: Pfam domain module=Osmo_CC::Osmo_CC::Osmo_CC; Domain location=128-173::174-215::72-117
MMNTHKAFKALQQAGVADHQAEVMVDIFAGMQQENSLTKTHLSQAMEGVMRANHATAQRVDKLAQSLRHFENEVRHTFKAIELRFDNVDEQFRKIDQRFEQIDQRFEKVDAQFRSIDKRFEKVDAQFRTIDQRFEQIDEQFRKIDQRFEKMDEQFRKIAQRFEQIDEQFRKIDQRFEQIDEQFRKIDQRFEQIDERFRQIDKRFEKMDEQFRQIDKRFEKVDERLLDLDHRMQLGFNELKRDNLWHRRLMMAMASAFVLSAAKYIFAG

SEQ ID NO: 206883 - protein, 95 aa, Glycine max
  Coding DNA Sequence Number=SeqID_90105
MGGRSWYLGQNKFVGQGVGLGLNFHIIPQGTRNNDDLETTCKISHGHSQVGTQASRLWHCDTTVGNLHKQTQRFQIMFFHQFNEFIHSYLCYSGK

SEQ ID NO: 206884 - protein, 46 aa, Glycine max
  Coding DNA Sequence Number=SeqID_90106
MTLPSPTTLHYQTMVHFSPTFISTLMKFFSQSDYHHVYRFIHRFKQ

SEQ ID NO: 206885 - protein, 133 aa, Glycine max
  Coding DNA Sequence Number=SeqID_90107
MHIEARFHPDRYRETSADHAHHHNFDLPLPKWITATRHSVDPEKPNTVLGFSALIMSLCQFYGVLITPSKVIRPPVNRTFIEKYCAPRQVQGEAPQQPRDVQQQATNAPPPLLESTLAHLQRLKRRCLRPMAD

SEQ ID NO: 206886 - protein, 309 aa, Glycine max
  Coding DNA Sequence Number=SeqID_90108
  Gene Ontology: Cellular component=periplasmic space; Biological process=alginic acid biosynthetic process
  Homolog annotation: Hit_ID=Q1H2L7; Match level="QueryCoverage=63%, HitCoverage=63%, E-value=3e-53, Identity=50%"; Hit description=Sigma E regulatory protein, MucB/RseB
  Pfam annotation: Domain name=MucB_RseB; Domain location=99-309; Score= -100.1; E_value=3.5e-08; Accession=PF03888.5; Description=MucBRseB family
GWVQSDMTSRIMAQLADEPTMLAPQAVAASEKITHIRPRFSKYTWSIAASVAAAFFVGLFVVNQPEVTAPAQIADNDADTDQYVLAHHNYAPNSATYYMHNVAQPVVAEEDLWATMQKTASAARELNYQGLFVYQNGAVIRSVQITHIYEGGREFTRNVVLDGRPREVFSEGDDIVIFNAKNDKVVIEKRRGQNLFPAMLPTQLYPLKQNYKLKFVGQERVAGRLTQVLDMIPNDNLRYQYRIWSDSEYGLLLKMSMMDVQGHTLEQIGFNQVSMLQTKDLDWFQPKIDATKPYVMDDTTDLTHTVENL

SEQ ID NO: 206887 - protein, 147 aa, Glycine max
  Coding DNA Sequence Number=SeqID_90109
MGVWIASGGSNPARLGELRSPGRAGRQPPLPFSYKKAEGGCSKDPSAPWLCISAVLGEKNCFRKENPSRGASVTLSRCFRKQICEGFRPFFIVLHPFFVLQRNYVGLISSSQLRIRRSKSPAFVDHPKRSLMVQCLNVSLLSKTRDR

SEQ ID NO: 206888 - protein, 95 aa, Glycine max
  Coding DNA Sequence Number=SeqID_90110
MNIVRGSRMTAAGCYNVPLCGGPEASNDSSWWPLVIVGGGGGVSRMSLSGNPLFTLSATFRAECNSSLIGIALSMLVSLREMSKSVIGKIPTVKA

SEQ ID NO: 206889 - protein, 132 aa, Glycine max
  Coding DNA Sequence Number=SeqID_90111
MPPTGGIGEQSLYGHYDNPMHTYWSPSRLGFPVLITTLCDAQGVVSDTLTFESLSPVINLAYIKKNCWNPADPSITFSWPRCTRTRAATPDALPPAQPPPQAARHQHPATLAQPDLHSQMLQSIYQGQQIIV

SEQ ID NO: 206890 - protein, 53 aa, Glycine max
  Coding DNA Sequence Number=SeqID_90112
MVGEFSQKSVTLTSLPVILPSKSDLTYYCVMVRWMTMENPMLEDAGTQCSDRM

SEQ ID NO: 206891 - protein, 58 aa, Glycine max
  Coding DNA Sequence Number=SeqID_90113
MDKSLKVGEDEWREKERGSMKFYASNEIKQVNNTRELLTQFGATSPTSGGYQAREEMH

SEQ ID NO: 206892 - protein, 42 aa, Glycine max
  Coding DNA Sequence Number=SeqID_90114
MADQRATKSKAKGKQSTRTHLVAHDPGDLNKTSASSEGRKIP

SEQ ID NO: 206893 - protein, 149 aa, Glycine max
  Coding DNA Sequence Number=SeqID_90115
  Gene Ontology: Cellular component=outer membrane
  Homolog annotation: Hit_ID=Q3R879; Match level="QueryCoverage=94%, HitCoverage=22%, E-value=3e-43, Identity=58%"; Hit description =Surface antigen (D15):Surface antigen variable number
  Pfam annotation: Domain name=Surf_Ag_VNR; Domain location=25-111; Score=13.0; E_value=0.071; Accession=PF07244.5; Description=Surface antigen variable number repea
MQPKKYALPLMVLSLAATSVVHARGTIDKVDIKGLDKGDDAAIIENIQESLSLYDTIGKEQGESRLEYLLSQAERQTRQALEPFGYYNPVIKVEAPREDEHVRVLIHVDKGTPVTVRREHIDITGPAMYDQYLQDDLAAFKPRKGRGIL

SEQ ID NO: 206894 - protein, 400 aa, Glycine max
  Coding DNA Sequence Number=SeqID_90116
  Gene Ontology: Mol. function=aminoacyl-tRNA ligase activity; Cellular component=intracellular; Biological process=arginyl-tRNA aminoacylation
  Homolog annotation: Hit_ID=Q8P3I5; Match level="QueryCoverage=85%, HitCoverage=49%, E-value=1e-120, Identity=69%"; Hit description =Glycyl-tRNA synthetase beta chain
MHHVIGDRLLSGGEDAGIVRDAGNDPDGHPPALPVGAKHAWHYISARQMLDCRDLAQALAQHRQQRQAVATQRRIFRVDHHAIEERVDLRAQARQARQHGHVILLVEAGAGVVDGGGDRFGQRALGVFLQQRRVDLAGNLAFGLAQDVADALVGRGQRFGFRQRGEGADRIQAAVKVIQRGGLQLGHGVEVRGRHALVSVVALQAVKDEVVQFADVGLHVARGQAGVGTGQQRAQVQLEAAFDDRAGQAQRVAAQGERVLVAGRLQACGETTGQGVHAFSNRQHLAQRRQRDVVTAEARLVGLVDGQRHLGRFTAGHGVVAAGDALQFREFVDHARLQVVLGQLRGAPGLRGVSTDLRRDHFGQGGHTRKHIDQVAKLVSVGNYFQEVQTKIPSLVSGHH

SEQ ID NO: 206895 - protein, 80 aa, Glycine max
  Coding DNA Sequence Number=SeqID_90117
  Gene Ontology: Mol. function=protein serine/threonine kinase activity; Biological process=protein amino acid phosphorylation
  Homolog annotation: Hit_ID=Q67UT0; Match level="QueryCoverage=59%, HitCoverage=12%, E-value=9e-14, Identity=66%"; Hit description =Putative serine/threonine protein kinase
MFGNPNRAIERGALESIKNATIDNGECLSDYIEVIRCEPYNEKCDVYSFGVILNELLTRNYLYVETKYGPTKIVMEVVEG

SEQ ID NO: 206896 - protein, 36 aa, Glycine max
  Coding DNA Sequence Number=SeqID_90118
MMLCALSEEEYTKAHNFRSAKQMWDTLAVTYVGTSQ

SEQ ID NO: 206897 - protein, 101 aa, Glycine max
  Coding DNA Sequence Number=SeqID_90119
MASKKRKAPSTPTQGRFDRSRFTSLEAWERYTDIVVPRKLLPEWNVVVYYIEFDEFKEELERKHWDEKLTDFFYSSIDIAIVKEFYANLYDPEDKSPKQVR

SEQ ID NO: 206898 - protein, 61 aa, Glycine max
  Coding DNA Sequence Number=SeqID_90120
  Gene Ontology: Mol. function=transferase activity, transferring nitrogenous groups; Biological process=biosynthetic process
  Homolog annotation: Hit_ID=P77806; Match level="QueryCoverage=98%, HitCoverage=15%, E-value=1e-22, Identity=83%"; Hit description =Aminotransferase ybdL
MTQPNLIPESKLPALGTTIFTQMSALAAQHNAINLSQGFPDFDGPRYLQQRLAHHVSEGAN

SEQ ID NO: 206899 - protein, 130 aa, Glycine max
  Coding DNA Sequence Number=SeqID_90121
MYCRKMGAYAKDEELLNMGKKGHESFKEYAKRWRDLAAQVAPPMTEKEMITIIVDTLPMFYYEKMVEYAPSSFADLVFVGERIKVGLKRGKFDHPALMNSKTRANEEDENEGETLAVTTIPTRPNFPSAQ

SEQ ID NO: 206900 - protein, 230 aa, Glycine max
  Coding DNA Sequence Number=SeqID_90122
MSHHSSSVNGEGTSHKDPLSRILDELSSLKLWKEKKERKENSSPHLLLLQDLIHGFLWCGVSNHLSSFSIPLPFIFKKQRTPLMKKIQCLQAPHGATSPIARDRLDTWFTNENKKTDFKMIYAMENKIKIFYLELVKVFYTCARVDMEGNLYSTVNDVEMIIDVAVWKAVAGLNMGESASLRNQWKATSRWRHTEALDLVHQWSPLLLEVHWQRNGEGRNMIGDATSRRR

SEQ ID NO: 206901 - protein, 120 aa, Glycine max
  Coding DNA Sequence Number=SeqID_90123
  Subcellular localization annotation: CTP_CleavageSite=27; ConfidenceScore=5.30e-01
MHALLGSFNSGNWSDSKVLGSAGLSCRAFTRNQGAISNLVPLDLEIEATLRRNRAERRRKLLQDRTVASILEEETHFSDLLSPDSPSSRESATQLLEAITMAEEHDQRITLEDYSSSSVP

SEQ ID NO: 206902 - protein, 318 aa, Glycine max
  Coding DNA Sequence Number=SeqID_90124
  Gene Ontology: Mol. function=binding
  Homolog annotation: Hit_ID=Q26UN4; Match level="QueryCoverage=51%, HitCoverage=13%, E-value=7e-09, Identity=29%"; Hit description=TPR repeat precursor
  Pfam annotation: Domain name=TPR_1; Domain location=248-281; Score =7.0; E_value=0.79; Accession=PF00515.18; Description=Tetratricopeptid e repeat
  Pfam annotation: Domain name=TPR_1; Domain location=49-82; Score=4.2; E_value=1.7; Accession=PF00515.18; Description=Tetratricopeptide repeat
  Pfam annotation: Domain name=TPR_1; Domain location=83-116; Score =5.4; E_value=1.2; Accession=PF00515.18; Description=Tetratricopeptide repeat
  Pfam annotation: Domain name=TPR_2; Domain location=248-281; Score =17.6; E_value=0.044; Accession=PF07719.7; Description=Tetratricopepti de repeat
  Pfam annotation: Domain name=TPR_2; Domain location=49-82; Score =11.3; E_value=1.6; Accession=PF07719.7; Description=Tetratricopeptide repeat
  Pfam module annotation: Pfam domain module=TPR_1::TPR_1::TPR_1::TPR _2::TPR_2; Domain location=248-281::49-82::83-116::248-281::49-82
MGPCCGEAALEAQQQPEQADAAIVTALQLGAPTVEALRARRVTLGRQRALLQAQQAYQLLSAGEDAAAIEQAHAAVELAPDVASYRLLLITAQLQGDQLADAEHSADQALQVDANDLNARVMRGYLRQRQGSTLRANEDFDAALATPGSTAQQRNVRLLAVDAALAAGDRVRAAALLAPLQAALPAGEGDARTRQLLQQGIEQRSRATRASREPPRISAEAYPAPVQHCQSGDSGNVCELVPADLQGDGGAAQRAYAAYARQDYADAIGEARQAVQLAPDDANLQGLLTTTLAAGNRAQQDEARQRLDTALAQRPDDA

SEQ ID NO: 206903 - protein, 555 aa, Glycine max
  Coding DNA Sequence Number=SeqID_90125
  Gene Ontology: Mol. function=hydrolase activity, acting on ester bonds; Cellular component=integral to membrane; Biological process =biosynthetic process
  Homolog annotation: Hit_ID=Q1D6A0; Match level="QueryCoverage=99%, HitCoverage=93%, E-value=9e-86, Identity=31%"; Hit description=Non -ribosomal peptide synthetase
  Pfam annotation: Domain name=AMP-binding; Domain location=334-555; Score=-60.9; E_value=5.1e-05; Accession=PF00501.18; Description=AMP -binding enzyme
  Pfam annotation: Domain name=Condensation; Domain location=2-150; Score=-103.1; E_value=0.0046; Accession=PF00668.10; Description =Condensation domain
  Pfam module annotation: Pfam domain module=AMP-binding::Condensation; Domain location=334-555::2-150
MEMYFQILHGETPRTNDFLQFSDYALAEEQWYATAEYQKGLAYWAKKFDDAQGLLEITTDRPRPAKMSTKGSMASHTFDRDFTQRLQMQAAQLGATPFHMILSAYMLLLHKYSNQQQIIIGCPFANRNQPETQNMLGLFMNTLPLKLDIVPEATLREIIGDVRSESEQAQLHQAIPLNDILEEIGHIRNPQVNPLFQAALTYQVFPHFHNNTLFTYKPLKIDYGVSKLDLNLWVEESRGSLLFTLNYNPDLFNRSTITRMLSDLRTVLETLIERPQITVRDLSLVTREEHRHLLSGCRRLLDAVPMAVHRQFERQADALGADSVAVRCDGRLLSYRQLNEQANRLAHCLLEHGLLPGQSVALFMAKSERCVVALLAILKAGGCYVPVDITLPMEQVDFILRDAQARFVVVDAGSPAVSQPTISIDQCHGAALSTNPQLLTMPTDAPAYIIYTSGSTGRPKGVRVNHVQLSRYCQVIASVLDQPAGARYGMFSAFTTDLAHTMLFPALIYQGQLEVISTQQLNDPQALFSYLESHPLDCMKITPTHLTALLMSPHA

SEQ ID NO: 206904 - protein, 72 aa, Glycine max
  Coding DNA Sequence Number=SeqID_90126
MAAAPALANPGNGNGNGEHGNSDKNIYHGDKGNHGHSASQSDNGGGKGQRKNYGKPDHVDSDISYTTARALA

SEQ ID NO: 206905 - protein, 328 aa, Glycine max
  Coding DNA Sequence Number=SeqID_90127
  Gene Ontology: Mol. function=transporter activity; Cellular component= integral to membrane; Biological process=transport
  Homolog annotation: Hit_ID=Q3K827; Match level="QueryCoverage=93%, HitCoverage=68%, E-value=1e-96, Identity=59%"; Hit description =General substrate transporter
  Pfam annotation: Domain name=MFS_1; Domain location=42-325; Score= -23.3; E_value=0.0037; Accession=PF07690.6; Description=Major Facilitator Superfamily
  Pfam annotation: Domain name=Sugar_tr; Domain location=38-327; Score=- 134.1; E_value=0.011; Accession=PF00083.14; Description=Sugar (and other) transporter
  Pfam module annotation: Pfam domain module=MFS_1::Sugar_tr; Domain location=42-325::38-327
MSTTQVLGDASFSPPGQHPDSLTARIDALPSSPGLWSFITLLALGGFFELYDLFQTGYISTGLLAEGIFHTGKDGVFGIADQAAFASSTFMGLFIGASLLAPLADRLGRRLTFMFALAWYGIFSLIMALQNSAEGVIFFRFLVGVGLGIELVTIDTYLSEWMPTHLRNKAFAYAFFIQFLSVPTVALMSWLLVPMTILGLSGWRWVIILGALCSLVIWVIRKKLPESARWLESKGRHDDAHRVMGEMEQRCGLSPSRRHASQAVAVPQRSNFKEIWAPQPSASSVSVTGCPRCSPARAPVLPIAFCTLFLSPLPTRLAACSVLALSIV

SEQ ID NO: 206906 - protein, 225 aa, Glycine max
  Coding DNA Sequence Number=SeqID_90128
  Gene Ontology: Mol. function=neprilysin activity; Cellular component =membrane; Biological process=proteolysis
  Homolog annotation: Hit_ID=Q21EE0; Match level="QueryCoverage=93%, HitCoverage=83%, E-value=9e-35, Identity=36%"; Hit description=ATP -dependent DNA helicase RecG
  Pfam annotation: Domain name=DUF1732; Domain location=181-224; Score =12.3; E_value=3.8e-07; Accession=PF08340.1; Description=Domain of unknown function (DUF1732)
  Pfam annotation: Domain name=YicC_N; Domain location=12-165; Score =149.0; E_value=1.3e-41; Accession=PF03755.4; Description=YicC-like family, N-terminal region
  Pfam module annotation: Pfam domain module=DUF1732::YicC_N; Domain location=181-224::12-165
MTAKKTAQDYPILSMTGFAAAESRFHGGLLLIELRAVNHRYLELNVKIDDSLRQYEAQIREQLQSRLGRGKVECRMSLKSDHAATHLALNPAMVAQISQTLSELQQHFPQAQPVNLVEVFKLPGVLQSEAVDADALAHGLLNGLTHAIDELIAARQREGEKLKQEKLTAKLREAMQADDDRVRQEIVLYAQRIDVDEELARLQSHIVEMDRILSAGGAVGKKLDS

SEQ ID NO: 206907 - protein, 623 aa, Glycine max
  Coding DNA Sequence Number=SeqID_90129
  Gene Ontology: Mol. function=nucleotide binding; Cellular component =intracellular; Biological process=small GTPase mediated signal transduction
  Homolog annotation: Hit_ID=Q8ZKY3; Match level="QueryCoverage=65%, HitCoverage=89%, E-value=0.0, Identity=88%"; Hit description=tRNA modification GTPase trmE
  Pfam annotation: Domain name=60KD_IMP; Domain location=1-159; Score =302.5; E_value=7.7e-88; Accession=PF02096.11; Description=60Kd inner membrane protein
  Pfam annotation: Domain name=Arf; Domain location=390-564; Score= -102.6; E_value=0.077; Accession=PF00025.11; Description=ADP -ribosylation factor family
  Pfam annotation: Domain name=Dynamin_N; Domain location=407-525; Score=-46.6; E_value=0.1; Accession=PF00350.13; Description=Dynamin family
  Pfam annotation: Domain name=GTP_EFTU; Domain location=402-585; Score= -72.5; E_value=0.053; Accession=PF00009.17; Description=Elongation factor Tu GTP binding domain
  Pfam annotation: Domain name=MMR_HSR1; Domain location=405-526; Score= 149.0; E_value=1.3e-41; Accession=PF01926.13; Description=GTPase of unknown function
  Pfam annotation: Domain name=Miro; Domain location=406-526; Score =41.4; E_value=3.1e-09; Accession=PF08477.3; Description=Miro-like protein
  Pfam annotation: Domain name=Ras; Domain location=406-566; Score= -92.4; E_value=0.024; Accession=PF00071.12; Description=Ras family
  Pfam module annotation: Pfam domain module=60KD_IMP::Arf::Dynamin _N::GTP_EFTU::MMR_HSR1::Miro::Ras; Domain location=1-159::390 -564::407-525::402-585::405-526::406-526::406-566
MYPLTKAQYTSMAKMRMLQPKIQAMRERLGDDKQKQSQEMMALYKAEKVNPLGGCLPLVIQMPIFLALYYMLSGSVELRHAPFVLWIHDLSAQDPYYILPVIMGITMFFIQKMSPTTVTDPMQQKIMTYMPVIFTVFFLWFPSGLVLYYIVSNLPRQEESVTPGNAEQDATSPGAAFMPPCFFWKKVLMSHSDTIVAQATPPGRGGVGILRISGGKAAEVAQAVLGKLPKPRYADYLPFNDADGSVLDQGIALWFPGPNSFTGEDVLELQGHGGPVILDLLLKRIVALPGVRIAQPGEFSERAFLNDKLDLAQAEAIADLIDASSEQAARSAVNSLQGAFSLRVNALVEALTHLRIYVEAAIDFPDEEIDFLSDGKIEAQLNAVIGDLNGVRAEARQGSLLREGMKVVIAGRPNAGKSSLLNALAGREAAIVTDIAGTTRDVLREHIHIDGMPLHIIDTAGLREASDEVERIGIERAWQEIEQADRVLFMVDGTTTDATEAAAIWPDFVARLPAALPITVVRNKADMTGETLGLTEVNGHSLIRLSARTGAGVDTLREHLKQSMGFAGNMEGGFLARRRHLQALELAATHLQQGKEQLLGAWAGELLAEELRLAQQALSEITG

SEQ ID NO: 206908 - protein, 83 aa, Glycine max
  Coding DNA Sequence Number=SeqID_90130
MGAKYLEVVKRGSHPNNGWSPDEIRNDHNLSLCFVGHVRAWAVRHRMTIICLCVPPDTTASGWRKGVRNDPNLSLPPSQLVVS

SEQ ID NO: 206909 - protein, 223 aa, Glycine max
  Coding DNA Sequence Number=SeqID_90131
  Gene Ontology: Mol. function=hydrolase activity
  Homolog annotation: Hit_ID=Q2SQG8; Match level="QueryCoverage=74%, HitCoverage=48%, E-value=5e-26, Identity=42%"; Hit description =Predicted hydrolase of the alpha/beta-hydrolase fold
MRLRGSEPAHLRRKYQSYIARAVLDVLHGQRRIQHRAHRGHAQQRHAGGRCTQSQAQHEVATQRIAGGHQRQLRPALGDVACGVHHFIDEIGVEDAGIEMMGVAVVAEVQPHHVEALLDHARGGHAHVTGFGTAFPAMQQQRDTLRLAAFDMTVPALQAHAITAIEDQLFADCTGGRQQQQAALQAHAAGTEHRLQVRIAQPARRADSQPHAASAYRRPGQVA

SEQ ID NO: 206910 - protein, 209 aa, Glycine max
  Coding DNA Sequence Number=SeqID_90132
MKHLEGKAKALADQGEWTSFVDVLALSVFGIVLFQNVDELVDLAVTGAFLAYHHNKESLVIAVLDDAYDTFDLRCEKSSARIVCCTPALYVWLVSHIFRHESRPVCPLQGHRMCAEKGKTNWEELLAAWLLKLKISSGEEAEVPAEREEVQALKAKLERTRVVKEKFKMAATRVRKEYDELRDVNMAMTEALERETKRARKEEWGRNKF

SEQ ID NO: 206911 - protein, 106 aa, Glycine max
  Coding DNA Sequence Number=SeqID_90133
MEAMKEQMITMMEAMMSMRKMMEVNMATVIAASTATEVREAKRWEVRVAPILCRSRASIPSHHMACLPTIHHSMLHTLLMRMSITLLPYPLRTNNPNLIMHMSLNP

SEQ ID NO: 206912 - protein, 124 aa, Glycine max
  Coding DNA Sequence Number=SeqID_90134
MSAEKYQSRLYNDRCRLLGNVRSASSGDTSFSNLDRSSFLADVGLHCFRSVSVNHIFLPRWANVFLAEKMRTYQCRPKHNLDTARTKNSSRPTLLKAQVEKDEDPSGEGQSPQVEKDEGPSGEG

SEQ ID NO: 206913 - protein, 217 aa, Glycine max
  Coding DNA Sequence Number=SeqID_90135
  Gene Ontology: Mol. function=RNA-directed DNA polymerase activity; Biological process=RNA-dependent DNA replication
MQVSLSNHKSTESTIKNLEVQVGQLDKQLVEKSMCNFAVNTKKNPKEECKVVLTRSQRKKSVEKEKRAGGILEDTKSQLAQEAKKEIPSISVKEAPYPLVPSKKEKEHYFAHFLDIFKKLEITIPFGEALQQIPLYTKFMKDLLTKKGKYINNESIMRIGNLRIAPTKMTLQLADHSITKPYGVVEDVLVKVRQFTFLVDFVIMDIDEDSNIPSILG

SEQ ID NO: 206914 - protein, 54 aa, Glycine max
  Coding DNA Sequence Number=SeqID_90136
MMLTSVSVELCWRRQSGLIRSRGNIQIIYMILDHNELQLAMVIFNFKMIISARS

SEQ ID NO: 206915 - protein, 44 aa, Glycine max
  Coding DNA Sequence Number=SeqID_90137
MALGVMAARPGKLVTSPLSYLGAQASQRLAGLNSASEDQKINKQ

SEQ ID NO: 206916 - protein, 112 aa, Glycine max
  Coding DNA Sequence Number=SeqID_90138
  Gene Ontology: Mol. function=nucleoside-triphosphatase activity
  Homolog annotation: Hit_ID=Q7PC87; Match level="QueryCoverage=69%, HitCoverage=5%, E-value=5e-23, Identity=64%"; Hit description =Pleiotropic drug resistance protein 6
MGFKGPERKGVADFLQVTSKKDQQQYWSRKDEPYKYVSVPEFVQAFSSFDIGEQLATELGVPYDKSQAQPTALVKDKYASMIELVAKMISEGRGLELMPMELDPTTPITSYR

SEQ ID NO: 206917 - protein, 218 aa, Glycine max
  Coding DNA Sequence Number=SeqID_90139
  Gene Ontology: Mol. function=helicase activity; Biological process =viral genome replication
  Homolog annotation: Hit_ID=Q1SN45; Match level="QueryCoverage=97%, HitCoverage=14%, E-value=5e-70, Identity=51%"; Hit description=AAA ATPase
MVKPQCLTWIRFNQKTIRSNVLNGLQEAVSRGETNPSSIGKSVILPSSFTGGMRYMFHNCKDAMIICKKFGYPDLFITITCNSTWSEICDFVQKKRMYIVEFQKGGLLHAHILLWLDGENRLHNGSDIDKIISVELPNPDLYPKLSKAIAPYMIHGPCGFANLKSPCTKERKCSKYFPMKFENSTIIDDDGYPCYRRRDMGMFVQKNDVTLDNRNFSL

SEQ ID NO: 206918 - protein, 105 aa, Glycine max
  Coding DNA Sequence Number=SeqID_90140
MLRNLTDYVIIPFLASRMLRNFMNCALTLPFDFQHVTELHGLPNDGCQVSRSGQTRVASQQTDGPRTKLGLVQEKHSWLLARIIAHRSSIEYEGIVEGQKLDAII

SEQ ID NO: 206919 - protein, 127 aa, Glycine max
  Coding DNA Sequence Number=SeqID_90141
  Homolog annotation: Hit_ID=P16181; Match level="QueryCoverage=30%, HitCoverage=24%, E-value=9e-09, Identity=69%"; Hit description=40S ribosomal protein S11-1
MDFYIIEKIDFKDKMSSLTPTPSFYIDAIKTLWEHDDALHVDHFYRFLYCRYVPVEAFLVLTFGHFRNSKKTRKGKSPRKGGNRFWKSIVVGFKTPREAIEGDFFVFFSRCQGLLLIVFCVLVSDQC

SEQ ID NO: 206920 - protein, 63 aa, Glycine max
  Coding DNA Sequence Number=SeqID_90142
  Homolog annotation: Hit_ID=Q1SN45; Match level="QueryCoverage=92%, HitCoverage=3%, E-value=4e-11, Identity=54%"; Hit description=AAA ATPase
MDSDDKGEGEIEIPNDLLVLDNDKPLLSLVDFVYSNIWENLNVPNFFDERAIIAPTLEIVEEG

SEQ ID NO: 206921 - protein, 251 aa, Glycine max
  Coding DNA Sequence Number=SeqID_90143
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=O22216; Match level="QueryCoverage=83%, HitCoverage=45%, E-value=7e-98, Identity=84%"; Hit description =Glycerol-3-phosphate dehydrogenase
  Pfam annotation: Domain name=NAD_Gly3P_dh_N; Domain location=38-236; Score=-34.6; E_value=0.00091; Accession=PF01210.13; Description=NAD -dependent glycerol-3-phosphate deh
MGVVSNEYSNGSVQGCNSLEEKLDDLRGLLGKADGDPLRIVSVGAGAWGSVFAALLQDTYGQFRDKVQIRIWRRPGKTVDRATAEHLFEVINSREDVLRRLIRRCAYLKYVEARLGDRTLLADEILKDGFCLNMIDTPLCPLKVVTNLQEAVWDADIVVNGLPSTETREIFEEISIYWKERITVPVIISLAKGIEAALEPVPHIITPTKMINQAKENPIKLLNCICTTTSVAFACNFVNHSTTTPMTITAT

SEQ ID NO: 206922 - protein, 118 aa, Glycine max
  Coding DNA Sequence Number=SeqID_90144
MTVCGGYWWLWVMEKVLGTLEMVLEERRRKKWRFSKATRKAKAETLKCFYSRERKRSSHTRHCIKDHNGQIVDLCPMNCQTKFREDPMVNEGWAAFLPRQVHVASLRSFIKRLSRGLL

SEQ ID NO: 206923 - protein, 186 aa, Glycine max
  Coding DNA Sequence Number=SeqID_90145
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=98%, HitCoverage=42%, E-value=4e-30, Identity=35%"; Hit description =Putative receptor protein kinase
  Pfam annotation: Domain name=LRR_1; Domain location=117-145; Score =2.6; E_value=93; Accession=PF00560.23; Description=Leucine Rich Repeat
  Pfam annotation: Domain name=LRR_1; Domain location=23-45; Score=6.6; E_value=16; Accession=PF00560.23; Description=Leucine Rich Repeat
  Pfam annotation: Domain name=LRR_1; Domain location=47-69; Score=1.9; E_value=1.3e+02; Accession=PF00560.23; Description=Leucine Rich Repeat
  Pfam annotation: Domain name=LRR_1; Domain location=71-90; Score=9.4; E_value=4.9; Accession=PF00560.23; Description=Leucine Rich Repeat
  Pfam annotation: Domain name=LRR_1; Domain location=93-114; Score =9.2; E_value=5.4; Accession=PF00560.23; Description=Leucine Rich Repeat
  Pfam module annotation: Pfam domain module=LRR_1::LRR_1::LRR_1::LRR _1::LRR_1; Domain location=117-145::23-45::47-69::71-90::93-114
MEMHLPCLQLGGRLNERISKLRMLRKISLCSNSFNETIPSLFSKCSLLRSVLLRDDLFSGNLPPKITNLTSLQILKVAQNHISDNIPSKLPINLKSLGLSSNAFSSEIPSFIVSISHVQLINLSYNQFSSEPQGASAATVPLGGPQPHQRNASFGACQLLYAFASEHGGNVLTGVVPLAISALPRL

SEQ ID NO: 206924 - protein, 281 aa, Glycine max
  Coding DNA Sequence Number=SeqID_90146
  Homolog annotation: Hit_ID=Q9FN45; Match level="QueryCoverage=60%, HitCoverage=69%, E-value=4e-52, Identity=56%"; Hit description =Genomic DNA, chromosome 5, P1 clone:MYJ24
  Pfam annotation: Domain name=DUF617; Domain location=114-281; Score =331.0; E_value=2.1e-96; Accession=PF04759.4; Description=Protein of unknown function, DUF617
MAAKSPHDSSFSFSRRYFHWKKKALDESDNEEEILNFSSSSSYFPEEVNDNQDDHNHNHNHHLTLQMPSQYNAKKKTHFSKKSKFKSVLTIFTVTRVPRLRLNNISNSFNLDMRVMGTLFGHRRDHVYFAFQEDPKLGPTFLVKLATRTSTLVREMASGLVRIALECEKKKNATAKVRLLEEPLWRTYCNGRKCGYANRRECGPHEWKILKAVEPISMGAGVLPVVCGNEAAGSEEEASGEVMYMRAKYERVVGSRDSEAFYMMNPDASGGPELSIYLIRV

SEQ ID NO: 206925 - protein, 78 aa, Glycine max
  Coding DNA Sequence Number=SeqID_90147
MDGVKKVDTEEGSSALNVTTMEEPSSVRSRGRSSSARIHGKKLFRCCNLQLQKNLLQQEEPSFMAFGEDVLPWMLKQA

SEQ ID NO: 206926 - protein, 355 aa, Glycine max
  Coding DNA Sequence Number=SeqID_90148
  Gene Ontology: Mol. function=receptor activity; Cellular component =outer membrane-bounded periplasmic space; Biological process=amino acid transport
  Homolog annotation: Hit_ID=Q5P3Q4; Match level="QueryCoverage=93%, HitCoverage=82%, E-value=1e-111, Identity=58%"; Hit description =Predicted LivK, ABC-type branched-chain amino acid transport systems, periplasmic component
  Pfam annotation: Domain name=ANF_receptor; Domain location=49-354; Score=-31.3; E_value=0.006; Accession=PF01094.18; Description =Receptor family ligand binding region
MKLNRIAAALCAIGLAGVAHAEAGISDGIVKVGVLTDLSGVYSDLAGNGSVVAARMAAEEMGNKVLGKPVEVVAADHQNKPDVAANLAREWFDQGKVDMITDFPTASTALAVMEIARQKNRVTMPSAGLSTAILGEKCSPLNAQWTTNTYALAAGTARALVKEGKKTWYFITADYTFGHSLEKDATEVIQENGGSVAGVSRHPFPGNDFSSFLLKAQASKADVIALANAGNDTVNAVKQANEFGITKKQIVAPLLTYISDVHSMGLAKAQGMYLTEAFYWDYDDASRAWARKFFEKTKKMPTASQAGVYSATLSYLKAIEAAGTDEAPAVMAKLREMTINDAVIRNGKLRADGAL

SEQ ID NO: 206927 - protein, 63 aa, Glycine max
  Coding DNA Sequence Number=SeqID_90149
MVILVRGEVHCVHFGRVESLTEIRRQVVVVVVVIVTTLVHKLYSIYGLTIRQFYITYGLTICK

SEQ ID NO: 206928 - protein, 82 aa, Glycine max
  Coding DNA Sequence Number=SeqID_90150
MKFAKRDQHAQRNYQPERKFTKRDQCAQHNSNMRRLAWPVRPVGLETIPSQLYNWIDHAIIPVLTSSIQYCRCGYPDWTASK

SEQ ID NO: 206929 - protein, 104 aa, Glycine max
  Coding DNA Sequence Number=SeqID_90151
MYKDNWTQPWPMGSEIYPEVHENPRAFFSSSSPIFLEPLAHGSSDWSLPREDCIKSFAIVESELAGAWLFFLFLSGGKKGHFKPFSESRLASGSPGPPNSLRVK

SEQ ID NO: 206930 - protein, 91 aa, Glycine max
  Coding DNA Sequence Number=SeqID_90152
MRLLMIEEDEDAQNKKEDPKGCIDRIQILKTKTNRMTNKEHQTKNDVEVDYSRNLVASQFGTFTHPPSRIFIAKDGIRGHGSLPKRPVASS

SEQ ID NO: 206931 - protein, 433 aa, Glycine max
  Coding DNA Sequence Number=SeqID_90153
  Gene Ontology: Mol. function=zinc ion binding; Cellular component =membrane
  Homolog annotation: Hit_ID=Q1SXA1; Match level="QueryCoverage=71%, HitCoverage=91%, E-value=3e-49, Identity=34%"; Hit description=Zinc finger, SWIM-type
  Pfam annotation: Domain name=SWIM; Domain location=328-360; Score =8.7; E_value=0.079; Accession=PF04434.8; Description=SWIM zinc finger
MASLEKKNPRKALSSTIGPMGHKMLKFIAVQLVDDQDVKGMIYIIRQSEIKRNTLLTPNPQLQYHESKGANYKIQPSNPTKLIVICDDDSCAWRCRASYILTMLALITHIKRTEGYTTTHRKVWLTKQKAIEKIYDDWERSYNDLPRLLQAMQQFILDMVMEKETLPIPPQEGQAVEGFMMSCHLFWSFRPCIDGFQYCKLLVQVDGTWLYAYARTKPILNHYYNILRDEVDVDQAINWLSEILLEKWTLAWDGGRRWGHMTTNPTKLINMILKKSINLPIGALVKSTYLRCNALFNKRGTEATTMLASRQLYMQIINLREVRSAGDFTIRLDERWCDYGKFQKLHMHCSHVVAACKQAHHEYRNYIHLVYTLESDSNVYKGLFAELRNEAFWSSCHEPMIYPDPNKKRNSKRHLVSSRIHTKMDIRESGQPK

SEQ ID NO: 206932 - protein, 297 aa, Glycine max
  Coding DNA Sequence Number=SeqID_90154
  Gene Ontology: Mol. function=protein binding; Cellular component =integral to membrane; Biological process=G-protein coupled receptor protein signaling pathway
  Homolog annotation: Hit_ID=Q7XAB8; Match level="QueryCoverage=97%, HitCoverage=97%, E-value=1e-113, Identity=71%"; Hit description =Protein THYLAKOID FORMATION1, chloroplast precursor
  Subcellular localization annotation: CTP_CleavageSite=14; ConfidenceScore=5.50e-01
MAALTSLSFSAVTHCSERKVTLSSTRFLASSSEIFGFRTDFSYHYVGVRASNSPSKMVVQCMSSATDVPPTVSETKLNFLKAYKRPIPSIYNTVLQELIVQQHLMKYKRSYRYDPVFALGFVTIYDKLMEGYPSDEDRDAIFQAYIKALKEDPEQYRIDARKLEEWARVQKPTSLVEFSSKEGEVEGILKDIAERAGGKGEFSYSRFFAVGLFRLLELANATEPTILDKLCVALNINKRSVDRDLDVYRILLSKLVQAKELLKEYIDREKKKRDERAEPQKANEAITTCLGQQLPGL

SEQ ID NO: 206933 - protein, 80 aa, Glycine max
  Coding DNA Sequence Number=SeqID_90155
MGSFGVANDIKKQIRHSKRKVQMWMSKFRAVKPGKAVLVVAGSPKLEVYETDFGWGSISLSDCRDGKEELRLDWRLTRFG

SEQ ID NO: 206934 - protein, 467 aa, Glycine max
  Coding DNA Sequence Number=SeqID_90156
  Gene Ontology: Mol. function=transferase activity; Biological process= paclitaxel biosynthetic process
  Homolog annotation: Hit_ID=Q1T1Y8; Match level="QueryCoverage=92%, HitCoverage=91%, E-value=1e-138, Identity=56%"; Hit description =Transferase
  Pfam annotation: Domain name=Transferase; Domain location=8-461; Score=14.6; E_value=1.2e-11; Accession=PF02458.6; Description =Transferase family
MEEARAQKLVEKSEVSPATSTTTSLPLTFLDLSLAGPVYVRRQFFYHFPHHTEIFYETTLPSLKHTLSLTLQHFFPLAGNLLCPPPPHKPFIRCTDDDTVTLTIIESKADFNHLSSNHPKNLKDLGHLVPKLTCTTMHEEDTFIFPIVALQVTVFPNNGLCIAITYCHVMDDRCCGHFMKSWSSICRSGGVDLTLVEKSPPCFDRKILKDPKGSLEAIFLRDYFQERSTWKDKLIGQTPKHVCDDEDFLKATIAFGRDDIESLKRYVLNHWKKNAELKAPQYLSKFVVTCAFVWVSLVKAKYRDDDEGEEMKEEYFRFAADCRDRLDYPIPETYFGNCLTRCYAVLKRKELKGEGGFVNAVKAIARAITDMKTEPLRGAENWRALFRKMFVLGSTVLVTGSPKFSVYETDFGFGRPTKVEMVHSPKCMSVAESGDKEGGLELGLVFRSGEFEYFISVIEQGFVALKS

SEQ ID NO: 206935 - protein, 113 aa, Glycine max
  Coding DNA Sequence Number=SeqID_90157
MELLFKDSDEPIHPNEWFPQNLLILWSCSSKIVMKLLFKDSDEPIHSNEWFPQNLLILWGCSSKIVMKLLFKDSDEPIHPNEWFPQNLLILWSCSSKILMNLFIRMNGSLRIY

SEQ ID NO: 206936 - protein, 155 aa, Glycine max
  Coding DNA Sequence Number=SeqID_90158
  Gene Ontology: Mol. function=diacylglycerol kinase activity; Cellular component=integral to membrane; Biological process=protein kinase C activation
  Homolog annotation: Hit_ID=Q9FVC9; Match level="QueryCoverage=94%, HitCoverage=29%, E-value=4e-27, Identity=60%"; Hit description =Diacylglycerol kinase variant B
  Pfam annotation: Domain name=DAGK_cat; Domain location=39-122; Score=- 13.7; E_value=0.022; Accession=PF00781.14; Description=Diacylglycerol kinase catalytic domain
MASHSDANSLRDFWIPGHVLVPDSVVEGSNIDIEGPKCPVLVFVNSRSGGQLGGELLKTYRALLNENQVFDLGEEAPDKVLSRIYANLENLRLQGDHIAIQIMEKLRLIGVMEQQAGYLELFVISNYLIRHPLPRFRWAQGIIYHLHLVGYEIAV

SEQ ID NO: 206937 - protein, 166 aa, Glycine max
  Coding DNA Sequence Number=SeqID_90159
  Gene Ontology: Mol. function=acyltransferase activity
  Homolog annotation: Hit_ID=Q69FA1; Match level="QueryCoverage=98%, HitCoverage=37%, E-value=2e-35, Identity=44%"; Hit description =Anthocyanin acyltransferase
QKEEEGNNYVTKGYFDEPCNIGFSADCHNHPQFSLPSNYFGNCLIPLLTTLKRAANAIERKIRDFKSDALRLAETTMSDIRGLGKCGQSLVVIVGSPKLTAYNTDFGWGKPIKSEVVNLDSVRTVSLTDCRDQEGGIQVGIVLERIQMNNFTNILEEHLSHIAVLD

SEQ ID NO: 206938 - protein, 146 aa, Glycine max
  Coding DNA Sequence Number=SeqID_90160
MYPRLFSLNLVDVPSTRTDPQEMYPLLFSVKLKEWEESKEFSDCVVLNSLTRKKGDTKEFRRLVICSFGKGRRETQKEFRRLVLGEFFLAKGEENERMNSTSFQGLENQKTSESFWYKEEEEKVQRDFKACKGLIGKAKVFKIFEM

SEQ ID NO: 206939 - protein, 621 aa, Glycine max
  Coding DNA Sequence Number=SeqID_90161
  Gene Ontology: Mol. function=transferase activity; Biological process= paclitaxel biosynthetic process
  Homolog annotation: Hit_ID=Q1T1Y8; Match level="QueryCoverage=99%, HitCoverage=98%, E-value=1e-125, Identity=52%"; Hit description =Transferase
  Pfam annotation: Domain name=Transferase; Domain location=8-452; Score=27.9; E_value=2.6e-12; Accession=PF02458.6; Description =Transferase family
MVVLREHKLVGKIQVVPAVRTITTLPLTFLDLPLAGPIYVRRQFFYQFPHSTLHFSETTLPSLKTSLSKTLQHFFPLAGNLICPPPPHKPFIRCTDDDSVTLTIIESQADFKNLSSNHPKSLKDLDHLVPKLTCTYTHDDTFIFPLVALQATVFPNHGLCIAITYCHVMDDNCCSHFMKSWSSICRSGGVDLTLVEKSTPCFDREVLKDPKGLEAIFLRDYFEERSSWKVGKTSEISNENTEDYVKATIVFGREDIEGLRRWVLNQWKKSEEFNTPQYMSKFVVACAFVWASLDKTRCINDEEENVKEKYFGFTADCRDRLGYPIPETYFGNCLTLCYAMLKRNDLKGENGFVNAAKVIERAVADMKIEPLKDVEHWRESFMKMYVLESTLMVTGSPKFTVYETDFGFGRPTKVEMVHLFKCISLAESGDEEGGLEVGLVCRSTENDDEEDVKEEFFRFAADCRDRLEHSAPETYFGNCLTLCYATLKRKNLEGESGLVNVVKVIEFKDVCVGKWSRSLNVVKVIEFKDVCVGKWSRSLNVVKVIERAVTDMKRSPKFTVYETDFGFGRPTKVEMIHSFKGMSLAESEDKEGGLEIGLVCTSTEFEYLRSAIEQGLQVSKF

SEQ ID NO: 206940 - protein, 76 aa, Glycine max
  Coding DNA Sequence Number=SeqID_90162
  Gene Ontology: Mol. function=RNA-directed DNA polymerase activity; Biological process=RNA-dependent DNA replication
  Homolog annotation: Hit_ID=Q1T2D5; Match level="QueryCoverage=58%, HitCoverage=2%, E-value=9e-12, Identity=68%"; Hit description=Chromo
MFRPSSSPEELGKSMDLCWDVSNRRKGDRKLAFLSRFSGNGGIYMGLGGEDDVEEDDDVAVRCGLWVVGLSEIGRK

SEQ ID NO: 206941 - protein, 821 aa, Glycine max
  Coding DNA Sequence Number=SeqID_90163
  Gene Ontology: Mol. function=RNA-directed DNA polymerase activity; Cellular component=chromatin; Biological process=chromatin assembly or disassembly
  Pfam annotation: Domain name=Chromo; Domain location=733-786; Score =20.4; E_value=0.0038; Accession=PF00385.14; Description='chromo' (CHRromatin Organisation MOdifier
  Pfam annotation: Domain name=rve; Domain location=430-586; Score =116.6; E_value=6.9e-32; Accession=PF00665.16; Description=Integrase core domain
  Pfam module annotation: Pfam domain module=Chromo::rve; Domain location=733-786::430-586
MTFRTHQGNYEYRVMPFGLSNAPSTFQAAMNSLSHHSCDTVLCKTLSLHVQHLEMIFKALLDGQFYLKYTKCVFAQKQVDYLGHVVSGRGVEPEPSKIQAMLQWPTPTSVKELRGFLGLTGFYRKFIRDYASIASPLTTLLCKDAFEWNEVSQAAFDALKSAMTQAPVLALPIFSEPFIVDTDASKTAMGVVLVQKNHPVTFFSKVFGPRLTHASTYIRELHTIVTAVRKWRQYLLGRSFTILTDHKSIQELMTQVIQTPEQHYYLSKFLGFDYTIRYKAGASNIVADALSRAPPPSGQLLLLLVPHLDFISDLRRSLHDEQEFQTLLSKVQAKPSDYLDYQIHNGLLFFQGRIWLPKTNPYIPTILLKYHATPLGGHMGVAKTTHRLESSFTWQNLKADVKSFVCECKVYQQTKSSIRRPGGLLQPLPLPTGIWEDISMDFITHLPASHGYTVVLVIVDRFSKGVHLGALPTHFSAYKVATLFLDLVCKHHGFPRSIVSDRDPVFLSSFWRELFRLHGTLLRMSRTYHPQTDGQTEVMNRILEQYLHSFVHSQLANWFRYLALAEWSYNTSLHTSSGFTPFEVIYGKPPPALPHYLPGNTTNEAVDTMITSRQEIHTKLWQRLLKAQAAMKLHADSKREDVSFTIGQWVYVNLRPHRQRSVAGDTHSKLSKRFFGPFQIVDRIGQVAYRLRLPDTARIHPAFRCSLLRTHHGRLPSSLDTWPLQVVDHKPIPRPLCFLDSKMDDSTSPPTRLVLTQWQGQPPEDTTWESWPELRDSYLLEDNMVFGEGSIDTSMHKPELKGTRTRRGATTPRYLRDYILE

SEQ ID NO: 206942 - protein, 317 aa, Glycine max
  Coding DNA Sequence Number=SeqID_90164
  Gene Ontology: Mol. function=transferase activity
  Homolog annotation: Hit_ID=Q1T1Y8; Match level="QueryCoverage=99%, HitCoverage=66%, E-value=4e-88, Identity=53%"; Hit description =Transferase
  Pfam annotation: Domain name=Transferase; Domain location=1-304; Score=-166.0; E_value=0.0065; Accession=PF02458.6; Description =Transferase family
MALQATVFPNHGLCIAITYCHAIDGKSCSHFMKSWSSICRSGGVDFTLLEKSPPCFDREVLKDPRGLEAIFLRQYFEERTTWKGKLGGRKDDSDEDFVKATIVFGKDDTEGLKRWALTQWKKNNEFNSPQNLSKFVVTCAFVWASLVKTRCRNYDDEEEDVKEEYFRFAADCRDRLGYPIPETYFGNCLTLCYAILKRKDLKGESGFVNAAKVIEKSVSDMKIDPFKDAEHWRELFLKMFVLGSALLVTGSPKLTVYETDFGFGRPTKVEMVHPFNCMSLAESEDEEGGLEVGLVCRSTEFEDLNSVIQQGLKTSKS

SEQ ID NO: 206943 - protein, 328 aa, Glycine max
  Coding DNA Sequence Number=SeqID_90165
  Homolog annotation: Hit_ID=Q2LME6; Match level="QueryCoverage=43%, HitCoverage=38%, E-value=2e-72, Identity=87%"; Hit description=MYB18
  Pfam annotation: Domain name=Myb_DNA-binding; Domain location=14-61; Score=44.6; E_value=3.3e-10; Accession=PF00249.21; Description=Myb -like DNA-binding domain
  Pfam annotation: Domain name=Myb_DNA-binding; Domain location=67-112; Score=48.9; E_value=1.8e-11; Accession=PF00249.21; Description=Myb -like DNA-binding domain
  Pfam module annotation: Pfam domain module=Myb_DNA-binding::Myb_DNA -binding; Domain location=14-61::67-112
MGRAPCCDKNDLKKGPWTPEEDLLLTNYIQTYGPGNWRTLPKNAGLQRCGKSCRLRWTNYLRPDIKRGKFSFEEEEAIIQLHSVLGNKWSAIAAKLPGRTDNEIKNYWNTNIRKRLLRMGIDPVTHAPRLDLLDMSSILRSAIGTVNPSFLNLQGLLGAQALMNPEFFKLAATATLLSLKNHENASNLVSQVQQQFNNNAGNGQVQNQVAAPNQFQTPTLSNNNVNNGLSSISPENSSIPSYLGENNYQLNAQQINQVDLLLDPELEHYLNSINQNIGHESVTPLSTPTSLNSSSTYVNSCAEEERDTYCSDVFKLEIPESLDISDFL

SEQ ID NO: 206944 - protein, 164 aa, Glycine max
  Coding DNA Sequence Number=SeqID_90166
MAANSWTYADAMRSFVLKAIWADWFQTKLSLVNTVVKGPMLYSLHFRVYWFDPLSRNEVAKMPDMLLDNGTIDQEIVKKHNKEPRARNEFASINEVGGADGTKLKIGIPFELDHTTGVKEFHGEVIVVCQDRSQRLQPLHSENQVGTTEVETPNWPTSVRVHQA

SEQ ID NO: 206945 - protein, 379 aa, Glycine max
  Coding DNA Sequence Number=SeqID_90167
  Gene Ontology: Mol. function=RNA-directed DNA polymerase activity; Cellular component=chromatin; Biological process=chromatin assembly or disassembly
  Pfam annotation: Domain name=zf-H2C2; Domain location=67-108; Score =21.1; E_value=0.00056; Accession=PF09337.1; Description=His(2) -Cys(2) zinc finger
MPHFEFINELKRELVRHPQFIELRQNIIELPQHHADYKITQDLILKDGCIWLPSGFQLISSLLMEFHSTPSGDHMGIMKTMAKLSDSFTWSGMKRDIQEFIVACLDCQHTKYESKQSAGLLYPLPVPARPWEDLSLDFIVGLPPYRGHTTILVVVDRFSKGILAGVVSFMWHDTTHEFYVSPIVGRSDREYYYNTLCHSGSGVSLYEVTYGKKPLTIPQYITGTSRVEAIDDFLSNRESVFTELRKKLLKVQEHMKLSADMKRRNVNFECGDLVMVKLRPHRQTSTSGSNVPYSKLAKRFYGPYRVLEDWNALMIPHEKIGRNSSLVMTLRTRSFLMVQGMIRNAKPAEERPLRDPRGRSCHPNIYKILFNKLVSGNDT

SEQ ID NO: 206946 - protein, 57 aa, Glycine max
  Coding DNA Sequence Number=SeqID_90168
MWKEKQTAGTLEQIWYWACNGCSVLSSTIVASDLVAKLSFYMTQVLPIHLVMSILCI

SEQ ID NO: 206947 - protein, 109 aa, Glycine max
  Coding DNA Sequence Number=SeqID_90169
  Gene Ontology: Mol. function=hydrolase activity; Cellular component =cytoplasmic membrane-bound vesicle; Biological process=biological _process
  Homolog annotation: Hit_ID=Q5JLP6; Match level="QueryCoverage=62%, HitCoverage=23%, E-value=6e-30, Identity=88%"; Hit description =Putative S-formylglutathione hydrolase
MWTVLNIIAGLVDIGIFYFSEYFSIIGKYWQFSISDFHIHSGTGAGFYLNATQEKWKNWRMYDYVVKELPKLLSDNFPHLETSKASIFGHSMGGHGALTIYLKNQDKYK

SEQ ID NO: 206948 - protein, 231 aa, Glycine max
  Coding DNA Sequence Number=SeqID_90170
  Homolog annotation: Hit_ID=Q94GC7; Match level="QueryCoverage=95%, HitCoverage=98%, E-value=1e-22, Identity=27%"; Hit description =Hsp20/alpha crystallin family protein
  Pfam annotation: Domain name=CS; Domain location=21-102; Score=-2.7; E_value=0.041; Accession=PF04969.6; Description=CS domain
  Pfam annotation: Domain name=HSP20; Domain location=24-118; Score =20.1; E_value=5.6e-06; Accession=PF00011.11; Description=Hsp20alpha crystallin family
  Pfam module annotation: Pfam domain module=CS::HSP20; Domain location= 21-102::24-118
MAQTDPSSHQAANRVYEDFEPSYEWAQDEESDTLILMLKGFRKENLRVQIGTNRRLKLSGEQQISENKWHRFNKEYTIPPHSNTNGIKAKLQGGLLYIRLPKIITEAKSTTKSPTPNLEADDNQRGTKETPTQEEPKTSEVSQTKEMGKVGEDDNCVAQNRAKATTSEAQNMHETIDELSNKKVDRRLPTTLYGLVGEVVKQKKLANLVVVILFLGMGMYVKNAIKSFFGG

SEQ ID NO: 206949 - protein, 111 aa, Glycine max
  Coding DNA Sequence Number=SeqID_90171
MSFALQFPWIDIHDHLDELYPMIPEEIKALIEEENPSFVEGTSDLWVWSHRIDEVTHARVPMTFFKWLRRHAQRGWNKCGISRNNLLVSEEQVPSWVDKGVALAPMYPQVQ

SEQ ID NO: 206950 - protein, 88 aa, Glycine max
  Coding DNA Sequence Number=SeqID_90172
MQLRHTQSGWNKCGISRNNLLVSEEQVPSWVSSQVKKRVMIVSIILWMIWHAQNAQIFDGKEVTTTKTYAYIQVHWIRLKEAFVRSGE

SEQ ID NO: 206951 - protein, 116 aa, Glycine max
  Coding DNA Sequence Number=SeqID_90173
  Gene Ontology: Mol. function=phospholipase D activity; Cellular component=membrane; Biological process=phosphatidylcholine metabolic process
  Homolog annotation: Hit_ID=O23078; Match level="QueryCoverage=68%, HitCoverage=8%, E-value=8e-11, Identity=38%"; Hit description =Phospholipase D beta 2
MDTTLCFSSTTASKKLITNNPYLIVYVVNTIVTCSHMILILQNPTWNEHFKIPFTHLALQVEFYIKDNDMFGVDLIKVATIPIKWIHASASRIEEEDGEKKRVSGSVRLRLYKFCM

SEQ ID NO: 206952 - protein, 54 aa, Glycine max
  Coding DNA Sequence Number=SeqID_90174
MVVWYNVAFGGCSGGVGWRRDAVAIMEVWTRGGHRGLLRILENSKVNQPKNGRH

SEQ ID NO: 206953 - protein, 237 aa, Glycine max
  Coding DNA Sequence Number=SeqID_90175
  Gene Ontology: Mol. function=plastoquinol-plastocyanin reductase activity; Cellular component=ubiquinol-cytochrome-c reductase complex; Biological process=electron transport
  Homolog annotation: Hit_ID=P26291; Match level="QueryCoverage=89%, HitCoverage=94%, E-value=1e-104, Identity=83%"; Hit description =Cytochrome b6-f complex iron-sulfur subunit, chloroplast precursor
  Pfam annotation: Domain name=CytB6-F_Fe-S; Domain location=66-104; Score=87.7; E_value=3.5e-23; Accession=PF08802.1; Description =Cytochrome B6-F complex Fe-S subunit
  Pfam annotation: Domain name=Rieske; Domain location=126-216; Score =58.9; E_value=1.7e-14; Accession=PF00355.16; Description=Rieske [2Fe- 2S] domain
  Pfam module annotation: Pfam domain module=CytB6-F_Fe-S::Rieske; Domain location=66-104::126-216
  Subcellular localization annotation: CTP_CleavageSite=45; ConfidenceScore=5.36e-01
MWLCGTYVALAPYPATVVLTVVVLCSGKSGIFSPSQALLVKPVKRQMMGKSKGMRIACQATSIPADRVPDMGKRQLMNLLLLGAISLPSAGMLIPYTYFFVPPGSGSSAGGTVAKDAVGNDVIAENWLKAHGPGDRTLAQGLKGDPTYLVVEKDRTLATYAINAVCTHLGCVVPWNQAENKFICPCHGSQYNDQGRVVRGPAPLSLALAHCDIDDGKVVFVPWVETDFRTGDAPWWA

SEQ ID NO: 206954 - protein, 175 aa, Glycine max
  Coding DNA Sequence Number=SeqID_90176
  Subcellular localization annotation: CTP_CleavageSite=73; ConfidenceScore=5.14e-01
MHVGSHAHIDLTCVSHLVVRRACLLRVLPAVIPCLSSCASNSHPCLVRRGVAGFFGGLSSRGSRSHPLPPTVPCSTTGLGFRHIQNFLKGLYKVSLSPIVTEDEKVVEIAYFKAQHGSTSLITQWVYFTSVSNKVSGCNTNNILSRRTRSSCNTSFLRYTWVVKNFFSLASQKKS

SEQ ID NO: 206955 - protein, 330 aa, Glycine max
  Coding DNA Sequence Number=SeqID_90177
  Gene Ontology: Cellular component=nucleus; Biological process =regulation of progression through cell cycle
  Homolog annotation: Hit_ID=Q9ZR04; Match level="QueryCoverage=94%, HitCoverage=98%, E-value=6e-61, Identity=43%"; Hit description =Putative D-type cyclin
  Pfam annotation: Domain name=Cyclin_C; Domain location=168-299; Score= 10.9; E_value=0.0054; Accession=PF02984.9; Description=Cyclin, C -terminal domain
  Pfam annotation: Domain name=Cyclin_N; Domain location=18-166; Score =35.3; E_value=1.2e-07; Accession=PF00134.13; Description=Cyclin, N -terminal domain
  Pfam module annotation: Pfam domain module=Cyclin_C::Cyclin_N; Domain location=168-299::18-166
MDFDLENPLGNFHDLPCDAVPSLFLIESDHIPPPNYCQSFKASDFDISVRRDVVSLISQLSCTFDPVLPYLAINYLDRFLAHQGILNMLPQDLTENGYEQQQPKPWANKLLAISCFSLAAKMLKTEYSATDVQVLMNHGDGGAIFEAQTIQRMEGIVLGALQWRMRSITPFSFIPFFVNLFRLKDPALRQVLKDGASEIILKSQREIKVLEFKPSTVAASALLYASHELFPFQYPCFLRAISDCSYINKETVVQCYNVIHDITREEYESVLNINSTSDTPVNVLDEHFLSLESEKTNGTNVVTQEQDFKRRKTTDYGNNRTVPFSHFHQC

SEQ ID NO: 206956 - protein, 225 aa, Glycine max
  Coding DNA Sequence Number=SeqID_90178
  Gene Ontology: Mol. function=DNA binding; Cellular component=nucleus; Biological process=regulation of transcription
  Homolog annotation: Hit_ID=Q0PJC4; Match level="QueryCoverage=64%, HitCoverage=63%, E-value=5e-10, Identity=31%"; Hit description=MYB transcription factor MYB117
  Subcellular localization annotation: CTP_CleavageSite=65; ConfidenceScore=5.04e-01
WSVIATHLPGRTDNEIKNHWHTTLKKRFGKNTVHPNKKVKATKSNSSGSKEIQKVGFFHSSSTITTSETSDSVPLSPREFSSTTSDYTTVVTNENFLLEDGFDFLEACLEDVNENIWTETNAASISNSKTPMLDNGNGSNFHGSDAAGPIMEYNENLVLENDEFAFLEALQPTVTTENFLTDMSLVPNELLAPLVNESEEYFSSLYDVDLWCPSNFHDLHVGLLQ

SEQ ID NO: 206957 - protein, 252 aa, Glycine max
  Coding DNA Sequence Number=SeqID_90179
  Gene Ontology: Cellular component=integral to membrane; Biological process=protein transport
  Homolog annotation: Hit_ID=Q9SKT3; Match level="QueryCoverage=86%, HitCoverage=85%, E-value=3e-85, Identity=67%"; Hit description =Putative secretory carrier-associated membrane protein
  Pfam annotation: Domain name=SCAMP; Domain location=82-234; Score =280.2; E_value=4.1e-81; Accession=PF04144.4; Description=SCAMP family
DGTAKGKASGQSNHGGGAASKLSPLSPEPYDCAATVDIPLDSSKDLKAKEKELQAREAELKRREQELKRREDAIARAGIVIEEKNWPPFCPIIHHDIANEIPIHLQSIQYVAFTTWLGLVGCLLWNIAAVTVAWIKGEGLSIWFLSIIYFISGVPASYVMWYRPLYRATRTDSALRFSWFFLSYGVHILFCVFATIAPPIVFKGKSLTGILPAFEVLDYNGLVGQVYMYFRGSGKAAAMRREAAQGAMRAAL

SEQ ID NO: 206958 - protein, 162 aa, Glycine max
  Coding DNA Sequence Number=SeqID_90180
  Homolog annotation: Hit_ID=Q339L1; Match level="QueryCoverage=82%, HitCoverage=32%, E-value=7e-08, Identity=25%"; Hit description =Expressed protein
MRNLICVWDGLTKLQQSVLKKKIKFVREKFEMKIAYVLYSQMKLLEAWGGMERQHLQAITAIKVNMQSTSIALRHASDLTASIKLILTTCSSSEAEKIVAMLSELAKVIAQEKQLLEEFYDLFQTIGVFEVQERSVKCNLVQLEGWQQKYQLQQFLLPEITS

SEQ ID NO: 206959 - protein, 762 aa, Glycine max
  Coding DNA Sequence Number=SeqID_90181
  Gene Ontology: Mol. function=zinc ion binding; Cellular component =integral to membrane; Biological process=multicellular organismal development
  Homolog annotation: Hit_ID=Q6ZKF1; Match level="QueryCoverage=98%, HitCoverage=98%, E-value=1e-148, Identity=61%"; Hit description =Putative vacuolar protein sorting protein 18
  Pfam annotation: Domain name=Pep3_Vps18; Domain location=242-393; Score=223.0; E_value=6.7e-64; Accession=PF05131.5; Description =Pep3Vps18deep orange family
MDQGRQVFTVDLLERYAAKGRGVITCMAAGNDVIVIGTSRGWVVRHDFGSDNLSVWSVEIDLSVGRPGDQSIHRVFVDPGGSHCIATVVGPGGAETFYTHAKWTKPRILSKLKGLVVNAVAWNKQQITEVSTKEVILGTENGQLHELAVDEKDKKEKYIKFLFELTELQEAFMGLQMETASMINGTRYYVMAVTPTRLYSFTGSYLDRTVHFMELPGDIANRQQRRAVHFAWLSGAGMYHGGLNFGGQQSSSSGNENFIENKALLDYSKLSEGAEVVKPSSMALSEFHFLLLLGNKVKVVNRISEKIIEELQFDQTSDSASKGIIGLCSDATAGLFYAYDQNSIFQVSINDEGQDMWKVYLDMNEYAAALANCRDPFQRDQVYLVQAEAAFSFKDYLRAASFYAKQGEAKKALEVLQKPSVPIDLQYKFAPDLVALDAYETVESWMTTKNLNPRKLIPAMMRYSSEPHAKYSEDDSSLLRFLQSKFGKGPENGPEFFYDPKYALRLCLKEKRMRACVHIYSMMSMHEEAVALALQIDSELAMAEADKVEDDEDLRKKLWLMIAKHVVEQEKGTKRENIRKAIAFLKETDGLLKIEDILPFFPDFALIDDFKEAICSSLEDYNKQIEQLKEEMNDATHGADNIRNDISALAQRCTIIDRDEECGAEYILDLQKQLSLMGSEARRESNGTLSPEESIPSMTTIDKLRSQLDDAIASECPFCGDLMIRKIFLPFINPEEEQHVLSWEIKPSSGSQRNSISLPASA

SEQ ID NO: 206960 - protein, 114 aa, Glycine max
  Coding DNA Sequence Number=SeqID_90182
  Subcellular localization annotation: CTP_CleavageSite=56; ConfidenceScore=5.07e-01
MSYLNRVWMAATVAVAQGHTDPGHKCKTALTSIHHNRSRLFSGGALSDLRPLSGVVGSDVAGSVAGSSDVENRVRQADDSLRKVMSRFELKKRSFKKQFYKEKIIENEAIMIGI

SEQ ID NO: 206961 - protein, 90 aa, Glycine max
  Coding DNA Sequence Number=SeqID_90183
  Gene Ontology: Mol. function=structural molecule activity; Biological process=response to gibberellin stimulus
  Homolog annotation: Hit_ID=Q6YZ10; Match level="QueryCoverage=92%, HitCoverage=36%, E-value=9e-33, Identity=78%"; Hit description=27k vesicle-associated membrane protein-associated protein-like
MGIWHFDEQRDQVAIEQILRVMFLDPERPSPVLDKLKRMLAEADAALEARKKPPEEKGPRVAGEGLVIDEWKERRERYLAQQQVQGVDSV

SEQ ID NO: 206962 - protein, 147 aa, Glycine max
  Coding DNA Sequence Number=SeqID_90184
  Homolog annotation: Hit_ID=Q9SBR5; Match level="QueryCoverage=54%, HitCoverage=87%, E-value=1e-15, Identity=55%"; Hit description =Putative wound-induced protein
  Subcellular localization annotation: CTP_CleavageSite=61; ConfidenceScore=5.20e-01
MSSTSRAWTWTVAASVGVVEALKDQGICRWNSVMRSAQQHAKHNMKSLSQTKKLSSQSSVMASAKLKDEKAKKSEESLRTEDEKWKTQKIHQSEKSFNSQPTPCYLHAMLEHLLIKPIESKAELRIYSLKHVFCLYLIDNHLWNDEI

SEQ ID NO: 206963 - protein, 97 aa, Glycine max
  Coding DNA Sequence Number=SeqID_90185
  Homolog annotation: Hit_ID=Q9SBR5; Match level="QueryCoverage=87%, HitCoverage=98%, E-value=2e-26, Identity=70%"; Hit description =Putative wound-induced protein
  Subcellular localization annotation: CTP_CleavageSite=59; ConfidenceScore=5.09e-01
MTDTWPSICKMMISSRRAWTVAVSVGVVESLKDQGLCRWNSTFKSAQQSVKSHMRSLSRANKLSSAMLSSTLLHGEKTKQSEESLRTVMYLSCWGPN

SEQ ID NO: 206964 - protein, 47 aa, Glycine max
  Coding DNA Sequence Number=SeqID_90186
  Homolog annotation: Hit_ID=Q2QTQ5; Match level="QueryCoverage=72%, HitCoverage=9%, E-value=5e-10, Identity=68%"; Hit description =Expressed protein
MDICLHGTNDDIVDWSHGKRLWELSNEKYDPLWVKGGVTRGVRRYVK

SEQ ID NO: 206965 - protein, 83 aa, Glycine max
  Coding DNA Sequence Number=SeqID_90187
VQNMEEGIKDGTPTKDNLISSSHKGSSSRIPGLSKPENRVAGNGYENVIHQASKCSNVDAADKFKKAEESLRTVMYLSCWGPN

SEQ ID NO: 206966 - protein, 122 aa, Glycine max
  Coding DNA Sequence Number=SeqID_90188
QNRGEACRSARPSEPGCFLQKQQPSGGIFWKAQLSKKLRKLTDCAKTSLFDFRHITKFHGSCKPASFRFLRRLGTSFIVQQRTPSISKRLTKDCMSSSNNPRTKLGYDNTIQTLKSVVRRLP

SEQ ID NO: 206967 - protein, 132 aa, Glycine max
  Coding DNA Sequence Number=SeqID_90189
MPISPCRCISWDRAYKTPSGPEEVQQGPGVSSSGYGPLSVLLGARSPSKEWHPQRHPVDPEKSNRALGFPALVVGLCQSYRVPVPPGKGSRPQDTQWTRRGPTGSWSCQALITGIGQFYGVPVAPSKSSAPY

SEQ ID NO: 206968 - protein, 131 aa, Glycine max
  Coding DNA Sequence Number=SeqID_90190
  Subcellular localization annotation: CTP_CleavageSite=31; ConfidenceScore=5.31e-01
MGQMATQLNQAQSQNSDKLPSQTMQNPKNVSAITLKSDNQIQVPPLVAAPAPEPVKLASTPEKEDDIVAQKRKLPNKKFHADCSTNKALFQDSLKTKPCLKTKCFQDMQGSGNRLPGSVIDYQKTGLRNSC

SEQ ID NO: 206969 - protein, 86 aa, Glycine max
  Coding DNA Sequence Number=SeqID_90191
  Subcellular localization annotation: CTP_CleavageSite=36; ConfidenceScore=5.18e-01
MKIYLCNSSASLKFLRARVFDLQNRRGKHSTLPGTNADSLGSVVLVSPSACKGNDACNASTPIKFLRARAFDIQNCICMHIVWDEC

SEQ ID NO: 206970 - protein, 34 aa, Glycine max
  Coding DNA Sequence Number=SeqID_90192
  Homolog annotation: Hit_ID=Q93XM3; Match level="QueryCoverage=99%, HitCoverage=10%, E-value=7e-07, Identity=76%"; Hit description =Nuclease
MPYGKAAKTELTKIVQDKPFRVLVYREDRYGRSV

SEQ ID NO: 206971 - protein, 74 aa, Glycine max
  Coding DNA Sequence Number=SeqID_90193
  Gene Ontology: Mol. function=amino acid transporter activity; Cellular component=membrane; Biological process=amino acid transport
  Homolog annotation: Hit_ID=Q9LZ20; Match level="QueryCoverage=96%, HitCoverage=16%, E-value=6e-17, Identity=68%"; Hit description=Amino acid transport-like protein
MTATATKSISLKPLGRDGTVRRHLAEEIPIVVPRYAIKPLATMALEIAASDGHVDYKLGVAEGGVEGAKAGNGN

SEQ ID NO: 206972 - protein, 82 aa, Glycine max
  Coding DNA Sequence Number=SeqID_90194
MGSKTTKRAVQFRLRQERGLRTIGRIELAYGRIEVKATRFLDLAQFLTKLHKISSTSSDMDNRSKEQLCACKVYVAGHLALG

SEQ ID NO: 206973 - protein, 63 aa, Glycine max
  Coding DNA Sequence Number=SeqID_90195
MRVSFVRTRELLLHKAAKSTAANNEKPQNGRERETLVLISQPPQEQGFKSWGTGKKNSHNSTI

SEQ ID NO: 206974 - protein, 208 aa, Glycine max
  Coding DNA Sequence Number=SeqID_90196
  Homolog annotation: Hit_ID=Q10BI2; Match level="QueryCoverage=88%, HitCoverage=93%, E-value=3e-19, Identity=31%"; Hit description =Expressed protein
  Pfam annotation: Domain name=DUF567; Domain location=19-201; Score =138.9; E_value=1.3e-38; Accession=PF04525.3; Description=Protein of unknown function (DUF567)
MEASAPELPMEVAHGFPMISVVEDSFCVTYPTEITVKKNYRGFFLNQRYEVLDVNGDLLLQVDGSSLDVRKKRVMRDAAGSPILTMREKVKLITLRHRWMVHRGKSSEEKDLIFGVQRSHPLDMKPRLDVFMATNINEDISSFQLVGSHSDKSCKVYKGDTMIAEVIGVYPRSNFSNWTESFKVKMNAGVDYAFIVALLVILTVNDYI

SEQ ID NO: 206975 - protein, 114 aa, Glycine max
  Coding DNA Sequence Number=SeqID_90197
  Homolog annotation: Hit_ID=Q1RXL8; Match level="QueryCoverage=90%, HitCoverage=40%, E-value=1e-09, Identity=38%"; Hit description=Amino acid/polyamine transporter II
MFVGFVLEEEVLCGNESKGTTHSGVLQEWFGINWWTSRAFALLIVARFIMFPLVMLRRVVHSIRAELGKVAHMGLATRISLTICVAIYFAIGFFGDSIMPDVLINFDQNSNTSS

SEQ ID NO: 206976 - protein, 82 aa, Glycine max
  Coding DNA Sequence Number=SeqID_90198
MYINSAELIAKRKAPEGKKARRRIIRGERERAHKMVSKEQKRAALHEKLQHLRSITNSHAVIPYIISSDIFLSIGFLREHSQ

SEQ ID NO: 206977 - protein, 187 aa, Glycine max
  Coding DNA Sequence Number=SeqID_90199
  Subcellular localization annotation: CTP_CleavageSite=74; ConfidenceScore=5.36e-01
MEASNERRVLPRRKPLSDRTNTSSPSAVPLKPLKTKTPSSAPAKCTATNLDSAPNPTSPSPSLKTPSPSLHEIVDVEASEPITVVYSRRRSSNKRKKDKGKTVAVPFTTTPNFKISHTCDTEDEFEGVNLPKAKAMTVPRTKKQRALSSEKDEFKDHQLQEFIQKQKAYFKEIDEFELEVESGDELD

SEQ ID NO: 206978 - protein, 55 aa, Glycine max
  Coding DNA Sequence Number=SeqID_90200
MKLRVRKFNREKKKKKNKARTTQFGLGNMNTSYGGLLIQYGLGLTVSFVSLGKIF

SEQ ID NO: 206979 - protein, 72 aa, Glycine max
  Coding DNA Sequence Number=SeqID_90201
MKEGGRVRDDGVAGPHDERKGKAEKREKSKGGIVVAESASGGRGVTVWAMVWLVSEEEQSKVVVTCCEVWPM

SEQ ID NO: 206980 - protein, 74 aa, Glycine max
  Coding DNA Sequence Number=SeqID_90202
MGGIAEQQKRKMKRKVKQGTSIELEKKIVVAFDTCARAHSIPTPRRVHGFSGPKRMYHGWDWIGTCKELKMAQN

SEQ ID NO: 206981 - protein, 436 aa, Glycine max
  Coding DNA Sequence Number=SeqID_90203
  Gene Ontology: Mol. function=indole-3-glycerol-phosphate synthase activity; Cellular component=chloroplast; Biological process =tryptophan metabolic process
  Homolog annotation: Hit_ID=Q9LUB2; Match level="QueryCoverage=86%, HitCoverage=87%, E-value=7e-90, Identity=69%"; Hit description =Indole-3-glycerol phosphate synthase
  Pfam annotation: Domain name=IGPS; Domain location=92-428; Score =232.0; E_value=1.3e-66; Accession=PF00218.12; Description=Indole-3 -glycerol phosphate synthase
  Subcellular localization annotation: CTP_CleavageSite=56; ConfidenceScore=5.72e-01
MEGLASLKAPFPATPFLSSRPRTSILPSQASFRKRSSFLSFSVHAQVESDDGSAVVATSGESVTEVLKIKEWEVGMFQNEVAASQGQYAPDILEEIVWNKDTEVSQLKERKPLGVLKKALENAPPARDFIGALKAANERTGLPGLIAEVKKASPSRGILREDFDPVVWSEDVVVVHRGGRIICHEDALVVGSSMSDCSVNMLADEFVISVRNMLCFLIEYLGLLVLLYQSMYHALQVEIAKAYEKGGAACLSVLTDEKYFKGSFENLEAIRKAGIKCPLLCKEFIIDAWQLYYARTKGADAVLLIAAVLPDLDIKYMIKICKLLGLTALVEVHDEREFDRVLAIEGIELIGINNRNLETFELDISITKKLLEGERGKIIHERGIIMVGESGLFTPDDIAYVQEAGVKAILVGESIVKQSDPGKGISNLFGKDISLG

SEQ ID NO: 206982 - protein, 505 aa, Glycine max
  Coding DNA Sequence Number=SeqID_90204
  Homolog annotation: Hit_ID=Q10LQ3; Match level="QueryCoverage=92%, HitCoverage=85%, E-value=2e-30, Identity=27%"; Hit description =Expressed protein
  Pfam annotation: Domain name=DUF827; Domain location=1-320; Score =39.1; E_value=1.9e-13; Accession=PF05701.2; Description=Plant protein of unknown function (DUF827)
EAAKLEKDLIVKELETLDVLEELGATKAILEELKQQLQSEALNCFATPGGNSYEQVGAAVQNCVNGINNEEQALQCQSPCATSSPDMFMMELGQAKISLGKTISDLGVIQSSVEALNKKMKKEKLFVERTREKLASKFATVSTQEVAKKETRLNPPEATVGTGCTCHHPLNIARSLKFDTGQCNLMSETRSSEVSRPLPEFGENGFSIKTAEMRWFAAKKMEEAAMAAEAVALAEIEALCNPEISLEFAPPQHQKVPFALGERSPLHPIVQIPQESTLEKVIDSKFQVDKISSSKLSILKKLEEATEEVTRSKQILNEALNSVESANRKQHAAEEALRRWIPQDDLRGQPVYNYIKPKKFNQAGNCQDSPLPDVTRSITVNNDQKPILKSSVSMRDVLSKKQVPEEYTTKEMEEHTERKVALSQMLRALRQDQTLPTIPEKDGSNQRQFIAQRKKFGFIQISLPLGKRRKRHEFNPIAYAWINIQNSCISVLPFFIDSYVLLLFC

SEQ ID NO: 206983 - protein, 87 aa, Glycine max
  Coding DNA Sequence Number=SeqID_90205
MVFPRLLKDGNRKGGGKVTECGVVASASGRGADVDASRPLHTQLHSQIGAGSGGSQLGCTVGGHALGRAVRVGATGRAGVAGASRPI

SEQ ID NO: 206984 - protein, 191 aa, Glycine max
  Coding DNA Sequence Number=SeqID_90206
MNLMLDGSVAEQDGVIVVRDFAAMAVTRSVSGAMGTTILSSGWWETAKGGGADVGAIVGGGLGGDGDGVGAVKVSTGGGASVGDELGGKGMGMRAKGRSRMMSSLAVISRVWVVMEERFKVRWYTASSRRSRVAWWLYGPNNLYMVVTNYYGSALPKLNQRGAPLSLFLHLLLKRTAQEQLENGQQKSQNH

SEQ ID NO: 206985 - protein, 447 aa, Glycine max
  Coding DNA Sequence Number=SeqID_90207
  Gene Ontology: Mol. function=phosphoinositide binding; Cellular component=multivesicular body; Biological process=cell communication
  Homolog annotation: Hit_ID=Q00V04; Match level="QueryCoverage=87%, HitCoverage=67%, E-value=4e-44, Identity=32%"; Hit description=[U] KOG2273 Membrane coat complex Retromer
  Pfam annotation: Domain name=PX; Domain location=87-213; Score=85.5; E_value=1.7e-22; Accession=PF00787.14; Description=PX domain
  Pfam annotation: Domain name=Vps5; Domain location=259-445; Score= -70.3; E_value=0.00055; Accession=PF09325.1; Description=Vps5 C terminal like
  Pfam module annotation: Pfam domain module=PX::Vps5; Domain location =87-213::259-445
MMNHDSNNEQHQILHVSQDDEIMESLILDDDSSSVQQHHRPTSPQSPNSPFNSFLDPPSYADAIFTSFDSNGHDQAIESPAARSGSEDYLHISVTDPQKEQDIATSLVPGAAAFYTYLITTRTNLPEYGGIGAEFAVRRRFRDVVTLSDRLSEAYRGFFIPVRPDKSTVESQVMQKQEFVEQRRVALEKYLRKLAAHPVIGRSEELRLFLEAKGRLPLAKTFDVASRMLDGAVRLPRQLFGGEAELGEVAQPAKGGRDLLRIFKELKQSVANDWVGSKPLVVEEDKEFMERKDKLVDFEHHLSNVSQQAESLVKFQQDMGETVGELGLAFVKLTKFETEEAIFESQRVRAADMRNVATAADKLHEYLGTMLAVNNAFSDRSSALLTVQTLSSELASLHSRVEKLEVASSKIFGGDKSRMRKIEELKEAIRVTENAKICADREYERIK

SEQ ID NO: 206986 - protein, 58 aa, Glycine max
  Coding DNA Sequence Number=SeqID_90208
  Pfam annotation: Domain name=GRP; Domain location=1-56; Score=-24.7; E_value=0.025; Accession=PF07172.2; Description=Glycine rich protein family
MNTKPVFFLCFLCALLLISVVATEPSKDETQAEEPKTQLDAWGRGGSGGPDGSWGGIL

SEQ ID NO: 206987 - protein, 51 aa, Glycine max
  Coding DNA Sequence Number=SeqID_90209
MRREERQYVCGDWPEAQAGEAPAGTPDDAEEARMDEQMTDLLGFMGGSRAT

SEQ ID NO: 206988 - protein, 317 aa, Glycine max
  Coding DNA Sequence Number=SeqID_90210
  Gene Ontology: Mol. function=DNA binding; Biological process =regulation of transcription, DNA-dependent
  Homolog annotation: Hit_ID=Q1S2M5; Match level="QueryCoverage=21%, HitCoverage=17%, E-value=3e-08, Identity=37%"; Hit description =Transcriptional factor B3; Cupredoxin
  Pfam annotation: Domain name=B3; Domain location=6-103; Score=39.2; E_ value=1.5e-08; Accession=PF02362.12; Description=B3 DNA binding domain
MAAKKYFVTVFKPEEHSESMLIPDAFVKSTRLQGWRIPEDVILTNVGRRVWNVKTRLVGNKIYFEEGWKVFQEENFLGKEDYLVFKYDGANIFKVVILEQSSRCERTEAEEEDEVIEITDDEEHEEAEDDEDEGDDDDQYREMEEEHSAEYMRSQSHPRRASKRLSATSYSPTVEGPHLEDYEFDPQMYIQPGNPNFEAKLFKNRPNELHVPKNVIKDSSLTFGEQITLSRCQCFQFEDTQRDELRDYHGLPQWTPIYSEVAKVSEWRDGRVCIKGWTSFCKKNKINKNDACICEIISGEDRIIRTIQVHVLGARNG

SEQ ID NO: 206989 - protein, 797 aa, Glycine max
  Coding DNA Sequence Number=SeqID_90211
  Gene Ontology: Mol. function=protein-tyrosine kinase activity; Cellular component=integral to membrane; Biological process=protein amino acid phosphorylation
  Homolog annotation: Hit_ID=Q8L3Y5; Match level="QueryCoverage=98%, HitCoverage=92%, E-value=0.0, Identity=68%"; Hit description =Receptor-like kinase RHG1
  Pfam annotation: Domain name=LRRNT_2; Domain location=16-58; Score =30.4; E_value=6.1e-06; Accession=PF08263.3; Description=Leucine rich repeat N-terminal domain
  Pfam annotation: Domain name=LRR_1; Domain location=109-131; Score =11.5; E_value=2; Accession=PF00560.23; Description=Leucine Rich Repeat
  Pfam annotation: Domain name=LRR_1; Domain location=133-155; Score =14.8; E_value=0.32; Accession=PF00560.23; Description=Leucine Rich Repeat
  Pfam annotation: Domain name=LRR_1; Domain location=157-176; Score =9.8; E_value=4.2; Accession=PF00560.23; Description=Leucine Rich Repeat
  Pfam annotation: Domain name=LRR_1; Domain location=178-200; Score =17.3; E_value=0.056; Accession=PF00560.23; Description=Leucine Rich Repeat
  Pfam annotation: Domain name=LRR_1; Domain location=207-229; Score =16.1; E_value=0.13; Accession=PF00560.23; Description=Leucine Rich Repeat
  Pfam annotation: Domain name=LRR_1; Domain location=231-253; Score =17.2; E_value=0.059; Accession=PF00560.23; Description=Leucine Rich Repeat
  Pfam annotation: Domain name=LRR_1; Domain location=255-277; Score =14.0; E_value=0.54; Accession=PF00560.23; Description=Leucine Rich Repeat
  Pfam annotation: Domain name=LRR_1; Domain location=279-301; Score =11.8; E_value=1.8; Accession=PF00560.23; Description=Leucine Rich Repeat
  Pfam annotation: Domain name=LRR_1; Domain location=303-325; Score =14.1; E_value=0.51; Accession=PF00560.23; Description=Leucine Rich Repeat
  Pfam annotation: Domain name=LRR_1; Domain location=327-349; Score =18.2; E_value=0.029; Accession=PF00560.23; Description=Leucine Rich Repeat
  Pfam annotation: Domain name=LRR_1; Domain location=351-374; Score =8.5; E_value=7.4; Accession=PF00560.23; Description=Leucine Rich Repeat
  Pfam annotation: Domain name=LRR_1; Domain location=85-107; Score =13.2; E_value=0.93; Accession=PF00560.23; Description=Leucine Rich Repeat
  Pfam annotation: Domain name=Pkinase; Domain location=506-774; Score =109.9; E_value=7.2e-30; Accession=PF00069.15; Description=Protein kinase domain
  Pfam annotation: Domain name=Pkinase_Tyr; Domain location=505-774; Score=100.8; E_value=4e-27; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR _1::Pkinase::Pkinase_Tyr; Domain location=16-58::109-131::133 -155::157-176::178-200::...
  Pfam module annotation: Domain location=207-229::231-253::255 -277::279-301::303-325::327-349::351-374::85-107::506-774::505-774
MVPVASEERWDGVVVTQSNFLALQAFKQELVDPKGFLRSWNDSGYGACSGAWVGIKCAQGQVIVIQLPWKGLKGHITERIGQLRGLRKLSLHDNQIGGSIPSALGLLLNLRGVQLFNNRFTGTIPPSLGSCPLLQSLDLSNNLLTGTIPMSLGNATKLYWLNLSFNSLSGPMPTSLTSLTYLSLQHNNLSGSIPNSWGGSLKNNFFRLRNLIIDHNLLSGSIPASLGGLSELTEISLSHNQFSGAIPNEIGNLSRLKTLDFSNNALNGSLPAALSNVSSLTLLNVENNHLGNQIPEALGRLHNLSVLVLSRNQFSGHIPQNIGNISKLRQLDLSLNNLSGEIPVAFDNLRSLSFFNVSHNNLSGPVPTLLAQKFNSSSFVGNIQLCGYSPSTTCPSLAPSGSPPEISEHHHHKKLGTKDIILIVAGVLLVVLVTICCILLFCLIKKRATSNAEGGQATGRASAAAAGRTEKGVPPVAGEAEAGGEVGGKLVHFDGPLTFTADDLLCATAEIMGKSTYGTVYKATLEDGSQAAVKRLREKITKGQREFESEVSIIGRIRHPNLLALRAYYLGPKGEKLLVFDYMPNGSLASFLHSRGPETAIDWPTRMKIAQGMAHGLLYLHSRENIIHGNLTSSNVLLDENVNAKIADFGLSRLMTTAANSNVIATAGALGYRAPELSKLKKANTKTDVYSLGVILLELLTGKPPGEAMNGVDLPQWVASIVKEEWTNEVFDVELMRDASTYGDEMLNTLKLALHCVDPSPSARPEVQQVLQQLEEIRPEISAASSGDDGAIPSTSE

SEQ ID NO: 206990 - protein, 83 aa, Glycine max
  Coding DNA Sequence Number=SeqID_90212
  Gene Ontology: Mol. function=phosphoinositide binding; Biological process=cell communication
MSKIRNVSENNRSELERIDQERNSDFLSMLRGFVVNQVKLIYLLCFNSNYSTSSILQAGYAEKTASVWEKLAEETAAYSSDSS

SEQ ID NO: 206991 - protein, 109 aa, Glycine max
  Coding DNA Sequence Number=SeqID_90213
MRKNTKQLRTRKRMRMRIRMMMMTTIIMSIKKWKKKVKKKIVLNTRGVKLIIVEPAKGRMQQVPLPPMIGGLLHEDYEFDHKCIFSLQDYNLQSWVKVELVAFSPKPDK

SEQ ID NO: 206992 - protein, 134 aa, Glycine max
  Coding DNA Sequence Number=SeqID_90214
  Gene Ontology: Mol. function=nucleic acid binding; Cellular component= chromatin; Biological process=RNA-dependent DNA replication
MGVEEFLDWQIDVDRFFDVMDVPEHKQVKMVAIRLKSTAAVWWDRLVVQRTRQRKNPIRTWRKMKQLMLERFLPEDYEQILYKMYIECVQGKRSVTEYTAEFLRFSERNELGESENQKVARYISGLKGSLQEKM

SEQ ID NO: 206993 - protein, 247 aa, Glycine max
  Coding DNA Sequence Number=SeqID_90215
  Homolog annotation: Hit_ID=Q9FKW5; Match level="QueryCoverage=49%, HitCoverage=28%, E-value=7e-20, Identity=77%"; Hit description =Arabidopsis thaliana genomic DNA, chromosome 5, TAC clone:K2A18
MEVISASSLNPNAPMFVPLAYRTVEDFSDQWWDLVHSSPWFRDYWLRECFQDPQYQYDDVFDFDFDLDLQDKDENEGKEGKEVVSLGVLKWRSCGGGWAEAPRYVEKAPKFVKPKKLQQRWHASFFDDEFPVTVVVASKGDEGSGCVGTFVQGSTGEKNGDLFPDEAENGLVGGDGREAQVLVVALVGGGTWDARRGRCCSWRPGGGGPPTSQFWISAPDIPVGNSGPLPQASKPGPPFVSGSPGPP

SEQ ID NO: 206994 - protein, 91 aa, Glycine max
  Coding DNA Sequence Number=SeqID_90216
  Gene Ontology: Mol. function=DNA topoisomerase type I activity; Cellular component=chromosome; Biological process=DNA unwinding during replication
  Homolog annotation: Hit_ID=Q9SKZ9; Match level="QueryCoverage=78%, HitCoverage=8%, E-value=3e-19, Identity=62%"; Hit description =Putative DNA topoisomerase III beta
MTEVEAGRLVGVRGIHEGVQAGRELVPTTLGITLVRGYQTIDPDLCLPDVRSFIEQQITLIAKGQVDHGHVVQHVIQQFTQKFSYFVKKVG

SEQ ID NO: 206995 - protein, 580 aa, Glycine max
  Coding DNA Sequence Number=SeqID_90217
  Gene Ontology: Mol. function=RNA-directed DNA polymerase activity; Cellular component=chromatin; Biological process=chromatin assembly or disassembly
  Homolog annotation: Hit_ID=Q94I07; Match level="QueryCoverage=98%, HitCoverage=56%, E-value=1e-161, Identity=40%"; Hit description =Putative retroelement
  Pfam annotation: Domain name=rve; Domain location=270-427; Score =111.0; E_value=3.4e-30; Accession=PF00665.16; Description=Integrase core domain
  Pfam annotation: Domain name=zf-H2C2; Domain location=216-253; Score =4.7; E_value=0.086; Accession=PF09337.1; Description=His(2)-Cys(2) zinc finger
  Pfam module annotation: Pfam domain module=rve::zf-H2C2; Domain location=270-427::216-253
EQSFALIKEKLCTAPVLALPDFDKVFQVECDASGIGIGAVLSQEKKPIAFFSEKLSEARRKWSTYDQEFYAVFRALRQWEHYLIHREFILFTDHQALKFLHSQKLINKMHARWVSFLQKFPFIIQHKSGALNKVADALSRRDSLLVTLAQEVVGFECLKELYENDAEFQELWAKCREHPCDDFHVREGFLFKGNRLCIPCSSLREKLIRDLHGGGLSGHMGRDKTIASLEERFYWPHLRKDAGTIVKKCYTCQVSKGQSQNTGLYMPLPIPDDIWQDLAMDFVLGLPRTQRGVDSVFVVVDRFSKMSHFIACKKTADASNIAKLFFREVVRLHGVPKSITSDRDTKFLSHFWITLWKLFDTSLNRSSTAHPQTDGQTEVTNRTLGNMIRCVCGDKPKQWDLALPQVEFAYNSTMHSATGKTPFSLVYTSVPRHVVDLIKLPKAPGFSVAAENMAEEIIAVKDSVKSKLEATGLKNKIAADKRRRVKVFNVGDEVMVFLRKERFPVGTYSKLQPRKYGPFQVTRKINDNAYVVALPASMNISNTFNVADIYEYHADEVLYRDENSGSSSFEVEETDVGGFI

SEQ ID NO: 206996 - protein, 266 aa, Glycine max
  Coding DNA Sequence Number=SeqID_90218
  Gene Ontology: Mol. function=prephenate dehydrogenase (NADP+) activity; Cellular component=cytoplasm; Biological process=tyrosine biosynthetic process
  Homolog annotation: Hit_ID=Q1S123; Match level="QueryCoverage=98%, HitCoverage=98%, E-value=1e-116, Identity=79%"; Hit description =Prephenate dehydrogenase
  Pfam annotation: Domain name=PDH; Domain location=10-264; Score= -33.2; E_value=8.7e-07; Accession=PF02153.8; Description=Prephenate dehydrogenase
  Subcellular localization annotation: CTP_CleavageSite=32; ConfidenceScore=5.13e-01
MSTWSLKIGVVGFGSFGQFLAKTMIKQGHTLRATSRTDYSLLCLPMGIQFFRDVAAFLEADNDVILVCTSILSLSEVLSSMPLTCLKRSTLFVDVLSVKEHPRNLLIKVLPEESDILCTHPMFGPDSGKDGWQDLTFVYDKVRIRDEAICSSFLHIFASEGCRMLQMSCEEHDKIAAKSQFITHTIGRTLAEMDIKSTPIDTKGFHSLVQLKDTTIRDSFDLYSGLFLHNRFAVQELENLEHALHKVKEMLVQRKSEELGLEKTEC

SEQ ID NO: 206997 - protein, 77 aa, Glycine max
  Coding DNA Sequence Number=SeqID_90219
  Gene Ontology: Mol. function=nucleic acid binding
  Homolog annotation: Hit_ID=Q93XM3; Match level="QueryCoverage=92%, HitCoverage=23%, E-value=7e-15, Identity=53%"; Hit description =Nuclease
MFLSRYRKLVDAWKEAKPPPKTPDEAARLVIQTLKRHQKADVEGFMVFLYHTPLFKGTAQPPSSFPNGVQLKCTHCP

SEQ ID NO: 206998 - protein, 362 aa, Glycine max
  Coding DNA Sequence Number=SeqID_90220
  Homolog annotation: Hit_ID=Q9FMU1; Match level="QueryCoverage=77%, HitCoverage=74%, E-value=9e-24, Identity=32%"; Hit description =Arabidopsis thaliana genomic DNA, chromosome 5, P1 clone:MUA22
MKLLGWMHRKFRQNSAEVPFKDLIIGGGNSCDEEHNNYPKASFGNYKHVKQQSHLQKEVRKSLDHDEYEEDSAGAMYELFHGFLAIGTLGSEASTTPTFAISVENITEKEDEVTENELKLINDELEKVLVLGPDHDESSSISCGRSSHGSIITLSGGGGKPAAATLLEDQSNGNAVCPLQGYLFGSAIELSETTTTVAKKEHRTSLGELFQRTKLADQENNNFGPPKDQADKSAMHLMKKKLKKKMRSSTSTTVDSASAADRKLHKILHMFHRKVHPENSTGAQKCDKYQKKKTMNEGEGEGEEDILMMQPKRAVLSTENYMRQYKIQPNPLLGSCEEDSSENKEHWIKTDADCKYTIISPL

SEQ ID NO: 206999 - protein, 53 aa, Glycine max
  Coding DNA Sequence Number=SeqID_90221
MCLKVACDIPIHHKVHISCQEGFQIPKKRTLKDDVVLDKWCRYCAQRTGEVKI

SEQ ID NO: 207000 - protein, 365 aa, Glycine max
  Coding DNA Sequence Number=SeqID_90222
  Gene Ontology: Mol. function=protein phosphatase type 2C activity; Cellular component=nucleus; Biological process=protein amino acid dephosphorylation
  Homolog annotation: Hit_ID=Q1SK22; Match level="QueryCoverage=95%, HitCoverage=91%, E-value=1e-104, Identity=54%"; Hit description =Protein phosphatase 2C-like
  Pfam annotation: Domain name=PP2C; Domain location=52-332; Score =144.1; E_value=3.8e-40; Accession=PF00481.12; Description=Protein phosphatase 2C
  Subcellular localization annotation: CTP_CleavageSite=48; ConfidenceScore=5.33e-01
MGSCLSVSGASASVDAFDESSSNSSSRTASDYNMEMRLHRVPGRLFLNCSSQVASLFCKQGRKGINQDAMLLWDNFSSNKDTVFCGVFDGHGPHGHMVAKKLRDSFPLKLIAQWNLLHPNNNSSSNNNSDTPCAVAPGNIGTLRDSFVKACKVMDRELKVQHQIDCSCSGSTGLTLLKQGQDLVIANVGDSRAVLATQDRSNGSLVAVQLSTDHKPHLPREAERIRICKGRVFSIKNESGIPRVWLPNIDSPGLAMSRAFGDFCLKDFGVISVPDFSYHRLTQRDQFVVLATDGVWDVLSNEEAVAIISSAPRSSAARMLVEAAIHAWKTKLPLTKVDDCSVVCLFFHSDSDSDSLRLEPQQNHQ

SEQ ID NO: 207001 - protein, 402 aa, Glycine max
  Coding DNA Sequence Number=SeqID_90223
  Gene Ontology: Mol. function=carbohydrate binding; Cellular component= chloroplast; Biological process=carbohydrate metabolic process
  Homolog annotation: Hit_ID=Q6ZY51; Match level="QueryCoverage=72%, HitCoverage=24%, E-value=1e-118, Identity=72%"; Hit description =Phosphoglucan, water dikinase, chloroplast precursor
  Pfam annotation: Domain name=PPDK_N; Domain location=12-332; Score= -53.5; E_value=1.1e-09; Accession=PF01326.9; Description=Pyruvate phosphate dikinase, PEPpyruvate
MVVKMILEDAYAILIFSDQNHRLTVYSDQGVSASFRVPSGAVLPFGSMELELEKSNSTEAFRSILEKIETAKQEGGELDVLCHQLQELISSLKPSNDFIESIGRIFPSNARLIVRSSANVEDLAGISAAGLYESIPNASPSNPTVFGNAVSQVWASMYTRRAVLSRRATGVPQKEASMAVLIQEMLSPDLSFVLHTVSPTNQDNNCVEAEIASGLGETLASGTRGTPWQISSGKFDGQVKTLAFANFSEELLVRGEGPADGEVIRLTVDYSKKPLTVDSVFRRQLGQRLCAVGFFLERKFGCPQDVEGCLVGKDIFIYTFNTGSTYFCIAPELCSPDGNGMKFDFDKLLDMKSAVTVDLSTIVSCVKLKGVLKPGVFIPKAYTPKSPSGSLPPDSGPTQKIF

SEQ ID NO: 207002 - protein, 59 aa, Glycine max
  Coding DNA Sequence Number=SeqID_90224
  Homolog annotation: Hit_ID=Q0KJ40; Match level="QueryCoverage=90%, HitCoverage=8%, E-value=1e-18, Identity=77%"; Hit description=Ku70 homolog
MVFAVAFSGSSSRPQLVALIAQEEVIQSGGQIEPPGMHMIYLPYSDDIRFVEEVENCNI

SEQ ID NO: 207003 - protein, 495 aa, Glycine max
  Coding DNA Sequence Number=SeqID_90225
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=Q0KJ40; Match level="QueryCoverage=94%, HitCoverage=49%, E-value=3e-99, Identity=78%"; Hit description=Ku70 homolog
  Pfam annotation: Domain name=Ku_N; Domain location=35-271; Score =201.4; E_value=2.2e-57; Accession=PF03731.5; Description=Ku70Ku80 N -terminal alphabeta domain
MDLDGDDNDNDIFRDDEDDPQAQLSLLENESSKEYVVYLVDASPKMFSTTCPAEEDDQNGETHFHIAISCISQTLESQIINRSYDQVAICFFNTREKNNLQDLNSVFVFNVPEREFLDRPTARLIKEFYQLEESFSKIIGSQHGIVSGTRENSLYNAIWAAQALLRKGSAKTVDKRILLFTNDDDPFGSIKGAVKSDMTRMTLQRAKDAQDLGISIELLPLSHPDEVFNVSQFYADLIGLEGDDLVDFMPSAGKKHSKSRIKGPGWNQCNSRVGTVPRHCGFVFRKEADDKENAEGEGAEKQKEDIKPELVVMQYDLLNRLYSAKYSEIASSGKLDRSSDVSKIFSPISFGRCGHHIGNFVAGEVGIYEDRNKVSPNALLREQQQESFILPVEVGYMDLPTTFGTVKNQRLEDMKDQLRKRMFTKRIVKRLKFMIVNGISIELNSYALIRPTVPGAITWLDSVTNHPLKIERTFICVDTGALVEEPTKRFLPYKK

SEQ ID NO: 207004 - protein, 302 aa, Glycine max
  Coding DNA Sequence Number=SeqID_90226
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=endoplasmic reticulum; Biological process=peptidyl-proline hydroxylation to 4 -hydroxy-L-proline
  Homolog annotation: Hit_ID=Q337H1; Match level="QueryCoverage=40%, HitCoverage=42%, E-value=1e-29, Identity=53%"; Hit description =Prolyl 4-hydroxylase alpha subunit, putative, expressed
MAPAMRIVFGLLTFVTVGMIIGALSQLAIIRRLEDSHGTDSLPFSRLRGLDTDRHLQLPRGIPFWNNDKEAEVLRLGYVKPEVLNWSPRIILLHNFLSMEECDYLRAIALPRLHISNVVDTKTGKGIKSDVRTSSGMFLNPQERKYPMVQAIEKRISVYSQIPIENGELMQVLRQFNLKRGGQRIATMLMYLSDNIEGGETYFPLFAYYGHYPRTPNDYKEKHLTPHTYKHPALADLAIGQPYYSCDRKCQCSRVLNHGESVIVCAMDFLAGWKIYDGKLSTCLVRDWMDSQIRIVCMEDVR

SEQ ID NO: 207005 - protein, 61 aa, Glycine max
  Coding DNA Sequence Number=SeqID_90227
MKVLNEFTATMQQPSYIIQDIHGPSIQVEEPVCGQNGLAGFLHAIVLFMKLSNQKLVMLFN

SEQ ID NO: 207006 - protein, 598 aa, Glycine max
  Coding DNA Sequence Number=SeqID_90228
  Gene Ontology: Mol. function=D-alanyl-D-alanine endopeptidase activity; Cellular component=integral to membrane
  Homolog annotation: Hit_ID=UPI0000162C76; Match level="QueryCoverage =89%, HitCoverage=82%, E-value=2e-62, Identity=53%"; Hit description =D-alanyl-D-alanine endopeptidase/ peptidase
  Pfam annotation: Domain name=PA; Domain location=65-160; Score=57.1; E_value=5.7e-14; Accession=PF02225.12; Description=PA domain
  Pfam annotation: Domain name=Peptidase_A22B; Domain location=442-594; Score=-95.1; E_value=2.2e-05; Accession=PF04258.4; Description=Signal peptide peptidase
  Pfam module annotation: Pfam domain module=PA::Peptidase_A22B; Domain location=65-160::442-594
MASSPSLAVAVVVLLLLALFAAAAADDASCHHDLQLVKIKSWIDGKKDVDYNGMTARFSSYLPEDADQASKTPALFSDPIDCCSSSTSKLSGSVALCVRGTCDFTTKATFAQSAGATATLMINNADELFEMECSNYTRINISIPVVEITKSTGDTLNKLLTSKSKDYVSTKKDIQFLSNSNCRSDNQHCKWNNDIEAPIWHLEMDLIAEQSWPIDLRERIENLIMNVGVLPRMEFAMAGIVEWTILDWTILLQRTQKRNLEYQVQVIMINDCSTPSGVIVTIKELCDKCLTRLIRGMRYYVEERSGSCGEGLGTRVLGLLDHVGELLMGSDEASEYYPQSSIISGKIAYWFGTVTSHRTHGCLSCATEGSREVGIGEYSSWVEILLYAPTRPVVDYSVAFLWLMAVGTVICASLWSDITAPDQTDERYNELSPKSLSEAGKDDSEDLVNIDTKGAIVFVITASTFLVLLFFFMSSWFIWVLIILFCIGGIEVARGDKAGGEAIPMLLRFPRLSDPWGGYDMIGFGDILFPGLLVSFARRPLLHISGAIYDERSWTTCTAVPGSMYTSTFGAMMQTPPPRLSPKSLLKFRWQLRNGNVL

SEQ ID NO: 207007 - protein, 428 aa, Glycine max
  Coding DNA Sequence Number=SeqID_90229
  Gene Ontology: Mol. function=triacylglycerol lipase activity; Biological process=lipid metabolic process
MYKKWLCLSRCSAVLIVLQFLSAAYLVLTSSHHFSTSHSNHHCLLESKWNHTPVSIFIILVSSVAVLQCFTGSDIIKWRSFYETHDHAWKCHYSEVFDHGIRETLCCLGRLQYLTTSEEDEVYSVARLLADLVAYRASGTGHMELLAALALLQSHGNSTESYEESMEAPEMKIREAEALHKFAEAAYTGPLLDVGRNPFVFPCAWLYRQGILSPWTRNRYATCLEGSTVSGLIDPPLFPFHKSMHNMIYVPISHLLRRPVLDGDNWWRGHAAAFLKYVNLPPEALRHGRVSQVKCEAAYFIVVLHQLQSVVIAIRGTETPEDLITDGLCKECTLSVDDLAGLINCNYIHSNIKKNVTSSFPHYGHSGIVEAARELFMQIEGNPEGPDSESYGLLSKLLGFGCECFGYNVRIVGHSLGGAIAALLGLQV

SEQ ID NO: 207008 - protein, 133 aa, Glycine max
  Coding DNA Sequence Number=SeqID_90230
  Gene Ontology: Mol. function=transcription regulator activity; Cellular component=nucleus; Biological process=regulation of transcription
  Homolog annotation: Hit_ID=Q8LDA7; Match level="QueryCoverage=59%, HitCoverage=22%, E-value=1e-33, Identity=86%"; Hit description =Contains similarity to bHLH transcription factor GBOF-1 from Tulipa gesneriana gb|AF185269
  Pfam annotation: Domain name=HLH; Domain location=28-76; Score=35.6; E_value=1.7e-07; Accession=PF00010.16; Description=Helix-loop-helix DNA-binding domain
MSTVDKLLHIPEDSVPCKIRAKRGCATHPRSIAERERRTRISGKLKKLQDLVPNMDKQTSYADMLDLAVQHIKGLQTQVQVKMLEKRASKLEEEVCEMINRAEKEPLSLLELIDNVQRLGLTYKFEKDIIKAL

SEQ ID NO: 207009 - protein, 148 aa, Glycine max
  Coding DNA Sequence Number=SeqID_90231
MSGSLVLVLERLVEVAEKAMELLSQGSIPKVVLEGSTLTVLERDSWKKGRKKGTMVIGEMGKEAGGRAFLAEQGGSEGGGVVVERSLLFAGRLRRLSGKVGTGTGSTNKRINRAGEKRTGGGTVASEASLGHGLRGRGGGGRGRGIHG

SEQ ID NO: 207010 - protein, 395 aa, Glycine max
  Coding DNA Sequence Number=SeqID_90232
  Gene Ontology: Mol. function=DNA binding; Cellular component =membrane; Biological process=DNA integration
  Homolog annotation: Hit_ID=Q1SS72; Match level="QueryCoverage=95%, HitCoverage=27%, E-value=5e-67, Identity=34%"; Hit description =Integrase, catalytic region
  Pfam annotation: Domain name=zf-CCHC; Domain location=247-264; Score =8.1; E_value=0.045; Accession=PF00098.13; Description=Zinc knuckle
  Pfam annotation: Domain name=zf-CCHC; Domain location=285-302; Score =9.9; E_value=0.023; Accession=PF00098.13; Description=Zinc knuckle
  Pfam module annotation: Pfam domain module=Retrotrans_gag::zf -CCHC::zf-CCHC; Domain location=76-191::247-264::285-302
MNELTPNTESYLYLHPSENPAVALVSPDLDSNNYHSWSRSMITALSAKNKVEFVNGNAPEPLKTDRTYGAWSRYNNMVVSWIVHSVSISIRQSVLWMDKAEEIWKDLKSRYAQGDLLRISDLQQDASSMKQGTISITEYFTKLRIIWDEIENFRPDPICSCTIKYTCSVLTTIAQRKLEDRAMQFLHGLNEQYGNVRSHVLLMDPMPTIPKIFLYVAQQERQLSSNNSLPNFNLEAKESSSINVVKIVCEFCRRVGHTESVCYKKHGVPSNYDGKSKGYNERNGKTCIHCGKIDHTVDVCYKKHGFPPGYKFSNGKAIANNIVAVEGKAKDDQIQRHESQELVRFSPEQYKALLALIQQPPSGNSAPTQSQVASISSCSPNTTSGYQHPSEDWYS

SEQ ID NO: 207011 - protein, 98 aa, Glycine max
  Coding DNA Sequence Number=SeqID_90233
  Gene Ontology: Mol. function=magnesium ion binding; Cellular component=chloroplast; Biological process=metabolic process
  Homolog annotation: Hit_ID=Q50L36; Match level="QueryCoverage=93%, HitCoverage=16%, E-value=2e-26, Identity=54%"; Hit description =Isoprene synthase
MFPQPQFNNCHNEITKVGILLVILDDVYDIYGTLDELELFTNAVERWKVNSVNTLPDRLVLCLMAVYNTVNAMVYEIFKGRGIKILPYLTKVVCNATQ

SEQ ID NO: 207012 - protein, 54 aa, Glycine max
  Coding DNA Sequence Number=SeqID_90234
MVSMTMMTVIVIERWWGEIVVTMNGGGEDGQQEIVVVMTMVVTMAVMMVVTMTL

SEQ ID NO: 207013 - protein, 46 aa, Glycine max
  Coding DNA Sequence Number=SeqID_90235
MGNMGVAKNPMRKKRAWSKEHCGFFVWARRCSKGSSQWGMIHKKGQ

SEQ ID NO: 207014 - protein, 123 aa, Glycine max
  Coding DNA Sequence Number=SeqID_90236
  Gene Ontology: Mol. function=lipid binding; Cellular component =nucleus; Biological process=endocytosis
  Homolog annotation: Hit_ID=Q93YP4; Match level="QueryCoverage=100%, HitCoverage=10%, E-value=1e-45, Identity=72%"; Hit description=Epsin- like protein
  Pfam annotation: Domain name=ENTH; Domain location=23-123; Score =93.0; E_value=9.3e-25; Accession=PF01417.11; Description=ENTH domain
MKKAIGQTVRELKREVNKKVLKVPGIEQKVLDATNNEAWGPHGSLLADIAQASRNFHEYQMIMAVIWKRINDTGKNWRHVYKNGAYVYALIVQQQALTVLEYLVANGSERVIEEIREHAHQIS

SEQ ID NO: 207015 - protein, 252 aa, Glycine max
  Coding DNA Sequence Number=SeqID_90237
  Gene Ontology: Mol. function=transferase activity, transferring glycosyl groups; Cellular component=membrane
  Homolog annotation: Hit_ID=Q9FN55; Match level="QueryCoverage=81%, HitCoverage=39%, E-value=2e-45, Identity=45%"; Hit description =Arabidopsis thaliana genomic DNA, chromosome 5, P1 clone:MYC6
  Pfam annotation: Domain name=DUF604; Domain location=141-251; Score= -49.6; E_value=1.9e-10; Accession=PF04646.3; Description=Protein of unknown function, DUF604
  Pfam annotation: Domain name=Fringe; Domain location=5-242; Score= -98.8; E_value=0.069; Accession=PF02434.7; Description=Fringe-like
  Pfam module annotation: Pfam domain module=DUF604::Fringe; Domain location=141-251::5-242
  Subcellular localization annotation: CTP_CleavageSite=16; ConfidenceScore=5.28e-01
ISRLSPTTRRHLLFSVASSSTSWPRRLPYINLWYSPATTRALAFLDKTPPNATSADDSSPPLVISGDTSSFPYTFRGGLRSAIRVARAVKEAVDRNETDVRWFVFGDDDTVFFVDNVVRALARYDHSKWFYVGSNSESYEQNVKYSFEMAFGGGGFAISYSLARVLARVLDSCLRRYGHLYGSDSRIYSCIAELGVALTHEPGFHQEMGSENQLGLFPHLVPHNMPNQVLKCAEEFIDVPLTILFLTSFVDI

SEQ ID NO: 207016 - protein, 474 aa, Glycine max
  Coding DNA Sequence Number=SeqID_90238
  Gene Ontology: Mol. function=transferase activity, transferring glycosyl groups; Cellular component=membrane
  Homolog annotation: Hit_ID=Q6ZJW6; Match level="QueryCoverage=89%, HitCoverage=86%, E-value=1e-82, Identity=40%"; Hit description =Putative fringe-related protein
  Pfam annotation: Domain name=DUF604; Domain location=196-448; Score =464.4; E_value=1.5e-136; Accession=PF04646.3; Description=Protein of unknown function, DUF604
  Subcellular localization annotation: CTP_CleavageSite=87; ConfidenceScore=5.09e-01
MQLFHKPTKGQSLVNLILVSSSFCALYLIVSVLLLGPSKLVHVNRSSQDVSTPTTIDHLVFGIASSTSSWGKRKEYVKLWWNNTNTKKAMKGCVFLDSLSDEDNARNANDTSLPPLCVSQDTSRFRFTHKGGLRSAIRVARVVAETVALYNDSDVRWYVFGDDDTVFFPENVQKTLSKYDHELWYYIGAHSEVYEQNRVFGFGMAFGGAGFAISSSLAKVLAKVFDSCIERYPHLYGSDGRVYSCLAELGVGLTHEPGFHQVDLKGNTFGLLASHPLTPLLSLHHPDYTDPIFPNMTTKQALNHLLEAVNVDSQRMLQQAICYDKWFSWTVSVSWGYAVQVFPNHMLLPDVLKVQETFKQWRKGNMLAKSYTFNTRELHPDPCKRSTVFFLDNVSSGKDGIISSYKKSFQNCSIDDVSPKKLEVIKVVTNRLDLDIKQLHAPRRHCCDVLHSTARDKMEIAIRECEDEELVYMH

SEQ ID NO: 207017 - protein, 231 aa, Glycine max
  Coding DNA Sequence Number=SeqID_90239
  Homolog annotation: Hit_ID=Q93YP4; Match level="QueryCoverage=88%, HitCoverage=20%, E-value=6e-19, Identity=34%"; Hit description=Epsin- like protein
MEICGFLNLEEICNCPAWFTRFRSNSTGGMYRPGSFSSSGSYGDRYEDDRYGSMEEDRSGYGYGREKEWGYRDDDRYGRDGYRDDEYRRRSVDDDQYGSRSRRSFRDRDHNFNDDGQHSSRGSSAKAEDHSLEGRLERKLSEQNVSAPPSYEEAVSQSPLHYERDGGISAASAPKGSSPVSDNPRQTSAPTGSSLLSDNPTEATAAASTATSGNREVKAFDEFDPRGPPVS

SEQ ID NO: 207018 - protein, 51 aa, Glycine max
  Coding DNA Sequence Number=SeqID_90240
MRVRVSVCGSIVASAMDRKRGRPEAAFNFNGGAKKSRPGLSLLFTPFLSTY

SEQ ID NO: 207019 - protein, 518 aa, Glycine max
  Coding DNA Sequence Number=SeqID_90241
  Gene Ontology: Mol. function=protein binding
  Homolog annotation: Hit_ID=Q93YP4; Match level="QueryCoverage=76%, HitCoverage=47%, E-value=1e-35, Identity=30%"; Hit description=Epsin- like protein
MPVEKISGHFTSEARNCTFHLYACVPTEKYNMWTTAPAPANNVEMDLFGSLSESFSSNALALVPSTSKITTSQGNANLDSTASFALPPSASSNFNLVFEDPFGDSPFKASPSTETARSHPRTPQGLAPSQSSGPNTELVSNFGFGVSFSAPGASYTQHLSLNSQFLSMPPPSQETDILAEILPPAPLPGTTSEQNFPAPPDAQSSSSFSASSGQMAPQSFFPQSGQHMQQDFSAVTSQPAAQAVSAPGGQPLQPPSSVPTSQHAQQPFPYQADQPAQSGSHIYGGFPSLAAGSPTQEASSGMFPQSHGGHMNQGSMALVPSHTAPQASTGLSANYLSSQSPIAIDQASQFNSGSLLGQSFNHQPLGQGVHASQSAVSQPPKDKFETKSTVWADTLSRGLVNLNISGPKLNPLAYIGVDFDAINRREKRMEKPTTTTVTSTVTMGKAMGSGSGMGRAGVGALRPPSNPMMGMGMGSYGGVNAPMGMGQMPPPPSRFPPGNYNSMMGRSGYPQHPYGGYR

SEQ ID NO: 207020 - protein, 596 aa, Glycine max
  Coding DNA Sequence Number=SeqID_90242
  Gene Ontology: Mol. function=transporter activity; Cellular component= membrane; Biological process=oligopeptide transport
  Homolog annotation: Hit_ID=Q1T4L2; Match level="QueryCoverage=96%, HitCoverage=89%, E-value=0.0, Identity=70%"; Hit description=TGF -beta receptor, type I/II extracellular region
  Pfam annotation: Domain name=MFS_1; Domain location=51-522; Score= -3.1; E_value=0.00044; Accession=PF07690.6; Description=Major Facilitator Superfamily
  Pfam annotation: Domain name=PTR2; Domain location=113-510; Score =330.2; E_value=3.7e-96; Accession=PF00854.12; Description=POT family
  Pfam module annotation: Pfam domain module=MFS_1::PTR2; Domain location=51-522::113-510
MATSFSANSPNIAANKLIEGDSSNREESVLMERTSRAGEKKTGGAKVASLLLVNQALATLAFFGVGVNLVLFLTRVLGQDNVNAANNVSKWIGTVYMFSLIGAFLSDSYWGRYLTCTVFQLVFVLGLALSSLSSWRFLINPVGCGDGHTPCKPSSIGDEIFYLSIYLVAFGYGGHQPTLATFGADQYDEKNPKEKSSKVAFFCYFYFALNVGSLFSNTVLVYYEDTGMWTMGFLVSLVSAVIAFLAFLLGTPRYRYVKPCGNPVMRVAQVFSAVFRKWKVSPAKAEELYEVDGPQSAIKGSRKIRHTDDFEFMDKAATIKETEEHSPKNPWRLCTVTQVEEAKCVLRMLPVWLCTIIYSVVFTQMASLFVEQGDVMNSYIGSFHLPAASMSAFDICSVLVCTGIYRQILVPLAGRLSGNPKGLSELQRMGIGLIIGMLAMVASGATEIARLRRISHGQKTSSLSIFWQIPQYVLVGASEVFMYVGQLEFFNGQAPDGIKSFGSSLCMASISLGNYVSSMLVNMVMIITARGQSKGWIPENLNTGHMDRFFFLLAGLAAFDFVLYLFCAKWYKSINIEDSDMGDQGQEKEEDVNNKV

SEQ ID NO: 207021 - protein, 124 aa, Glycine max
  Coding DNA Sequence Number=SeqID_90243
  Gene Ontology: Mol. function=oxidoreductase activity; Cellular component=membrane; Biological process=electron transport
  Homolog annotation: Hit_ID=Q9LF95; Match level="QueryCoverage=90%, HitCoverage=31%, E-value=1e-23, Identity=41%"; Hit description =Cytochrome P450-like protein
MAELLHNPKALKKVQMEIRSKIGPDRNMDEKDIENLSYLQAVIKETLRLHPPLPHMAMYSCNMLGYNIPQGSFISFGSGRRMCPAMPLASRVLPPPIGSLLCSFDWVLPDGENQRRWTPQRKWE

SEQ ID NO: 207022 - protein, 89 aa, Glycine max
  Coding DNA Sequence Number=SeqID_90244
  Homolog annotation: Hit_ID=Q9C6P5; Match level="QueryCoverage=41%, HitCoverage=11%, E-value=2e-12, Identity=84%"; Hit description=RAV -like DNA-binding protein, putative
MRVVVLTWRLCFMTNSCDCGSSDTAIGRAAKVTCSPEAGIEEDSKGDTKQVLGNQLQLAGSEEGEDEDANIGKDFNAQKGLRLFGVCIT

SEQ ID NO: 207023 - protein, 263 aa, Glycine max
  Coding DNA Sequence Number=SeqID_90245
  Homolog annotation: Hit_ID=Q00YC2; Match level="QueryCoverage=73%, HitCoverage=85%, E-value=4e-14, Identity=30%"; Hit description =Homology to unknown gene
  Pfam annotation: Domain name=DLH; Domain location=58-260; Score= -71.0; E_value=0.021; Accession=PF01738.9; Description=Dienelactone hydrolase family
  Pfam annotation: Domain name=Peptidase_S15; Domain location=54-242; Score=-75.8; E_value=0.00029; Accession=PF02129.9; Description=X-Pro dipeptidyl-peptidase (S15 family)
  Pfam module annotation: Pfam domain module=DLH::Peptidase_S15; Domain location=58-260::54-242
MGFEHKYWFCCFGRSVMSGPSQPIFQRTNNQIVSPAHLAQKNYTLESFTVEGSDGVKLRTRVFKPDAGTEADGKLGIVLVHPYSILGGCQGLLKGIASGLALNGYTAVTFDMRGVGKSTGRASLTGFSEVKDVVAVCNWLSNTFSLPRILLLGSSAGAPIAGSAVDQIEQVIGYVSIGYPFGMTASILFGRHHKAILQSPKPKLFIMGTQDGFTSVKQLRNKLNSAAGRVETHLIDGVGHFQMEGPGYDAEMVDLIIKFIASL

SEQ ID NO: 207024 - protein, 339 aa, Glycine max
  Coding DNA Sequence Number=SeqID_90246
  Homolog annotation: Hit_ID=Q9LT44; Match level="QueryCoverage=77%, HitCoverage=71%, E-value=3e-64, Identity=50%"; Hit description =Arabidopsis thaliana genomic DNA, chromosome 3, P1 clone: MOE17
  Pfam annotation: Domain name=Nse4; Domain location=5-270; Score= -39.1; E_value=2e-10; Accession=PF08743.1; Description=Nse4
MAIAMAIRTQLLAGSYAPSSSNSRISSMSDKFDTILDEFDKLHVQVEKPREQVADAEALLDLTRTLVGSVKSLTNEGVTPSQFVSSLLIRYAHAQHSIDWHQLGLAASPIFLSFHGSSTMLGPMDNQFKQRKTGVPRNCNPRQIATTRPLQVDEAVTEENTDTDKNMATMFHILRRTKRVPLENLILNRESFAQTVENLFALSFLVKDGRAEISLDENRLHYVSPKNAPAANLVSSKEVSYTHFVFRYDYQDWKLMKDVVPDGKELMPRRTQCCTVVASQEGMSDDNFQPALAVTPIRKLSRNRGRVVQEEGVVEESPECNEENASRAGAIRRCKRKLH

SEQ ID NO: 207025 - protein, 242 aa, Glycine max
  Coding DNA Sequence Number=SeqID_90247
  Homolog annotation: Hit_ID=Q6H5H5; Match level="QueryCoverage=84%, HitCoverage=53%, E-value=2e-51, Identity=54%"; Hit description=Emsy N terminus domain-containing protein-like
  Pfam annotation: Domain name=ENT; Domain location=35-108; Score =148.3; E_value=2e-41; Accession=PF03735.5; Description=ENT domain
MEFDLCDSSDHATGTGNGRSAIVGLGPYPRMQNDMETQIHNIEQEAYTSVLRAFKAQSDAITWEKESLITELRKELRVSDEEHRELLSRVNADDIIHNIREWRKGNGLQSGAVNTAQQVHDHNTSPTILASRKKQKKSQSVASLSLGAPSPAVHPSMQPSSSALKHGPPSGTKTKKQKSFPSTGLTSQSQVTNQGGSSGAFATKGPAEAASYDPWIGRKVWTRWPEDNHFYEAVITDYNAAE

SEQ ID NO: 207026 - protein, 115 aa, Glycine max
  Coding DNA Sequence Number=SeqID_90248
  Subcellular localization annotation: CTP_CleavageSite=57; ConfidenceScore=5.36e-01
MVECKRCYLTIAAMKKPSSSKHSISKKRKTTIATTDSTSFELCSFDTQFPDTTFSLKASVSSTRTVVSDHSCCSSTPCHQICRFALSMKGYKPNLNFTVKGKLHLQHQHQSKRYY

SEQ ID NO: 207027 - protein, 103 aa, Glycine max
  Coding DNA Sequence Number=SeqID_90249
MMKKKKKRYLIGAYTYAKWQLYATALTEMVSKHLIEVVGREAGYLVPGEEAQEVATRVSRTVATDVARTVYEDNQLRLVEEVKSNEKLNMEAWVLRKEHTITL

SEQ ID NO: 207028 - protein, 800 aa, Glycine max
  Coding DNA Sequence Number=SeqID_90250
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=92%, HitCoverage=37%, E-value=0.0, Identity=55%"; Hit description=CCHC -type integrase
  Pfam annotation: Domain name=B_lectin; Domain location=73-180; Score =32.0; E_value=2.1e-06; Accession=PF01453.15; Description=D-mannose binding lectin
  Pfam annotation: Domain name=Pkinase; Domain location=510-777; Score =132.7; E_value=9.9e-37; Accession=PF00069.15; Description=Protein kinase domain
  Pfam annotation: Domain name=Pkinase_Tyr; Domain location=511-777; Score=84.7; E_value=2.9e-22; Accession=PF07714.7; Description =Protein tyrosine kinase
  Pfam annotation: Domain name=S_locus_glycop; Domain location=204-334; Score=-43.2; E_value=0.055; Accession=PF00954.11; Description=S-locus glycoprotein family
  Pfam module annotation: Pfam domain module=B_lectin::Pkinase::Pkinase_ Tyr::S_locus_glycop; Domain location=73-180::510-777::511-777::204-334
MAAKTVLVCVTVILLPLLQLPYVSATNVSIGETLVAGNGGKRWLSPSEDFAFGFHQLDNDLYLLAISYQNIPRDSFIWYANGDNPAPKGSKLELNQYTGLVLKSPQGVELWTSQLISGTISYGLMNDTGNFQLLDENSQVLWDSFSNPTDTLVPTQIMEVKGTLSSRQKEANFSRGRFQFRLLPDGNAVLNPINLPTNYTYDAHYISATYDSTNTTNSGFQVIFDNSGLYILKRSGEKVYITNPKDALSTDSYYYRATINFDGTFTISNYPKNPASNPSWTVMKTLPDNICMNLLGNTGGSGVCGFNSICTLKADQRPKCSCPEGYSPLDSRDEYGSCKPNLELGCGSSGQSLQGDLYFMKEMANTDWPVSDYELYKPYNSEDCKTSCLQDCLCAVSIFRDDSCYKKKLPLSNGRRDRAVGASAFIKLMKNGVSLSPPNPFIEEKKYKKDQDTLITVISVLLGGSVFFNLVSAVWVGFYFYYNKKSSTNKTATESNLCSFTFAELVQATDNFKEELGRGSCGIVYKGTTNLATIAVKKLDKVLKDCDKEFKTEVNVIGQTHHKSLVRLLGYCDEEQHRILVYEFLSNGTLANFLFGDFKPNWNQRVQIAFGIARGLVYLHEECCTQIIHCDIKPQNILLDEQYNARISDFGLSKLLKINESHTETGIRGTKGYVAPDWFRSAPITTKVDVYSFGVLLLEIICCRRNVDGEVGNEEKAILTDWAYDCYRAGRIDILLENDDEAIDDTNRLERFVMVAIWCLQEDPSLRPPMKKVMLMLEGIAPVTIPPSPSPYTSVSVSCG

SEQ ID NO: 207029 - protein, 101 aa, Glycine max
  Coding DNA Sequence Number=SeqID_90251
  Gene Ontology: Mol. function=protein dimerization activity; Cellular component=nucleus; Biological process=regulation of transcription, DNA-dependent
  Homolog annotation: Hit_ID=Q0GPG6; Match level="QueryCoverage=83%, HitCoverage=18%, E-value=6e-19, Identity=59%"; Hit description=BZIP transcription factor bZIP99
MVLRSCIARAGVCVEDEKGTARGMPSFDSQLPNSNACYTEGSAIDSFCVFDFDQSVGYRIEDCVALRGNSVFDSLKVSSQTISRGPVEVDSFDKLGKLGDW

SEQ ID NO: 207030 - protein, 374 aa, Glycine max
  Coding DNA Sequence Number=SeqID_90252
  Gene Ontology: Mol. function=sugar porter activity; Cellular component=integral to membrane; Biological process=carbohydrate transport
  Homolog annotation: Hit_ID=Q8VZR6; Match level="QueryCoverage=88%, HitCoverage=65%, E-value=1e-109, Identity=59%"; Hit description =Probable inositol transporter 1
  Pfam annotation: Domain name=MFS_1; Domain location=42-374; Score =47.0; E_value=6.3e-11; Accession=PF07690.6; Description=Major Facilitator Superfamily
  Pfam annotation: Domain name=Sugar_tr; Domain location=38-372; Score =156.0; E_value=1e-43; Accession=PF00083.14; Description=Sugar (and other) transporter
  Pfam module annotation: Pfam domain module=MFS_1::Sugar_tr; Domain location=42-374::38-372
MVAEMGMGMSMRAGSSGYLEMHPERKITFFQNPYIVGITFAAGLGGLLFGYDTGVVSGALLYIKEDFELVRNSSFIQEVIVGMALIGAIFGAAIGGVINDHLGRKTATIIADICFGAGSVIMGLAGNPYVIIFGRFLVGLGVGSASVTAPVYIAEVSPSEIRGGLVSANTLMITAGQFLSFIVNYGLTRVPGTWRWMLGLSGFPAVLQFVLISFLPESPRWLYMKNRREEAILVLSKIYSSPRLEDEIKILDDLLLQEPESKASVKYTDVFTNKEIRVAFTFGAGLQALQQFAGISIIMYYSPTIIQMAGFKSNQSALFLSLIVSGMNAAGTILGIYLIDLAGRKKLALGSLSGVLVSLIILSTSCYLMGHGNT

SEQ ID NO: 207031 - protein, 200 aa, Glycine max
  Coding DNA Sequence Number=SeqID_90253
  Gene Ontology: Mol. function=oxidoreductase activity; Cellular component=cytoplasm; Biological process=flavonoid biosynthetic process
  Homolog annotation: Hit_ID=Q41399; Match level="QueryCoverage=95%, HitCoverage=59%, E-value=3e-56, Identity=53%"; Hit description =Chalcone reductase
  Pfam annotation: Domain name=Aldo_ket_red; Domain location=11-200; Score=80.2; E_value=6.2e-21; Accession=PF00248.11; Description =Aldoketo reductase family
MEPKAIQEVELNSGHKMPTLGFGTGTVPLPPHHVLIPAFIEAIKSGYRHFDTAAYYGSEEPLGQAIALALDQGLIKSRNELFVTTKLWCTDAHPGLVLPALESSLQRLGLEYVDLYLIHFPVRLRQGVKGTKYSKGEILPLDMKGTWEDMERCSKLGLAKSIGVSNFGVKKLSEILQNARVPPALVQSRKCPFEKEATGL

SEQ ID NO: 207032 - protein, 451 aa, Glycine max
  Coding DNA Sequence Number=SeqID_90254
  Gene Ontology: Mol. function=sugar porter activity; Cellular component=integral to membrane; Biological process=carbohydrate transport
  Homolog annotation: Hit_ID=Q1T4L1; Match level="QueryCoverage=92%, HitCoverage=84%, E-value=1e-155, Identity=65%"; Hit description =Major facilitator superfamily
  Pfam annotation: Domain name=DUF81; Domain location=73-336; Score= -71.7; E_value=0.068; Accession=PF01925.9; Description=Domain of unknown function DUF81
  Pfam annotation: Domain name=Lactate_perm; Domain location=1-410; Score=-343.9; E_value=0.071; Accession=PF02652.5; Description=L -lactate permease
  Pfam annotation: Domain name=MFS_1; Domain location=1-388; Score =91.8; E_value=2.1e-24; Accession=PF07690.6; Description=Major Facilitator Superfamily
  Pfam annotation: Domain name=Sugar_tr; Domain location=10-429; Score =366.5; E_value=4.1e-107; Accession=PF00083.14; Description=Sugar (and other) transporter
  Pfam module annotation: Pfam domain module=DUF81::Lactate_perm::MFS _1::Sugar_tr; Domain location=73-336::1-410::1-388::10-429
MVGLEKKDGLTWSSCQLGALKLTKHEETIVSMAVTGAIVGAAAGGWINDVYGRKKATLIADVIFTLGAIVMAAAPDPYILIIGRVLVGLGVGIASVTAPVYIAESSPSEIRGALVGINVLMITGGQFLSYLINLAFTQVPGTWRWMLGVSGVPAVVQFFLMLLLPESPRWLFIKNRKEEAITVLAKIYDFARLEDEVNLLTTQSEKDCQRRDGIRYWDVFKSKEIRLAFLAGAGLQAFQQFIGINTVMYYSPTIVQMAGFQSNELALLLSLIVAGMNAAGSVLGIYLIDHAGRRKLALYSLGGVIASLIILALSFFNQSSESGLYGWLAILGLALYIAFFSPGMGPVPWTVNSEVYPEEYRGICGGMSATVNWVSNLIVVQSFLSVAAAVGTGPTFLIIAIIAVLAFMFVVVYVPETKGLTFDEVELLWKERAWGKNPDAQSLLVRTENHS

SEQ ID NO: 207033 - protein, 497 aa, Glycine max
  Coding DNA Sequence Number=SeqID_90255
  Gene Ontology: Mol. function=sugar porter activity; Cellular component=integral to membrane; Biological process=carbohydrate transport
  Homolog annotation: Hit_ID=Q1T4L1; Match level="QueryCoverage=98%, HitCoverage=98%, E-value=0.0, Identity=74%"; Hit description=Major facilitator superfamily
  Pfam annotation: Domain name=MFS_1; Domain location=39-436; Score =117.5; E_value=3.8e-32; Accession=PF07690.6; Description=Major Facilitator Superfamily
  Pfam annotation: Domain name=MFS_Mycoplasma; Domain location=185-433; Score=-158.4; E_value=0.094; Accession=PF07672.4; Description =Mycoplasma MFS transporter
  Pfam annotation: Domain name=Sugar_tr; Domain location=35-477; Score =444.3; E_value=1.6e-130; Accession=PF00083.14; Description=Sugar (and other) transporter
  Pfam module annotation: Pfam domain module=MFS_1::MFS_Mycoplasma::Suga r_tr; Domain location=39-436::185-433::35-477
MTMTTIQSTPGSSGYLDLFPDRKMSFFKNPYILGLTAVAGIGGMLFGYDTGVISGALLYIKDDFEGVRQSNLLQETIVSMAIAGAIVGAAGGGWMNDAYGRKKATLIADVIFIMGAIGMAAAPDPYLLILGRFLVGMGVGVASVTSPVYIAEASPSEIRGSLVSTNVLMITAGQFLSYIVNLAFTRVPGTWRWMLGVSAVPAIVQFLLMLFLPESPRWLFIKNRKNEAVHVLSNIYDFARLEDEVDFLTTQSDQERQRRNSIKFGDVFKSKEIKLALLVGAGLQAFQQFTGINTVMYYSPTIVQMAGFNSNELALLLSLVVAGMNAVGTILGIYLIDHAGRKMLALSSLGGVFASLVVLSVSFLNQSSSNELYGWLAVLGLVLYIAFFSPGMGPVPWTVNSEIYPEEYRGICGGMSATVCWVSNLIVSQSFLSIAEAIGIGSTFLILAAISVLAFLFVLLYVPETKGLTFDEVELIWKERAWGNNTDSRNLLAENQP

SEQ ID NO: 207034 - protein, 803 aa, Glycine max
  Coding DNA Sequence Number=SeqID_90256
  Gene Ontology: Biological process=nuclear mRNA splicing, via spliceosome
  Homolog annotation: Hit_ID=Q53MI2; Match level="QueryCoverage=32%, HitCoverage=55%, E-value=4e-47, Identity=41%"; Hit description =Survival motor neuron (SMN) interacting protein 1 (SIP1), putative
  Pfam annotation: Domain name=SIP1; Domain location=202-478; Score =164.0; E_value=3.7e-46; Accession=PF04938.3; Description=Survival motor neuron (SMN) interacting protein 1 (SIP1)
MADVSDSQEQPVLDSAELEMKKKRLLVELESALGGEKSVTAQASSSSSSSLGLGIEVIDETALLDSVAKKNGGSRRTKNNNNGHNHKKSKPSNKIGNKKYSRKELESLRFVNMARQRKFWKAIHAAFQTTVAMEYDALASSPLPHNKPILSAVFCEIRDSEKVTPVDPSCSHNLVGEDGCSIVKECSEEDDGSDDDYASIQRPAFMVDGEPNFDSGPPEDGWEYLRRVRWEAHQIPKVKVAKLDRGKLNKEQSAYMPQIPDIAKCPEHLLPLKEWEDAFLAEFSALRTNFSCLDGSSAIHSGNLHVHSSQIVGNNCGEFSSVMSRDVLLNNHLRIGNANDQPTNLTAEDKDRTLSSENPEAKTSADQRSSSSSPTPPLLSVILAMDSVARVSSLLKRIRLLEAADTMTRNDCMWLFALCATVDAPLDADTCAALRSLLRKCASIRAGKAELDEEFPPPSPCRRHCRLTVVCSSFRRRSRSRRRHNKVSLPTTTSTSSFEPKLEAVIDLTPLTAFQSELRRFLSSGKDAYRDLQTLVTLDHNRRLVVSCRPSTLHFLGTSAALTFLAFSVFTVLAQLISRFSSWRRNASSHKPVVVRRDRSLGGKEVVVAWGQRSDTNPLSAPVRDSVKRSAKNKVVPFQRKLPKWWPTVINSSASVFDANEQEEYKREAYRVVRVSIEPTNIRDTLYRASVNFVLNVCSRAPTHSTSIDINGEDAPQFLTGFAENIGLENVRAATIVSAAVAARTRSCLLQAWALEMQGKQVDAMVELSKICLLLRIFPPEESSEDDVDASCKAGSYFLTIKK

SEQ ID NO: 207035 - protein, 83 aa, Glycine max
  Coding DNA Sequence Number=SeqID_90257
MASDGAEGELAVRWQCRPATVDDNDEVAKTVVLAVERVHRRGGWRWREKNYETPSPPEIASVSSEQWSEVKRWSEGKRRGNLV

SEQ ID NO: 207036 - protein, 48 aa, Glycine max
  Coding DNA Sequence Number=SeqID_90258
MRGEKNDETLIMESLRFIYAKAKVKLGNRVNETGHVSSRACVYATLCF

SEQ ID NO: 207037 - protein, 366 aa, Glycine max
  Coding DNA Sequence Number=SeqID_90259
  Gene Ontology: Mol. function=cytokinin dehydrogenase activity; Cellular component=vacuole; Biological process=stomatal complex morphogenesis
  Homolog annotation: Hit_ID=Q9LY71; Match level="QueryCoverage=99%, HitCoverage=84%, E-value=1e-132, Identity=56%"; Hit description =Cytokinin dehydrogenase 6 precursor
  Pfam annotation: Domain name=Cytokin-bind; Domain location=72-358; Score=332.6; E_value=6.6e-97; Accession=PF09265.1; Description =Cytokinin dehydrogenase 1, FAD and cyto
  Pfam annotation: Domain name=FAD_binding_4; Domain location=1-122; Score=54.7; E_value=3e-13; Accession=PF01565.13; Description=FAD binding domain
  Pfam module annotation: Pfam domain module=Cytokin-bind::FAD_binding _4; Domain location=72-358::1-122
MGFASQLKIAARGHGHSLQGQAQVHGGLVINMESLQGPEIKVYNGELPYVDVSGGELWINILHETLKHGLAPKSWTDYLHLTVGGTLSNAGISGQAFKHGPQINNIFQLEVITGKGEVVTCSGNRNADLFYGVLGGLGQFGIITRARISLEPAPMMMAKYFNPDEAEAMNQSVDQLLSKLSYIPSTLFLSEVSYVEFLDRVHVSENKLRAQGLWEVPHPWLNLLIPRSEIHDFAEEVFGNILKDTSNGPILIYPVNQTRWNSRPSLVTPEEDVFYLVALLSSALPNSTGADSLEHILAQNNKIIDFYTGAQLRVKQYLPHYSTQEEWQVHFGSRWEAFVERKRAYDPLALLAPGHRIFQKAVSSSC

SEQ ID NO: 207038 - protein, 223 aa, Glycine max
  Coding DNA Sequence Number=SeqID_90260
MEESSSIEESVASVVEEAKEVQDAVSAHISKASSDEEPLRQRVRRVDSRIHSLRSSLDSLVSTKQIPPSLADKLDEDLQRARCIIVDGDSSSLLPGHAQGSFLRMFLGPINVRASRKDVQLKVKEEYNSYRELLQRAQHASELLKNGEAQISRESASLIGVGDRTALLFLLFPATLLILRSWVWSGCLPTFPVQMYQAWLLFLYTGLALRENILRVNGSDIRP

SEQ ID NO: 207039 - protein, 55 aa, Glycine max
  Coding DNA Sequence Number=SeqID_90261
MNEIIKLLQGWEGLPNPEGREILQTIPVPTSNKLHAKVTRKVQFAFWILEYIKDA

SEQ ID NO: 207040 - protein, 131 aa, Glycine max
  Coding DNA Sequence Number=SeqID_90262
  Gene Ontology: Mol. function=transferase activity, transferring acyl groups, acyl groups converted into alkyl on transfer; Biological process=carboxylic acid metabolic process
  Homolog annotation: Hit_ID=Q9C550; Match level="QueryCoverage=87%, HitCoverage=18%, E-value=7e-44, Identity=77%"; Hit description=2 -isopropylmalate synthase
  Pfam annotation: Domain name=LeuA_dimer; Domain location=58-131; Score=-3.2; E_value=7.3e-05; Accession=PF08502.1; Description=LeuA allosteric (dimerisation) domain
MALAFWTYASPHGTSILVIFDGRHALRKRLEELGYELSDDQVQTLFWRFKAVAEQKKRVTDADLRALVSDEVFQAEPVWKLGDLQVTCGTLGLSTATVKLLSSDGSTHVACSVGTGPVDSAYKAVDLIVKV

SEQ ID NO: 207041 - protein, 723 aa, Glycine max
  Coding DNA Sequence Number=SeqID_90263
  Gene Ontology: Mol. function=protein binding; Cellular component =membrane; Biological process=defense response
  Homolog annotation: Hit_ID=Q2L360; Match level="QueryCoverage=72%, HitCoverage=93%, E-value=2e-59, Identity=40%"; Hit description =Putative CC-NBS-LRR resistance protein
  Pfam annotation: Domain name=LRR_1; Domain location=453-474; Score =5.9; E_value=22; Accession=PF00560.23; Description=Leucine Rich Repeat
  Pfam annotation: Domain name=LRR_1; Domain location=476-498; Score =7.3; E_value=12; Accession=PF00560.23; Description=Leucine Rich Repeat
  Pfam annotation: Domain name=LRR_1; Domain location=500-522; Score =14.9; E_value=0.29; Accession=PF00560.23; Description=Leucine Rich Repeat
  Pfam annotation: Domain name=LRR_1; Domain location=570-592; Score =11.8; E_value=1.8; Accession=PF00560.23; Description=Leucine Rich Repeat
  Pfam annotation: Domain name=LRR_1; Domain location=648-673; Score =5.6; E_value=25; Accession=PF00560.23; Description=Leucine Rich Repeat
  Pfam annotation: Domain name=LRR_1; Domain location=675-697; Score =10.9; E_value=2.7; Accession=PF00560.23; Description=Leucine Rich Repeat
  Pfam annotation: Domain name=LRR_1; Domain location=699-722; Score =0.0; E_value=2.8e+02; Accession=PF00560.23; Description=Leucine Rich Repeat
  Pfam annotation: Domain name=NB-ARC; Domain location=154-397; Score= -0.1; E_value=2.8e-10; Accession=PF00931.13; Description=NB-ARC domain
  Pfam module annotation: Pfam domain module=LRR_1::LRR_1::LRR_1::LRR _1::LRR_1::LRR_1::LRR_1::NB-ARC; Domain location=453-474::476 -498::500-522::570-592::648-673::675-697::699-722::154-397
MAESFIFSIVESLIEKLASRAFQEASEALDVYDHLREFENTLSLVKAVLLDAEKKQEHDHVLREWLRQLKSVFYDAQYVLDEFECQTLRKQVLKAHGTIKDEVSHFFSSSNPLVFRSKMAQKIKDVSKRLDKVAADRHKFGLRTIDVDTRVVHRRDTSRMTHSRVSDSDVIGREHDKEKIIELLMQQNPNDDDKSLSVIPIVGIGGLGKTTLAQFVFNDKRIDECFSLKMWVYVSDDFDINQLIIKIINSVNVADAPLPQQNLNMVDLEQLQNQLRNKLAGQKFLLVLDDVWNDDRVKWVELRNLIQESNGPLKKDYQFLSEEVAIHWGALGLLASPRKNETPENVVKQYLDELLSRSFLQDFVNFGTIYRFKMHDLVHDLALFVAKDECLVINSHIQNIPVNIRHLSFAEYNFIGNSFTSKSVAVRTIMFRNGAQGANVEALLNTCVSKFKLLRVLDLRDSTCKTLPRSIGKLKHLRYFSIENNRNIKRLTNSICKLQNLQLLNVSGCKELEALPKGLRKLISLRHLEITTKQPVLPYSEITNLIKLAHLYIASSHNMEPIFGGVKLPTLKTLNVADCHSLKSLPLDVTNFPELETLIVLLCVNLDLDLWKDHHEEQNPKLKLKVVGFGYLPQLVALPQWLQETADSLQTLFIRNCDNCDNLEMLPEWLSTLTNLKVLILSDCPKLISLLDNIHHLTALERLRIVGCPELCKKCQPHVGEFW

SEQ ID NO: 207042 - protein, 100 aa, Glycine max
  Coding DNA Sequence Number=SeqID_90264
MKSIEHRLKKEGHGALIEDWWSDCKEEDTNEIDLDDLPYGTGMKASPMRANKVTGMRNEVKIGSFGRRLLKRHKEHSNSVKGKGTELRISEKGKVTLPVF

SEQ ID NO: 207043 - protein, 98 aa, Glycine max
  Coding DNA Sequence Number=SeqID_90265
  Subcellular localization annotation: CTP_CleavageSite=24; ConfidenceScore=5.23e-01
MSPLQRRFLIPRFRNSVILSRACAVSMISSSEWGFISASQHVKRSSIKLTVSPRDVVQRSTWRRTEDRWRLVDSAMATVETTVVATTVGVGEAAARER

SEQ ID NO: 207044 - protein, 147 aa, Glycine max
  Coding DNA Sequence Number=SeqID_90266
LIGERVENMSLSPEITDVDGTDFLKAQLLRMPPNYNKVVAVGNGGANSKPPWLDHHHHEGKTLLCDHDNIINTFKNLIICDHDVEPTDEDDDDGGIHTCPNVFETESDQRKKILMAIIRRRHLSAAAGIGNNKSKVFEKEKLLSLLL

SEQ ID NO: 207045 - protein, 318 aa, Glycine max
  Coding DNA Sequence Number=SeqID_90267
  Gene Ontology: Mol. function=protein binding; Cellular component =membrane; Biological process=defense response
  Homolog annotation: Hit_ID=Q1T0I4; Match level="QueryCoverage=98%, HitCoverage=35%, E-value=4e-47, Identity=34%"; Hit description =Disease resistance protein
  Pfam annotation: Domain name=NB-ARC; Domain location=119-318; Score= -5.8; E_value=6.4e-10; Accession=PF00931.13; Description=NB-ARC domain
IAESLIAKLASRAFQEASEALDVYNHLREFEKTLSLVKEAVLLDAEQKQLKSVFYDTEDVFDEFECQTLGKQVLKVHGTIKDEMAQKIKDVSKRLDKVAADRHKFGLGIIDVDTRVVHRRDMSRMTHSRVSDSDVIGREHDKEKIIELLMQQNPNDDDKSLSVIPIVGMGGLGKTTLAKFVFNDKRIDECFSLKMWVCVSDDFDINQLIVKIINSANDANASLRQQNLNMVDLEQLQNQLRNILAGQKFLLVLDDSLPPVNSLSLFVKWAFKEGEEEKHPHLVNIGKEIVKKCRGVPLAVRTLGSLLFSKYEANEWEY

SEQ ID NO: 207046 - protein, 283 aa, Glycine max
  Coding DNA Sequence Number=SeqID_90268
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9XEG1; Match level="QueryCoverage=75%, HitCoverage=12%, E-value=1e-88, Identity=65%"; Hit description =Putative callose synthase catalytic subunit
MDDPVFLHSILLLAQYERFGRDRMLISGSSRHQGKTSFVEHRTFFHLYHSFHRLWIFLFMMFQGLTILAFNDGKFNAKTLREILSLGPTFVVMKLFEMILHFQMFVHDCRKALQEESKSNGNSVVFRLYVIVIGIYAGVQFFISFLMRIPACHRLTNQCGRWPLVHFVKWLRQERHYVGRGMYERSSDFIKYMLFWLVILSGKFAFAYFLQIRPLVKPTKAIIIADNINYSWHDFVSKNNHNALTVVSVWAPVVAVSIVSLFVYLLPPSSNMLIIKGGYIGPG

SEQ ID NO: 207047 - protein, 209 aa, Glycine max
  Coding DNA Sequence Number=SeqID_90269
  Gene Ontology: Mol. function=RNA-directed DNA polymerase activity; Cellular component=chromatin; Biological process=RNA-dependent DNA replication
MILRGATKYENVVEKGDDEMSEPCNKSNFEKQRAPSSSSKRSSIVGIENRSLMVRAFKAHIDDENGLVLGCISPFCSMHSTYNSICASDNRGDVSVGTTVTWKHDISSENGTEGLQPLDAQNNIGTDDRQDIEVHREGCCLEVNGDRLTKPMTLQLLVVTHHNRERSSGAIREVELGDEVLLNEIMGALSVHQEEHRLAENGSHQPESL

SEQ ID NO: 207048 - protein, 382 aa, Glycine max
  Coding DNA Sequence Number=SeqID_90270
  Gene Ontology: Mol. function=RNA-directed DNA polymerase activity; Cellular component=chromatin; Biological process=chromatin assembly or disassembly
  Subcellular localization annotation: CTP_CleavageSite=90; ConfidenceScore=5.21e-01
MVKGTTIEPFQWSTQAHMAFNTLKQALSMTSVLALPDFKLPFTVETDASRVGMGVLLSQQGHPISFFSKPFSPKLMRASTYVWELAAITTAVKKWQQYLLKHHFTIVTDHRSLKELLNQVANALSRLPEHDSTVLMVLFVPCLMFMKELCCQLDNHSDYQRHLQELPPYSWSIMRHPQGDTPGLLRLWQESWKISSSQGFKKMLHNLWPTVSSARHSPGNASFESLCPNDNIPVFGLCHEASWASSELGLRPRSTICQSLLARAFSGKWQATPNDIHKKLLKAQEAMKRQADKKRREVQYQVDDWVLVKLRPHRQTSAKGDEAIAGKLAKRYYGPFQQYSTTAELHPVHHGRYLCNGKGYLQMKHLGKIGPSCAVIFTLRTR

SEQ ID NO: 207049 - protein, 303 aa, Glycine max
  Coding DNA Sequence Number=SeqID_90271
  Gene Ontology: Mol. function=RNA-directed DNA polymerase activity; Cellular component=membrane; Biological process=RNA-dependent DNA replication
MLLEIGVIGFGSIAFQLVGMLENFNERMPSKIIVKLEAIQRRFLSGGGSEHRKIAWVNWKTVCQPKDKGGLGIKDIKIFNSALMAKWRWDLFHKQEELWAKVINSKYGGWRALEEGIRGNHQQQQNLVIKRETAWKVGGGEKFRFWEDPWTDNGMPLMEKFPRLYHISSQQNANIMQMGSINNNGWESKLTWRRDLFDSKVEMADTFIGEISQQQVQPHREDTWIWKHDQSGSYSTKSGYDLIRRKLTGANHDSDFVDLWKLQIPSKAAMFAWRLIMDRLSTRMNLRRRQVMVNDSMCPLCGL

SEQ ID NO: 207050 - protein, 116 aa, Glycine max
  Coding DNA Sequence Number=SeqID_90272
RVQMKVRVAEAEPFGSVDSDVEGKEEGVAELRVLDLGDEHPVDGGPAAAGEGRLGLAVIGEGVAAELAWVCVRGVPSQRKKMEASLAMASSMRSILVLDRVDSAMVAVLNESTKLL

SEQ ID NO: 207051 - protein, 275 aa, Glycine max
  Coding DNA Sequence Number=SeqID_90273
  Gene Ontology: Mol. function=monodehydroascorbate reductase (NADH) activity; Cellular component=extracellular region; Biological process=one-carbon compound metabolic process
  Homolog annotation: Hit_ID=UPI0000162AE2; Match level="QueryCoverage =92%, HitCoverage=95%, E-value=3e-78, Identity=51%"; Hit description =carbonate dehydratase/ zinc ion binding
  Pfam annotation: Domain name=Carb_anhydrase; Domain location=43-267; Score=65.5; E_value=1.7e-16; Accession=PF00194.11; Description =Eukaryotic-type carbonic anhydrase
MTLPTNLNFFYVFLPMLILYSSSFLASASDSKAEDEKFTYAIGSSTGPENWWHVNQKWKTCGDGKLQSPIDLLDQRVQELPQLGKLKKAYKSAPAVLKNSGHDIVLEWKGDAGHLNINETYYNLIQCHWHTPSEHTLNGTKFDLELHAVHKSSKGEFAVIGILYKIGSPDPFFSKLLNDIKSSVDKDIDVGVINPREIKFKSRPYYRYVGSLTTPPCTEGVVWTIVKKVRTVSSEQLSALKGAVHHGYEENARPTQELGGRQVWLYGPMENEKPT

SEQ ID NO: 207052 - protein, 118 aa, Glycine max
  Coding DNA Sequence Number=SeqID_90274
  Homolog annotation: Hit_ID=Q1SRP0; Match level="QueryCoverage=78%, HitCoverage=22%, E-value=2e-33, Identity=75%"; Hit description =Putative callose synthase catalytic subunit-related
MIVHLKRVMDSDSALTEDLVAYNIIPLDASSSTNAIVYFPEVQAAVSALKYFNGLPELPRGYFLQPTRNANMFDFLQCTFGFQIIHVRAIHQHFHLVVVPRVLRQCCCQVDLGERLPP

SEQ ID NO: 207053 - protein, 166 aa, Glycine max
  Coding DNA Sequence Number=SeqID_90275
  Homolog annotation: Hit_ID=Q1SRP0; Match level="QueryCoverage=49%, HitCoverage=19%, E-value=2e-36, Identity=90%"; Hit description =Putative callose synthase catalytic subunit-related
MSRAEELWERLVRAALRRERTGDDAYGQPVGGIAGNVPSALAKNRDIDEILRVADEIEDDDPNISRILCEHAYSLSQNLDPNSEGRGVLQFKTGLMSVIKGKTSTVVIDISPVIIYEEISMRILMLKSMANSSSWSGWLPLIYSLGVVGSRLGGHKAAPVLRSYCT

SEQ ID NO: 207054 - protein, 182 aa, Glycine max
  Coding DNA Sequence Number=SeqID_90276
  Homolog annotation: Hit_ID=Q1SRP0; Match level="QueryCoverage=49%, HitCoverage=21%, E-value=8e-39, Identity=90%"; Hit description =Putative callose synthase catalytic subunit-related
MEKQRLRWFEGEKEGEKTKPKPYSFMTNRKKVANEEEDHTMMEGMHVRDSVGEYAHIFETLIAQTRGFTGRAIVGVLSLWAKTRVKQKLAKREAGTIDRSQDIARLQEFYKSYREKHNVDKLREEEMKLRESGAFSRDLGELERKTVKRKRVFATLKVLGTVLEQLSEEIPDEVGFLPSGHS

SEQ ID NO: 207055 - protein, 895 aa, Glycine max
  Coding DNA Sequence Number=SeqID_90277
  Gene Ontology: Mol. function=nucleic acid binding; Cellular component= nucleus; Biological process=regulation of transcription, DNA-dependent
  Homolog annotation: Hit_ID=Q9M2L7; Match level="QueryCoverage=96%, HitCoverage=61%, E-value=0.0, Identity=58%"; Hit description =Helicase-like protein
  Pfam annotation: Domain name=DEAD; Domain location=518-698; Score= -33.8; E_value=0.004; Accession=PF00270.19; Description=DEADDEAH box helicase
  Pfam annotation: Domain name=ResIII; Domain location=514-692; Score= -16.0; E_value=0.001; Accession=PF04851.6; Description=Type III restriction enzyme, res subunit
  Pfam annotation: Domain name=SNF2_N; Domain location=520-827; Score =349.3; E_value=6.2e-102; Accession=PF00176.13; Description=SNF2 family N-terminal domain
  Pfam module annotation: Pfam domain module=DEAD::ResIII::SNF2_N; Domain location=518-698::514-692::520-827
MDHRPKSKDSLSYSTLFNLEPLMNFQLPKQDDDFDYYGNSSQDESRDSEGGGITNHGNGNVHEKEVNLFKKRRWSLNSDNEEKTSFYGAHMTEERYRSMLGEHIQKYKRRFKGTLSSPAQNQAAAPLVKSNTGLKARKSGNEHRGGGLHVAESTSEWMNDSSSQKPGNYRDADFSPQYGTDRIMYEPASLDIGDGIIYKIPPVYDKLAGALNLPSFSDIHVEDFYLKGTLDLGSLAEMMAADKRFGNRNRAGMGEAIPQFESLQARLKVLEKGDTYELCLFGLLQIIERSLPKKQKVKKDPALIEKEEMERCGKIWANIVRMKVSRSLKWTRTVGMRTRKLARDMLLFWKRIDKEMTEVRKREEKEAAEALRREQELREAKRQQQRLNFLIQQTELYSHFMQNKSNLLSSETLPKEDEDADDQDALVDSSDVMPDEEVDPEEAELKKEALKAAQEAVSKQRMLTSAFDTECLRLRQAGETDSLPPDVAGASNIDLQTPSTMPVASTVRTPELFKGVLKEYQLKGLQWLVNCYEQGLNGILADEMGLGKTIQAMAFLAHLAEVAIQPHVLEKNIWGPFLVVAPASVLNNWNEELERFCPELKRLPYWGGLSERTVLRKSINPKDLYRREAKFHILITSYQLLVSDEKYFRRVKWQYMVLDEAQAIKSATSIRWKTLLSFNCRNRLLLTGTPIQNNMAELWALLHFIMPTLFDSHEQFNEWFSKGIENHAEHGGTLNEHQLNRLHSILKPFMLRRVKKDVISELTTKTEVTVHCKLSSRQQAFYQAIKNKISLAELFDSNRGQLNEKRILNLMNIVIQLRKVCNHPELFERSEGSTYLYFGEIPNSLPPPPFGEMEDVYYSGGHNPISYEFLSSENGSIVNSRYKEDFSMVLDSNTG

SEQ ID NO: 207056 - protein, 523 aa, Glycine max
  Coding DNA Sequence Number=SeqID_90278
  Homolog annotation: Hit_ID=Q1SRM6; Match level="QueryCoverage=86%, HitCoverage=85%, E-value=1e-139, Identity=60%"; Hit description=PRLI- interacting factor A
  Subcellular localization annotation: CTP_CleavageSite=64; ConfidenceScore=5.21e-01
MNDQSQMMMNLNQMSQPQMMNQVQIIGQSQPQMLSHNQGMNQQAQQPQMKTSQIMMNQSQPQPPMMNRGYNKVWSQQPPLDPNMKFQNPMKPNYRSNWKGKKVTDKRKDPRRMEKPNPSGIATLSISNSGVVGYQPPTLHELQSQNRLKARKFYPKKKFNNRFAPYAPRNTTSFIIRAKKSGGIASLVSPCPVTPAVLPTPILSPSREVLGDMAKEEWGVDGYGSMKGLIRLRSPGNEADVHDYEDEEDGGSSESDVEEHVEVERRLDHDLSRFEMIYPNYGVEYNNVLENRVDDQDSHIAQLEEENLTLKERLFLMERELGDLRRRLLFLERQNQAVEDVNEEVVENGSDNESEGGSDVPVIGIENNVEMVDSLPESGRDGNVEADAKLDNGGVLEAEGVDDVFMEGSVPNEAIVKKDEIRGNEMGGDCVFDEVKEKDEQQDEVVSRQCLTDKFFAKDNEVMDNKESDDFEMLNRNEESTSQGATDENTNDLVLNEKDESKNQVVGTSSETTSGDDNLSVPC

SEQ ID NO: 207057 - protein, 86 aa, Glycine max
  Coding DNA Sequence Number=SeqID_90279
MQSIRSSDNLLRHMLYRNTDTRFMFEIVRMKRKRERKFVGKNDKIAMGMGGWGLMTEQTREQINRERESSGRQEQPYTVQDENGSI

SEQ ID NO: 207058 - protein, 610 aa, Glycine max
  Coding DNA Sequence Number=SeqID_90280
  Gene Ontology: Mol. function=membrane alanyl aminopeptidase activity; Cellular component=cytosol; Biological process=proteolysis
  Homolog annotation: Hit_ID=Q84TA3; Match level="QueryCoverage=99%, HitCoverage=99%, E-value=0.0, Identity=71%"; Hit description =Putative leukotriene A-4 hydrolase
  Pfam annotation: Domain name=Leuk-A4-hydro_C; Domain location=466 -606; Score=183.1; E_value=7e-52; Accession=PF09127.1; Description =Leukotriene A4 hydrolase, C-terminal
  Pfam annotation: Domain name=Peptidase_M1; Domain location=12-393; Score=167.2; E_value=4.3e-47; Accession=PF01433.10; Description =Peptidase family M1
  Pfam module annotation: Pfam domain module=Leuk-A4-hydro_C::Peptidase_ M1; Domain location=466-606::12-393
MAAVDPHSFTDSRQAGTRHVALSLYLDLPSSTIHASALFSLQTSHSGPFYLDTRSLTIHSVIHPKTQTPIPFSLSDPDPIKGSLLSFTLSDHSSFLISYSTSPSSSALQWLLPPQSSHPFVYTQCQSIHARSVFPCQDTPALRIQYSALLNVPSQLSAVMAARHVERRSPKHDDAVHVVLPDGESWCAQGRIVEEFVMEQSVPPYLFAFAVGELGNREVGPRTRVYAENAAAVLDSAAAEFAGTEDMIREGEKLFGPYEWERFDLLVLPPSFPYGGMENPRMVFLTPTVIKGDATGAQVVAHELAHSWTGNLITNKTNEHFWLNEGFTTYAERRIVEAVQGEQRAALNIGIGWRGLNEDVERFKDNLEFTKLKNNQEGIDPDNVYSQVPYEKGFQFLWRIERQVGRPAFDEFLKKYIATFKFKSIDTETFLDFLKANIPGIENQIDLLLWTEGTGIPPDAYEPESTAYKTIVSLANEFTNGRMPREDEVAGWQGQEWELYLDNLPKSIEASQVIDLDSRYKLSESKDYEVKVSFLQRAISCGCKTYYNEVEKTLKGVGRMKYLRPLYTALVKGSGKEDGKVFAKRIFSEARECYHPIAQGVVEAIFAKHL

SEQ ID NO: 207059 - protein, 86 aa, Glycine max
  Coding DNA Sequence Number=SeqID_90281
MENPNLPSPIRQGAPQHQLQHSVPAMSCCGTLPSERLPLGVGPARDITSYGFGYDLPQSQVQVATCLIYSFPSSITRSSQVGSKAI

SEQ ID NO: 207060 - protein, 75 aa, Glycine max
  Coding DNA Sequence Number=SeqID_90282
  Gene Ontology: Mol. function=structural molecule activity; Cellular component=chloroplast thylakoid membrane
  Homolog annotation: Hit_ID=Q1SRM5; Match level="QueryCoverage=78%, HitCoverage=15%, E-value=2e-16, Identity=66%"; Hit description=PAP fibrillin
MTLERILLMKQSRKTGSGVYGVTMDDAAIIGGPFGYPLELKNNFILELLYSDEKLRVSRGNNSILFVHVRTDALR

SEQ ID NO: 207061 - protein, 827 aa, Glycine max
  Coding DNA Sequence Number=SeqID_90283
  Gene Ontology: Mol. function=Rab GTPase activator activity; Cellular component=intracellular; Biological process=regulation of Rab GTPase activity
  Homolog annotation: Hit_ID=Q5QMF8; Match level="QueryCoverage=93%, HitCoverage=88%, E-value=0.0, Identity=55%"; Hit description =RabGAP/TBC domain-containing protein-like
  Pfam annotation: Domain name=DUF827; Domain location=584-779; Score= -115.1; E_value=0.073; Accession=PF05701.2; Description=Plant protein of unknown function (DUF827)
  Pfam annotation: Domain name=TBC; Domain location=239-486; Score =60.8; E_value=4.3e-15; Accession=PF00566.9; Description=TBC domain
  Pfam module annotation: Pfam domain module=DUF827::TBC; Domain location=584-779::239-486
MKSNKTVNPLITFEHKRDAYGFTVRPQHLQRYREYANIYKEEEEERSDRWNSFLDRQAESSELATDGLVVGEGEKVLGDEAAGQEADTSSEKGVDGHEASNQVPGGSDSAAENGSQKEEVPPAEETKVHRVQLWTDIRSSLRTIEDMMSVRVKKKTGSVKDEQIIEAAKSPSHSDDVKSPKGAAFEEDSEEEFYDVERSDPSPDMPVVDGTNASANGITADAAPPEASFPWKEELEVLVRGGVPMALRGELWQAFVGVKARRVEKYYQDLLASENDSEIKTDQQSMESTDSNGKTGADFGCMPEKWKGVKGQIEKDLPRTFPGHPALDEDGRNALRRLLTAYARHNPSVGYCQVVLDFGAMFLQAMNFFAGLLLLLMPEENAFWTLMGILDDYFDGYYSEEMIESQVDQLVFEELVRESQSSGLSGSAGGMGYWTMVPVHFCEHASLGKWSVLRVWDVLLFEGNRVMLFRTAVALMELYGPALVTTKDAGDAVTLLQSLAGSTFDSSQLVLTACMGYQNINETRLQQLRNKHRPAVIASIEERSKGLKAWKDSQGLASKLADMQVLGNLSRTESGSTNADEILISLTGEGEIDAVPDLQEQVVCLKVELCRLLEEKRSAILRAEELETALMEMVKQDNRRQLSAKVEQLDEEVAQLRQALADKQEQETAMLQVLMRVEQEQKVTEDARRFAEQDAAAQRYAAQVLQEKYEEATAALAEMEKRAVMAESMLEATLQYQSGQVKVLQSPRSSQSDSPVSRNNQEPDIPARRISLLSRPFGLGWRDRNKGKPTNEEPAEGNPSVEEQNTISEQDVNGLKVQDESRKEVSA

SEQ ID NO: 207062 - protein, 71 aa, Glycine max
  Coding DNA Sequence Number=SeqID_90284
  Gene Ontology: Mol. function=membrane alanyl aminopeptidase activity; Biological process=proteolysis
  Homolog annotation: Hit_ID=Q84TA3; Match level="QueryCoverage=100%, HitCoverage=17%, E-value=5e-13, Identity=46%"; Hit description =Putative leukotriene A-4 hydrolase
MNGLALGVDEGVGGLGREEPLECGGGRGGGVRDEEGGVVGESEGEEGAFDGIEGAAVGSLETEECGGVDGG

SEQ ID NO: 207063 - protein, 328 aa, Glycine max
  Coding DNA Sequence Number=SeqID_90285
  Gene Ontology: Mol. function=DNA binding; Cellular component =intracellular; Biological process=regulation of transcription, DNA -dependent
  Homolog annotation: Hit_ID=Q1SCS8; Match level="QueryCoverage=99%, HitCoverage=85%, E-value=1e-119, Identity=63%"; Hit description=High mobility group proteins HMG1 and HMG2; AT-rich interaction region
  Pfam annotation: Domain name=ARID; Domain location=32-118; Score= -18.5; E_value=0.0099; Accession=PF01388.11; Description=ARIDBRIGHT DNA binding domain
  Pfam annotation: Domain name=HMG_box; Domain location=236-303; Score =62.4; E_value=1.5e-15; Accession=PF00505.9; Description=HMG (high mobility group) box
  Pfam module annotation: Pfam domain module=ARID::HMG_box; Domain location=32-118::236-303
MASTSCVGNTSLSMKDSASSYSAYPLPLAKYEEVVDNPQLFMFTLEKLHAAMGTKFMIPIVGGRELDLHRLFVEVSSRGGIAKYYVSLLYHYEQIYFFKAREWDPIAPDVSQNQSTLPVPPPKMQFQQPLSETQPAVFQLSNVNAAKLPEAMAASSAGSPVIGVIDGKFESGYLVTVTIGSEKLKGVLYQAPQNPVLTASHHSASANNNNASASLGVHRRRRRKKSEIKRRDPAHPKPNRSGYNFFFAEQHARLKLLHHGKDREISRMIGELWNKLKESEKTVYQEKAMKDKERYRVEMEDYREKLKMGPVISDAVPLQQRLPEPDTD

SEQ ID NO: 207064 - protein, 47 aa, Glycine max
  Coding DNA Sequence Number=SeqID_90286
MTPDFPAPTLATLGPRQQNPHKRSCTKELVPTQAQCQQLQQLKHGKT

SEQ ID NO: 207065 - protein, 71 aa, Glycine max
  Coding DNA Sequence Number=SeqID_90287
MPIFVPKASAVNGMMDKPLCRNCLGSGAVLYCFDIIPDAICCNLINENGKLLTGSELKMFTNLLSVQIVMV

SEQ ID NO: 207066 - protein, 94 aa, Glycine max
  Coding DNA Sequence Number=SeqID_90288
  Homolog annotation: Hit_ID=Q1RYI2; Match level="QueryCoverage=92%, HitCoverage=14%, E-value=8e-08, Identity=34%"; Hit description =Ribonuclease H
MTFGPLSMMNPKRKEVAICWTPPPISFVKINVNGSYKSSTGRAVCGGIVCDHMDNIVTTFHHKLGICNLLWAELWALRLGIQVAKDLGLKDISF

SEQ ID NO: 207067 - protein, 433 aa, Glycine max
  Coding DNA Sequence Number=SeqID_90289
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q69T67; Match level="QueryCoverage=75%, HitCoverage=30%, E-value=9e-54, Identity=56%"; Hit description =Lustrin A-like
  Subcellular localization annotation: CTP_CleavageSite=63; ConfidenceScore=5.68e-01
MVDSPSVSGNRLLTRTDSMRFFSSRGVKSFASGFTLASILLMLFLILNPSSYQSSPRLRNAFQSSRGGYHFSNVFAHIFPNSSSSPPSHDQTSKNDDAIDLRLGTSAPSPSQISRKEGSGLTAKEEHRIQAPPQEPSLTAWSPLPIPITWSPSPTASSPNEKHSEQDWMEMWKDCDMYEGSWVRDDSYPLYIAGSCPYIDEPFNCFRNGKSENMYEKYRWQPKNCNVPRYFLMSSITLSMYRKQCKGEILWYPQKFKGFDKAIEKLSPLMCPNSFNYWSKTFIPELFSKFLSEMSNVRRFKANEMLEMLRGKRLVFVGDSLNRNMWESLVCVLRNSVKDKSRLFEASGREEFRTEGSYSFIFQDYNCSVEFFRSVFLVQEWEIPDQKGSTKETLRLDLLERSCDKYKDADVLIFNTGHWWTHEKRIEGYCFFF

SEQ ID NO: 207068 - protein, 309 aa, Glycine max
  Coding DNA Sequence Number=SeqID_90290
MSQQQNQNLPAVSQSLLQQTVSGADVKPFSIRQYVIASRHINILHNWPFHEKHLQLCLNHGLKEVLPPFGRQTSPAESLQGCSNLMQSLDDNDNKEADFCKAEVPHLIDDDHPQSTNNECVYKVTNHTSAHEEASHSNQLNCSISDNLSQPAANTCTLPSSTHASKSLPSSKAVKDKRKRRKWRCKKRSMVDILAVARHTTLEEIHRMNKFYYAETVIKGCQQTVPHENISRSEVVGLDSCRKAGSEDHGVANVDMTPKGPLLLKFKLNGCNEISDKYADLVTIKVANTPKIMIKITLVDCFLKFFAHS

SEQ ID NO: 207069 - protein, 139 aa, Glycine max
  Coding DNA Sequence Number=SeqID_90291
  Gene Ontology: Mol. function=protoheme IX farnesyltransferase activity; Cellular component=integral to membrane; Biological process=heme biosynthetic process
  Homolog annotation: Hit_ID=Q1SCR9; Match level="QueryCoverage=87%, HitCoverage=69%, E-value=3e-39, Identity=64%"; Hit description =Putative heme A-related
MENPDTHVSALSTGGLTSGWFCLESAALTLAISAAAFSFYRNRTKEKARRMFHASLLYLPVFMSGLLIHRRSENEQFLEDKAKGFVKSASSTESSELDDDNGDQNIKARRPYRTEARPPVSYASVAPFPFLPAPSYNFP

SEQ ID NO: 207070 - protein, 444 aa, Glycine max
  Coding DNA Sequence Number=SeqID_90292
  Gene Ontology: Mol. function=protein serine/threonine kinase activity; Cellular component=lysosome; Biological process=protein amino acid phosphorylation
  Homolog annotation: Hit_ID=Q2QX93; Match level="QueryCoverage=98%, HitCoverage=57%, E-value=0.0, Identity=72%"; Hit description=WD repeat domain 48, putative, expressed
  Pfam annotation: Domain name=WD40; Domain location=124-163; Score =33.5; E_value=7.4e-07; Accession=PF00400.22; Description=WD domain, G-beta repeat
  Pfam annotation: Domain name=WD40; Domain location=216-254; Score =26.4; E_value=0.0001; Accession=PF00400.22; Description=WD domain, G- beta repeat
  Pfam annotation: Domain name=WD40; Domain location=258-296; Score =39.5; E_value=1.2e-08; Accession=PF00400.22; Description=WD domain, G-beta repeat
  Pfam annotation: Domain name=WD40; Domain location=300-338; Score =21.5; E_value=0.003; Accession=PF00400.22; Description=WD domain, G -beta repeat
  Pfam annotation: Domain name=WD40; Domain location=33-76; Score=14.3; E_value=0.43; Accession=PF00400.22; Description=WD domain, G-beta repeat
  Pfam annotation: Domain name=WD40; Domain location=82-119; Score =27.8; E_value=3.7e-05; Accession=PF00400.22; Description=WD domain, G-beta repeat
  Pfam module annotation: Pfam domain module=WD40::WD40::WD40::WD40::WD4 0::WD40; Domain location=124-163::216-254::258-296::300-338::33 -76::82-119
MVIPNVSAMHRVGSASNGNNSTRPRKEKRLTYVLNDSDDIKHCAGINCLALLTSAASDGSDYLFTGSRDGRLKRWALGVDRATCLATFESHVDWVNDAVLVGDSTLVSCSSDTTLKTWNALSFGTCTRTLRQHSDYVTCLAAAEKNNNIVASGGLGGEVFIWDIEAALAPVSKCNDDTVDESSNGINGSGNLLPLTSLRTINSSDNMSMHTTQTQGYIPIAAKGHKDSVYALAMNESGTILVSGGTEKVVRVWDTRSGSKTLKLRGHTDNIRALLLDSSGRYCLSGSSDSMIRLWDIGQQRCVHSYAVHTDSVWALASTPAFSHVYSGGRDFSLYLTDLQTRESSLLCTGEHPILQLALHDDSIWVATTDSSVHRWPAEGCNPQKIFLRGNSFLAGNLSFSRARVSLEGSTPVPVYKEPTLTILGTPAIVQHEVLNNKRHVLTK

SEQ ID NO: 207071 - protein, 75 aa, Glycine max
  Coding DNA Sequence Number=SeqID_90293
MAERASRRGERNGWRGEIKGSFRRGWERKGGSGRKKEKEKGRKLGNSKKGKRKEGWVKNFELGDKRIISRENKNQ

SEQ ID NO: 207072 - protein, 113 aa, Glycine max
  Coding DNA Sequence Number=SeqID_90294
MNHISDIKLKNRFREHFLHNGSVYIPEMTMGENLISPNVVTRCRSRELVKHAKYNIELNQKGAARTQAPTTTNYDVGSPTWGDLRWAPLQSAMEVTNLGHGHSRSSIDPTQIA

SEQ ID NO: 207073 - protein, 267 aa, Glycine max
  Coding DNA Sequence Number=SeqID_90295
MPSLRILNKICYSINQNCKYKYRTISSTAQLQGSWMEKVKNVITGQKSTPQSQGDASQVTSDSFTLLRFADEMKNAKRIGAFKEFMAGRSSEATFSSAFDKYEAIIRSLGALDPTGENLPTAQKQEAAKHCNCTIADVEDALAKFTWAKEAQKKIQKLKEEGKPMPKSFAEVQKLVGSTPLDLARSNLAQAGLISRNALCPCGAAEMTEGIQRLNVKLQGSLIYYGGSIPTHMHIAELICSRTLFYSVQIKLAYALDCKHAPKLILG

SEQ ID NO: 207074 - protein, 115 aa, Glycine max
  Coding DNA Sequence Number=SeqID_90296
  Gene Ontology: Mol. function=N-acetyltransferase activity; Biological process=metabolic process
  Homolog annotation: Hit_ID=Q9LJ90; Match level="QueryCoverage=75%, HitCoverage=59%, E-value=2e-16, Identity=41%"; Hit description =Alanine acetyl transferase-like protein
MGVQEGLWPRFGDLHCTLEGVSLRPLKMSDVDDFLLWAGDDQQALTVIRDLCMPHPWTRSICVDDVTIGFVSVSPGTGDDRCRAEIDYVIVAKYWGQGISTKAVKIAVTSLQGCA

SEQ ID NO: 207075 - protein, 539 aa, Glycine max
  Coding DNA Sequence Number=SeqID_90297
  Gene Ontology: Mol. function=galactose oxidase activity; Biological process=cell wall catabolic process
  Homolog annotation: Hit_ID=Q10NU0; Match level="QueryCoverage=93%, HitCoverage=94%, E-value=1e-161, Identity=54%"; Hit description =Glyoxal oxidase, putative, expressed
  Pfam annotation: Domain name=DUF1929; Domain location=444-538; Score =114.4; E_value=3.2e-31; Accession=PF09118.1; Description=Domain of unknown function (DUF1929)
  Pfam annotation: Domain name=Glyoxal_oxid_N; Domain location=46-290; Score=562.4; E_value=4.6e-166; Accession=PF07250.2; Description =Glyoxal oxidase N-terminus
  Pfam module annotation: Pfam domain module=DUF1929::Glyoxal_oxid_N; Domain location=444-538::46-290
MSTIMILIPFILASLFPFFQAQPLSSAFANQGQWNLLQPSIGISPMHMQLLHNDKIIMFDRTDFGHSYLPLSNGRCRMDPNEIALKVDCSAHSVLYDVATNTFRPLMIQTDTWCSSGSVLPNGTLVQTGGYNDGERSIRMFTPCFGETCDWVEFPGLLSQRRWYATNQILPDARVIVVGGRRQFNYEFLPKTPSPNSSPSSIPLNFLQQTSDRSENNLYPFVHLLPDGNLFIFANTKSVLFDYKQNSVIREFPPIPGGDPRNYPSSGSSVLLPLDENLDSLEPEVVVCGGAPRGSFENAARGNFVQALGTCGRIKVTDSNPNWVMQNMPMPRAMGDMLLLPNGDVVIINGAGAGTAGWEHGHDPVLSPVIFRPSETVNQFSVMAPASRPRLYHSSAVLLRDGRVLVGGSNPHVFYNFTGVEYPTDLSLEAFSPPYLAPDFAPVRPVIRVFCYVTFTVPNYASVSEVSIRIVAPSFTTHSFGQNQRMVVLKLSAVTYLAGEAYYATVMGPSTAEIAPPGYYLLFVVHKGVPSWGSWVQVM

SEQ ID NO: 207076 - protein, 169 aa, Glycine max
  Coding DNA Sequence Number=SeqID_90298
  Gene Ontology: Mol. function=acyltransferase activity; Cellular component=plastoglobule; Biological process=metabolic process
  Homolog annotation: Hit_ID=Q1SYE9; Match level="QueryCoverage=54%, HitCoverage=13%, E-value=1e-43, Identity=82%"; Hit description =Esterase/lipase/thioesterase; Phospholipid/glycerol acyltransferase
MALVTGFLASHVGAVRHHRFEVGIGVRAVSSSESETVAAVNGSSSRNGSLLLKEEKKVPFLRVEEKKNKRGEEEEEGLAALWDDGYGRRSVEDYFAAAKEMCKSDGGPPRWFCPLECGPPFKDSPTLLFLPGMDGTGLGLTLHHQALGKAFEVRCLHIPVHDRTPFEGL

SEQ ID NO: 207077 - protein, 884 aa, Glycine max
  Coding DNA Sequence Number=SeqID_90299
  Gene Ontology: Mol. function=protein serine/threonine kinase activity; Cellular component=lysosome; Biological process=protein amino acid phosphorylation
  Homolog annotation: Hit_ID=Q2QX93; Match level="QueryCoverage=75%, HitCoverage=95%, E-value=0.0, Identity=62%"; Hit description=WD repeat domain 48, putative, expressed
  Pfam annotation: Domain name=WD40; Domain location=216-259; Score =15.2; E_value=0.24; Accession=PF00400.22; Description=WD domain, G -beta repeat
  Pfam annotation: Domain name=WD40; Domain location=265-302; Score =26.2; E_value=0.00011; Accession=PF00400.22; Description=WD domain, G-beta repeat
  Pfam annotation: Domain name=WD40; Domain location=307-346; Score =34.4; E_value=3.9e-07; Accession=PF00400.22; Description=WD domain, G-beta repeat
  Pfam annotation: Domain name=WD40; Domain location=399-437; Score =26.4; E_value=0.0001; Accession=PF00400.22; Description=WD domain, G- beta repeat
  Pfam annotation: Domain name=WD40; Domain location=441-479; Score =39.5; E_value=1.2e-08; Accession=PF00400.22; Description=WD domain, G-beta repeat
  Pfam annotation: Domain name=WD40; Domain location=483-521; Score =13.9; E_value=0.59; Accession=PF00400.22; Description=WD domain, G -beta repeat
  Pfam module annotation: Pfam domain module=WD40::WD40::WD40::WD40::WD4 0::WD40; Domain location=216-259::265-302::307-346::399-437::441 -479::483-521
MQLVEVIDEFDQSLTRGTGLTSATGDLSYTGLANSRVIRLRSQLINEQIAIKLASPVELKSPVTLARPMSRVKGRPNSPIAFASLPWLLGVRLAIDFVALRFDLNRIESSVRLICDYALTGGSDSMEIMSLNFAWIRSFLVNVKNTSRVVDFSISVWHIEKRAPGLYRYAVMPNAFLYVVSVGVEVFGFSAMHRVGSASNGNNSTRSRKEKRITYVLNDSDDTKHCAGINCLALLTSAASDGSDYLFTGSRDGRLKRWALAVDRATCSATFESHVDWVNDAVVVGDSTLVSCSSDTTLKTWNALSFGTCTRTLRQHSDYVTCLAAAGKNSNIVASGGLGGEVFIWDIEAALTPVSKCNDATVDESSNGINGSGNVLPLTSLRPINSSNNMSMHTTQTQGYIPIAAKGHKDSVYALAMNESGTILVSGGTEKVVRVWDARSGSKTLKLRGHTDNIRALLLDSSGRYCLSGSSDSMIRLWDIGQQRCVHSYAVHTDSVWALASTPTFSHVYSGGRDFSVSEHPILQLALHDDSIWIASTDSSVHRWPAEGYDPQKIFQRGNSFLAGNLSFSRARVSIEGSTPVPVYKEPILTILGTPAIVQHEVLNNKRHVLTKDASGSVKLWEITKGVVIEDYGKVLFEEKKEELFEMVSIPAWFTVDTRLGSLSVHLDTPQCFSAEMYSADLNVVGKPEDDKINLARETLKGLLAHWLRKRKQRMGSPAPANGELLSGKDISSRSLAHSRIEVDGSSENDAMVYPPFEFSVTSPPSIITEGTHGGSSVQILTQGKLSAPRILRVHKVINYVIEKMVLDKPLDSLSGDGSFAPGLTGSQSQLQAVGDGSFRSGFKPWQKLRPSIEILCNNQASSLLSTCLICNLMTVHIAWFSRC

SEQ ID NO: 207078 - protein, 85 aa, Glycine max
  Coding DNA Sequence Number=SeqID_90300
MCGGGLGCADGEGEGATKGWRPRWWEQCDGEEVPFGVASCRSEPLARRRQSFGGAEYRLMGLTEQTNTKVSIIGLERQGYSGHVA

SEQ ID NO: 207079 - protein, 86 aa, Glycine max
  Coding DNA Sequence Number=SeqID_90301
  Homolog annotation: Hit_ID=Q1RV98; Match level="QueryCoverage=98%, HitCoverage=6%, E-value=3e-22, Identity=65%"; Hit description =Phospholipase, patatin family, putative
MVALSMSQDTVVVELRPRDDDESVVDLGMKVVKRREPLRAVTMAKAVASDQQSDGIGILIRLLRSDLPSSTPPNVGDVVLAGSGHH

SEQ ID NO: 207080 - protein, 144 aa, Glycine max
  Coding DNA Sequence Number=SeqID_90302
  Gene Ontology: Mol. function=oxidoreductase activity; Cellular component=membrane; Biological process=electron transport
  Homolog annotation: Hit_ID=Q1S4Y7; Match level="QueryCoverage=54%, HitCoverage=14%, E-value=1e-20, Identity=62%"; Hit description =Berberine and berberine like, putative
  Subcellular localization annotation: CTP_CleavageSite=24; ConfidenceScore=5.24e-01
MSPPPLEPHNHSQTHLKLSGRLPLQARFSAGLHTTKSLKLSRTWTFLSLENPRHAKLQEKAKVEVLLNRQPKSVKYLKRKFDYVKKSISKEGLEGIWRKMIELVDTSLNFNLYGGRMAEIPSTTSPFPHRAGNLWKIQYLAKTS

SEQ ID NO: 207081 - protein, 276 aa, Glycine max
  Coding DNA Sequence Number=SeqID_90303
  Gene Ontology: Mol. function=hydrolase activity, acting on carbon -nitrogen (but not peptide) bonds; Cellular component=cortical actin cytoskeleton; Biological process=nitrogen compound metabolic process
  Homolog annotation: Hit_ID=Q1SCR6; Match level="QueryCoverage=98%, HitCoverage=94%, E-value=2e-94, Identity=61%"; Hit description =Nitrilase/cyanide hydratase and apolipoprotein N-acyltransferase
  Pfam annotation: Domain name=CN_hydrolase; Domain location=1-177; Score=5.4; E_value=3.4e-05; Accession=PF00795.12; Description=Carbon- nitrogen hydrolase
MASNLAANMATCSHLLKEAASAGAKLLCFPEAFSYVGTMDGDSVLVAEPLDGPIMNHYCSLARFDVDVPGGRVYKESSFTESVLPQRNSLSRKSEGKGEGECLKEKISTLGYDMHHEGWGFHVNFFCFGDVFRLDIVAVDSPIGRLGLSVCYDLRFPEMYQLLRFQHEAQVLLVPAAFTTVTGEAHWEILLRARVIETQCYVIAAAQAGKHNDKRESYGNTLIIDPWGTIVGRLPDRLSTGIVVADIDLSFVDSVREKMPIAKQRKPIDFWKAASL

SEQ ID NO: 207082 - protein, 74 aa, Glycine max
  Coding DNA Sequence Number=SeqID_90304
  Gene Ontology: Mol. function=oxidoreductase activity; Cellular component=membrane; Biological process=electron transport
  Homolog annotation: Hit_ID=Q9FKU9; Match level="QueryCoverage=90%, HitCoverage=13%, E-value=1e-18, Identity=61%"; Hit description =Berberine bridge enzyme-like protein
  Pfam annotation: Domain name=BBE; Domain location=12-65; Score=90.8; E_value=4.2e-24; Accession=PF08031.2; Description=Berberine and berberine like
MTPFVSKNPRRAFFNYRDLDLGSINCNAKGRVYGVKYFKDNFNRLVQIKTKVDPDNFFITAQSIPMVPYQKLLE

SEQ ID NO: 207083 - protein, 955 aa, Glycine max
  Coding DNA Sequence Number=SeqID_90305
  Gene Ontology: Mol. function=GTPase activity; Cellular component =cytoplasm; Biological process=immune response
  Homolog annotation: Hit_ID=Q1SCR5; Match level="QueryCoverage=97%, HitCoverage=98%, E-value=0.0, Identity=63%"; Hit description=Moesin; Prefoldin
  Subcellular localization annotation: CTP_CleavageSite=10; ConfidenceScore=5.26e-01
MKKFFFFKSSASSSGSNNDAAPPKSTNKQAAWDSFSDIGMNNNQAYGKTKSEDYFQSPKGFFSKSRKHVSDNQSSSAGPDLRRSRSLSSSTYQFRDSTRSPSSSIVSDPYQQVERSSRSQAPNYEKQKRDKPTQVAVPSVQNLHRYERPGSPSSSRSHHESSGNSSTCSSNISSKIVDRYIDGEQHPEEIRPRNNSQRNNSRQGNYGVKLPPKVQLTAPNSPTHGVKDKPRTHSFREAKATRLGFSSRDWTENGFGPESPRSLAKNVIERLSQSCDLAKPCSKNANVDNPITIEDIYSRSVNGHYDSDFDAAQPKNDLLDEPYRMTNGYHGMDGNFEGLSCDEAEEDADAELMRRSKEAEERVILLSKKLERDSFFPDGGYDVSALIQTIRHLLEEKISLALEVSTHLRSQIAERVSAREELRRVKTELEFRTQRLEKEKNEMQSALEKELDRRSSDWSFKLEKYQLEEQRLRERVRELAEQNVSLQREVSSFSEREMESKSVMAFTDQQLKGLTDKTEIMKNEIIDLQQNLLELQEKYKIAEENRDCILRNFEEKEKECKELHKSLTRLLRTCSEQEKSITGLQDGFSEELRRNHPIESVDNHIEKMRMEQMRLTGVELALRKELESCRFEADSLRHENIILLNRLKGDGKESVAATYRLDKELCARIYCLQNQGLTMLNESTYLCSKLLEFVKGKGSRLHQNVQPDREVIGNGLDGQFIVESETKIQGLKSGTEGLTRSLQMMSSLLKDKSNPLTCKFQSECIDAGKLATLNDQSSEDILRTELKAECLVTSLLREKLYSKELQVEQMEAELASAVRGNDILRSEVQNALDNLSSVTHKLKDLELQMLKKDESRNCLQNDLQESNRELTIMRGKLPKVTEERDYMWEQVKQYSEQNMLLNAEVNVLKKKIETLEENNLEKEGQISILQDSLAKRSYDDLLGSPAHEFFSTKLL

SEQ ID NO: 207084 - protein, 233 aa, Glycine max
  Coding DNA Sequence Number=SeqID_90306
  Subcellular localization annotation: CTP_CleavageSite=20; ConfidenceScore=5.24e-01
MSQQQNLSSVSQSLLQQTISGANVKPFSIRQCVLASRHTNILQSWPFHEKHLQLCLNQGLKEVLPPFGRQASPAESVQGCSNLMQSLDDNVKEADFCKAEVPHLYDDHPQNIKNECDYKVTKQPSSHEEGNQHKCSISSTSNVHKSSPPLPPSKAVKDKRRRCRGRRKKRSIVDILAMARHSTLEEIHGMNKFYYAATVIEGCQQTGAYENISKSELAGEDSCRNAGSEDLVV

SEQ ID NO: 207085 - protein, 62 aa, Glycine max
  Coding DNA Sequence Number=SeqID_90307
  Homolog annotation: Hit_ID=Q2QQS5; Match level="QueryCoverage=69%, HitCoverage=8%, E-value=7e-14, Identity=86%"; Hit description=Cyclin family protein, putative, expressed
MAIATVCMFHAGKVEKTPHPLKDAILVSYEIIHKKDPDAAQRIKQKPKVVAMSYAKRKRLQE

SEQ ID NO: 207086 - protein, 93 aa, Glycine max
  Coding DNA Sequence Number=SeqID_90308
MRNEDRRKSFFSGQKLVLYATFFGVWRRYGLTVEDFNLAHRIVQPIFRTQTTMYYMDSLNPTVVDHIHLANLEEKLFVAGRSNGKPYKAIREV

SEQ ID NO: 207087 - protein, 409 aa, Glycine max
  Coding DNA Sequence Number=SeqID_90309
  Gene Ontology: Mol. function=nucleic acid binding
  Homolog annotation: Hit_ID=Q1RWP6; Match level="QueryCoverage=28%, HitCoverage=8%, E-value=7e-21, Identity=46%"; Hit description=Zinc finger, CCHC-type; Polynucleotidyl transferase, Ribonuclease H fold
MGCLFVRLYASVYPSQFLWVFSLAEGSEVEGSAGGTRVASKAPSANEEQASKQISSQAPQHKSVDTTAIPQRGTKNQSNDGSVEMGSDITDHNLDIRESHNLEQLTHQDNKRQVSNRSKSSTQRDQDRIVGTKQGAEVGRRDESALNNSGSNVGRNLERQEVPLGHSPNEAIKIDKDKLKALAAMGEKRKEQRGEMALKKHVMDEDYLIERELENGIELAVEDDKITYWIWINLIQFNGRRGRATMSKSRGSMLNVKERTKQKGEQTCARVQRKEQAESTTVCHSSTIGEGDVAIVNPTYTQWTLQDHYAFVTLLGSYNSDAQIVMTYAKSSTIAWNRLNKQYVNCSRTRVMSLKERLATITKGTSSVSVYLHSIKVITDELALIGHPIDDLDLVIVALNGLGQLSREF

SEQ ID NO: 207088 - protein, 57 aa, Glycine max
  Coding DNA Sequence Number=SeqID_90310
MEREEKRIMIQREWRKELGLPVTLNAIDSDSRFLSAFSMVPPFEEFFGISIGSNERD

SEQ ID NO: 207089 - protein, 222 aa, Glycine max
  Coding DNA Sequence Number=SeqID_90311
  Homolog annotation: Hit_ID=Q1SYE0; Match level="QueryCoverage=69%, HitCoverage=14%, E-value=1e-56, Identity=70%"; Hit description=HASTY
  Pfam annotation: Domain name=Xpo1; Domain location=4-118; Score=3.0; E_value=0.0029; Accession=PF08389.2; Description=Exportin 1-like protein
MTRMQDTCCNHNTCSCCNSRQSDRRRLLLRGLTQSLPEILPLLYTLLERHFTAAMNEAGRKQMDIAKQHAATVTATLNAVNAYAEWAPLSDFAKSGIIHGCGVLLSAPDFRLHASEFFKLVSPRKRPIDASASEFDQAMSSIFQILMNVSREFLYRSGSGPGSMDEGEYEFAEFICESMVSLGSYNLQSIAGDSTILPLYLEQGDAAPLFSILLGQAMAGVA

SEQ ID NO: 207090 - protein, 109 aa, Glycine max
  Coding DNA Sequence Number=SeqID_90312
MGRGWRVREQKGRGTRSERQQVNQGRRRAGEAEFFVQCPTETHHHGGRAVAPLLHPKSELASLLSFQTKEENNNRSYFSHIYDFCYIGAYGSYYPNVNSCKLTAYGTLS

SEQ ID NO: 207091 - protein, 328 aa, Glycine max
  Coding DNA Sequence Number=SeqID_90313
  Homolog annotation: Hit_ID=Q1SYE0; Match level="QueryCoverage=90%, HitCoverage=27%, E-value=1e-122, Identity=76%"; Hit description=HASTY
MSAVILLSCYSGFGIGCSMPLSGITMHYVAMHEMLGFFQHFKFGIHFQSMHFWLVLMRDLMSKPKNSTHSAADSSAVSSTGSGEVENAKKKTLSFVSDDFCGAILDTSFPRMLKREKILHETAISLGALELWSDDFEGKGTFSQYRSRLLELIRFVSFYKPLIAATKVSEKIDTIIKGLLLSSAPTQDLAVMESMQLALENVVNAAFDGSNDFTKANAEVQLALCRTFEGLLQQFISLKWTEPALVEVLVHYLDAMGPFLKYFPDAVGSVINKLFELLTSIPLVIKVPATTPFHDMSMHNARHARLQTCTSFIRIAKTADKSILPHMK

SEQ ID NO: 207092 - protein, 318 aa, Glycine max
  Coding DNA Sequence Number=SeqID_90314
  Homolog annotation: Hit_ID=Q1SYE0; Match level="QueryCoverage=95%, HitCoverage=27%, E-value=1e-131, Identity=77%"; Hit description=HASTY
MHLQGLAYGAILLVGIADTMGCLQREGRLLQGEHNLLGEAFLVMASSAGIQQQQDVLRWLLEPLSIQWTQSEWQDKYLSGPHGLVQLCSDAPVMWSIFHTLTFFERALKRSGLKKANWNSENSSTPNSTPLNPMASHISWMVTPLLKLLRCIHSLWSPSVSQALPGEVRAAMVMGDVERFSLLGEGNSKLPKGVTDGSKVDMNKEGYAEPNESDIRNWFKGIRDSGYNVLGLSTTVGDSFFKYLDVHSVAVALMENIQSMEFRHIRQLVHSTLIPLVKNCPLDMWEIWLEKLLHPLFVHAQQALSCSWSSLLQDGRAK

SEQ ID NO: 207093 - protein, 460 aa, Glycine max
  Coding DNA Sequence Number=SeqID_90315
  Gene Ontology: Mol. function=translation initiation factor activity; Cellular component=eukaryotic translation initiation factor 2B complex; Biological process=regulation of translational initiation
  Homolog annotation: Hit_ID=O64760; Match level="QueryCoverage=97%, HitCoverage=58%, E-value=1e-143, Identity=57%"; Hit description =Putative translation initiation factor eIF-2B epsilon subunit
  Pfam annotation: Domain name=Hexapep; Domain location=132-149; Score =6.2; E_value=26; Accession=PF00132.14; Description=Bacterial transferase hexapeptide (three rep
  Pfam annotation: Domain name=Hexapep; Domain location=69-86; Score =18.1; E_value=0.031; Accession=PF00132.14; Description=Bacterial transferase hexapeptide (three rep
  Pfam annotation: Domain name=Hexapep; Domain location=92-109; Score =21.2; E_value=0.0038; Accession=PF00132.14; Description=Bacterial transferase hexapeptide (three rep
  Pfam annotation: Domain name=W2; Domain location=377-459; Score =101.4; E_value=2.6e-27; Accession=PF02020.8; Description=eIF4 -gammaeIF5eIF2-epsilon
  Pfam module annotation: Pfam domain module=Hexapep::Hexapep::Hexapep:: W2; Domain location=132-149::69-86::92-109::377-459
YAARIDNFRSYDTVSKDIIHRWTYPLVPDVMNFGDTATKLERQGIYRASGMDENFVVYIGNAEISQSQSAVIGPFTVIGSGTKIGHNTKILNSVIGEGCKIGSNVIIEGCYIWDNISIEDGCKLQHAIVCDGVIIKSGAVLEPGVILSFKVVVGPEFVVPPYSNVSLLQQPIEEDSDEELEYADSTSVIGSQVDKSDVEIASKVLETHFSPASELGMGGAGHVWSTCEGSHEEEWRHSVAPIPKDKVMEAIKTMKDDLENDDSFLPPSGELKPNSNYSDDDDHEDSRDDSYYFEKEVEATFLRAVHENIQESHLILEINSLKLSYNKLAADCAGAVFSAMMKYALDTPHSSADVLLQNVQAVFTKWKKALTSYLTDIDEQIEVILKFEEICEESAKEFAPLFTRILHYLYNEDVVEEDAILSWEAELKDADEADKVFVKQAQKLIQWLKEAPEEDDDDEE

SEQ ID NO: 207094 - protein, 542 aa, Glycine max
  Coding DNA Sequence Number=SeqID_90316
  Gene Ontology: Mol. function=sodium:hydrogen antiporter activity; Cellular component=integral to membrane; Biological process=sodium ion transport
  Homolog annotation: Hit_ID=Q1SYD9; Match level="QueryCoverage=98%, HitCoverage=99%, E-value=0.0, Identity=71%"; Hit description =Sodium/hydrogen exchanger
  Pfam annotation: Domain name=FtsX; Domain location=190-357; Score= -30.0; E_value=0.096; Accession=PF02687.11; Description=Predicted permease
  Pfam annotation: Domain name=MFS_1; Domain location=150-476; Score= -40.6; E_value=0.023; Accession=PF07690.6; Description=Major Facilitator Superfamily
  Pfam annotation: Domain name=Na_H_Exchanger; Domain location=24-439; Score=171.2; E_value=2.7e-48; Accession=PF00999.11; Description =Sodiumhydrogen exchanger family
  Pfam module annotation: Pfam domain module=FtsX::MFS_1::Na_H _Exchanger; Domain location=190-357::150-476::24-439
MGGELSYVLSKMEMLTSDHASVVSMNIFVALLCACIVIGHLLEENRWLNESITALLIGICTGVVILLLSRGKSSHLLVFSEDLFFIYLLPPIIFNAGFQVKKKQFFVNFITITLFGAVGTLISCSIITFGVTQIFKRMGVGKSLDMGDYLAIGAIFAATDSVCTLQVLNQDETPLLYSLVFGEGVVNDATSVVLFNAIKSFDLNKIDHRIGLHFFGNFLYLFTTSTLLGVLAGLLSAYIIKTLYIGRHSTDREVALMMLMAYLSYILAELWYLSGILTVFFCGIVMSHYTWHNVTESSRITTKHAFATLSFVLETFIFLYVGMDALDIEKWRPKTSVAVSSVLLGLVLAGRAAFVFPLSFLSNLTKKTQSEKISFREQVIIWWAGLMRGAVSMALAYNQFTLSGHTELRTNAIMITSTITVVLVSTMVFGLMTKPLIRFLLPINPPPKRKNSMSDIGSFNNSPKSITMPFLGGSQDSENEFDGSENQRPSSIRALLTTPTHTVHQLWRNFDNSFMRPVFGGRGFVPVVPTSTTARTINQQWH

SEQ ID NO: 207095 - protein, 420 aa, Glycine max
  Coding DNA Sequence Number=SeqID_90317
  Gene Ontology: Mol. function=peptidase activity; Cellular component =cellulose and pectin-containing cell wall; Biological process =proteolysis
  Homolog annotation: Hit_ID=Q1SAR7; Match level="QueryCoverage=88%, HitCoverage=92%, E-value=6e-39, Identity=29%"; Hit description =Eukaryotic aspartyl protease, putative
  Pfam annotation: Domain name=Asp; Domain location=98-389; Score= -134.8; E_value=1.2e-05; Accession=PF00026.14; Description=Eukaryotic aspartyl protease
MDLKLAQETVVMATPLVYTLVSLPFIFHFSLTTATITTSTINLVIKLIHHESSLSPYNSKDTIWDHYSHKILKQTFSNDYISNLVPSPRYVVFLMNFSIGEPPIPQLAVMDTGSSLTWVMCHPCSSCSQQSVPIFDPSKSSTYSNLSCSECNKCDVVNGECPYSVEYVGSGSSQGIYAREQLTLETIDESIIKVPSLIFGCGRKFSISSNGYPYQGINGVFGLGSGRFSLLPSFANMQGDSTTLNVINGLYYVNLEAISIGGRKLDIDPTLFERSITDNNSGVIIDSGADHTWLTKYGFEVLSFEVENLLEGVLVLAQQDKHNPYTLCYSGVVSQDLSGFPLVTFHFAEGAVLDLDVTSMFIQTTENEFCMAMLPGNYFGDDYESFSSIGMLAQQNYNVGYDLNRMRVYFQRIDCELLDG

SEQ ID NO: 207096 - protein, 223 aa, Glycine max
  Coding DNA Sequence Number=SeqID_90318
  Homolog annotation: Hit_ID=O82222; Match level="QueryCoverage=60%, HitCoverage=82%, E-value=3e-55, Identity=75%"; Hit description =Expressed protein
  Pfam annotation: Domain name=DUF788; Domain location=26-219; Score =156.4; E_value=7.4e-44; Accession=PF05620.2; Description=Protein of unknown function (DUF788)
  Subcellular localization annotation: CTP_CleavageSite=57; ConfidenceScore=5.63e-01
MKNVGPVGPLSKFGCSVPASRSRSRTQVACGCWGKNRKRWRIRVLRNARKRTLVTWRGSAKSSSPATMLVFHSSFTWKHWIGLIVTSLAYVIPYQQLAKMATPAYAEDGELLDGGFDMSTGGVCGYLHDVIYITCFVQVMSIVSGKFWYTYLVIPAFGAYKSFGFIKGFLPGGSEVRSPLLINVYFKTTYRTMESFEDEKTRKKREKMEKKASRPKFAKTRTR

SEQ ID NO: 207097 - protein, 341 aa, Glycine max
  Coding DNA Sequence Number=SeqID_90319
  Gene Ontology: Cellular component=phycobilisome; Biological process =photosynthesis
  Homolog annotation: Hit_ID=Q2R3H0; Match level="QueryCoverage=85%, HitCoverage=41%, E-value=2e-29, Identity=31%"; Hit description =Expressed protein
  Subcellular localization annotation: CTP_CleavageSite=16; ConfidenceScore=5.47e-01
MGQEPPQSVRGMPSVRSSASSNALAEQPPPRTPTLTNNAEQQPPSARLTPGNRTLELSPSARTIIITRSPQPSSANNDQPPSARSTSGRPSGLSKVVPMVPPSVPITLRPVSSVGVPPSEPLLDIRKDRRHAAATVRENANQQQRPTSELEDELRLAEEKCEEAESRVRQLEQQAALRNASKNHGGFQTALQADAETAREETASAFEKLRLMTQRMILTPEEMEEVVLKRCWLARYWGLCVRHGIHADIAEAKYKYWSMFAPNPIEVVLAAAKKAKEEKDLDVEDTEGQLDLKELSGEGNIENMLFVEQGLRQLASLKVEEALAVALAQHRRPNMLKAGFS

SEQ ID NO: 207098 - protein, 144 aa, Glycine max
  Coding DNA Sequence Number=SeqID_90320
  Subcellular localization annotation: CTP_CleavageSite=51; ConfidenceScore=5.69e-01
MEAFRAASTSQLPASNMDRRRIYDRQNSSSGTPSSPSSPVNMISPLHRHARAGSTGSAMTNVRRAQNNATKAAAQRLAQVMSHTDDDDEDEDDVPLDYSAIAGGGGIGLGGGRPMPARSPMAVRSVQDAASARSRSPLVISFLS

SEQ ID NO: 207099 - protein, 124 aa, Glycine max
  Coding DNA Sequence Number=SeqID_90321
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q6PUG0; Match level="QueryCoverage=88%, HitCoverage=21%, E-value=6e-24, Identity=52%"; Hit description=3 -dehydroquinate dehydratase / shikimate dehydrogenase isoform 2
MGSNQVWKHSVMVCAAITTHQYVSAEQIVNGMHQAKAEGADIVELRLDCITNFHSHHDLKIILQNKPLPVLIVNRPKWEGGLYEGDENKRLEALQLAVELSADFIDVELKLFRQLLVFQPWWNI

SEQ ID NO: 207100 - protein, 312 aa, Glycine max
  Coding DNA Sequence Number=SeqID_90322
  Gene Ontology: Mol. function=nucleic acid binding
  Homolog annotation: Hit_ID=Q1SYD5; Match level="QueryCoverage=53%, HitCoverage=96%, E-value=6e-87, Identity=91%"; Hit description =Transport protein particle (TRAPP) component, Bet3
  Pfam annotation: Domain name=TRAPP_Bet3; Domain location=9-177; Score= 209.0; E_value=1.1e-59; Accession=PF04051.6; Description=Transport protein particle (TRAPP) component, Bet3
MVREVSESCIDSLLTEMVACYCNRFYANKPELAARRIEAIGYQVGHQLSERYTMDRPRFTDHLEAIKFICKDFWSELFKKQIDNLKTNHRGTFVLQDNKFRWLARMSIDPSTENVSPVEDITSPTAESKAAQAMSMHLYFPCGIIRGALSNLGIPCAVSADISNLPACADSMEYDNIELLDCGKTENSNHCNIVALFVWLATLFSLPRKSTVTTKGILRTLCSSSDPRVRQVIHVNLQLFAELGAHDGEELSPTPSKSICHGAALVLQARDEALMGVCDAWHWLWCLRRCGGNMVDDCWVMVFEEVLTNDEK

SEQ ID NO: 207101 - protein, 312 aa, Glycine max
  Coding DNA Sequence Number=SeqID_90323
  Homolog annotation: Hit_ID=Q75J22; Match level="QueryCoverage=99%, HitCoverage=94%, E-value=1e-58, Identity=41%"; Hit description =Expressed protein
MVPQSVITQVSDSSGVNAISNVSSGHGFYDWLFECHGFWHNATLNIPSFLFVFYLALQARHSLLKLSLARSYIIISYNLCLWLITLLNLAWCFLQHHLYALELVPRIPTLVLTDSLLIVLIGMGVHVWEKVDMEPVILVHYFRNAVFGSGLDAMKRTFGISTLVVGLDILLKAIYLFVFGIPLFVDSNEHTHGKWNLWVVHKLLLTAVYGFIMFIYHSGWKETLPAKIAFYKYVAIMFIFNAIATLACGLAGTGAAFAFWLYRVTVVFYHAFYLPFLYTTFLADFFQEENFHLENVYYSEMKDAGFFDTDWE

SEQ ID NO: 207102 - protein, 104 aa, Glycine max
  Coding DNA Sequence Number=SeqID_90324
MVDLCGICGCGESTCTIARSPPRTTYEGVVPGDMSWGSRDLGDVRWGAIAQNQAWPIPTQPGHSQSVRTCDVPKQASSWQSTDKRTKTTKKGGLCGGCPAMDLE

SEQ ID NO: 207103 - protein, 101 aa, Glycine max
  Coding DNA Sequence Number=SeqID_90325
MVQLWFGIRVKEPGGPFGPANKSYLEPHELIVIHASSTIESGAPRIYCPALFVRPPPSSPEPYELIVIHASSTIESEAPRIDCLGLFVHPPPTNLIRSPMK

SEQ ID NO: 207104 - protein, 160 aa, Glycine max
  Coding DNA Sequence Number=SeqID_90326
MSSDSPSLDDKGADDGVSLGVLSCSGLMVHGRRCKSPCVNGLTFLWLTKGPDNHKLTKGVEDDVSLCVLSCSGSDGEQKNVYMDNHMGISAYPLTSRVRITIRYPRMSSDSSSLDDKGADDDVQKTTLVSACYHALGLMDSKRMFIRITTRVFPPAPNCT

SEQ ID NO: 207105 - protein, 364 aa, Glycine max
  Coding DNA Sequence Number=SeqID_90327
  Gene Ontology: Mol. function=glutamate-tRNA ligase activity; Cellular component=aminoacyl-tRNA synthetase multienzyme complex; Biological process=tRNA aminoacylation for protein translation
  Homolog annotation: Hit_ID=UPI000068E944; Match level="QueryCoverage =98%, HitCoverage=71%, E-value=1e-124, Identity=59%"; Hit description= glutamyl-tRNA synthetase
  Pfam annotation: Domain name=tRNA-synt_1c; Domain location=3-345; Score=421.7; E_value=1e-123; Accession=PF00749.11; Description=tRNA synthetases class I (E and Q), catalytic domain
MEKVRVRFAPSPTGPLHLGGVRTALYDYLFAKNQGGEFVLRIEDTDTARYVEGAEEYIEEALEWCGIIPDESPKKGGKYAPYRQSERREIYDRYTEQILKTDYAYVAFDTPEELDAIRAEYETKGDVFSYDNKTRNRLRNSLALSEEEVQKLLDEKTPYVVRFKMPVDRILNLEDIIRGKSSVNTNTLDDKVLVKNDGMPTYHFANVIDDHEMKITHVIRGEEWLPSLGLHTLLYEAMQWEAPQFAHLSLILKPEGKGKLSKRDGDKFGFPVFPLDFKDPETGNISKGYRENGYLPDAFINMVALLGWSPADDKEILPLKEMIKEFDLHKVHKAGARFSKEKAEWFNHQYIQLKSDKELLDILK

SEQ ID NO: 207106 - protein, 226 aa, Glycine max
  Coding DNA Sequence Number=SeqID_90328
  Gene Ontology: Mol. function=protein dimerization activity; Cellular component=integral to membrane; Biological process=proteolysis
  Homolog annotation: Hit_ID=Q1LSG6; Match level="QueryCoverage=72%, HitCoverage=37%, E-value=3e-53, Identity=68%"; Hit description =Peptidase dimerisation precursor
KSLDHLDLRVKVLAGHTWWLLAVGASSWGRGVAGGGPASWGRLRGARGFGAGAWGAGWLFHRGLVLGDVHDHAGGQVEAGDDGGDLDVFGVVGVGAEAAQAHAFDDGAAGLEGGEGGVGAAAAGAVDDFHGKAEFLVDGDAVVGEGARGGGGFQRRAAHFKFDADLGLGQQFLLDAFLQGAFQGVEVGDLEGAGVGLGGALTGDDVAVGPAWATVQFSFRPSSGLE

SEQ ID NO: 207107 - protein, 188 aa, Glycine max
  Coding DNA Sequence Number=SeqID_90329
  Homolog annotation: Hit_ID=Q1RWU1; Match level="QueryCoverage=77%, HitCoverage=37%, E-value=3e-09, Identity=35%"; Hit description =Resistance-like protein HAAS-2-related
GFAWGAVALVHMYEHLNDASQASTRAGYTSTFLQCIHPSFMMLMMRRAHGPAGGLRGVKGFDLISSYTGQLRWGQIVVYIRPEQVLRQFGYLQTVPLPPVCDSLTGDDIDDRWLHFSDHLVPSGELCVVPGQVAPDYMEWFFRILHPFVMWTEETATPRHPPPPHHEEFVEPPIPEVSVATDLPTHLV

SEQ ID NO: 207108 - protein, 134 aa, Glycine max
  Coding DNA Sequence Number=SeqID_90330
ALGFPALITGLCQSFGVPVTPSKLIRPPITRAFIEKYCTPRQVQGDAHQAAANHCGQVQIHECVYRFSLSQQGQGSAPFACPTPELFGVEVTWPGDWPEAQAGEEPAGSPSEAEEARMDEDMIDLLGFLGGSGA

SEQ ID NO: 207109 - protein, 51 aa, Glycine max
  Coding DNA Sequence Number=SeqID_90331
MIQTNIQALSSDSRHHELILMDAKSFDMIGAIDDNKETFKLGVRIVDRWFD

SEQ ID NO: 207110 - protein, 97 aa, Glycine max
  Coding DNA Sequence Number=SeqID_90332
MGRREEEFRSALLVIQESLEISEKNWFREENPSRGASVRFPKHFRGDFREDFQPFFNVLHSFFIVLRSSTELRRSDFLIAIKEYVGARETTSSTAKR

SEQ ID NO: 207111 - protein, 334 aa, Glycine max
  Coding DNA Sequence Number=SeqID_90333
  Gene Ontology: Mol. function=RNA-directed DNA polymerase activity; Cellular component=intracellular; Biological process=RNA-dependent DNA replication
MAVEDREKTSFITPWGTFCYRVMPFGLINAGATYQRGMTTLFHDMMHKEIEVYVDDMIVKSGTEEEHVEYLLKMFQRLRNQKGIGVDPDKVKAIREMPVPQTEKQVRGFLGRLNYISRFISHMTATCGPIFKLLRKDQGVVWTEDCQKAFDSIKNYLLEPPILIPPVEGRPLIMYLTVLEDSMGCVLGQQDETRKKEHAIYYLSKKFTDCESRYSLLEKTCCALAWAAKRLRHYMINHTTWLISKMDPIKYIFEKPALTGRIARWQMLLSEYDIEYRTRKAIKGSVLADHLAHQPIEDYQPIKFDFPDEEIMHLKMKDCDEPLLGEGPDPESRW

SEQ ID NO: 207112 - protein, 105 aa, Glycine max
  Coding DNA Sequence Number=SeqID_90334
  Gene Ontology: Mol. function=RNA-directed DNA polymerase activity; Cellular component=intracellular; Biological process=RNA-dependent DNA replication
MPGLDPRIVEHCLPLKPECSPVKQKLRRTRPDMALKIKEEVQKQIDAGFLVTSEYPQWLANIVPVPKRDGKVRMCVDYRDLNKASPKDDFPLPHIDVLVDSAEEA

SEQ ID NO: 207113 - protein, 83 aa, Glycine max
  Coding DNA Sequence Number=SeqID_90335
GPGVSSSGYGPLSVLQGARIAPTKNPVDPEKSNRALGFPALITALCQFYGMPGETPQQPKDGWERATNAPPPPLEFISTHPQK

SEQ ID NO: 207114 - protein, 138 aa, Glycine max
  Coding DNA Sequence Number=SeqID_90336
  Gene Ontology: Mol. function=transcription factor activity; Biological process=regulation of transcription, DNA-dependent
  Homolog annotation: Hit_ID=Q0MMC4; Match level="QueryCoverage=87%, HitCoverage=40%, E-value=4e-34, Identity=62%"; Hit description =Putative transcriptional regulator, LysR family protein
  Pfam annotation: Domain name=HTH_1; Domain location=20-79; Score =58.5; E_value=2.3e-14; Accession=PF00126.17; Description=Bacterial regulatory helix-turn-helix protein, lysR family
  Subcellular localization annotation: CTP_CleavageSite=70; ConfidenceScore=5.40e-01
MAGYFTFASGVQMPNLLNETAGLLAFVRTVEAGSFSAAARLLKTSPSVISRSVGRLERLIEARLFLRSTRALVLTADGHLLFERLSPLLRELDIADDEINARKEISGRVRFSMSSELAPLFLDTILSGFAARYAGNSS

SEQ ID NO: 207115 - protein, 117 aa, Glycine max
  Coding DNA Sequence Number=SeqID_90337
  Gene Ontology: Mol. function=oxidoreductase activity; Cellular component=membrane; Biological process=metabolic process
  Homolog annotation: Hit_ID=Q0MMC3; Match level="QueryCoverage=97%, HitCoverage=45%, E-value=2e-35, Identity=62%"; Hit description =Putative dehydrogenasereductase, short-chain dehydrogenase/reductase protein
  Pfam annotation: Domain name=adh_short; Domain location=7-114; Score=- 23.6; E_value=0.0002; Accession=PF00106.15; Description=short chain dehydrogenase
MGLLKDKVAVITGGNSGIGKATAKLFVENGAQVVITARRQDALNAALKDIGGNAIGICGDVSDLSHHKQVADEISDRFGTFDIYFANAGVIDLKASEAVTEDIYDRHFNINTKGVFF

SEQ ID NO: 207116 - protein, 68 aa, Glycine max
  Coding DNA Sequence Number=SeqID_90338
MFGEGINWENNKDHISQSRGSALDGGGHMNSARQSIHGAPNKRREWRIALGNHYAWLQTRWWWNQSGK

SEQ ID NO: 207117 - protein, 153 aa, Glycine max
  Coding DNA Sequence Number=SeqID_90339
  Homolog annotation: Hit_ID=Q1SKD7; Match level="QueryCoverage=83%, HitCoverage=35%, E-value=3e-08, Identity=25%"; Hit description =Ankyrin
MAPKKLSTKRSRRAAVAEVSSAAPEFDSHRFRSVEHWQHFEAIKGWSLHRERRVQLREDEYTDFQEEIARRHWTSLVTPMAKLDPEVVLEFYANAWPTKGGSARHAFMADALSQFLGDPLVLEEGQQCEFSQRRNKADEFDEEAIAQLLCTPG

SEQ ID NO: 207118 - protein, 135 aa, Glycine max
  Coding DNA Sequence Number=SeqID_90340
MVHTPNENVNDSTPILIKSQQPQSDHAPIPQPMGATHEIPHHNLANFEPCLEYVTQGQANMCKKEHESFKGYAQRWRDMAAQVVPPMMEKEMITMIVDTLPVFYYEKMVDYTPSSFADFVFAGERIEVSMKRGKF

SEQ ID NO: 207119 - protein, 99 aa, Glycine max
  Coding DNA Sequence Number=SeqID_90341
GRSAVSLAGELGGAAASSDDASKMIIRGGDGGTTSRSREDSGFTTGDYGSAGSGSTCTSVGSGGAASLGLTNGITNGGAGVDDEGMSSVLALFLDAIYN

SEQ ID NO: 207120 - protein, 53 aa, Glycine max
  Coding DNA Sequence Number=SeqID_90342
MYLAEKALSFEHPRLFQHPSSNSCRGSVGSSEDNVGVEGAVSGSFQAGGEREE

SEQ ID NO: 207121 - protein, 194 aa, Glycine max
  Coding DNA Sequence Number=SeqID_90343
MRAIKGIGDIYCRHGEAMLSAQCVIPPKFKVPDFDKYKGTTWPKNYLKMYYRMMGAYSRDEKLLMHFLQEILVGVAITWQYQYNTDMAPNRTQLQNMCKKEHESFKEYAQRLLSYPNFVRGPLFDGMQPLLDRFEKSKESIVARSVKFRNMPEIKRKHCYTIREGGANSNQAHLGLPGSSSRRHPGGSNLARLG

SEQ ID NO: 207122 - protein, 121 aa, Glycine max
  Coding DNA Sequence Number=SeqID_90344
  Gene Ontology: Mol. function=N-acetyltransferase activity; Biological process=metabolic process
  Homolog annotation: Hit_ID=UPI00005F917B; Match level="QueryCoverage =71%, HitCoverage=84%, E-value=1e-15, Identity=55%"; Hit description =COG0454: Histone acetyltransferase HPA2 and related acetyltransferase s
LDDGEPTVIRRPESEFTALYRELAGRVAAQLYWQDASTRTGPVRSLPALRAASRAADKTAAPLRSVADISARQWSKACAVAGDLRHQYRFTGNNRVEIFQLPVVAGQPCPVMTARREIQCA

SEQ ID NO: 207123 - protein, 194 aa, Glycine max
  Coding DNA Sequence Number=SeqID_90345
  Gene Ontology: Mol. function=hydrolase activity; Cellular component =membrane; Biological process=programmed cell death
  Homolog annotation: Hit_ID=Q7CHQ7; Match level="QueryCoverage=94%, HitCoverage=79%, E-value=2e-72, Identity=72%"; Hit description =Putative membrane protein
  Pfam annotation: Domain name=LrgB; Domain location=1-189; Score =304.5; E_value=1.9e-88; Accession=PF04172.6; Description=LrgB-like family
MAIIIPLLLLTHLPYARYFAGSALLNQLLQPAVVALALPLYEQMHQIRARWKTIISVCFIGSITAMVSGTAIALWMGATPEIAATILPKSVTTPIAMAVSGSLHGIPAISAICVLIAGVLGAVFGHMLLNLFKVRSKSSRGLAIGNASHALGTARAAEIDYQEGAFSSLALVICGIITSLLAPFIFPLLMRLLG

SEQ ID NO: 207124 - protein, 276 aa, Glycine max
  Coding DNA Sequence Number=SeqID_90346
  Gene Ontology: Mol. function=sequence-specific DNA binding; Cellular component=intracellular; Biological process=regulation of transcription, DNA-dependent
  Homolog annotation: Hit_ID=Q0K3J2; Match level="QueryCoverage=88%, HitCoverage=69%, E-value=6e-67, Identity=52%"; Hit description =Transcriptional regulator, LuxR-family
MPEAELKQSEFFRNFLEPVDVFHILGVDINTNDGAQCRLRISRGRDDAPFVESEKHLLARFIPHLERSIKLHMQLNRIETERNLYAGAVDQMAVGTIILDDTGKRPGYPGVSSPGAPGHALAEGQPGVGGRGHARQAPLRACRPGHHRAFSTAVGLERGQTMPDRGHFHQRPGAAILGAPGDRPRPVRLHPGRNPVGDAAGQRPDPRRSLRGAGHQPQYLACASALDLLQDRRHTPDHARAVDPAQRRHLGLKPRPTRLPGHRPLGRWQALAGSAQ

SEQ ID NO: 207125 - protein, 74 aa, Glycine max
  Coding DNA Sequence Number=SeqID_90347
MSAEKYQSGQFHNRCRDEDITKGKDHEALEGNPCGVYPDLSSFTGSGVIQTSVACIKRSTPTQVHIIWYQSFGS

SEQ ID NO: 207126 - protein, 195 aa, Glycine max
  Coding DNA Sequence Number=SeqID_90348
  Subcellular localization annotation: CTP_CleavageSite=31; ConfidenceScore=5.18e-01
MVEPSKKQKGSSSRSQRHSEAQDTPIPSSISSSSLFSSEEQRTRYSNLFSSHSIIDPKFIDMDFFSDESFKCIQAFHNSNLIPFMSLKLPVYYELVKAFYSNLEIQERTLIYEVYGIKMVIDQSLFYDLTQLSSDSLPFEGALDDDWKFDLSVHDARRLVCTNQVDMTGRLLAGSLALDKSIVIKTVKCYQKKLT

SEQ ID NO: 207127 - protein, 95 aa, Glycine max
  Coding DNA Sequence Number=SeqID_90349
  Subcellular localization annotation: CTP_CleavageSite=69; ConfidenceScore=5.10e-01
MGDQATSMHNISTDRNNEHIKTTSNIYFSSILCSALGSRSLFRPPLHSPQFRLKKGFLSVKVRLARRIRDNLLAEQADDALSAKRLMSSLAVESH

SEQ ID NO: 207128 - protein, 145 aa, Glycine max
  Coding DNA Sequence Number=SeqID_90350
MAALLIHDRVEMECLEGAWETLEGNARCRFRGTIRFTTTSLVHPDEPARTLQRTVEWILPTPTPYRLVEPVQVIEVTSSEEDLEEDPEELPPEPAVDALDFLEGDEDPLPEVDSPEDVMSASEERWPWRDGDQWRLFIIVDSSLD

SEQ ID NO: 207129 - protein, 42 aa, Glycine max
  Coding DNA Sequence Number=SeqID_90351
MDASCLAGTGVKPTKHRERICQDRYHRTFLAMVVGKESVDCC

SEQ ID NO: 207130 - protein, 62 aa, Glycine max
  Coding DNA Sequence Number=SeqID_90352
MPGSSASLLASSARWLFFFCELPLCPLCECFFFFCSSASFHYVLHRVCRYVVDPLKDLGHPQ

SEQ ID NO: 207131 - protein, 295 aa, Glycine max
  Coding DNA Sequence Number=SeqID_90353
  Homolog annotation: Hit_ID=Q2HRX8; Match level="QueryCoverage=67%, HitCoverage=30%, E-value=2e-15, Identity=28%"; Hit description=IMP dehydrogenase/GMP reductase
  Pfam annotation: Domain name=DUF1723; Domain location=164-213; Score =50.8; E_value=4.4e-12; Accession=PF08330.1; Description=Protein of unknown function (DUF1723)
MVRTRGLGRALIRGIGRGRGGQDEHHADDAPWRCRPTASICRQWVHVSVAEDVADMTVPQMTEDVPLMTTDIPTTRVEGLASDVAIGSVADDAEGFPGGPRDPSMLTLFAEHVAHNIWSGEEHPELKLVSHERKVEKFGRSAPEIAGLVATTRLTPLIGCSVVTGDPGVISAFVERWHRETSTFDLPLGEVTITLDDVVSLLHLPITGAFQSFEPLLMDEAVVLLVELLEVLGEEAKAETARVHGAYVRLSWLGDIYLRRCEAGRWIVAARAYLLHLVGCSLFAIKSATHVNVVH

SEQ ID NO: 207132 - protein, 922 aa, Glycine max
  Coding DNA Sequence Number=SeqID_90354
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9M2A0; Match level="QueryCoverage=99%, HitCoverage=90%, E-value=0.0, Identity=75%"; Hit description=ATPase 8, plasma membrane-type
  Pfam annotation: Domain name=Cation_ATPase_N; Domain location=9-89; Score=115.1; E_value=2.1e-31; Accession=PF00690.16; Description =Cation transporterATPase, N-terminus
  Pfam annotation: Domain name=E1-E2_ATPase; Domain location=102-329; Score=280.3; E_value=3.9e-81; Accession=PF00122.10; Description=E1 -E2 ATPase
  Pfam annotation: Domain name=Hydrolase; Domain location=333-660; Score=51.6; E_value=2.7e-12; Accession=PF00702.16; Description =haloacid dehalogenase-like hydrolase
  Pfam module annotation: Pfam domain module=Cation_ATPase_N::E1-E2 _ATPase::Hydrolase; Domain location=9-89::102-329::333-660
MASDDISFEDLKKENIDLENIPVEEVFEKLKCTREGLTSAEGEKRLQIFGPNKLEEKKDSKLRKFLGFMWNPLSWVMECAAIMAIVLANGGGKPPDWQDFTGIVVLLIINSTISFIEENNAGNAAAALMAGLAPKTKATHICSVLRDGKWSEEEAAILVPGDVISIKLGVIVPADARLLEGDPLKIDQSALTGESLPVTRNPGQQVFSGSTCKQGEIEAVVIATGVHTFFGKAAHLVDSTNNVGHFQKVLTSIGNFCICSIAVGMLIELVVMYPIQKRSYRDGIDNLLVLLIGGIPIAMPTVLSVTMAIGSHRLSQQGAITKRMTAIEEMAGMDILCSDKTGTLTLNKLTVDKSLIESNNHMANAHVNVYGVQNGMFSLKIDINVFPTGMDKDTLVLYAARASRTENQDAIDASIVGMLDDRKEARAGITEVHFLPFNPVDKRTAITFIDNNGDWHRSSKGAPEEIIELCGLKGETLKKAHKVIDEFANRGLRSLGVSRQTVSERTKESAGDAWEFLGLLPLFDPPRHDSSETIRRALELGVNVKMITGDQLAIGKETGRRLGMGTNMYPSSSLLGESKDNALATMSIDELIEKADGFAGVFPGMDITSIYAQHCYSEHKYEIVKRLQDRNHIVGMTGDGVNDAPALKKADIGIAVDDATDAARSASDIVLTEPGLSVIVSAVLTSRAIFQRMKNYTIYAVSITIRIVFGFMLVALIWKFDFSPFMVLIIAILNDGTIMTISKDRVKPSPLPDSWKLKEIFATGIVLGAYMAIITAVFFYVVHDTSFFSNHLTKVCFLSLFQNIFGVSPIAESEEQLNSALYLQVSIISQALIFVTRSRSWSYFERPGIMLCVAFICAQLVATVIAVYAHWDFARINGVGWRWAGVIWIYSIITYIPLDILKFLIRMGLTGSAGDNMHQNKV

SEQ ID NO: 207133 - protein, 45 aa, Glycine max
  Coding DNA Sequence Number=SeqID_90355
MSMCPKHAEVAMTVGGEFPQGGAEWLIEESSKKDSREDPNDDMRD

SEQ ID NO: 207134 - protein, 184 aa, Glycine max
  Coding DNA Sequence Number=SeqID_90356
  Homolog annotation: Hit_ID=Q1SAK3; Match level="QueryCoverage=52%, HitCoverage=6%, E-value=4e-08, Identity=34%"; Hit description =Integrase, catalytic region; Zinc finger, CCHC-type
  Pfam annotation: Domain name=zf-CCHC; Domain location=109-126; Score =9.4; E_value=0.028; Accession=PF00098.13; Description=Zinc knuckle
  Subcellular localization annotation: CTP_CleavageSite=37; ConfidenceScore=5.09e-01
MSRRWGPQVTTLKVLKNLDMMSLEKLVRNLKKAKKVPSSKESSSRSSSKNASKALSLDNSSDEEFDEDDELALISRKIQKMWKNKSGSRWRNSSNKVFKDKKDRENSTIICYKCKNPRCFKSECPKMKNSKDKYKHYMSKDKKSLMSTWEDLDNTTSNEEGEKEANLCLMTKKLLKDQNQNKRR

SEQ ID NO: 207135 - protein, 305 aa, Glycine max
  Coding DNA Sequence Number=SeqID_90357
  Gene Ontology: Mol. function=hydrolase activity; Cellular component =membrane; Biological process=proteoglycan metabolic process
  Homolog annotation: Hit_ID=Q70YJ3; Match level="QueryCoverage=59%, HitCoverage=36%, E-value=7e-59, Identity=56%"; Hit description =Putative heparanase
  Pfam annotation: Domain name=Glyco_hydro_79n; Domain location=1-223; Score=9.4; E_value=1.2e-13; Accession=PF03662.4; Description =Glycosyl hydrolase family 79, N-terminal domain
MVLWFVAVSTRRTTTSQIPNYPNLPYQLLCQVQNVTLHGSILGVEVSISRKSYSTQLVVMEDENGNQNSAPPQNGGFLIPNIFTLTIPKVDGGNELSGKGIGASVGVAQYGKDLIKLKQILSTLYESSKFKPSLVEPGGFYEKYCVSKLISLSDSDEHLERKILDPERLSRVESIFSNLSETIKIYGPWSSAWVGEAGGAYNSGGNHVSNRFLNNFWYLDQLGIASCYSTKVYSRQTLIGGNYGLLNTTTFAPNPDYYSAVLWHRLMGKKILAVSSDVHIKDFYIQLENVHAEAKGGETWRPWLL

SEQ ID NO: 207136 - protein, 123 aa, Glycine max
  Coding DNA Sequence Number=SeqID_90358
  Subcellular localization annotation: CTP_CleavageSite=66; ConfidenceScore=5.36e-01
MGQVVPLYLSKSKTLNFRGMMTSGTSHNSASFNGPQPFLYMIKFSPFYHSKALPTIKMQGLWLWVKLRALQSVWQGYTTNYLPISGISEECVQHWGCIVGWQAIWWEGMLVLNLHKIGAARTS

SEQ ID NO: 207137 - protein, 79 aa, Glycine max
  Coding DNA Sequence Number=SeqID_90359
MRARARVMSEIEEVQEQIKADMEAMKDQMAPMMEAMLSMKKIMEVNAAADATTGVATEVDPTHPSSLNQVNPPVLYIVG

SEQ ID NO: 207138 - protein, 1006 aa, Glycine max
  Coding DNA Sequence Number=SeqID_90360
  Gene Ontology: Mol. function=DNA-directed RNA polymerase activity; Cellular component=DNA-directed RNA polymerase II, core complex; Biological process=transcription from RNA polymerase II promoter
  Homolog annotation: Hit_ID=Q99368; Match level="QueryCoverage=69%, HitCoverage=74%, E-value=0.0, Identity=95%"; Hit description=DNA -directed RNA polymerase
  Pfam annotation: Domain name=RNA_pol_Rpb1_4; Domain location=1-75; Score=98.9; E_value=1.5e-26; Accession=PF05000.7; Description=RNA polymerase Rpb1, domain 4
  Pfam annotation: Domain name=RNA_pol_Rpb1_5; Domain location=82-657; Score=533.9; E_value=1.7e-157; Accession=PF04998.8; Description=RNA polymerase Rpb1, domain 5
  Pfam annotation: Domain name=RNA_pol_Rpb1_6; Domain location=148-332; Score=352.2; E_value=8.7e-103; Accession=PF04992.5; Description=RNA polymerase Rpb1, domain 6
  Pfam annotation: Domain name=RNA_pol_Rpb1_7; Domain location=417-551; Score=287.0; E_value=3.6e-83; Accession=PF04990.3; Description=RNA polymerase Rpb1, domain 7
  Pfam annotation: Domain name=RNA_pol_Rpb1_R; Domain location=730-745; Score=1.0; E_value=1.9e+02; Accession=PF05001.4; Description=RNA polymerase Rpb1 C-terminal repeat
  Pfam annotation: Domain name=RNA_pol_Rpb1_R; Domain location=771-785; Score=10.3; E_value=3.7; Accession=PF05001.4; Description=RNA polymerase Rpb1 C-terminal repeat
  Pfam annotation: Domain name=RNA_pol_Rpb1_R; Domain location=786-799; Score=20.0; E_value=0.0085; Accession=PF05001.4; Description=RNA polymerase Rpb1 C-terminal repeat
  Pfam annotation: Domain name=RNA_pol_Rpb1_R; Domain location=800-813; Score=20.5; E_value=0.006; Accession=PF05001.4; Description=RNA polymerase Rpb1 C-terminal repeat
  Pfam annotation: Domain name=RNA_pol_Rpb1_R; Domain location=814-827; Score=19.4; E_value=0.013; Accession=PF05001.4; Description=RNA polymerase Rpb1 C-terminal repeat
  Pfam annotation: Domain name=RNA_pol_Rpb1_R; Domain location=828-841; Score=18.8; E_value=0.02; Accession=PF05001.4; Description=RNA polymerase Rpb1 C-terminal repeat
  Pfam annotation: Domain name=RNA_pol_Rpb1_R; Domain location=842-855; Score=15.6; E_value=0.18; Accession=PF05001.4; Description=RNA polymerase Rpb1 C-terminal repeat
  Pfam annotation: Domain name=RNA_pol_Rpb1_R; Domain location=856-869; Score=18.8; E_value=0.02; Accession=PF05001.4; Description=RNA polymerase Rpb1 C-terminal repeat
  Pfam annotation: Domain name=RNA_pol_Rpb1_R; Domain location=870-883; Score=16.5; E_value=0.098; Accession=PF05001.4; Description=RNA polymerase Rpb1 C-terminal repeat
  Pfam annotation: Domain name=RNA_pol_Rpb1_R; Domain location=884-897; Score=17.1; E_value=0.065; Accession=PF05001.4; Description=RNA polymerase Rpb1 C-terminal repeat
  Pfam annotation: Domain name=RNA_pol_Rpb1_R; Domain location=898-911; Score=19.2; E_value=0.015; Accession=PF05001.4; Description=RNA polymerase Rpb1 C-terminal repeat
  Pfam annotation: Domain name=RNA_pol_Rpb1_R; Domain location=912-925; Score=17.1; E_value=0.065; Accession=PF05001.4; Description=RNA polymerase Rpb1 C-terminal repeat
  Pfam annotation: Domain name=RNA_pol_Rpb1_R; Domain location=926-938; Score=7.5; E_value=12; Accession=PF05001.4; Description=RNA polymerase Rpb1 C-terminal repeat
  Pfam annotation: Domain name=RNA_pol_Rpb1_R; Domain location=939-952; Score=16.6; E_value=0.091; Accession=PF05001.4; Description=RNA polymerase Rpb1 C-terminal repeat
  Pfam annotation: Domain name=RNA_pol_Rpb1_R; Domain location=953-966; Score=17.1; E_value=0.065; Accession=PF05001.4; Description=RNA polymerase Rpb1 C-terminal repeat
  Pfam annotation: Domain name=RNA_pol_Rpb1_R; Domain location=967-980; Score=10.7; E_value=3.1; Accession=PF05001.4; Description=RNA polymerase Rpb1 C-terminal repeat
  Pfam annotation: Domain name=RNA_pol_Rpb1_R; Domain location=983-996; Score=10.1; E_value=4.1; Accession=PF05001.4; Description=RNA polymerase Rpb1 C-terminal repeat
  Pfam module annotation: Pfam domain module=RNA_pol_Rpb1_4::RNA_pol _Rpb1_5::RNA_pol_Rpb1_6::RNA_pol_Rpb1_7::RNA_pol_Rpb1_R::RNA_pol_Rpb1_ R::RNA_pol_Rpb1_R::RNA_pol_Rpb1_R::RNA_pol_Rpb1_R::RNA_pol_Rpb1 _R::RNA_pol_Rpb1_R::...
  Pfam module annotation: Pfam domain module=RNA_pol_Rpb1_R::RNA_pol _Rpb1_R::RNA_pol_Rpb1_R::RNA_pol_Rpb1_R::RNA_pol_Rpb1_R::RNA_pol_Rpb1_ R::RNA_pol_Rpb1_R::RNA_pol_Rpb1_R::RNA_pol_Rpb1_R::RNA_pol_Rpb1_R; Domain location=...
  Pfam module annotation: Domain location=1-75::82-657::148-332::417 -551::730-745::771-785::786-799::800-813::814-827::828-841::842 -855::856-869::870-883::884-897::898-911::912-925::926-938::939 -952::953-966::967-980::983-996
  Subcellular localization annotation: CTP_CleavageSite=23; ConfidenceScore=5.00e-01
RDDAGNSAGNSLSESNNLKAMVTAGSKGSNINISQMTACVGQQNVEGKRIPYGFVDRTLPHFTKDDHGPESRGFVENSYLRGLTPQEFFFHAMGGREGLIDTAVKTSETGYIQRRLVKAMEDIMLKYDGTVRNSLGDVIQFLYGEDGMDAIWIETQKLDTLKMKKTEFDRVFRYEFDEENWKPNYMLQEPVEDLKTIREFRNVFEAEVQKLEADRHQLAIEIASNGDNSLPLPVNLKRLIWNAQKTFKVDFRRPSDMHPMEIVEAIDKLQERLKVVPGEDALSQEAQKNATLLFNILLRSTFASKRVLEEYRLSRESFEWVVGEIESRFLQSLVVPGEMIGVVAAQSIGEPATQMTLNTFHFAGVSAKNVTLGVPRLRELINVAKSIKTPSLSVYLKPDAGKTKERAKTVQCALEYTTLRSVTQATEVWYDPDPMSTIIEEDVDFVMSYYEMPDEEVALEKISPWLLRVELNREMMVDKKLSMADIAQKINLEFDDDLSCIFNDDNAEKLILRIRIMNDDAPKGEVQDESAEDDVFLKKIETNMLTEMTLRGIPDINKSNGEWMLDTEGVNLLAVMCHEDVDATRTTSNHLIEVIEVLGIEAVRRSLLDELRIVISFDGSYVNYRHLAILCETMTYRGHLMAITRHGINRNDTGPMMRCSFEETVDILLDAAAYAETDSLRGVTENIILGQLAPIGTGQCALYLNDGMLKNAIELQLPSYTDGLDFGIMSGATPYHEGTMMSPSYLLSPNLRLSPSSDAQFSPYVGGMAFSPSSSPGYSPSSPGYSPSSPGYSPTSPGYSPTSPGYSPTSPTYSPSSPGYSPTSPAYSPTSPSYSPTSPAYSPTSPAYSSTSPAYSPTSPSYSPTSPAYSPTSPSYSLTSPSYSPTSPSYSPTSPSYSPTSPAYSPTSPSYSPTSPSYSPTSPSYNPQSAKYSPSLAYSPSSPRLSPTSPNYSPTSPSYSPTSPSYSPSSPTYSPSSPSAGYSPSQPGYSPSSTSQDTPQTSDKDE

SEQ ID NO: 207139 - protein, 197 aa, Glycine max
  Coding DNA Sequence Number=SeqID_90361
  Homolog annotation: Hit_ID=Q10BI2; Match level="QueryCoverage=74%, HitCoverage=79%, E-value=4e-14, Identity=33%"; Hit description =Expressed protein
  Pfam annotation: Domain name=DUF567; Domain location=5-170; Score =100.5; E_value=5e-27; Accession=PF04525.3; Description=Protein of unknown function (DUF567)
MANQFSVISPSYCAPYALNLQINTEKGVTYDINGNPVFYVKDALFTLHDRRVLYDNQGNSIVTLYKKNMTLHGRCQVFKGKSNDSSELLFSVKRSSMIQYSVMKLDVFLANNRNENVCDFRVNFCRDKSSCIVYASESPTIVATMQINGGLNVLVYPYVDYAFIVALLMIVNEMKDYYDELMDVALGVTFAALGNIN

SEQ ID NO: 207140 - protein, 495 aa, Glycine max
  Coding DNA Sequence Number=SeqID_90362
  Gene Ontology: Mol. function=DNA-directed RNA polymerase activity; Cellular component=DNA-directed RNA polymerase II, core complex; Biological process=transcription from RNA polymerase II promoter
  Homolog annotation: Hit_ID=P18616; Match level="QueryCoverage=99%, HitCoverage=26%, E-value=0.0, Identity=82%"; Hit description=DNA -directed RNA polymerase II largest subunit
  Pfam annotation: Domain name=RNA_pol_Rpb1_1; Domain location=12-352; Score=518.0; E_value=1.1e-152; Accession=PF04997.3; Description=RNA polymerase Rpb1, domain 1
  Pfam annotation: Domain name=RNA_pol_Rpb1_2; Domain location=354-495; Score=162.4; E_value=1.2e-45; Accession=PF00623.11; Description=RNA polymerase Rpb1, domain 2
  Pfam module annotation: Pfam domain module=RNA_pol_Rpb1_1::RNA_pol _Rpb1_2; Domain location=12-352::354-495
MDVRFPFSPAEVAKVATVQFGIISPDEIRQMSVVQIEHGETTERGKPKIGGLSDPRLGTIDRKLKCDTCTGSMAECPGHFGHLELAKPMFHIGFLKTVLAIMRCVCFNCSKILANEDDHKFKLALRIRNPKNRLRKILDACKNKSKCEGGDDIDIHGKDTGEPVKKSRGGCGAQQPKITIEGMKINAEYKAQRKKSDDQEQLPEPVERKQTLSAERVLSVLKRISDEDCQLLGLNPQYARPDWMILQVLPIPPQPVRPSVMMDTSSRSEASDDLTHQLAMIIRHNENLKRQEKNGSPAHIISEFVQLLQFHVATYFDNELPGLPRATQRSGRPIKSICSRLKAKEGRIRGNLMGKRVDFSARTVITPDPTINIDQLGVPWSIALNLTYPETVTPYNIERLKELVEYGPHPPPGKTGAKYIIRDDGQRLDLRYLKKSCDHHLELGYQALFLNNDNIVERHLNDGDFVLFNRQPSLHKMSILGNRIKIMPDSTFGLI

SEQ ID NO: 207141 - protein, 482 aa, Glycine max
  Coding DNA Sequence Number=SeqID_90363
  Gene Ontology: Mol. function=sugar binding; Cellular component =mitochondrion; Biological process=metabolic process
  Homolog annotation: Hit_ID=Q1RZN7; Match level="QueryCoverage=99%, HitCoverage=100%, E-value=0.0, Identity=68%"; Hit description=C-type lectin; Tetratricopeptide-like helical
  Pfam annotation: Domain name=PPR; Domain location=119-152; Score=1.4; E_value=5.1; Accession=PF01535.11; Description=PPR repeat
  Pfam annotation: Domain name=PPR; Domain location=173-207; Score =24.7; E_value=0.00033; Accession=PF01535.11; Description=PPR repeat
  Pfam annotation: Domain name=PPR; Domain location=245-279; Score =19.3; E_value=0.014; Accession=PF01535.11; Description=PPR repeat
  Pfam annotation: Domain name=PPR; Domain location=280-314; Score =25.1; E_value=0.00024; Accession=PF01535.11; Description=PPR repeat
  Pfam annotation: Domain name=PPR; Domain location=315-349; Score =42.1; E_value=1.9e-09; Accession=PF01535.11; Description=PPR repeat
  Pfam annotation: Domain name=PPR; Domain location=350-384; Score =34.7; E_value=3.3e-07; Accession=PF01535.11; Description=PPR repeat
  Pfam annotation: Domain name=PPR; Domain location=385-419; Score =20.3; E_value=0.0072; Accession=PF01535.11; Description=PPR repeat
  Pfam annotation: Domain name=PPR; Domain location=420-454; Score=8.5; E_value=0.73; Accession=PF01535.11; Description=PPR repeat
  Pfam module annotation: Pfam domain module=PPR::PPR::PPR::PPR::PPR::PP R::PPR::PPR; Domain location=119-152::173-207::245-279::280-314::315 -349::350-384::385-419::420-454
MVRHPLSKRANKYLRKFKKWPHSPYKTSWHHNFGEEQAMKNLKQATLEMDSSQHPQRPNLPCPFLLSTLLDSFKAYSIDPTPKAYFFVLKTLTSTSQLQDIPPVLYHLEHLEKFETPESILVYLIRFYGLSDRVQDAVDLFFRIPRFRKRDCLEMVPEILLKSQHMNIRVEESTFRVLIRALCRIKRVGYAIKMLNFMVEDGYGLDEKICSLVISALCEQKDLTSAEALVVWRDMRKLGFCPGVMDYTNMIRFLVKEGRGMDALDILNQQKQDGIKLDVVSYTMVLSGIVAEGEYVMLDELFDEMLVIGLIPDAYTYNVYINGLCKQNNVAEALQIVASMEELGCKPNVVTYNTLLGALSVAGDFVKARELMKEMGWKGVGLNLHTYRIVLDGLVGKGEIGESCLLLEEMLEKCLFPRSSTFDNIIFQMCQKDLFTEAMELTKKVVAKSFLPGASTWEALLLNSGSKLGYSKATFSGLLGPI

SEQ ID NO: 207142 - protein, 506 aa, Glycine max
  Coding DNA Sequence Number=SeqID_90364
  Gene Ontology: Mol. function=monooxygenase activity; Cellular component=membrane; Biological process=electron transport
  Homolog annotation: Hit_ID=Q1SI93; Match level="QueryCoverage=94%, HitCoverage=95%, E-value=0.0, Identity=64%"; Hit description=E-class P450, group I
  Pfam annotation: Domain name=p450; Domain location=35-491; Score =359.9; E_value=4.1e-105; Accession=PF00067.12; Description =Cytochrome P450
MTNIVAIISFSLILIVVLMKIVRNHKKTKPTPNVPPGPWKLPVIGNVHQIITSAPHRKLRDLAKIYGPLMHLQLGEVTTIIVSSPECAKEIMKTHDVIFASRPRGVVTNILSYESTGVASAPFGNYWRVLRKMCTIELLSQKRVDSFQPIREEELTTLIKMFDSQKGSPINLTQVVLSSIYSIISRAAFGKKCKGQEEFISLVKEGLTILGDFFPSSRWLLLVTDLRPQLDRLHAQVDQILENIIIEHKEAKSKVREGQDEEKEDLVDILLKLQDGDDSNKDFFLTNDNIKATILEIFSAGGEPSAITIDWAMSEMARDPRVMKKAQDEVRMVFNMKGRVDETCINELKYLKSVVKETLRLHPPGPLLLPRESTQECKIHGYDIPIKSKVIVNAWAIGRDPNYWNEPERFYPERFIDSSIDYKGNNFEYIPFGAGRRICPGSTFGLVNVEMALALFLYHFDWKLPNGIQNEDLDMTEEFKVTIRRKNDLCLIPVSPPCSVVAMYSS

SEQ ID NO: 207143 - protein, 252 aa, Glycine max
  Coding DNA Sequence Number=SeqID_90365
  Gene Ontology: Mol. function=intracellular transporter activity; Cellular component=endoplasmic reticulum; Biological process =intracellular protein transport
  Homolog annotation: Hit_ID=Q1RXL2; Match level="QueryCoverage=98%, HitCoverage=91%, E-value=4e-79, Identity=57%"; Hit description =Tetratricopeptide-like helical
  Pfam annotation: Domain name=NSF; Domain location=117-128; Score=9.9; E_value=9.4; Accession=PF02071.10; Description=Aromatic-di-Alanine (AdAR) repeat
  Pfam annotation: Domain name=NSF; Domain location=157-168; Score=0.5; E_value=2.2e+02; Accession=PF02071.10; Description=Aromatic-di -Alanine (AdAR) repeat
  Pfam annotation: Domain name=NSF; Domain location=27-37; Score=2.2; E_ value=1.2e+02; Accession=PF02071.10; Description=Aromatic-di-Alanine (AdAR) repeat
  Pfam annotation: Domain name=NSF; Domain location=58-69; Score=14.1; E_value=0.5; Accession=PF02071.10; Description=Aromatic-di-Alanine (AdAR) repeat
  Pfam annotation: Domain name=NSF; Domain location=77-88; Score=7.3; E_ value=22; Accession=PF02071.10; Description=Aromatic-di-Alanine (AdAR) repeat
  Pfam annotation: Domain name=NSF; Domain location=97-108; Score=1.4; E_value=1.6e+02; Accession=PF02071.10; Description=Aromatic-di -Alanine (AdAR) repeat
  Pfam annotation: Domain name=TPR_2; Domain location=138-171; Score =5.5; E_value=7.6; Accession=PF07719.7; Description=Tetratricopeptide repeat
  Pfam annotation: Domain name=TPR_2; Domain location=98-131; Score =13.1; E_value=1; Accession=PF07719.7; Description=Tetratricopeptide repeat
  Pfam module annotation: Pfam domain module=NSF::NSF::NSF::NSF::NSF::NS F::TPR_2::TPR_2; Domain location=117-128::157-168::27-37::58-69::77 -88::97-108::138-171::98-131
MGDHIAKGQELAKRAENKLHACCPLFGSNLEDAAELFHKSATSFKLAKSLQLDSKYDAANAYVDAAHCYKKTSTSGAISCLNKAVTIFTEIGRHIMAAKYSKEIGELYELDQDIEHARSYYERAAELFEIGDAATSVIQCKVKVAQFCAQLQQYQKAIKIYEDIARQSLDSNLLKYGVRGHLLNSGLCQLVQGDFVAITNSLERYQDLDLTFSRTREYKFLADLSASIDEGDVEKFTRVVKEFNSITPLVYF

SEQ ID NO: 207144 - protein, 520 aa, Glycine max
  Coding DNA Sequence Number=SeqID_90366
  Gene Ontology: Mol. function=D-alanine-D-alanine ligase activity; Cellular component=cell wall; Biological process=peptidoglycan biosynthetic process
  Homolog annotation: Hit_ID=Q3LHI3; Match level="QueryCoverage=86%, HitCoverage=44%, E-value=1e-121, Identity=50%"; Hit description=D -alanine-D-alanine ligase precursor
  Pfam annotation: Domain name=Dala_Dala_lig_C; Domain location=200 -449; Score=-39.7; E_value=3.4e-07; Accession=PF07478.3; Description =D-ala D-ala ligase C-terminus
  Pfam annotation: Domain name=Dala_Dala_lig_N; Domain location=73-199; Score=60.4; E_value=5.8e-15; Accession=PF01820.11; Description=D-ala D-ala ligase N-terminus
  Pfam module annotation: Pfam domain module=Dala_Dala_lig_C::Dala_Dala_ lig_N; Domain location=200-449::73-199
  Subcellular localization annotation: CTP_CleavageSite=54; ConfidenceScore=5.34e-01
MATSSLSGNFSLLRHSETQSRSLLLLGGSSVKLFRSKHEASTCHGARVAAAVPRASAPEVAVVEKGREKVRVLKLGLICGGPSAERGISLNSARSVLDHLQGDDLHVSCYYIDCNLNAFAISSAQVYSNTPADFDFKLESLAQSFQTLSDLAKHLATAVDIVFPVIHGQFGEDGGIQELLEKYNVPFVGTGSKECCQAFDKHKASLELRKHGFITVPSFLVQGYETDKSELSEWFKKHQLDPDLGKVVVKPTRGGSSIGVGVAYGVNDSLVKANEIMSEGIDKKVLIEIFLEGGNEFTAIVLDVGSDLDSFPVVLLPTEVELQFRGANDVKENDAIFNYRRKYLPTQQVAYHTPPRFPLDVIENIRKGASLLFQRLCLQDFARIDGWFLPNSSSKLSPFSQSEFGRTESGAIIFTDINMISGMEQTSFLFQQASKVGFSHTNILRSIIHHACLRFPNLASVSGISGQLPSRSKSLQRNKSFSRREGTRKVFVIFGGNTSERQVSLMSGTNVWLNLLAFHD

SEQ ID NO: 207145 - protein, 152 aa, Glycine max
  Coding DNA Sequence Number=SeqID_90367
  Homolog annotation: Hit_ID=Q1S2Y9; Match level="QueryCoverage=95%, HitCoverage=97%, E-value=4e-71, Identity=84%"; Hit description=Wound- induced protein WI12, putative
  Pfam annotation: Domain name=WI12; Domain location=53-152; Score =121.6; E_value=2.2e-33; Accession=PF07107.2; Description=Wound -induced protein WI12
MEDHQKVEMQNKARVEVLYKALLGQGTMDNVAKLLASDLEWWFHGPPHCHHMMKVLTGETDHTKGFRFEPRRVTAVGDCTIAEGWEGKAYWVHVWTLKNGLITQFREYFNTWLVVRDLRPPRWEDSKDSMTLWQSQPRDLYHRSLPGLVLTI

SEQ ID NO: 207146 - protein, 84 aa, Glycine max
  Coding DNA Sequence Number=SeqID_90368
  Homolog annotation: Hit_ID=Q10LR1; Match level="QueryCoverage=82%, HitCoverage=38%, E-value=6e-07, Identity=46%"; Hit description=BHLH transcription factor bHLH033, putative, expressed
MAASREKRRASLEETLQQLRDVTNSTAVIDMKLVLLLNKASIIVDASKYIEELKQKVEGLNSELEIAESSTTTQIDELPMVLYY

SEQ ID NO: 207147 - protein, 68 aa, Glycine max
  Coding DNA Sequence Number=SeqID_90369
MNFAPFIIQEQQAEWINVHRSIMRPLSFRNNKLGGKRAETDSTPFIIQEQQVEWFCWQGGSLAEWCFG

SEQ ID NO: 207148 - protein, 201 aa, Glycine max
  Coding DNA Sequence Number=SeqID_90370
  Homolog annotation: Hit_ID=Q6ZVI3; Match level="QueryCoverage=69%, HitCoverage=87%, E-value=7e-14, Identity=41%"; Hit description=CDNA FLJ42547 fis, clone BRACE3004880
MKAQRWRTLSPVKDKVRILSHVKDKVGNLSLVKDKVRILSLMKDKVRTLSLVKDKVRTLIPMKDKVRTLSPVKDKVRTLSPVKDKVRILSPMKDKVRALSLVKDKVRTLIPMKDKVRTLSPVKDKVRTLSLVKDKVMILSPVKAKSEDFESYERVFPFLFKSFDYFAQQGNIRLWDQSCAPLKDGHRLTPRVCRSHGNSMA

SEQ ID NO: 207149 - protein, 90 aa, Glycine max
  Coding DNA Sequence Number=SeqID_90371
  Homolog annotation: Hit_ID=Q1SSL7; Match level="QueryCoverage=47%, HitCoverage=6%, E-value=7e-07, Identity=55%"; Hit description =Peptidase aspartic, catalytic
MALWVMAASARELLLQPEVTFLAQASCSSPILLEPFVHGSSDWSLPREDCIKRGNNLPLLHFDLVGPTRTNSVSGKRYGLVTVDDYSRWT

SEQ ID NO: 207150 - protein, 422 aa, Glycine max
  Coding DNA Sequence Number=SeqID_90372
  Gene Ontology: Mol. function=oxidoreductase activity; Biological process=electron transport
  Homolog annotation: Hit_ID=Q5SMI8; Match level="QueryCoverage=87%, HitCoverage=88%, E-value=1e-99, Identity=48%"; Hit description =Putative D-amino acid dehydrogenase
  Pfam annotation: Domain name=DAO; Domain location=49-399; Score=97.7; E_value=3.4e-26; Accession=PF01266.14; Description=FAD dependent oxidoreductase
  Subcellular localization annotation: CTP_CleavageSite=49; ConfidenceScore=5.52e-01
MKSLNLWPNPNGRILPRISTCPTLNLVYSVPPSPSSVRCHSSPTQLPLRCAVLGAGFAGLSVVWHLLKQSPKELQMRIDIYDEVGIGGGASGVSGGLLHPYSPKVKLLWEGAQCWKESMKLLRVAEEASVSKDCRTGESAEDMKAFVAHKRVETLNDEEAQSLLPGVCLPFNTAFYMPEALNINSQHYLQALFQGCKNLVKESSTLESGHKQLSLHKRSVHRLSDFEGEYDAVIICLGAKVNMLPEISGRLPLRTCRGVIAHLELPDDMIGYPESGPSILSDAWISVQGPRSLKVGSTWEWKSINSLPNVSTDEATKALLELLPKASTIYPGIKDWVFTGARAGLRAMPPLTTLGSLPLLGCINDVIGRNHTCRYWLFGGLGSRGLLYHAWLGNLMAQAVLSCNEEVIPSELTSWKATEPKI

SEQ ID NO: 207151 - protein, 55 aa, Glycine max
  Coding DNA Sequence Number=SeqID_90373
MTNVVTCTLPGDVSIFRPILRKYLICYLFYFCHPETFKSNDARDSSLLDGDDRVR

SEQ ID NO: 207152 - protein, 58 aa, Glycine max
  Coding DNA Sequence Number=SeqID_90374
MEKHQVLSPISSSSSTSPSDFKLGDHNSNAHVKKAGVMLIYWMMGTGGDRIPAARGIH

SEQ ID NO: 207153 - protein, 44 aa, Glycine max
  Coding DNA Sequence Number=SeqID_90375
MEAKNNEALQGSTWPAEWSLQAGGAAAKVIPRTWSSTHLKFYYN

SEQ ID NO: 207154 - protein, 142 aa, Glycine max
  Coding DNA Sequence Number=SeqID_90376
MAEDIVVFEMQMKSQSKDIESSTKGADDHIGLYVSSNLPSYYKGADNHEVSLHAIVLAISGYQRDQMTILVSACHQTCRLWMMKVRITMRCLRALSDLSSPDSKGKTKVVSVDRHRVFDRGVEAKLHDESRLIQRCFDDNKR

SEQ ID NO: 207155 - protein, 410 aa, Glycine max
  Coding DNA Sequence Number=SeqID_90377
MSSIIAYLEKATMTFICISKTTMSSVIACLQKASFHDLHLHFEDDNVFSHCMLSKGDNDLHLHFEDENVFIHCMPSIGDNAIIYAFEDVLLLGLPLVVGQGRGLSLRGSTFFAVATYPSAGGRRETRGMRVPRKEYARSRHQRLFEENVGKTGKDAIYELLSERFGSCIYARGSKIGEVLAAQLAQASQVASSRSNSLLEEYSGGPNTLQGPKKGRMSSSKGPRMKLGYDICIEFSLEISEEKKKEGENPSRGASVTHPRRFHDRFRGRSSPFFVILQSSTGCDSGVPNLTHWLRGASDRRCTSKTKDSNTQGSMYPALIANIDLADDNVTLKEMVIELEEDVKGLDTRVVNNKTSTRQHAKETERLKATLVEVTGPLSIDVPLTEVVDNEDDDNGDEEEVQHGNDELIS

SEQ ID NO: 207156 - protein, 128 aa, Glycine max
  Coding DNA Sequence Number=SeqID_90378
  Gene Ontology: Mol. function=chitin binding; Cellular component =extracellular region; Biological process=chitin metabolic process
  Homolog annotation: Hit_ID=UPI0000612705; Match level="QueryCoverage =70%, HitCoverage=43%, E-value=3e-09, Identity=26%"; Hit description =UPI0000612705 related cluster
LTLGYTPSPSKDYITFRGLHVLTFRGLHTLTFRGLDVLTVRGLDVLAIKGVHAHAFRGLYVLVFRRLQDLTFRGLHALAFRGMHALAFKGRHVLNFRGLHAFAFRGLCILIFSVLHIHTLREFRVLCP

SEQ ID NO: 207157 - protein, 187 aa, Glycine max
  Coding DNA Sequence Number=SeqID_90379
SMKEEMGSEETNFPSKPWIRDSHHVHSDAARETTSHAWPQHMSPPTPPPCVKGNNNISNNEIDVSMSSGAQYCYYMLEAMPQPGPTWSTTGPCVLAEPTPTPTLTPSALIEDSSYTCWLGYLEGFDGNLTTEKLDPPFVENVVMENAKGVFGYESTLVEAIDLSYCCPDDWLVIPTMEQDLEDIVMP

SEQ ID NO: 207158 - protein, 54 aa, Glycine max
  Coding DNA Sequence Number=SeqID_90380
MDTISTLPKSRGVCTDKKTGRVYVMGLLFTFHSVGVHDQFGFSGKWQKGVENWP

SEQ ID NO: 207159 - protein, 87 aa, Glycine max
  Coding DNA Sequence Number=SeqID_90381
METIYGGLWMKLKWGGIFRILYLDKSNKGMEIRRRRSKETTGMVSWPYKISHGIDEDRKKSRVAIIDEQGMGLILLAQVLYAYMLYM

SEQ ID NO: 207160 - protein, 102 aa, Glycine max
  Coding DNA Sequence Number=SeqID_90382
MAEPLIKMCCILLDVRVVSDVEVHGLSSNYVTEQVLSKLIWGGIAIKILRGKFHDHILQKLLCLFSSHAKSSQQHLHIETTKVHQKEDNRIICTKTSRQLQL

SEQ ID NO: 207161 - protein, 59 aa, Glycine max
  Coding DNA Sequence Number=SeqID_90383
MAHNTRPPSWQCCHCAVTLLTLLICTVLDPCGNWSTRCACYRKSSSNSTVLCENEYDHN

SEQ ID NO: 207162 - protein, 85 aa, Glycine max
  Coding DNA Sequence Number=SeqID_90384
  Gene Ontology: Mol. function=alanine-glyoxylate transaminase activity; Cellular component=mitochondrion; Biological process =photorespiration
  Homolog annotation: Hit_ID=Q94AL9; Match level="QueryCoverage=67%, HitCoverage=12%, E-value=3e-22, Identity=86%"; Hit description =Alanine--glyoxylate aminotransferase 2 homolog 2, mitochondrial precursor
MKDAEYNNEGAEYNSPLSILVIGDVRGIGMMLGVELVSDRELKTPAQNETLHVMDQMKELGVLIGKGGYYGNVFRITPKKMQVAL

SEQ ID NO: 207163 - protein, 423 aa, Glycine max
  Coding DNA Sequence Number=SeqID_90385
  Gene Ontology: Mol. function=sugar binding; Biological process =protein amino acid phosphorylation
  Homolog annotation: Hit_ID=Q5JK65; Match level="QueryCoverage=65%, HitCoverage=66%, E-value=5e-17, Identity=25%"; Hit description =Protein kinase-like
  Pfam annotation: Domain name=B_lectin; Domain location=88-194; Score =54.6; E_value=3.3e-13; Accession=PF01453.15; Description=D-mannose binding lectin
MLLLLLPLMRLFPFLFLLLVLLFNYGFSESGVGAGYQLMVAVPVEYEVNFKGRAFLVETNQTAPNFRVALSIEAINGKYSCSLEVFLGDVKVWDSGHYSRFYITEKCLLELTMDGDLRLKGPKERVGWKTGTSGQGVKRLEIQRTGNLVLVDALNNIKWQSFNFATNVMLRGQQLDVATRLTSSQSNSSLFYFSFEIEDKKVALYLNYGKLRYSYWGFQPTMNRSITYIKLSSRGLLLFDVKYKKIAQIPSEGIHPLRFLALNNETGNLGLYHYSPEKGKFEASFQALNSTCDLPISCRPYGICTFSNSCSCIQLLANENKGGADCSGGITGGFCNGKEAEMLEIDNISSVLKNVTRVDCKCAAALYFGNASTDEAECYIYRLVLGLKQGLDIGWLKGEVIAYILEPAIHEQFRKKPGPGESS

SEQ ID NO: 207164 - protein, 247 aa, Glycine max
  Coding DNA Sequence Number=SeqID_90386
  Gene Ontology: Mol. function=zinc ion binding; Cellular component =membrane; Biological process=defense response
  Homolog annotation: Hit_ID=Q1SIN6; Match level="QueryCoverage=97%, HitCoverage=32%, E-value=2e-63, Identity=51%"; Hit description =Regulator of chromosome condensation, RCC1
  Subcellular localization annotation: CTP_CleavageSite=20; ConfidenceScore=5.16e-01
MFQLFLKALIAIKKGTQLIKYSRKTKPKVCPFRLSLVVFRRYLQPEKDYLSFSLVYSNEERTLDLICKDKDEAEVWFTGLKTLISTGKLRRIGSELFDDGVDFTPKGRPFGAALEFGICITRNNKVAFDFASHEPSLNLVTSTDVGLESANNMQPRTSIGDGFRVSVSSTPSVSSTGSGPDDIESLGDVYIWGEVWADGVSLDGFSTQAPSTTDVLIPKPLESSVVLDVQQIASGVRHIALVTRQGE

SEQ ID NO: 207165 - protein, 219 aa, Glycine max
  Coding DNA Sequence Number=SeqID_90387
  Homolog annotation: Hit_ID=Q1RZK3; Match level="QueryCoverage=53%, HitCoverage=8%, E-value=8e-20, Identity=50%"; Hit description=WD40 -like
MQATRIYTSPTILKKQMSPLGDEAAVGGAGGDGGLEGVVAELAQDDGVGQVGHAGGGIPGVVAAANDGDGGFRVAAVREIGVVVAAAVVVKSGDGGGSRGGRGGGGGIVEVVVRGGNDENCGLGKARGHQISQCHPNRKPSSVAIVHGIIIGKVLRKEGTLGFRSVRDMKMKIKVKVKVMMMAMVMVMVLALMMVGMGMVMMMMMKGAHRTVAAGTVSP

SEQ ID NO: 207166 - protein, 580 aa, Glycine max
  Coding DNA Sequence Number=SeqID_90388
  Gene Ontology: Mol. function=zinc ion binding; Cellular component =membrane; Biological process=defense response
  Homolog annotation: Hit_ID=Q9LTC2; Match level="QueryCoverage=94%, HitCoverage=49%, E-value=1e-141, Identity=47%"; Hit description =Chromosome condensation regulator-like protein protein
  Pfam annotation: Domain name=DZC; Domain location=513-548; Score =51.8; E_value=2.2e-12; Accession=PF08381.1; Description=Disease resistancezinc fingerchromo
  Pfam annotation: Domain name=FYVE; Domain location=112-180; Score =40.6; E_value=5.3e-09; Accession=PF01363.12; Description=FYVE zinc finger
  Pfam annotation: Domain name=RCC1; Domain location=62-109; Score =23.4; E_value=0.00083; Accession=PF00415.9; Description=Regulator of chromosome condensation (RCC1)
  Pfam annotation: Domain name=RCC1; Domain location=8-56; Score=23.4; E_value=0.00079; Accession=PF00415.9; Description=Regulator of chromosome condensation (RCC1)
  Pfam module annotation: Pfam domain module=DZC::FYVE::RCC1::RCC1; Domain location=513-548::112-180::62-109::8-56
MTVALTTSGHIFTMGSNENGQLGNHLADGKVPILVQDKLVGEFVEVISCGSHHVAALSSRSELYTWGKGANGRLGHGDIEDRKSPTIVESLKDRHVKNISCGSNFTSCICIHKWVSGVDQSVCTGCRQPFGFTRKRHNCYNCGLVHCHGCSSRKVLKASLAPTPGKPHRVCDSCYNKLKAVEACASSNLHRKMTTTPRNSLDTRERFGQGDVKSSRLILPPITEPMKFHQIMMANKMGSKHDYSSMSPASQVPSLLQLNDIAFGNSISSTQNVLRSAIALSPPPTPPLNSRPTSPYSRRASPPRSRTPGFSRSLIDSLRKTNELLNQEVSKMQNQIRSVRLKNDMEIQKLQKNVMEATSFAAEESSKHKAMKEIFESTVDQMKEMIEKLPPDVLDSGNLKVVLTRAENFLKENSEFETPSSAKSQQQHALNTPNLNTSSSKLQEHRIEENNETVDEGNVIQESNNSSLSNNEASMPSQNDSKSQDSSRPGKEGETEVIEFEPGVHVTLIVKPGGVRFFKQVKFSKRRFREHQAKEWWSKNKDRVHRKYIAPQTTNSEGTGSSNTLPPPPPTKENIETVSS

SEQ ID NO: 207167 - protein, 586 aa, Glycine max
  Coding DNA Sequence Number=SeqID_90389
  Gene Ontology: Mol. function=binding; Cellular component=cytoplasm; Biological process=embryonic development ending in seed dormancy
  Homolog annotation: Hit_ID=Q1RZK3; Match level="QueryCoverage=98%, HitCoverage=41%, E-value=0.0, Identity=91%"; Hit description=WD40 -like
  Pfam annotation: Domain name=HEAT; Domain location=498-534; Score =20.2; E_value=0.0077; Accession=PF02985.12; Description=HEAT repeat
MAPQKALESIGKTLSSQYERWQPKVGVFRQARYKCQLDPTVDEVKKLCTTCRKYAKSERVLFHYNGHGVPKPTANGEIWVFNKSYTQYIPLPINELDSWLKTPSIYVFDCSAAGMIVNSFIELHEWSASNSSVSQRDCILLAACEAHETLPQSAEFPADVFTSCLTTPIKMALRWFCTRSLLRESLDYSLIDKIPGRPNDRKTLLGELNWIFTAVTDTIAWNVLPHDLFQRLFRQDLLVASLFRNFLLAERIMRSANCSPVSHPMLPPTHQHHMWDAWDMAAELCLSQLPSLVEDPNAEFQPSTFFTEQLTAFEVWLDHGSEHKKPPEQLPIVLQVLLSQCHRFRALVLLGRFLDMGPWAVDLALSVGIFPYVLKLLQTTTPELRQILVFIWTKILALDKSCQVDLVKDGGHIYFIKFLDSMEAYPEQRAMAAFVLAVIVDGHRRGQEACIEAGLIHVCLKHLQSSCPNDSQTEPLFLQWLCLCLGKLWEDFSEAQTIGLQEDATTIFAPLLSEPQPEVRASAVFALGTLLDVGFDSCRSVGGDEECDDDDKFRAEVSIVKSMLDVASDGSPLVRAEVAVGRLLSI

SEQ ID NO: 207168 - protein, 160 aa, Glycine max
  Coding DNA Sequence Number=SeqID_90390
  Homolog annotation: Hit_ID=Q1RZK5; Match level="QueryCoverage=40%, HitCoverage=8%, E-value=4e-11, Identity=60%"; Hit description=Epsin, N-terminal; GAT; ENTH/VHS
  Subcellular localization annotation: CTP_CleavageSite=76; ConfidenceScore=5.75e-01
MIPQANTAASYSSAPRVRPVQHNNSFPSRGSGGAPASATGQKLFVPSYRLFEDLNVFGNTDARVKMTNSGSSSSLSGSMGPGMDNFYHRRAEKLNKFQTHSVIFLGNLEKISRDTQEAFNIVQRTTPCARKSFHRSKSGLLILFRNRILQKGHSGIGCQG

SEQ ID NO: 207169 - protein, 67 aa, Glycine max
  Coding DNA Sequence Number=SeqID_90391
MFDPFCLSWQYMQTRSQRLKLLEEPEIERLARRLRKGHREKAMTEVENATQTLMDYLNLHLRETNNI

SEQ ID NO: 207170 - protein, 342 aa, Glycine max
  Coding DNA Sequence Number=SeqID_90392
  Gene Ontology: Mol. function=kinase activity; Biological process=D -ribose metabolic process
  Homolog annotation: Hit_ID=Q2K4U5; Match level="QueryCoverage=77%, HitCoverage=86%, E-value=3e-51, Identity=43%"; Hit description =Probable sugar kinase protein
MQQRGKKAGVKAVAGTDCVDHRDRATSLLQAVLTLPAARALRTAFHHAAAAPAEPLRQQVRAGVQIICATQSERFDFIEQQPVALRQPAGDLRAYLIAPALRRPAGIDGGDKPALLQFGQQLRIVVIQLQAEKRAAQQHDIAAAGLRRELAQHVLRAEPHNVTEITEERSLVIGVRDANGERGFAGVARPVRRAVRKMARQPCAEAVIALISDGAMAHLHRFQRQRAVACRTARTQLTVLQHHFGAALRPAVQRTHDDIDIDIAHHVERGAGFLIAHHPLLPPLARPLTSVFCSQIAIKRGGTDARIPTAAISPSSVARPAVKPAMVTGRVCAAMLLVNSRA

SEQ ID NO: 207171 - protein, 231 aa, Glycine max
  Coding DNA Sequence Number=SeqID_90393
  Gene Ontology: Mol. function=sugar binding
  Homolog annotation: Hit_ID=Q1SN79; Match level="QueryCoverage=57%, HitCoverage=33%, E-value=2e-40, Identity=57%"; Hit description =Curculin-like (Mannose-binding) lectin; Root cap
  Pfam annotation: Domain name=Root_cap; Domain location=169-229; Score= 40.6; E_value=5.4e-09; Accession=PF06830.2; Description=Root cap
MEKWKQLYLAIKRELDEPTQRTYDGDGLYWKAEENDIQMEKQKKELQEKEETIKVLKTQLLSMEKEKYKRRGSLTCNRLSHRDDKVDCLIVKWDDELVNIPTYGEAKWRANGEERQVVMERTNETNSVTVTISGLVELDIHFFQLDRTCTKVHNYQLPTDYSFSHLETQLWFEKSIDNFEGVLGQTYRPGYVSPVKRGVPMPIMGGEHQIKIIWPKLKCLSHSDYFDIYSM

SEQ ID NO: 207172 - protein, 140 aa, Glycine max
  Coding DNA Sequence Number=SeqID_90394
  Gene Ontology: Mol. function=cysteine-type endopeptidase activity; Cellular component=endoplasmic reticulum; Biological process =proteolysis
  Homolog annotation: Hit_ID=O65039; Match level="QueryCoverage=97%, HitCoverage=43%, E-value=5e-54, Identity=69%"; Hit description =Vignain precursor
  Pfam annotation: Domain name=Peptidase_C1; Domain location=1-122; Score=46.9; E_value=5.2e-15; Accession=PF00112.13; Description =Papain family cysteine protease
QYGITTASNYPYEAKDGTCDASMVNEPAVSIDGHENVPVNNEAALLKAVAHQPGVFTGNCGTALDHAVAIVGYGTTQDETKYWIVKNSWGSEWGEKGYIRMKRSISVNKGLCGIAIEASYPIKKSSSKPREHSSYPKDEL

SEQ ID NO: 207173 - protein, 135 aa, Glycine max
  Coding DNA Sequence Number=SeqID_90395
  Homolog annotation: Hit_ID=Q1STZ2; Match level="QueryCoverage=66%, HitCoverage=19%, E-value=1e-07, Identity=31%"; Hit description=IMP dehydrogenase/GMP reductase
MGSSQVPLLKKRFYQVKVNSLGIASLKELGQLMGQLQRQAFCKAYGKVWDLAMAEVSTEAIASLAQYYDQPLRCFTFGDFQLSPMVEEFEEILGCPLGGRKPYLFSGIRPQKASRKWGGWSTEKMFGGKSKNLGR

SEQ ID NO: 207174 - protein, 125 aa, Glycine max
  Coding DNA Sequence Number=SeqID_90396
NPQLYDIYAETLTTVCNFGEIFVLDVQWEVWIKHPKHGSIPVVATCPFAGERGRGSRVRFPKEERCAESPPMFICGKLRKNRRKPVKMKILSSGVVFTFEEGISTSHVCPKGQQPIFKNCGIALP

SEQ ID NO: 207175 - protein, 127 aa, Glycine max
  Coding DNA Sequence Number=SeqID_90397
  Homolog annotation: Hit_ID=Q1SI25; Match level="QueryCoverage=43%, HitCoverage=6%, E-value=5e-13, Identity=64%"; Hit description=NB-ARC domain, putative
MMCHVHYSSLDNIRADGLKNLLVINNTKTTIQLYKKDALVSFEDEEWQRVLSNIEPETASPIGKFAPDAKRGAVSPLSLTIWPATGVASLTGDLHRLSRATGEIKDIASATGEIKDIASGASEIMQL

SEQ ID NO: 207176 - protein, 180 aa, Glycine max
  Coding DNA Sequence Number=SeqID_90398
MEEAAQSGSTNLVIDPPSPIRRHVKWKMVSTKKTGQMMSEASKEIADKIASQGSFVAHGRQDVLTVAIGRPEHPVRVCATGVGMQSQGLALPPKPAVGPSAARVSTKESCVDPLRNDIDTGDSEKCGLYIKENPPRLDALGKLYEGSTTVHNIPLRHDKVKVGVEEVRDADALIPIPTEE

SEQ ID NO: 207177 - protein, 116 aa, Glycine max
  Coding DNA Sequence Number=SeqID_90399
  Homolog annotation: Hit_ID=Q1SCB3; Match level="QueryCoverage=25%, HitCoverage=11%, E-value=8e-07, Identity=86%"; Hit description=40S ribosomal S4 protein
MEAANCLSYESQFGCLCEEEYRDFGEVVAAASLIGAAGSIVGLESALIGELELEFESVVGSTEEECTVQFYKTEIQIRGRYSFGILNSAKPAEVCSDIPSTHCYSDAATCSCRWQR

SEQ ID NO: 207178 - protein, 81 aa, Glycine max
  Coding DNA Sequence Number=SeqID_90400
MRVLESASPVESLTHLHAGRGMTRAIQCMRHLPSGVWGGWMYATLIYEREWEKRDVEWKMAGRFRVLHWKFNMNVLAGSSL

SEQ ID NO: 207179 - protein, 1260 aa, Glycine max
  Coding DNA Sequence Number=SeqID_90401
  Gene Ontology: Mol. function=nucleic acid binding; Cellular component= nucleus; Biological process=regulation of transcription, DNA-dependent
  Homolog annotation: Hit_ID=Q9M2L7; Match level="QueryCoverage=83%, HitCoverage=65%, E-value=0.0, Identity=67%"; Hit description =Helicase-like protein
  Pfam annotation: Domain name=DEAD; Domain location=318-490; Score= -28.5; E_value=0.0014; Accession=PF00270.19; Description=DEADDEAH box helicase
  Pfam annotation: Domain name=Helicase_C; Domain location=965-1043; Score=94.4; E_value=3.4e-25; Accession=PF00271.21; Description =Helicase conserved C-terminal domain
  Pfam annotation: Domain name=ResIII; Domain location=314-484; Score= -10.5; E_value=0.00035; Accession=PF04851.6; Description=Type III restriction enzyme, res subunit
  Pfam annotation: Domain name=SNF2_N; Domain location=320-624; Score =346.3; E_value=4.9e-101; Accession=PF00176.13; Description=SNF2 family N-terminal domain
  Pfam module annotation: Pfam domain module=DEAD::Helicase _C::ResIII::SNF2_N; Domain location=318-490::965-1043::314-484::320 -624
MEVGGAEAWPKACGVERCNSSLSMRPASARTIKLLRCCSTSVAASLVNMGFQNQQLNDQAYQDRSTHPSFPTLTEISCLSQFHTSTMVKVTEAPKSTDNALEATWNQLKNGCRGLLERGEDGGADRLGTPEKGVMVVGEMRCTVVAGHGTSKWEQHAEVRKREEKEAAEALRREQELREAKRQQQRLNFLIQQTELYSHFMQNKSSVHSSDALPSVDENTNDQDVLFDSSDAGHNEEEDPEEAELKKEALKAAQEAVSKQRMLTNAFDSACLRFRQVDEADSLTRQLAGGSNIDLQTPSTMPVVSTVQTPELFKGCLKEYQLKGLQWLVNCYEQGLNGILADEMGLGKTIQAMAFLAHLAEEKNIWGPFLVVAPASVLNNWNEELERFCPEIKRLPYWGGLSERAVLRKSINPKDLYRREAKFHILITSYQLLVTDEKYFRRVKWQYMVLDEAQAIKSSNSIRWKTLLSFNCRNRLLLTGTPVQNNMAELWALLHFIMPTLFDSHEQFNEWFSKGHLTKVLQSFMINLMPELRTMQNMGHSILKPFMLRRVKKDVISELTNKTEVMVHCKLSSRQQAFYQAIKNKISLAGLFDSNRGQLNDKKVMSLMNIVIQLRKVCNHPELFERNEGSTYFYFGEIPNSLPPPPFGELENIYYPGGHNPISYEIPKLVYKEIIQSSAVGHGICRESFQKYFNIFRPENVHRSIFSEDIIVKSGNFGFTHLMDLSPQEVAFMATGSFMERLLFSMMRWERKFLDEVLDFLIETTIGDPECYLEKGKVRAVSRMLLLPSRYETKFLQKKFATGPTNAPFEALMVSHQDRLSSNARLLHSAYTYIPPTRAPPICAHCSDRNFSYKMIEELHDPWVKRLFVGFARTSECNGPRKPDNPSHLIEEIDSELPISQPALQFTYGIFGSSPPVRNFDPAKLLTDSKKLQTLDILLKRLRAENHRVLLFAQMTKMLNILEDYMNYRKYRYFRLDGSSTIQDRRDMVRDFQHRSDIFVFLLSTRAGGLGINLTAADTVIFYESDWNPTLDLQAMDRAHRLGQTKDVSSSLTFGGEEDENLGGPRERRGGNNMILMHIMSTFWAFGGATAPLGINLVPSLNVTSQTNGLYRTSFLGYSSVVTVYRLICKETVEEKILHRASQKSTVQNLVMTGGSVGGDLLAPEDVVSLLLDDVQLQQKLKEIPLQVKSKQKKKPNKAIRINEEGDASLEDLTNCLDQGTANHDTSMDPEGPKSSNKKQKLSSFLYIMEDLLHEELSSG

SEQ ID NO: 207180 - protein, 178 aa, Glycine max
  Coding DNA Sequence Number=SeqID_90402
MDLEFDFEVNNGLYDCIRRLVSQPDVLQKILTRLHLYKTSVGIFSCDFAIKQTKIASPNSFSKRYRTEHKNLHDLVFVKYNQQLKQRDNARDGIHPISLKDIDMCWIQLGWLKWRKASGFICDRKVPTKLKGKLYCTAICPAILYGSECWALKGQHERKVEGSKNENVKMDVWPYKKR

SEQ ID NO: 207181 - protein, 258 aa, Glycine max
  Coding DNA Sequence Number=SeqID_90403
  Gene Ontology: Mol. function=nucleic acid binding
  Homolog annotation: Hit_ID=Q9M2L7; Match level="QueryCoverage=66%, HitCoverage=11%, E-value=1e-21, Identity=35%"; Hit description =Helicase-like protein
  Subcellular localization annotation: CTP_CleavageSite=61; ConfidenceScore=5.32e-01
MTPTQRTLVFTRASHTGCVYDLSLLSHRDLSYPSHPFFRAKASSPLSLTSSYSSSLFRKIRRMDRKSKRNHSFSYSTLFNLEPLKNFKLPREDDDDFDYYGNNSQEDESRDSQGERENYCNGNVHAREQNSSSKRVWSENSDTDDENKGRYYGTHMTQERYQSMLGDHVQKYKRRRKDAMSNTDQNQVVVPLVKSNNGLKIQKSGNDCRGASHAEERASEWLQDQKQGNFSRADFKQQYGTDRFAFLFCCIDSVGGFQ

SEQ ID NO: 207182 - protein, 65 aa, Glycine max
  Coding DNA Sequence Number=SeqID_90404
MFFMIGPLSSLSLPPASLMKWKEIYFPKEEEAVIQIQSQLGSSDNDQDNWLVGNGLTKESFNAKA

SEQ ID NO: 207183 - protein, 148 aa, Glycine max
  Coding DNA Sequence Number=SeqID_90405
MSSLDGKGADDHELSPCAIELDSLWIERVVDDHELSPCAIELDCLWITKRTCSLTTKGSSFLADPSVPSSEGKGSNSYPRSRFMADELRFWLNKLVEGQPDMMYVRDARPPWPRTAREWAKGKGRGPDFAGAGCNDRTSRSAAPSLCD

SEQ ID NO: 207184 - protein, 291 aa, Glycine max
  Coding DNA Sequence Number=SeqID_90406
  Homolog annotation: Hit_ID=Q9M9M5; Match level="QueryCoverage=27%, HitCoverage=20%, E-value=3e-19, Identity=47%"; Hit description =Putative 26S proteosome regulatory subunit
MGSFMIMKGSFIDCFNSSCSDTDILHAEILGRHGIHICNWNNITVVECFSILFNSTVYLPHTHFLCISFSSENGIRAPRLLAPKQQCRPSICIGEIGNQVDTAHGHESHMCRQSMLKHNFNLDETELELHKARPRGQIKEGADGRENGVAAQNDSQSPVAASFPCVPSDSNFSFSFLLAFDEGFIVNGLVLVATATKGAMVCLKWRFAEAENEYHRAKNQELVNLQEESSIRQEQARQVEGRAHEAKLAEDVNMRILVDRGLRAILTDQNKLVVAVCGVTALAAGRGLHCK

SEQ ID NO: 207185 - protein, 310 aa, Glycine max
  Coding DNA Sequence Number=SeqID_90407
  Gene Ontology: Mol. function=DNA binding; Biological process=DNA integration
MKADIEAMKEQMTMMMEAMMSMRKMMKDNTTTVVAASTATRIGLNVLTFIFHRTQCPLSLCFHMTQHPRLHVFIGLNVLAFIFHKTQHPHLYLSIGLNIVAFIFHRTQRPRLYVSIGLNWHQSLGFELRETLGEGSETLSEDSETLVRLLGSQDALEKGYTQIENEDSFPQNKKLTLLKMKKTDQEALTFICQGLDEGMSEMVSNASTSKEAWEILRTSLESVDKVKKLRLQTLCGKFESLCMKEFKSILDFGNRVVMVVNQMKCYRENTKDVCFVENVLHSLIAKSDFVVCAIEESKDIESMTADQLLG

SEQ ID NO: 207186 - protein, 86 aa, Glycine max
  Coding DNA Sequence Number=SeqID_90408
MTENENENAIVSRVVSESENKSARVRDEGSLCSYKECVSESESENESTRVRDKGCRRAAAKSVCLMIDKLEEDLEKMKSSTTLIAN

SEQ ID NO: 207187 - protein, 508 aa, Glycine max
  Coding DNA Sequence Number=SeqID_90409
  Gene Ontology: Mol. function=oxidoreductase activity; Cellular component=membrane; Biological process=electron transport
  Homolog annotation: Hit_ID=Q9SMP5; Match level="QueryCoverage=92%, HitCoverage=92%, E-value=1e-162, Identity=60%"; Hit description =Cytochrome P450-like protein
  Pfam annotation: Domain name=p450; Domain location=34-496; Score =128.2; E_value=2.3e-35; Accession=PF00067.12; Description=Cytochrome P450
MLIFFFTLLVSFSGFLLLFLDTQPEQQRSHNYNHAPLSHPIIGCLVSFYQNRHRLLDWYTEHLANSPTQTIVVRRLGARRTVVTANPRNVEYILKTNFGNFPKGKPFTEILGDLLGCGIFNVDGELWHTQRKLASHEFSTRSLKDFIVKTLQEETQQRLLPLLEHAARESHVIDLQDVLRRLTFDTVCRVSLGYDPSCLDLAKPLPPLLTAFDTASEVSAARGAAPVFLVWKMKRILNVGSEKSLKEAVKLVHESVVKIIKAKKDKIAFNERNCGMDLLDRLLKAGHEEIVVRDMVISMIMAGRDTTSAAMTWLFWLLSKHREQEASLVKEFSCGENENKCLDYECLKEMKLLKACLCESMRLYPPVAWDSKHAGGADVLPDGTHVGKGDRVTYFPYGMGRMEALWGKDCCEFKPERWFDEESVKKGVLKCVNPYKFPVFQAGPRVCIGREMAFIQMEYVVASILNRFVISPVSDDYPRFVPLLTAHMAGGFKVRVHYRNGTQRIKLE

SEQ ID NO: 207188 - protein, 140 aa, Glycine max
  Coding DNA Sequence Number=SeqID_90410
MQTASPIGEFALATTRGVCSGLVTVIDDLAMQRGLASLTSDLAMLGRSRLVGLGTSNRLQACSAFQTGNHQHHWRLVLGCINGIFFVMFIKYTKPSNLSHKNDDLELIHRWIVVKFKKHVCNPFPNILTVGNFDITSELR

SEQ ID NO: 207189 - protein, 400 aa, Glycine max
  Coding DNA Sequence Number=SeqID_90411
MLKSQDYLREAMKERIEGLFSTKSLRWIMRISLQLKCSSWCGGLAASNDGSWWPPVVMGGGGGGVRAWVGVWREDERKIIHMTKPSNSPPSESAPSSSSPKKTRKATQIRSLDTRPIRMERSVVYMDPNTGKVDEASNQRTKKKILKTIGERWRKFKSDLTSKLTLEQGKEEDDIGKEKWQQFCQSRREPSWKDVRKNAQVIQKLNTAPHVLSHGETIVDPPSPIRRHMKWKMTHTKKSREMTSEVAHEIANRIDVLTVAIGRPKYYDRVRVVGVGVTIKQYFGPGSKSSCTSTSITPKELEQLTQKIRDQLEQSITKKVTRQLMLSFNQMQSHMQSHGLVLPPESEVGPSVARVSTKGSGSTTIYNVPLGNDQVKVSVEEVQDANACVPVPTQEVQLVG

SEQ ID NO: 207190 - protein, 154 aa, Glycine max
  Coding DNA Sequence Number=SeqID_90412
MSETMNKGNEFEAKPQNECSRPLNPSAAWLFIGKGHLVQGKLAQASWLLKVEGVNSPRRVACLGLKKFHGSAFVSGTNKQPAKPYATPWPCTVTDVKQQQLEVVFLQGNTSKQRGINAQSYALFALSAMHRLNGQSRLCVRKYGEVLILKALLA

SEQ ID NO: 207191 - protein, 67 aa, Glycine max
  Coding DNA Sequence Number=SeqID_90413
MEMVINNETNLHGKRWREALREAAGISGVDDPAWVGDPEDDGELFFGDGFGRASLNPFLVLLPPLRE

SEQ ID NO: 207192 - protein, 314 aa, Glycine max
  Coding DNA Sequence Number=SeqID_90414
  Homolog annotation: Hit_ID=Q8H9A2; Match level="QueryCoverage=19%, HitCoverage=37%, E-value=3e-10, Identity=64%"; Hit description =Dehydratiion responsive element binding protein 1 like protein
MVGRFTHCHVLHLNVSFPSVQKTILQRVGTFKRHSDAQAGIERVLDCGREGIRSSRVKYLRFPPTKEGWDYLGIQPIKYSSSFFIKGVLGRGRRDPKLHRGEDTRASFTSHLYASLQNIRIIVFKDDKSLPKGDHISYSLLVNWRNNGVSQNHRAGGSYEAWGRVLGGVPHFRGLHVRPHGPKFIGFLFFTLSLLVGLFATIAIVATHRISFALVDTGKGNHHAESAKLRHPNPSGLVIGNTNLVDPLVVPLPHSSVHRNGHHQANHQANPHGLVVGGDAFDSMEDVRFLEFVELSLDEPKLENELITENVDNA

SEQ ID NO: 207193 - protein, 185 aa, Glycine max
  Coding DNA Sequence Number=SeqID_90415
MERKTRKKKKGKQRVKINQDEREQIREEERRKILKELRKEKHVTYSSHDSCKSLSEEFCDYYEGRHRSYLRPHSYKREKEKKPQEANINLPYFHGKDNVKAYLDWEIRVEQQLKRKSTSKSYGSHSYPKKDQGLDILWAAPSKPKDDKWKTIEKQPPKAILGERMKNKKVEAIGVSLSEAYALSE

SEQ ID NO: 207194 - protein, 84 aa, Glycine max
  Coding DNA Sequence Number=SeqID_90416
  Gene Ontology: Mol. function=structural constituent of ribosome; Cellular component=ribonucleoprotein complex; Biological process =ribosome biogenesis and assembly
  Homolog annotation: Hit_ID=P50346; Match level="QueryCoverage=63%, HitCoverage=16%, E-value=2e-15, Identity=75%"; Hit description=60S acidic ribosomal protein P0
MVTSLSLVNSYPRLVVAPHMFVNAYKNVLAVVVETNYSLPKADKVKVYLKETSRQSQFNGPMLPIPKLMLKGKKLRARARARPI

SEQ ID NO: 207195 - protein, 179 aa, Glycine max
  Coding DNA Sequence Number=SeqID_90417
  Homolog annotation: Hit_ID=Q8W4M7; Match level="QueryCoverage=49%, HitCoverage=11%, E-value=2e-14, Identity=48%"; Hit description=DNA repair helicase UVH6
MPTDTTKIITLLSLITSYALSKPHSPLKLLYCTDTRGSNAFQGYILCGTSIEYIYLGLTENKRGYISCGSVLMEGTSTRLFKENKGGYIPCGSLLVTRSNNTVHEMEKMLTELHLLHDYQLYHLGPTFEILALGLSSRKNLCANSRVLTTENYDSTDVDYRKLTSSWVWAVAAENPNMS

SEQ ID NO: 207196 - protein, 96 aa, Glycine max
  Coding DNA Sequence Number=SeqID_90418
MALGVEEKVEKGYREEENKKTTIIDVDVTEEDGPDIEHLSVVPTVALPHYLQTTKQTLFIKTFMFYLNGLELLLMLVWAVANPTQLQPSNCWCEKE

SEQ ID NO: 207197 - protein, 142 aa, Glycine max
  Coding DNA Sequence Number=SeqID_90419
  Gene Ontology: Mol. function=microtubule motor activity; Cellular component=microtubule associated complex; Biological process =microtubule-based movement
  Homolog annotation: Hit_ID=Q9LY67; Match level="QueryCoverage=57%, HitCoverage=18%, E-value=3e-23, Identity=67%"; Hit description =Kinesin heavy chain-like protein
  Pfam annotation: Domain name=Kinesin; Domain location=1-142; Score= -188.9; E_value=0.017; Accession=PF00225.13; Description=Kinesin motor domain
MVREHLVFQHKSLTKGKRIWCRRSKHRYTTTQITTSPKQGPGILECEEQNKGLLPRVVEGLFDSINSLDIEKTYSVKLSMVEIYMEKVRDLFDLSKDNIQIKEIKSRGIILPGVTEFLIEIHITAMHGVSNLISRKHTSLPK

SEQ ID NO: 207198 - protein, 154 aa, Glycine max
  Coding DNA Sequence Number=SeqID_90420
  Gene Ontology: Cellular component=intracellular; Biological process =signal transduction
  Homolog annotation: Hit_ID=O82460; Match level="QueryCoverage=74%, HitCoverage=31%, E-value=3e-41, Identity=65%"; Hit description=Rac GTPase activating protein 3
  Pfam annotation: Domain name=RhoGAP; Domain location=43-153; Score= -29.6; E_value=0.0011; Accession=PF00620.17; Description=RhoGAP domain
MNGSEEDDVTITLFQTSAFSVTVFVVSAKSMQCSYDPKGNSVPIILLLMQDHLYSQGSLKLNRGIVPDDIDVHYLARLIKAWFQELPLGVLDGLFLEQVLQCNTEKEFVELVKQLKPAESALPSWAIDLMVDVIEEEEFNKMNARILQWFLLHT

SEQ ID NO: 207199 - protein, 79 aa, Glycine max
  Coding DNA Sequence Number=SeqID_90421
MMTVTDWLATTMMTRVYQQREGNSSKCEHHERNSQRQRGREISWTPPSMGWVKADTDGLIRDNGCHDSCASVIRDVHGR

SEQ ID NO: 207200 - protein, 122 aa, Glycine max
  Coding DNA Sequence Number=SeqID_90422
  Gene Ontology: Mol. function=transporter activity; Cellular component= integral to membrane; Biological process=oligopeptide transport
  Homolog annotation: Hit_ID=Q9M390; Match level="QueryCoverage=97%, HitCoverage=21%, E-value=8e-32, Identity=57%"; Hit description =Peptide transport-like protein
PQEQFHTAFQRIEIGLVISIFAMFVFGTLEFLRLREVKNYNYYNLKHMLMSIFWQVPQYFIIGFAEVFTFVGKLKFFYEQAPTCNESLCSSLSLTTVALRSYLSIMLVNVVTDVSTRHGGSG

SEQ ID NO: 207201 - protein, 77 aa, Glycine max
  Coding DNA Sequence Number=SeqID_90423
MADEDQLRVTLEDYSSSSVSQFFTREAKKWLHSFKGNSLKMWEEVVEKFLKKYFSESKTAEGKAAISSFHQFPNESL

SEQ ID NO: 207202 - protein, 210 aa, Glycine max
  Coding DNA Sequence Number=SeqID_90424
  Homolog annotation: Hit_ID=Q1RWU1; Match level="QueryCoverage=88%, HitCoverage=42%, E-value=3e-11, Identity=27%"; Hit description =Resistance-like protein HAAS-2-related
MTERYAWGVTALVHMYDQLNDASMSHSRQLGDYITLPQCWIYEHFSSVAESTADQDYDEASPIPYGEHREVRDFHVRSCYSGLLRWGPVVVYYRPERVVWQFGYTQTILAPPVDSWVSYDDIHDRWMHYEDHIVPAGEVCVVSGQCSNDYMDWFFGISHPLMTPGHASNSLLHGHALQPRVVPQAPQTDIPHVPEPGASSTSAEEPRHAV

SEQ ID NO: 207203 - protein, 81 aa, Glycine max
  Coding DNA Sequence Number=SeqID_90425
MGSKIYPKVHENPKAFFINSSPILLEPLAHGSGNWSFPREDCITKVLSSLRLCLNMVFSLCVPDFDIWGKTNSCVRVSVSG

SEQ ID NO: 207204 - protein, 39 aa, Glycine max
  Coding DNA Sequence Number=SeqID_90426
MCRKHKRISSKSLEEARNTFGTDEDLLLWCSYHNLHLGL

SEQ ID NO: 207205 - protein, 400 aa, Glycine max
  Coding DNA Sequence Number=SeqID_90427
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=6e-57, Identity=31%"; Hit description= UPI00006A17C9 related cluster
TITFRGLHVLTFRGLHVLTFRGLHVLTFRGLHVLTAIRGQHALTFKGLHVLAIRGLQVLAIRGLHAFRGQHVLAFRRLHVLAFRELHVLTSIRGLHALTFKGLHVLAIRGLQVLAIRGLHAFRGLHVLAFRRLHVLAFRGIHALTIRGLHVLALRGLHAFSFRGLHVLAFRGLHVLTFRGLHALAFRGLHVFTFRGLHALAFVGLHVLTFRVLHVLAIRGLQVLAIRGLHAFRGLHVLAFRGRHALSFRGLHALTFRGLHVHAFVGLHALTVRGLHVLTFRGLYILTFRGLHVLAFRGLHVLAFRGLHTLAFIGLHVLAIRGLHVLTFRGLHVLSIRGLHVLTFRGLHVLTFKGLHVLTFKGLHVLTFKGLHALAFVGLHAFTFRGLDVLTVGGLHGLAF

SEQ ID NO: 207206 - protein, 123 aa, Glycine max
  Coding DNA Sequence Number=SeqID_90428
  Subcellular localization annotation: CTP_CleavageSite=31; ConfidenceScore=5.40e-01
MTKEVIHGHNSQCLGSTSPSSSMFFSQLSASCSSPRQVYDLVLKALICPGELDASLGSLLLIDDATNKRTFGHYARVLVDLDFARVLGDQAIEHKDIPSIVDKNGVVENMVKGSVPVQSENTY

SEQ ID NO: 207207 - protein, 182 aa, Glycine max
  Coding DNA Sequence Number=SeqID_90429
  Gene Ontology: Mol. function=nucleic acid binding
  Homolog annotation: Hit_ID=Q1T5Z8; Match level="QueryCoverage=51%, HitCoverage=20%, E-value=9e-20, Identity=45%"; Hit description=Zinc finger, CCHC-type
  Subcellular localization annotation: CTP_CleavageSite=42; ConfidenceScore=5.33e-01
MHFPPMEDAPVSLASLAHKRVDNISSFTSVPPMLGYSKRGVCATIATPLQCTAMTLLRCTSIFLMEPVPFFPWGFLNKPSISSHQEHTFVQALNHVCNIPLNQLPMLCLKGEPILVTILEDKYGGSLEGCKNHLNGRIILPKGAKPISLTDLRLRLSKLWQSLKQWNLTPIGKGFFECAFSS

SEQ ID NO: 207208 - protein, 117 aa, Glycine max
  Coding DNA Sequence Number=SeqID_90430
  Homolog annotation: Hit_ID=Q1SLD9; Match level="QueryCoverage=38%, HitCoverage=13%, E-value=3e-11, Identity=66%"; Hit description=Zinc finger, RING-type; RINGv
MEHRICGGLSSDARLHHQGEPQHADLLVDLRLRATVPHPYGLRVAEYHRRNDAPNNSDEDNVGTSESSSSLGFCFKWLLGLQAEKFEMSSQKGHHEHEEEMGTGKVVVIAVKASRDI

SEQ ID NO: 207209 - protein, 202 aa, Glycine max
  Coding DNA Sequence Number=SeqID_90431
  Gene Ontology: Mol. function=RNA-directed DNA polymerase activity; Biological process=RNA-dependent DNA replication
MIGIRLSSIKLPTTTRPWSECPFSRMEIVFSNRNKQFKIMSFSTMILYLPQTVCFTNDLIAKHIPNMVFDEDNLMISNLHSFDEVKMIVFSLSGNNTLGPNRINQYMPIAMTNFQFKIISKILVDKLATISPKIISTHRRGFIREGVFVRGTPSLPFSSVWQRKSSVVVYAWPKSLLKEVECWVHNFLLSWDIAIRKLVTVK

SEQ ID NO: 207210 - protein, 105 aa, Glycine max
  Coding DNA Sequence Number=SeqID_90432
MACNLRLTASRNLTPIVKQSVKFHDMSGVERKHYCAIRKVPWIASGSNTARLGELGGNLLPLFPIKRQNGAVLRVPDPPGYAFQLKSAKVFLRSSPFFICSSFFN

SEQ ID NO: 207211 - protein, 85 aa, Glycine max
  Coding DNA Sequence Number=SeqID_90433
MPIAVYISVGWPVLCEGNTQGHQKYDKLRQGLRESVVDRIQREREMDSHWVRMVLLIACILPALVECRVRHYKFHNDVVTTARVA

SEQ ID NO: 207212 - protein, 291 aa, Glycine max
  Coding DNA Sequence Number=SeqID_90434
  Gene Ontology: Mol. function=DNA binding; Cellular component=nucleus; Biological process=regulation of transcription
  Homolog annotation: Hit_ID=Q0PJE0; Match level="QueryCoverage=77%, HitCoverage=95%, E-value=1e-123, Identity=97%"; Hit description=MYB transcription factor MYB51
  Pfam annotation: Domain name=Myb_DNA-binding; Domain location=134 -181; Score=52.6; E_value=1.3e-12; Accession=PF00249.21; Description =Myb-like DNA-binding domain
  Pfam annotation: Domain name=Myb_DNA-binding; Domain location=26-75; Score=34.7; E_value=3.2e-07; Accession=PF00249.21; Description=Myb -like DNA-binding domain
  Pfam module annotation: Pfam domain module=Myb_DNA-binding::Myb_DNA -binding; Domain location=134-181::26-75
MNRGIEVLSPASYLRSSNWLFQESLGTRWTPQENKLFENALAVFDKDTPDRWLKVAALIPGKTVGDVIKQYRELEEDVSVIESGFIPLPGYTAADSFTLEWVNNQGFDGLRQFYGVTGKRGASTRPSEQERKKGVPWTKEEHRQFLMGLKKYGKGDWRNISRNFVTTRTPTQVASHAQKYFIRQLSGGKDKKRSSIHDITMVNLPEAKSPSSESNNRPYSPDHSVKDEHDWKLPCETVPMLFNSTNGNMFMTPLCGISSYGSKPLQEQYFLSGCQFGPYDTIMQMPSMQNQ

SEQ ID NO: 207213 - protein, 87 aa, Glycine max
  Coding DNA Sequence Number=SeqID_90435
MTISILQCDERSVTRISSWLLFKGVWDLLRQQRKDNDVVAMVMVLRKTVEVLRRKTKVFAVTMRGSLASEVSSAMTKVRDHECCPTY

SEQ ID NO: 207214 - protein, 69 aa, Glycine max
  Coding DNA Sequence Number=SeqID_90436
MENGEYAEGEKDGVKCGGVQRRGTGMSKALSCDWWIGCLWALRPHDGYNKAWTGLGKLVIYMEAMNIDV

SEQ ID NO: 207215 - protein, 371 aa, Glycine max
  Coding DNA Sequence Number=SeqID_90437
  Homolog annotation: Hit_ID=Q8TGM6; Match level="QueryCoverage=32%, HitCoverage=97%, E-value=3e-08, Identity=38%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPQTTRLADSASWCDRGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 207216 - protein, 560 aa, Glycine max
  Coding DNA Sequence Number=SeqID_90438
  Homolog annotation: Hit_ID=Q9ZRT1; Match level="QueryCoverage=34%, HitCoverage=30%, E-value=1e-46, Identity=50%"; Hit description =Protein gamma response 1
LETKTPDVFVATCVIKRVKEKPSEIDRGCNLSSPSSGFRDVPKCPSNTKLVSVSSTKRPVSSWRQTRSHQSRVGPDPHDDFLDTSLENIRENLNKDLNKEDQPCLIQKDISADSSDDETHDMNAKSSPQKKQKQSSVTVANTRSFKYVEPVRKKAERENLKGVECKQCRKFYDAVLPNADGKDADSKQSFRCEHLDGVSRHRYRYVPPMTPEGFWNIGFESEIINGCLRFFHVPYGDRIEAATAELTSDQTMSTKLDEILQRLTLLEIHYQFSNVLQPSLTPSSEQTAAGAVPQLNTKDGAAEFEPSFVCLDKKVQSLMEESLNSVSNQGRVVENQTMEAEVHGEDGSKFALGSNEKSVFGRGCRFGNYDCTVSRHHVPFELDHSDSEDANAVSFEVLKETPFWVYDREALGLFKKFNKGLGHFLGIDTFDPGGYLKGLKRRKEIIDYQYAWGYIMGNERLDANYVVPQWMPQFMCKSEARTLIVLDEVWTLSVVDQLMCRIPGCKFLVVSRPKFQMVLSYEVELLIEEDALSLFCHHAFGLKSIPLAANENLVKRVVTE

SEQ ID NO: 207217 - protein, 71 aa, Glycine max
  Coding DNA Sequence Number=SeqID_90439
MAGAGDGGEPYGRIEGQEHQMNQNVGRPYGGIRRGNNGPRQNRMEWQNRIEGVKLSIPPFKGESDPNAYLD

SEQ ID NO: 207218 - protein, 87 aa, Glycine max
  Coding DNA Sequence Number=SeqID_90440
MNCQQNAHEEITHGPVYTPSYSPPDITPSPSTAYAPSATPNESIAAPKVEETTNNLEGTTKTETSRLKIEIWKHFKKIKANGEDKAQ

SEQ ID NO: 207219 - protein, 141 aa, Glycine max
  Coding DNA Sequence Number=SeqID_90441
MQRRSIAGDLISIDLEESRADQKVEGFKQQLADEPTLESVDDLVQLVEIVEEAEEKVIETEKKKGKSEANIEKKKEAPPIECKEKLEITLPFGEALQQMPFYAKFLKDMLTKKNLYIHSDIIVVEGNYSAIIQRILPPVSR

SEQ ID NO: 207220 - protein, 49 aa, Glycine max
  Coding DNA Sequence Number=SeqID_90442
MVVVVVLVATTIVGIVVIVAITMTMSGDNDDGGNCYGDDGSSSGDDSSN

SEQ ID NO: 207221 - protein, 99 aa, Glycine max
  Coding DNA Sequence Number=SeqID_90443
GTIKVAHKRLKSQNSQNNSSIPDLVQNSCSLHDYIAVYDSGLQVLDAGGDLSSSEKSAQFQYSRAGCQDIVSDIVDPSTSIHHLTLYLALCIVHPDLIP

SEQ ID NO: 207222 - protein, 139 aa, Glycine max
  Coding DNA Sequence Number=SeqID_90444
RQDVLTMVIGRSEHPDCVCAAGAGVTIKQHFGLAPRTSHMSSSMAPEELEQLTQKIRDQLEESIIGKGLALPLKLEVGPSVARVSTKENCGYPSGNDPDTNESKKYRLYGSTTIHNILLGNDEVKVGVEEVRDADACIP

SEQ ID NO: 207223 - protein, 328 aa, Glycine max
  Coding DNA Sequence Number=SeqID_90445
  Gene Ontology: Mol. function=metal ion binding; Cellular component =integral to membrane; Biological process=metal ion transport
  Homolog annotation: Hit_ID=UPI00005F919E; Match level="QueryCoverage =85%, HitCoverage=84%, E-value=1e-71, Identity=51%"; Hit description =COG2215: ABC-type uncharacterized transport system, permease component
  Pfam annotation: Domain name=NicO; Domain location=70-320; Score =195.8; E_value=1e-55; Accession=PF03824.6; Description=High-affinity nickel-transport protein
MDETVKAHCQFDLHTPKPDDSLKQYALSLDKADAPPEDMDLGQQFAQTKVLHREMTQLLQQVAQQPQQAGVTLMLFSLAYGVLHALGPGHGKVVISTFLATHPAQLKTSMKLTLLAALLQGAVAIALVTLMLVALQTSSRQLHLTSYWLEKGSYLLVMALGVWVGWRALQGLRRAFRPATGLQIRAVRPHHQHHADCGCGHAHLPSAQQLAGAVSGRTQALVVLSMGLRPCSGAIMMLLFAKVIGVYGWGVASALTMALGTALTVSLLGLLVQRSRVLAVRLGRVSSRGAAQWLLPAVMLAGSLLLLLAGFILWHSATPGFGGGLRPF

SEQ ID NO: 207224 - protein, 130 aa, Glycine max
  Coding DNA Sequence Number=SeqID_90446
  Gene Ontology: Mol. function=DNA binding; Cellular component =endoplasmic reticulum membrane; Biological process=DNA integration
  Homolog annotation: Hit_ID=Q1T010; Match level="QueryCoverage=87%, HitCoverage=8%, E-value=4e-27, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTAAHVLNRCPTKRLNSMVPKEAWSGSKPLVKHFKIFGSLCYRHATDQKRKALNDKSEPMIFVGYNSTGTYKLYNPKTKEVLFSRDVYFDESKSWSEPQAITETIPRLQLDWEEIDSRKEATQGTLNTEQ

SEQ ID NO: 207225 - protein, 112 aa, Glycine max
  Coding DNA Sequence Number=SeqID_90447
  Gene Ontology: Mol. function=nucleoside-triphosphatase activity; Cellular component=chloroplast
  Homolog annotation: Hit_ID=Q2PMM5; Match level="QueryCoverage=93%, HitCoverage=6%, E-value=4e-49, Identity=70%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDQWSLPGPDEKMGSHLMTR

SEQ ID NO: 207226 - protein, 211 aa, Glycine max
  Coding DNA Sequence Number=SeqID_90448
  Gene Ontology: Mol. function=DNA binding; Cellular component =chromosome, pericentric region; Biological process=DNA integration
  Homolog annotation: Hit_ID=Q3KCJ9; Match level="QueryCoverage=97%, HitCoverage=53%, E-value=6e-66, Identity=64%"; Hit description =Integrase, catalytic region
  Pfam annotation: Domain name=rve; Domain location=87-211; Score=20.4; E_value=0.00012; Accession=PF00665.16; Description=Integrase core domain
MHQDWSSEQIAGWLKRCYPDNQEMHVLHETIYKTLFIQTRGALKKELQQCLRSGRVVRRSRTSSLKGKGLGSIPDSIPIRERPPEAADRAIPGHWEGDLIQGSKNSYIVTLVERHSRFVMLAKIRDNKTITVISALIKQARVLPVELYKTLTWDRGSEMTSHNRFTVATDIQVYFCDPQSPWQRGSMKIRTDCSDSIFQKELTYRFTASKD

SEQ ID NO: 207227 - protein, 413 aa, Glycine max
  Coding DNA Sequence Number=SeqID_90449
MEDWGNFLHQILEEDSEDSTPIKVFLLVLGFEWRFGEEHDNSGLAQLPLHYASLSGPKLAQRNSLSGCYTFRGLKVLPFRGLKVLAFIGLKVLTFLGLKVLAFRGLKVLAFRVLKVFAFRGLKVLAFVGLRVLCHLCFLETVVVSFHQPEERKPVDTKRHIWSSAPFVEDLLSFDRNYFSLPFVNQRQARPLTRRDKYGHLLPLSKTQCLLTVTSLVSLFYPETIESDGTPQCLLIEAIEVSLANQRQSGLMACGDHHGPHLYFKDDNVFSHCMPSKGNNVLIYISKMTMSSVIACLQKATMCLSTFRRRQCLPSLHAFKGNNDHHLHFEENNVFSHCMPSKATKGYIYLGLTENKRGYISCGSVLVEGTSTRLFKENKGGYIPCGSLLVKGFLQVEKKSQGPQVAWGLDVGT

SEQ ID NO: 207228 - protein, 106 aa, Glycine max
  Coding DNA Sequence Number=SeqID_90450
MAKNEGKSSRNCSRKRLGSIAEAPRLGFSSRKYIFSPKTVEMHSIGDGVVDKSGAFAPTYPAGRESRQRTGFCLWGFYGGWIFELQWGPLMVIFHHGDAAKDKGKE

SEQ ID NO: 207229 - protein, 40 aa, Glycine max
  Coding DNA Sequence Number=SeqID_90451
MYQIGINTMPKNSWPFGRRMHSYKRVIDFGDLEMNTRWSK

SEQ ID NO: 207230 - protein, 69 aa, Glycine max
  Coding DNA Sequence Number=SeqID_90452
MALSMPSSLLYACLWFDHPLVCAVKNFSIDKCTVSLELERAGLDNCSARHSVQGSSSYYVVLIMLFKSG

SEQ ID NO: 207231 - protein, 125 aa, Glycine max
  Coding DNA Sequence Number=SeqID_90453
  Homolog annotation: Hit_ID=Q9AY32; Match level="QueryCoverage=47%, HitCoverage=90%, E-value=2e-25, Identity=96%"; Hit description=RRNA intron-encoded homing endonuclease
WTLGWVDRSASGVHRSARPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 207232 - protein, 53 aa, Glycine max
  Coding DNA Sequence Number=SeqID_90454
MKATIRSFQEQTREGSRLVYQVMAAPVILGASSSLVLIEIQHLELQRDNDVGH

SEQ ID NO: 207233 - protein, 140 aa, Glycine max
  Coding DNA Sequence Number=SeqID_90455
MATLGLEILVESASSVILKMILSFDLAFALIPLLKFSSSKVTSSTSIEEPYLPTTTGARATIVETSKNNDDVLTTDVDILPNNVGGEPATDVDRKQNKYGCYAYPTLIWTTTTTSLANPTLKWTKTTTGCIKCASLNPFL

SEQ ID NO: 207234 - protein, 97 aa, Glycine max
  Coding DNA Sequence Number=SeqID_90456
MIYHTKFDEFKTELERRNWHKELTNFLDGSIDVAIVKEFYASLYDPEDKSPKQVRVTGHLIKFDEDALNTFLKTPVIIEEGESLSAYSRFCRLRPDP

SEQ ID NO: 207235 - protein, 270 aa, Glycine max
  Coding DNA Sequence Number=SeqID_90457
  Gene Ontology: Mol. function=structural constituent of cell wall; Cellular component=cellulose and pectin-containing cell wall; Biological process=protein amino acid phosphorylation
  Homolog annotation: Hit_ID=Q9LJ64; Match level="QueryCoverage=99%, HitCoverage=33%, E-value=1e-108, Identity=57%"; Hit description =Extensin protein-like
  Pfam annotation: Domain name=LRRNT_2; Domain location=30-69; Score =17.9; E_value=0.012; Accession=PF08263.3; Description=Leucine rich repeat N-terminal domain
  Pfam annotation: Domain name=LRR_1; Domain location=103-125; Score =2.8; E_value=84; Accession=PF00560.23; Description=Leucine Rich Repeat
  Pfam annotation: Domain name=LRR_1; Domain location=127-147; Score =3.7; E_value=58; Accession=PF00560.23; Description=Leucine Rich Repeat
  Pfam annotation: Domain name=LRR_1; Domain location=151-170; Score =13.5; E_value=0.79; Accession=PF00560.23; Description=Leucine Rich Repeat
  Pfam annotation: Domain name=LRR_1; Domain location=174-196; Score =7.4; E_value=12; Accession=PF00560.23; Description=Leucine Rich Repeat
  Pfam annotation: Domain name=LRR_1; Domain location=197-219; Score =6.8; E_value=15; Accession=PF00560.23; Description=Leucine Rich Repeat
  Pfam annotation: Domain name=LRR_1; Domain location=221-243; Score =0.0; E_value=2.8e+02; Accession=PF00560.23; Description=Leucine Rich Repeat
  Pfam annotation: Domain name=LRR_1; Domain location=245-266; Score =13.8; E_value=0.61; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=30-69::103-125::127 -147::151-170::174-196::197-219::221-243::245-266
DSQLAPPPEVGAIPPTFEVQNDAPLVNERLKKAYVALQAWKEAIYSDPLNTTGNWVGEDVCSYNGVFCAPAIDDPTLNVVAGVDLNNADIAGHLPEELGNLSDIALFHINSNRFCGIVPETLENLTLLHEFDISNNHFVGGFPSVVLKWPNLKYLDIRYNDFEGPLPPELFEKDLDAIFLNNNRFTSIIPDTLGKSKVSVVTFANNKFTGCIPKSIVNMKNMNEIVFMGNDLGGCLPQEIGLLESITVLDASHNGFVGTLPNLSGLKNVE

SEQ ID NO: 207236 - protein, 215 aa, Glycine max
  Coding DNA Sequence Number=SeqID_90458
  Gene Ontology: Mol. function=RNA-directed DNA polymerase activity; Biological process=RNA-dependent DNA replication
MEERLRVIKGGGNYAFADMAKLCLVPDMVISPKFKVPDFDKYKGTSCPKNHLKMYCRKMRAYAKDEKLLMHFFQESLVGATITWYTNLEPSQVYSWKDLMIAFIRQYQYNSDITPDIMQLQNMCKKDNESFKEYTQRWRDLETQVTPSMMEREMIVDTLPMFYYEKMVGYVPSSFADLVFAGERIEVGLRRGKFDYAATASSSNRRAGMSRGNKC

SEQ ID NO: 207237 - protein, 83 aa, Glycine max
  Coding DNA Sequence Number=SeqID_90459
MKLCFHIYVLTFRGLHVLTFRGLYVLTFSGLHTLTFKGRHVLNFRVLHVLAFRGLRVLTFSGLHIHALRGRAHKTPSGPGEVQ

SEQ ID NO: 207238 - protein, 144 aa, Glycine max
  Coding DNA Sequence Number=SeqID_90460
PHLPSFTTKVACICIPKDHVNCIDFLHLMSKSCGFGMTSPLDESISCFLIRVAPWVLVTLTVRGLHVLALRGLRVLTIRGLHALTSRGLYVLALRGLHALTLGLRVLTIRGLHALTSRGLHVLTLRGLHALTLGTSYPHRQWTT

SEQ ID NO: 207239 - protein, 120 aa, Glycine max
  Coding DNA Sequence Number=SeqID_90461
WNAVERKDKELRGSNNGVIRDYHTWLKARTEEAEVPEESEEVQSLKAKLERARGVKEKFKMTATRVRKECDELRDVNMAMAEGTQALKGRKGRVKDGKYDIRGQVEGLSKVEEEFNRTTE

SEQ ID NO: 207240 - protein, 348 aa, Glycine max
  Coding DNA Sequence Number=SeqID_90462
  Gene Ontology: Mol. function=oxidoreductase activity, acting on single donors with incorporation of molecular oxygen, incorporation of two atoms of oxygen; Biological process=aromatic amino acid family metabolic process
  Homolog annotation: Hit_ID=Q1IBW8; Match level="QueryCoverage=98%, HitCoverage=52%, E-value=2e-88, Identity=51%"; Hit description =Putative 4-hydroxyphenylpyruvate dioxygenase
MDVLAWSRHFRCFPGQGELNLAQFMTQLSAHGYRGAWSLEIFNDGFRASPVLPTAQDGFRSLLWLEEQTYDWLAKQPLLPNAMASLMERSLFHSQPHPPLLALEFIEFAVSHNDGLAMGQWLTQLGLVHAGEHRSKSVALYRNGKVNVILNAQPESQASGYYHLHGISLCAVAWRVRGVARLLQRAQDYGYALWQGETGPNERQIPALCAPDGSLIYLVEADEDPKNDIYHTDFHLTHRSAPPPALQSIDHLAIALTDESCGNWIMFLRSVPGFVQDNEWELPDPLGLVRSRVLRSPNDAIRLPLNMSVSRETQIAQALTTYQGAGLQHVAFGCEDLFSVVKRLSSVD

SEQ ID NO: 207241 - protein, 287 aa, Glycine max
  Coding DNA Sequence Number=SeqID_90463
  Homolog annotation: Hit_ID=Q1STZ2; Match level="QueryCoverage=78%, HitCoverage=46%, E-value=7e-12, Identity=26%"; Hit description=IMP dehydrogenase/GMP reductase
MDWDQLLAGIGGRTISWFPRWKEGKEGVLFSCGGYPNILLIGTRGCINYNPALAIRQLGYPMRGAPMEESMSPFIVRDFSTQNFKAIQRIHKAWETPLRKDKELRGIHNGIIGGYHEWLKVHTRGLDWLAKLKVVSEESFEAPEEDEEVQALKNELGKARLAKEKFKLATTDIRKECAGLREENATATRALEQETKRARREEHGRNKFRGALWGSKRSLFQRLCKTETNMLAIITKYQEELSLATAHEHRVADEYAQVYAEKEARGRAKAVANTYSAPRRSTNFSAI

SEQ ID NO: 207242 - protein, 160 aa, Glycine max
  Coding DNA Sequence Number=SeqID_90464
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=99%, HitCoverage=16%, E-value=3e-71, Identity=68%"; Hit description=DNA -directed RNA polymerase beta'' chain
MDSVGIRSANPYLATPGATVFQKVEQVLEVRSIDSISMNLEKRVDTWNGRITKILGIPWGFLIGAELTIAQSHGMSNVFLPGELIGLLRAERAGRSLEEAICYRVLLLGITKTSLNTQSFISEASFQETARVLSKAALRGRIDWLKGLKENVVLGGMIPV

SEQ ID NO: 207243 - protein, 129 aa, Glycine max
  Coding DNA Sequence Number=SeqID_90465
  Gene Ontology: Mol. function=transferase activity; Cellular component= intracellular; Biological process=translation
  Homolog annotation: Hit_ID=Q7PC91; Match level="QueryCoverage=98%, HitCoverage=26%, E-value=2e-45, Identity=65%"; Hit description =Putative transposase
MRVDALRQKGLSPLQKCTTAIHILAYGSPADNVDEYVRIGETIAVECLERFVSGIYTIFGNEYLRRPNNEDTERLLQMGAARGFPGMLGSIDCMQWEWKNCPVAWKGQFCRGDHRNPIIILEAMTSQDL

SEQ ID NO: 207244 - protein, 297 aa, Glycine max
  Coding DNA Sequence Number=SeqID_90466
  Homolog annotation: Hit_ID=UPI00006B27DF; Match level="QueryCoverage =45%, HitCoverage=14%, E-value=1e-58, Identity=83%"; Hit description =aconitate hydratase
GAEQVGDDGVVDDHLGRRERVDLVRVATESGDRLAHGGEVDDARDTGEVLHDHARRRELDLGVRLCRGIPRTQSFDLRLRHVRAVLGAQQVLQEDLETEGELVETGHRVDAEDLVVGAADRQGALGTEAVHRGHESVSFYSDGSDRRLHLGRRRAPAASKADLTSLLRTAHRRKPAIYLDVKINLSRLRRILVRGLSGVQRPHDEPGDGDQGCEQRQPHDELERSERRDVAGEIQRQLHGQTGEEQRGPGDPEPEVGAALAAVVAPGRALPHQEADGEADQRPADECRHEDHRAVDR

SEQ ID NO: 207245 - protein, 75 aa, Glycine max
  Coding DNA Sequence Number=SeqID_90467
  Pfam annotation: Domain name=G-patch; Domain location=1-42; Score =11.7; E_value=0.0069; Accession=PF01585.13; Description=G-patch domain
MVARVMLGNGYEPEMGLGKDNGGRTNLISARGKRGKFGKSKPRRFRNIFMGNYAKNFNRSSTFIVRSSFFFGLQP

SEQ ID NO: 207246 - protein, 110 aa, Glycine max
  Coding DNA Sequence Number=SeqID_90468
MRIKRSFKVVMGPRTSLSETTFHSACPTFNQYTMYIKYGPKYIMKHSQQNKLSNETKTPHTYSQNNSKAPKFLKDMEASTRIKPRLLCKQSMGQNTPNDYDDGWLKFSQR

SEQ ID NO: 207247 - protein, 456 aa, Glycine max
  Coding DNA Sequence Number=SeqID_90469
  Gene Ontology: Mol. function=transporter activity; Cellular component= integral to membrane; Biological process=transport
  Homolog annotation: Hit_ID=UPI0000162C35; Match level="QueryCoverage =71%, HitCoverage=54%, E-value=2e-28, Identity=29%"; Hit description =protein binding
  Pfam annotation: Domain name=Ank; Domain location=130-162; Score =21.5; E_value=0.003; Accession=PF00023.20; Description=Ankyrin repeat
  Pfam annotation: Domain name=Ank; Domain location=176-206; Score =14.7; E_value=0.23; Accession=PF00023.20; Description=Ankyrin repeat
  Pfam annotation: Domain name=Ank; Domain location=210-244; Score=9.9; E_value=1.1; Accession=PF00023.20; Description=Ankyrin repeat
  Pfam annotation: Domain name=Ank; Domain location=262-292; Score=9.0; E_value=1.6; Accession=PF00023.20; Description=Ankyrin repeat
  Pfam annotation: Domain name=Ank; Domain location=294-328; Score =25.9; E_value=0.00014; Accession=PF00023.20; Description=Ankyrin repeat
  Pfam annotation: Domain name=Ank; Domain location=96-128; Score=14.3; E_value=0.27; Accession=PF00023.20; Description=Ankyrin repeat
  Pfam module annotation: Pfam domain module=Ank::Ank::Ank::Ank::Ank::An k; Domain location=130-162::176-206::210-244::262-292::294-328::96-128
MDLDHLKIPIDDDPSWKERCNKRMEELKNTQFSSQDAASQQELLHKELVGEKIVLIPELYKAVEEGNVNKFLDVLEQECKQRKLNLSVIFEQVTETGDSLLHVAADKGKEKIVELICCHFPELLIRRNVRGGTPLHVAVRSKNSTMVNLILSQYASMKSTHDVMKDKEITREKDELGDTPLHEAVNNGDLSVLQVILHRDKDMVHELNKSRCSPLFLAAASGNVAIVNLLLDIPFSADQKLPLCFGNSPLHAAILKRNPAEDGSTSLHYAAYIGYVEGFRTLLKNSFSLEGNKKGHLPIHLACKRGHLEVVKEFLQNEWPINPRVLNKKGQNILHVAAKNGRTAFTVPGGVYSSDDTNPKNRGMAVLAHKRFFWVFTTFNMTAMYSSVLACGLMLMALIFDHKLATRTTILAMSCLILAFVTVPVAFMAAVRLVVANNSALSLLITVIGATYTFLI

SEQ ID NO: 207248 - protein, 83 aa, Glycine max
  Coding DNA Sequence Number=SeqID_90470
  Homolog annotation: Hit_ID=Q1T003; Match level="QueryCoverage=64%, HitCoverage=7%, E-value=2e-12, Identity=53%"; Hit description =Protein kinase; Concanavalin A-like lectin/glucanase
MSLNSSAVGDPTAFSASKGLRVWVSYSNVWPKDPMLKVDLNVGMYVKDLVYVGFSGPTQHSIKVHSVEWCMAKEAARSTTITQ

SEQ ID NO: 207249 - protein, 95 aa, Glycine max
  Coding DNA Sequence Number=SeqID_90471
MAASDIGILRDRAHIPTKKSLLELTSQDAMLAQNKLLSKQLETITETLRCTIFGGAHESGCCIPYEEHIAREVNYMGNKPRGNFNTSGFPGFQNN

SEQ ID NO: 207250 - protein, 135 aa, Glycine max
  Coding DNA Sequence Number=SeqID_90472
  Subcellular localization annotation: CTP_CleavageSite=36; ConfidenceScore=5.18e-01
MRRERREKNPSRGASVTLPRRFRKRSRGSSSSFFVRSSSFFDLQLVLGEHCLDGNCLVQIWEKGVVFIKSLNDYISIMQPKENCRKWHNYASNLLQKEKMKIKKNLRAGKERFKKGRFGSVSEELAQRARLAKRG

SEQ ID NO: 207251 - protein, 105 aa, Glycine max
  Coding DNA Sequence Number=SeqID_90473
MAELCLVSGIVIPLKFKVPNFDKYKGTTCPKNHLKEYCRKMGAYAKDEKLLMHFFQESLTGAAVTWQYQYNSDMASDRMQLQNMCKKSMNPSKDTPKGGGIWQLK

SEQ ID NO: 207252 - protein, 37 aa, Glycine max
  Coding DNA Sequence Number=SeqID_90474
MEEDNVKQPLLERKYYEISPSCKVDQAKELSEGQANF

SEQ ID NO: 207253 - protein, 119 aa, Glycine max
  Coding DNA Sequence Number=SeqID_90475
  Gene Ontology: Mol. function=RNA-directed DNA polymerase activity; Cellular component=intracellular; Biological process=RNA-dependent DNA replication
MSNSDSNTCHRVIHPVRAGLSNMYLTGSILDTNQVVWLIIDDLFPFSGIVMLPQHAPHQLIQHHHIEEERPPSHRWHQYRGVHEALLDLPKCLLTIVIPGNDLILAQKLEERLAGGREL

SEQ ID NO: 207254 - protein, 124 aa, Glycine max
  Coding DNA Sequence Number=SeqID_90476
  Gene Ontology: Mol. function=nucleic acid binding; Biological process= DNA integration
MTGDESKFTHISPKKSGHITYGDNNKGRILGVGKIGANASTSIENVLLVEGLKHSLLSVSQLCDKGYLCLALLSFKRLAKILLKHEHLDNEGKLELLHMMFNVMSRNKIGLHNAQGKIKCLVKN

SEQ ID NO: 207255 - protein, 253 aa, Glycine max
  Coding DNA Sequence Number=SeqID_90477
MGTFSFTSNHKETLEIRMGSNLDIVQNRTLTLSGGDNSISTLMLSGYMYTGDKPLVLNLTVAADFSDNLKTIIGSEFTDERRYYSDMKLYLVAEKGGTGGGAFYNTLNTLANKDDFAHVIAELAGDQLTVDRTGLTVYKADVKGNTTLDSAGALHFTDSKIDNMVTLNTGYANSVISVGETDNPWVFSKTGDKTATLYGSATTQAELQNAFSGLNATDNAQALFSQVLAKMTNGASANNLAEVGLLKLDKSLY

SEQ ID NO: 207256 - protein, 175 aa, Glycine max
  Coding DNA Sequence Number=SeqID_90478
  Subcellular localization annotation: CTP_CleavageSite=54; ConfidenceScore=5.79e-01
MATPPASPPPPLPSPSPPPTVASVSPSTQKRTRKATCLRSLATRPPREERPMVNVDPVTGKADGPHKKKLRTYLGVVARDKVDVTYETWKETEFEILEASDSRTKKKILQTVSERWWQFKLDLNRKWTLAAEQDGVDDTVYEKYDISKEKLAQFCQTHRDPSWEDVRKKTQVIQK

SEQ ID NO: 207257 - protein, 65 aa, Glycine max
  Coding DNA Sequence Number=SeqID_90479
MDASTSTTRSLLDDALGDYDGVVSDYIELCQQHRCSSHQLGPQSESLALDVCGGCCTATNCDLIF

SEQ ID NO: 207258 - protein, 259 aa, Glycine max
  Coding DNA Sequence Number=SeqID_90480
  Gene Ontology: Mol. function=agmatine deiminase activity; Biological process=polyamine biosynthetic process
  Homolog annotation: Hit_ID=Q3EQ73; Match level="QueryCoverage=97%, HitCoverage=60%, E-value=6e-68, Identity=51%"; Hit description =Agmatine deiminase
  Pfam annotation: Domain name=PAD_porph; Domain location=1-253; Score =72.2; E_value=1.7e-18; Accession=PF04371.5; Description =Porphyromonas-type peptidyl-arginine deiminase
DNGPIFVKDNKGHLLIEDWGFNGWGEKFDFENCDEIPQRIGKDIGAKVIDLNEEMVNEGGAIETDGNGVLMACKSSVISQKKGSVRTKGITQQEAEEMFKTYYGVSKVIWLDGITGLDVTDMHIDGFIKFIDKDTMITMDDEDLAEIGLSDQDINTLYTATNVKGKEYKKVYVPATKNKVKTAYGKQLDEKGSYVNYYVANKIVLVPNYGDPNDKVANKIIQDQYPTRKVIGIDVRNLYENGGMVHCVTQQQPAGELAK

SEQ ID NO: 207259 - protein, 71 aa, Glycine max
  Coding DNA Sequence Number=SeqID_90481
SWAKCISTAKRSFSVLSAKENLAEHQHQSRSLSATGLRTERPGHRIPEKPHAYLGKRAREAEKRSSLCIEA

SEQ ID NO: 207260 - protein, 168 aa, Glycine max
  Coding DNA Sequence Number=SeqID_90482
  Gene Ontology: Mol. function=transporter activity; Biological process= transport
  Homolog annotation: Hit_ID=Q0M803; Match level="QueryCoverage=98%, HitCoverage=25%, E-value=5e-85, Identity=88%"; Hit description =Hypothetical protein precursor
MLALPMFHAVGVDVQMRSMDRSLWEVRVRQGIDYDATAHRFGGNAGIAAILDPRYFIPNTTEALYAKGWQLWYRDPASKGAVEPPQPVKDALSRYDRVLGSPDPDVQRKLMAEILEIAADQFYVFGVCLPSDSYGVVKNNMQNVPKSMPNSWGYPTPGPANPETFFKA

SEQ ID NO: 207261 - protein, 242 aa, Glycine max
  Coding DNA Sequence Number=SeqID_90483
  Homolog annotation: Hit_ID=Q024H1; Match level="QueryCoverage=66%, HitCoverage=22%, E-value=2e-29, Identity=39%"; Hit description =Hypothetical protein precursor
MLHRPNAISGAAVRSPDWFKSATRWTQLTFAEDDPAKYDPEFWIDVFKRTKSNAVCLSAGGYIAYYPSEIPLHYVSSFIGDTDPFGTIVEGARKLGMHVMARVDPHAIHEDAALAHPEWVAINQDGSPREHWAFPGIYVTDALGSYNRDFTTDVIREVVTKYDVDAVFANRWQGHGVSYSDDNRIRFRQETGFDLPMRPDATDPAWQAWAAWRRRILTELVVYWDETVKSIRPHASFIPNMS

SEQ ID NO: 207262 - protein, 102 aa, Glycine max
  Coding DNA Sequence Number=SeqID_90484
MAHHWTNVTKDVLYLIMFMCSMLSPGLLNPDVSRMQRHTRIKCRSKLHDDEASFMMMNQAILMMPKAQVIDSRLIQDFKIKHQKSNPRFKRRNQEATSQDFI

SEQ ID NO: 207263 - protein, 48 aa, Glycine max
  Coding DNA Sequence Number=SeqID_90485
FSLNLEDATSVLSELTLAQHFCTAHPSSRVFYALSQRMSRLADGSLSA

SEQ ID NO: 207264 - protein, 328 aa, Glycine max
  Coding DNA Sequence Number=SeqID_90486
  Homolog annotation: Hit_ID=Q5XM22; Match level="QueryCoverage=38%, HitCoverage=85%, E-value=1e-51, Identity=69%"; Hit description =Resistance-like protein HAAS-2
ERPDLKLVSHGRKVTLIGRPVPEIEGLVAATGLSPLIDCSVITGDPGLISAFVESFHALSTEEARAETTLTRGAYVRLGWVRDIYETRCQARRWIVATRAYLLHLVGCTLFANKSATYVHVVHLDAFRDLTHSGGYAWGVAALVHMYDQLDEACRTTNPQLAGYLTLLQCWIYEHFPSVHQCVTDDTYQETSPRAFRWLTSKAHMKGITGAPYRAHCDGSALMGSYDRHSSTGEGGTPVRLHPEHPSAAFPGQVSADYMEWFFRISHPFMTPTQAGDQQRDAPAADPEDYIQPPSPQVPVAFDPPPHDDYEGYEAIAQRLERVLNLRI

SEQ ID NO: 207265 - protein, 208 aa, Glycine max
  Coding DNA Sequence Number=SeqID_90487
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=2e-29, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLRVLAFRELHVLAFTGLQVLAFRRLHALTFRGLHVLAIRGPHALTIRGLHVLAIRGLHALTFRGLHVLSIRGVHALTFRRLHVLAIRGPHALTFIGLHVLAIRGLHALTFIGLHVLTIKGLHAVTFKGLHVLAFKGLHALIFGGLHALDFRGQHVLAFRGLHVLAFRGLHVLVFRGLHVLAIKGLYALAIRGLHVLAIIGSHALTFR

SEQ ID NO: 207266 - protein, 38 aa, Glycine max
  Coding DNA Sequence Number=SeqID_90488
PNFTSGYANKSLLLKSNFLRWSNVYLANLSPRKHPNVA

SEQ ID NO: 207267 - protein, 127 aa, Glycine max
  Coding DNA Sequence Number=SeqID_90489
  Pfam annotation: Domain name=Transposase_23; Domain location=49-119; Score=0.3; E_value=0.0011; Accession=PF03017.5; Description =TNP1ENSPM transposase
  Subcellular localization annotation: CTP_CleavageSite=32; ConfidenceScore=5.34e-01
MASFSHLQSQMQSQGVAVPPEPVVGPSPSGPRVSTKGSCVDPSGNDPETGDSDRCGLYIEADPARLVAIGRVYEGSTVVHNTLLLPGQVKVSVEEVRDADAPVPVPTDEVSLVGQALHTFLAWPTHL

SEQ ID NO: 207268 - protein, 123 aa, Glycine max
  Coding DNA Sequence Number=SeqID_90490
  Gene Ontology: Mol. function=transposase activity; Cellular component= integral to membrane; Biological process=transposition, DNA-mediated
  Pfam annotation: Domain name=Transposase_8; Domain location=11-98; Score=105.1; E_value=2e-28; Accession=PF01527.10; Description =Transposase
MVEVLSGPERPRRRTPQEKIAIIQQTMEPGMTVSHVARLHGINANQIFKWRRQYEDGSLTAVASGEEVVPASELAAANKQIRELQRLLGKKTMEAEILKEAVEFGRAKNGLRMHPCCPGTTNN

SEQ ID NO: 207269 - protein, 128 aa, Glycine max
  Coding DNA Sequence Number=SeqID_90491
MGDKLHRREGNSPDHQLRPLNDRSVIKELTDRAALAPKMNGAKRSAEAVGCKKESVGERSPLEGRTRASSAGRSGSENVGLSNANVGENPMPRKPKGSSARPKGVVDGQQVNIPVLPFVGPEGRRRLG

SEQ ID NO: 207270 - protein, 75 aa, Glycine max
  Coding DNA Sequence Number=SeqID_90492
MVISAATSNNNNIHQLQSFNSQNNNYHLCDVSFSSYLNNKEEILAESGHGYVSSRKDPLGVKKEDDGELEYLKLK

SEQ ID NO: 207271 - protein, 180 aa, Glycine max
  Coding DNA Sequence Number=SeqID_90493
  Homolog annotation: Hit_ID=Q41123; Match level="QueryCoverage=38%, HitCoverage=70%, E-value=9e-30, Identity=67%"; Hit description=PVPR3 protein
LSDFDDLRGLHDGVLSRDGLSPRGLVVVGAVVAVGVAVLCAEKVPAAAPESRESHAPPAAGAAVHGAGGGGCIEESRRFGNRGGGGGGGGGGSDDDGNGGDCGCGNVTIMKIVVVVATMTMTMSGDSDDGYSCYGDEVMVVTTIVVVMAGTVMVLTTMVVTMPMMKMVVETETSLIVDFL

SEQ ID NO: 207272 - protein, 80 aa, Glycine max
  Coding DNA Sequence Number=SeqID_90494
MFGLHVWFRAGGTFDVLFCVMARSLDKIKSIDGSKETLKLSVRISYLWFIGMPNKSEQAEMVFVASDLYYLLLIVQFIVL

SEQ ID NO: 207273 - protein, 64 aa, Glycine max
  Coding DNA Sequence Number=SeqID_90495
RQAIHSEGSRIEGGGHMASARPRNQGAPDKNGEWRIGEIALGNQFAGLQTRRLEGGGHMNSARQ

SEQ ID NO: 207274 - protein, 176 aa, Glycine max
  Coding DNA Sequence Number=SeqID_90496
  Homolog annotation: Hit_ID=Q93Q53; Match level="QueryCoverage=94%, HitCoverage=60%, E-value=1e-17, Identity=31%"; Hit description=CjrA
  Subcellular localization annotation: CTP_CleavageSite=66; ConfidenceScore=5.29e-01
ALQRQRPQGFTGAGNDSQRAPATPAARAALAGQGPPGRRCTPAGTAGLGYALAVGRVWRPGTGGCRCRHAVVRRQPVAYRGQRAAGLDRGRAVPCGRCPPAPVGRGAGPACRRSTDAGRDAGRATGPRYAHGAGAARCARASAAGSRSLACTAQYRGTGLPVTGYACAGDRIGFTG

SEQ ID NO: 207275 - protein, 229 aa, Glycine max
  Coding DNA Sequence Number=SeqID_90497
  Gene Ontology: Mol. function=transferase activity, transferring glycosyl groups; Cellular component=integral to membrane; Biological process=response to oxidative stress
  Homolog annotation: Hit_ID=Q9M2R0; Match level="QueryCoverage=96%, HitCoverage=28%, E-value=1e-113, Identity=87%"; Hit description =Anthranilate phosphoribosyltransferase-like protein
  Pfam annotation: Domain name=C2; Domain location=41-121; Score=100.7; E_value=4.4e-27; Accession=PF00168.20; Description=C2 domain
MQRPPPEDFLLKETKPHLGGGKVSGDRLTSTYDLVEQMQYLYVRVVKAKDLPAKDITGSCDPYVEVKLGNYKGTTRNFAKNTHPEWNQVFAFSKDRLQASMLEVNVIDKDVLKDDLIGRVWFDLNEIPKRVPPDSPLAPQWYRLEDRKSDKAKGELMLAVWMGTQADEAFPEAWHSDAAMVSGSDALANIRSKVYLSPKLWYLRVNVIEAQDLMPTDKGRYPENSLRSR

SEQ ID NO: 207276 - protein, 69 aa, Glycine max
  Coding DNA Sequence Number=SeqID_90498
MGSSQTPWLKKRFYQVKIKSLGVTSLKELGQLIGQLQRQAFRKAYGKIWDLTMAEVSIEAIASLAQYYD

SEQ ID NO: 207277 - protein, 204 aa, Glycine max
  Coding DNA Sequence Number=SeqID_90499
  Homolog annotation: Hit_ID=Q9LSQ8; Match level="QueryCoverage=35%, HitCoverage=31%, E-value=5e-22, Identity=64%"; Hit description =Arabidopsis thaliana genomic DNA, chromosome 5, BAC clone:F24B18
  Pfam annotation: Domain name=zf-B_box; Domain location=3-49; Score =36.2; E_value=1.2e-07; Accession=PF00643.14; Description=B-box zinc finger
MEESSTTCVLCEKRAMMLCDSDQAKLCWECDEKVHSANFLVAKHSRVLLCRLCHSPTPWKASGMKLTPTVSFCNRCVAERNARWNRLVNNENEHQQQQQQQQQSDFVVDDGREYGSDHVFDDDDGDYSDDSGEEEEEDEDDEEENENQVVPMSSGSATSPPKVACLALKRLRNNSFSVDSSHISFRSVSSFHVLGKLVVQLCKL

SEQ ID NO: 207278 - protein, 256 aa, Glycine max
  Coding DNA Sequence Number=SeqID_90500
  Gene Ontology: Mol. function=diacylglycerol kinase activity; Biological process=protein kinase C activation
  Homolog annotation: Hit_ID=Q9FVC9; Match level="QueryCoverage=97%, HitCoverage=39%, E-value=8e-86, Identity=61%"; Hit description =Diacylglycerol kinase variant B
  Pfam annotation: Domain name=DAGK_acc; Domain location=49-255; Score=- 41.5; E_value=0.00069; Accession=PF00609.10; Description =Diacylglycerol kinase accessory domain
MRIKAPKEGSCDPIAPLDLPHAMHAFNRVSSTDKLNLKGYHTYRGGFWNYFSMGMDAQVSYAFHSERKLHPEKFKNQLYNQSTYLKLGCTQGWFFGSLFQSASRNIAQLAKVKIMKKGHWEDLHIPRRYENFYYGIQQQQQQQCLIPLGGSATWINFRHNVLSSTILRFKPLISILCIKSIVCLNLPSFSGGLNPWGTPNRRKSIYRDLTLPYVDDGLFEVVGFRDAWHGLVLLAPKGHGTRLAQVGHVGFVIIQQ

SEQ ID NO: 207279 - protein, 104 aa, Glycine max
  Coding DNA Sequence Number=SeqID_90501
  Subcellular localization annotation: CTP_CleavageSite=81; ConfidenceScore=5.20e-01
MFGLNCPNEFDEWHNDHCPSPSCRAVPSSFSSKPRFLIPTIVIFRSPSPSFCLTGIPGPSSPSFAFSGIEGPSSLRIVVFVVIKVKNRRLWHAQKSIGAAWVPR

SEQ ID NO: 207280 - protein, 49 aa, Glycine max
  Coding DNA Sequence Number=SeqID_90502
MVHDSILMSKVQIADKGAEQTQQYEGEVPIASDTKRKVSRPKKRQIQLL

SEQ ID NO: 207281 - protein, 157 aa, Glycine max
  Coding DNA Sequence Number=SeqID_90503
  Subcellular localization annotation: CTP_CleavageSite=43; ConfidenceScore=5.30e-01
MAEPSKKRKGIVTSSAVTRTRSHGTSKAQTSQISPTISSPTLFSSEEQHIQYNSLFSSHSIIDPKFVDLAFFDDEVFDCFQAFQNYGLIQFISMKLPFYPVSQHAILQASEARLTGALFKGGKMRGVATNVYLWKTSEKPKETGHNENSKFGSCIYA

SEQ ID NO: 207282 - protein, 87 aa, Glycine max
  Coding DNA Sequence Number=SeqID_90504
GVVLAEVLLADSRFTRPDMGFHPTKLNFVPSDADEAPLDVSICLHAFGIVGCGSFSGVKSCEREDPFHPGLFVGDAGGFQSPTREPR

SEQ ID NO: 207283 - protein, 145 aa, Glycine max
  Coding DNA Sequence Number=SeqID_90505
  Subcellular localization annotation: CTP_CleavageSite=31; ConfidenceScore=5.05e-01
MHPLFVFLLHKNFGFLGVATYPSAGGRCVTRGMRVPRKEYAQSCHQRLFEKNVGKTGKDAIYELLSERLGSCIYARGRVFPFAPTYSPIVMRKSDLRSSFLCVNQVILFYLKGDHFKALDLKNDPFYLVRNRNDKLSKSYFCGRA

SEQ ID NO: 207284 - protein, 399 aa, Glycine max
  Coding DNA Sequence Number=SeqID_90506
  Gene Ontology: Mol. function=chromatin binding; Cellular component =chromatin; Biological process=chromatin assembly or disassembly
  Homolog annotation: Hit_ID=Q1SAV4; Match level="QueryCoverage=65%, HitCoverage=65%, E-value=1e-56, Identity=43%"; Hit description =Integrase, catalytic region
  Pfam annotation: Domain name=Chromo; Domain location=298-344; Score =13.5; E_value=0.025; Accession=PF00385.14; Description='chromo' (CHRromatin Organisation MOdifier
MPDPSNVPTSLEDAILKLAAQQLSMGETLQTVTFQLNEILHRLPPALPNIGSASSTHASSSSPAQHHKIKIDVPRFDGSDPSGWIFKITQYFEYHATPEVMNKIIEQCLRAFVHRRPRVWGKLLLWVEWSHNTSWNAATGSTPYEITFGRKPFNFPDYITGTSKLDAVEDMLKDRDETFQCIRKKLLKAQANMKKFTDMKRREMSYQPGDWVLLKLRPRRQSSVKENPSVQGKLAKRFYGPFKVIERVGPVAYRLQLPENARAHPVFHCSMLKQLRGTPESEILVQLPDQFLQDQPLISPLSILDYRRSTPADPWQLLVQWKWLTPDDTSWEDWDTLQQDYHLEDKVILQGPPSDSIVMSKVQIADKGAEQTEQYEGEVRIASDTKRKVSRPKYLKDYV

SEQ ID NO: 207285 - protein, 56 aa, Glycine max
  Coding DNA Sequence Number=SeqID_90507
MWRDDGPSIPLKANEGDDGPGIPVKQKDGEGERKITMVGMRNLGLDENELGTARQL

SEQ ID NO: 207286 - protein, 42 aa, Glycine max
  Coding DNA Sequence Number=SeqID_90508
MAGCRDDEAGRYKGRGVGEEGGELGELGHGGEEGNEVVNVWK

SEQ ID NO: 207287 - protein, 84 aa, Glycine max
  Coding DNA Sequence Number=SeqID_90509
MEIKFCEKYTWQLKSYCYFGFRITIHLILATKTQLLSIFGLRAIEEAWSFILFYNRRGIELIREIVEDAKGGLGGKGCVESNQT

SEQ ID NO: 207288 - protein, 106 aa, Glycine max
  Coding DNA Sequence Number=SeqID_90510
MEELINKTQLSSKIIPTSSRQLDGSSTESHFLHPTTVILLPRTRHIQQLFIIHPWIQSRLLRMMHAPDLNSQMQCGTYRIQYQGNSPKRVYTTPHSGNHAVFVEAT

SEQ ID NO: 207289 - protein, 49 aa, Glycine max
  Coding DNA Sequence Number=SeqID_90511
MTKSARKGVPRRVQRRTSRAKFLEASGRRGASESRGVFGSFRWISDTFR

SEQ ID NO: 207290 - protein, 48 aa, Glycine max
  Coding DNA Sequence Number=SeqID_90512
MRLSLIGEFGGEEVGNIGGSSEGTRLERVWRYNAFEFDVKLPSIKEQL

SEQ ID NO: 207291 - protein, 104 aa, Glycine max
  Coding DNA Sequence Number=SeqID_90513
  Homolog annotation: Hit_ID=Q1T5G9; Match level="QueryCoverage=49%, HitCoverage=4%, E-value=5e-10, Identity=64%"; Hit description =Tetratricopeptide-like helical
MVGAFSQNIVTLTGLPMILLSESDLTNPLCDVSCYVLLSAPGWFFTDMRVSHLSLDQVEKPGYYWNGRPISSTKCRNLCKVGRAQKDDQRGQLCAHKLFIARYR

SEQ ID NO: 207292 - protein, 976 aa, Glycine max
  Coding DNA Sequence Number=SeqID_90514
  Gene Ontology: Mol. function=motor activity; Cellular component =myosin complex; Biological process=actin filament-based movement
  Homolog annotation: Hit_ID=Q1T0L3; Match level="QueryCoverage=91%, HitCoverage=75%, E-value=0.0, Identity=67%"; Hit description=IQ calmodulin-binding region; Myosin head, motor region; Myosin, N- terminal, SH3-like
  Pfam annotation: Domain name=IQ; Domain location=863-883; Score=13.5; E_value=0.77; Accession=PF00612.17; Description=IQ calmodulin-binding motif
  Pfam annotation: Domain name=IQ; Domain location=886-906; Score=16.5; E_value=0.099; Accession=PF00612.17; Description=IQ calmodulin -binding motif
  Pfam annotation: Domain name=IQ; Domain location=923-943; Score=24.7; E_value=0.00033; Accession=PF00612.17; Description=IQ calmodulin -binding motif
  Pfam annotation: Domain name=Myosin_N; Domain location=133-174; Score= 16.6; E_value=0.027; Accession=PF02736.9; Description=Myosin N -terminal SH3-like domain
  Pfam annotation: Domain name=Myosin_head; Domain location=186-848; Score=787.7; E_value=6.7e-234; Accession=PF00063.11; Description =Myosin head (motor domain)
  Pfam module annotation: Pfam domain module=IQ::IQ::IQ::Myosin _N::Myosin_head; Domain location=863-883::886-906::923-943::133 -174::186-848
MVLSASPCSLARSSLEEMLDSLRRRDEEEERKKDSPPALPARPASRARLPPARRSLPNNFKVSGSELAVAPEHGAGTNGENDLGQKRRRNGFGSKRVNKDVESPYVELSSSDSSGMIWELEGDDSVSYFIKKKLRVWSRQPRGQWELGTIQSTSGEEASISLSNGNVMKVVRSEILPANPDVLEGADDLNKLCYLNEPSVLHNLKLRYSQGMIYSKAGPILIALNPFKDLQTYGNDSVSAYRQRIIDSPHVYAVADTAYNKVIRDEVNQSIIISGESGSGKTETAKIALQYLAALGGGGSCAIENEFLQINRILEAFGNAKTSRNNNSSRFGKLIEVHFSSMGKICGAKIQTFGLFSWLCVCHMPTHMLTGTVMLEKSRVVQLANGERSYHIFYQLCTGSSSGLKERLNLRAVSEYKYLVQSDCTLIDGVNDANNFHQLMKALDTVQICKEDQEMIFKMLAAILWLGNISFQVDSENHIEVVDDEAVTSTAQLMGCSSQELMTALCTLKTQFDEDTIAKNLTLRQATERRDAIAKFIYASLFDWLVEQVNKSLEVGKPHTGKSISILDIYGFQTFQKNSFEQFYINYANERIQQHFNRHLFKLEQEDYELDGVDWTKVDFEDNEGCLDLFEKKPHGLFSLLDEESNLAKASDLTFANKLRHHLGANPCFKGERGRAFRVRHYAGEVLYDTNDFLEKNRDTLSSDSIQFLSSCNCELLQLLSKMFNQSQKQSVATKFKVQLFKLMQKLESTTPHFIRCIKPNSKDLPGIFDEGLVLQQLRCCEVLEVVRLSRAGYPIRMGHQEFSRRYGFLLSEANISQDPLSISVAVLQKFYIPYEMYHVGYTKLYLRAGQIDALENKRKQVLQGILEIQKCFRGHQARGYFCELKNGMTTLQSFIRGENTRRRYGVMVKSSITIYSRKLEEIHAIILLQSVIRGWLVRRDASHVNRSKRYPENAKPRRKSFMKIIPEVKLYYVKM

SEQ ID NO: 207293 - protein, 79 aa, Glycine max
  Coding DNA Sequence Number=SeqID_90515
  Gene Ontology: Mol. function=ATP binding; Cellular component =mitochondrion
  Homolog annotation: Hit_ID=Q2PMM5; Match level="QueryCoverage=85%, HitCoverage=2%, E-value=7e-33, Identity=97%"; Hit description =Protein ycf2
MDILSIMLPLLDDQDTSQKSKFLINGGTISPFLFNKIPKWMIDSFHTRKNDRKSFDNTYSYFSMISHDPDNWLNPVKRP

SEQ ID NO: 207294 - protein, 63 aa, Glycine max
  Coding DNA Sequence Number=SeqID_90516
MVDGDSSVLSSVTTLSAHGTRDLHKVVEEIQDEFVMTSNFGKEVVLLLEVCKRPYRYRVAALR

SEQ ID NO: 207295 - protein, 42 aa, Glycine max
  Coding DNA Sequence Number=SeqID_90517
MSEGGSTGGIPMKDFWILRGRRFGRVQILRRVASLCETREII

SEQ ID NO: 207296 - protein, 79 aa, Glycine max
  Coding DNA Sequence Number=SeqID_90518
MDKEEATKALIPNVRLKCLTYDVTNYKMKHSFGNDGGAATGELLEEVEAVAEGGQGITKSDAEEVKMLPKASKKRKSKI

SEQ ID NO: 207297 - protein, 91 aa, Glycine max
  Coding DNA Sequence Number=SeqID_90519
MTQSDIHRDEHQIPTNTTQDDQFVGDDNSDSTDNDVNMTQENINIEYSSNDPTIDDLDDYDEQTFLSASSAYQNTGGTYLDIGDPIWECPH

SEQ ID NO: 207298 - protein, 100 aa, Glycine max
  Coding DNA Sequence Number=SeqID_90520
MAEHKGIKELCEKQLQHGRHNPIPLSSFKCLDPAFFHSGKVFIIHKYSHSGHLWYLHRRSIYGTRCLDSPPGRLSIQGIPKAEIHHRHLTRLSQSPSRTI

SEQ ID NO: 207299 - protein, 72 aa, Glycine max
  Coding DNA Sequence Number=SeqID_90521
MKKGKSHIVRRVAIPYKGKYVASTSSTKDEKKDNDGKLNYGKKKKYGHKLSDFYFLKKKNQKEGTQEPDEVK

SEQ ID NO: 207300 - protein, 109 aa, Glycine max
  Coding DNA Sequence Number=SeqID_90522
MSFHSPLGFPISLLLPTENMATETLEDTKPSLQDKDHAKSEIPKNDASSDDVATKSKDTNVADKDRAFDNQEVEVEDAAEEKKENIDKDKEEEDDVKDKEEKCLRKSTL

SEQ ID NO: 207301 - protein, 96 aa, Glycine max
  Coding DNA Sequence Number=SeqID_90523
MEKRVLSEASNKSFFSLGSGDYYRFSFGCGLWTRQRTREKNVPLESLQQLVSEPMVQVGDRLRRVCKYRRWPKWLYLWMIKTFPRGGGYHVEETHT

SEQ ID NO: 207302 - protein, 97 aa, Glycine max
  Coding DNA Sequence Number=SeqID_90524
MFRKNENWHSGGTTCSLSDSLIGRHRMEGAYLRGAYRRKRHVAAAAGGAAGGADAEGRALHAGATARALHAGASRRAVPEAACQLLPCLQVSLPLFG

SEQ ID NO: 207303 - protein, 149 aa, Glycine max
  Coding DNA Sequence Number=SeqID_90525
MEAMKEEMATMMEAMMSMKKIMEVNATAVAAISVVSGVDPTPPSYLNLINHPTADTGDPHFVQAQNKQVFPPYGLPPNYTPPNENVNNFTSIPIESQQPQFDHAHVSQPMGETHEMRHHNLADFQPCFGYATEGQAVGGIPLQNTLEGP

SEQ ID NO: 207304 - protein, 76 aa, Glycine max
  Coding DNA Sequence Number=SeqID_90526
MNDKFSNLIISYFPNFQHIAERNVDRGPQQAGIPLIDITAVHTTVSHNRLRHAMNQKEYNSSVMCLLGRKQDLWNT

SEQ ID NO: 207305 - protein, 87 aa, Glycine max
  Coding DNA Sequence Number=SeqID_90527
PNYNGNVFGLGALSKRFSCSKSAPSTSIAPVEDQIEEMRETITKLNVELLAKADKERTLEEKMFPSTTRADGTEYHVHDAQVDHPHD

SEQ ID NO: 207306 - protein, 242 aa, Glycine max
  Coding DNA Sequence Number=SeqID_90528
  Subcellular localization annotation: CTP_CleavageSite=10; ConfidenceScore=5.01e-01
MESPKTRPKTCTNKFRLFRCFKSEFPDDVVFPPPPPRKAKSVNPPLSYIVVPEKQRTALPRALSSAFAATKGAEENASRRQKKMDKEHNNSLRRALMAALNHTSLAKKMKSCKRKTKQGSYSRESSINLSRITSSSSSSLGFTSSSTTTSSTLSSTTSTNASASSSESYLSRSMAMDGTGVAKNKQIIGEKGYFGSNMALSFLLITSILVLIMWGKCCAIAYTSIGFLVVPNCRKRPIKEGA

SEQ ID NO: 207307 - protein, 174 aa, Glycine max
  Coding DNA Sequence Number=SeqID_90529
MVTQLCATRRARRVSTEFLNASLSACRVQLSHCTIAISLVLLFSLSLIALLTLVLVLILGHKRLIFYKYLFLCLVLMVMPYGQVSRSFALRWKDELEHIWPLLDSNDNMYSVTYNQDRVNPTLLARWTKLRHFYGLTANHQVTMTYFGQSAFFLTIFKSISEPKTYPKWHSLYH

SEQ ID NO: 207308 - protein, 137 aa, Glycine max
  Coding DNA Sequence Number=SeqID_90530
MSTPARTAINQESSEFSVPQVSALNPRGEEMRGLIVDNAFDSMNLGHNNADIIDFIESLLEEDTYFTGLGHNVNTNNNGGVSRVVQPANQDFIQNLERVTIQEIRMEQSSDFMCSICREEFSVGNNTCPLCRRTIYL

SEQ ID NO: 207309 - protein, 80 aa, Glycine max
  Coding DNA Sequence Number=SeqID_90531
MVQMTTLVSACYRTLESDGRNETFSRSRPEDADISEKGANDDVSLCVPPDPLSLRATEPLGHDSKGGVVDKSGDFGPTYP

SEQ ID NO: 207310 - protein, 206 aa, Glycine max
  Coding DNA Sequence Number=SeqID_90532
  Homolog annotation: Hit_ID=Q02CA3; Match level="QueryCoverage=49%, HitCoverage=33%, E-value=9e-12, Identity=37%"; Hit description =Histone deacetylase superfamily
MNVDVPPGSNERRVLQAIEQQLVPAMQQFRPELIMVSAGLDAHAGDTLGALQYSDAGYAALATAAKQLAAHYTQGRMVWMLEGGYVPANNANAVEKITRALIARFYVYFLLAFLFAVAQTGIVTHEISHIKELTQHSQPDKKQGNEPCTLCISLAHAAGALTQSPQWSFPPQTSFTLSTAVVIAVQTSRVAIYSARAPPFLFQPDQ

SEQ ID NO: 207311 - protein, 107 aa, Glycine max
  Coding DNA Sequence Number=SeqID_90533
MRGTVHEPQVNIGADQKFSPIDVFNKKKGTNPGFQWIDYTSNDSIAVTPNGQVDPWVLVPNTFRGLYVLAIRGLHILAYRGLHALSFRGLRVLIFSVLHIHTLEEYK

SEQ ID NO: 207312 - protein, 57 aa, Glycine max
  Coding DNA Sequence Number=SeqID_90534
MEDAPVSPRVALPQKDAQCSAPEAMSPHNACPLHIDLKGVPTVAYLLKYSIQEYFHH

SEQ ID NO: 207313 - protein, 112 aa, Glycine max
  Coding DNA Sequence Number=SeqID_90535
TYQGNPCGVYPDLSSLTGSGVYPDLSSFIGSGVYPDLSSLTGSGVYPDLSSFTGSGVYPDLSSFTGSGVIQTFVTCIKRSAPTQVHITFEFLESFRCSISSVSIYYAPGSDL

SEQ ID NO: 207314 - protein, 79 aa, Glycine max
  Coding DNA Sequence Number=SeqID_90536
  Subcellular localization annotation: CTP_CleavageSite=33; ConfidenceScore=5.34e-01
MASIIATICSFIASMSAFTFSCISSALPITLALAQVKLEVTRISTALNVFGSRRRSDKWVYDPNMVGSWYLTHATKNAS

SEQ ID NO: 207315 - protein, 158 aa, Glycine max
  Coding DNA Sequence Number=SeqID_90537
  Gene Ontology: Mol. function=chitin binding; Cellular component =extracellular region; Biological process=chitin metabolic process
  Homolog annotation: Hit_ID=UPI000044A8F0; Match level="QueryCoverage =85%, HitCoverage=99%, E-value=4e-18, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAIRWLHALTCRGLHVLAFRGLHVLAIRGLHVLTFRGQHTLAFIGLHALTFRELRVLALRGLRVLTFRGLHVLAIRGPHVLTYRGLHVLAFRGLHVLTFRGLHVVTFRGLHALTLRGLHVLAIRGSHALTLEGRTPSLQRAALPHLQRTTRPHL

SEQ ID NO: 207316 - protein, 66 aa, Glycine max
  Coding DNA Sequence Number=SeqID_90538
MMHAPDLNSQMQCGTYRIQYQRNSPKRVYTTPHLGNHAVFVDTTYSCIVTSPLGDQLWGPQGVPYQ

SEQ ID NO: 207317 - protein, 123 aa, Glycine max
  Coding DNA Sequence Number=SeqID_90539
MAIEGGEHYAFANLKELFLEPNIITPPKFKVLDFDKYKGTTCPKNHLKMYYRKMGACAKDKELLIHSFQESLTGIDVGMKKGKFSHPAWTNEKTGANEEGEKEGETHAVTAIPIRPSFPPNPT

SEQ ID NO: 207318 - protein, 286 aa, Glycine max
  Coding DNA Sequence Number=SeqID_90540
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=3e-22, Identity=30%"; Hit description= UPI00006A17C9 related cluster
MRGLHALTSRGLHVLALRGLDALTLGLHVLTIRGLHALTSRGLHVLALRGLHALTLGLHVLTIRGLHAITSRGLHVLALRGLHALTLGTSYPHRQRTTHPHHQRAARPHLQRTISPRIERATRPHIGGLHVLAVKGSCTFTFVGLHALTFRGLHVLTFRGLHVLAIRGLLVLTFVGLHALTFRGLHVLANRGLHALTLRGLHALTSKGLHILALRGLRVLIFRASSFLLTVPGPPPDIAGGPTVRAQPEREAITQLLCIPGQDFIRAAVKRRVRIMRTNMTTLTQI

SEQ ID NO: 207319 - protein, 109 aa, Glycine max
  Coding DNA Sequence Number=SeqID_90541
MERIAGVVKISEQELDRVKQSGNGVGGIPRKCLEKAETLASQGKWALFIDVLALLAFGIVLFLNIDGLVDLATIDVFLAYHHNKESPVIAVLAYVYDTFDLRCEKSDAR

SEQ ID NO: 207320 - protein, 356 aa, Glycine max
  Coding DNA Sequence Number=SeqID_90542
  Gene Ontology: Mol. function=transporter activity; Cellular component= integral to membrane; Biological process=transport
  Homolog annotation: Hit_ID=Q8UK59; Match level="QueryCoverage=32%, HitCoverage=37%, E-value=2e-53, Identity=94%"; Hit description=ABC transporter, membrane spanning protein
  Pfam annotation: Domain name=BPD_transp_1; Domain location=189-356; Score=-3.0; E_value=0.0097; Accession=PF00528.12; Description =Binding-protein-dependent transport s
PSELYEFWALPARRLAGQNRYRLMGHSGDTISPDLYEAADIEGASRWQKFRMITWPLLRNTAVLVIIVITMQAFALFAQIDVMTKGGPRDSTQSIVYQAVERGYRQQDIAAGSAISVAGRRKSPVFLIGNYALMLAFAAIFILPLLFMGFSSLKPNDQLLSDATSIRAFLPVGDLSLENYTAAFARAPIATFIFNSVVVTGVTVFLALLLGSLAAFAFTFLNWRGKDLLFSIILATLIIPFETIAVPLLLEVNNLPWIGSGGFTWGWLNSWHVQIIPWIADGLTIFLFVQYFKDLPKELLEAARIDGASWLRIYAQVVMPLSGPVIATAAILKFLVMYSQQYLWPLLVTQSEAYRP

SEQ ID NO: 207321 - protein, 172 aa, Glycine max
  Coding DNA Sequence Number=SeqID_90543
TPNAKSTSRESDKHRVQCKSKDKELTGNSNRIASSSHKWLRVRPQELDWILKLKAAREEETETPEESEEVQTLKAELQKAQIVKEQFKSTAINYKEKLSLAATHEQRLEDEYAKVSILQAEREARERVIDSLHREAMMWKNRFAFTLNGSQELPRLLAKAKAMGDVYSAPDK

SEQ ID NO: 207322 - protein, 398 aa, Glycine max
  Coding DNA Sequence Number=SeqID_90544
  Gene Ontology: Mol. function=methionyl aminopeptidase activity; Cellular component=integral to membrane; Biological process=creatine metabolic process
  Homolog annotation: Hit_ID=Q8UB71; Match level="QueryCoverage=99%, HitCoverage=97%, E-value=1e-172, Identity=76%"; Hit description =Proline dipeptidase
  Pfam annotation: Domain name=Peptidase_M24; Domain location=175-387; Score=39.3; E_value=1.9e-10; Accession=PF00557.14; Description =metallopeptidase family M24
MREAEIDALVLFQPEAFRYAVGAPAGVATMWGKAGSAIALVPADAGAGLAAVVSDHAAPIIRRAAPDIDLRCHRIWIDLVDLSGVETIAQVDDAYRRNNSGGARPETFDRTACFGLLSDLLRERGLSAARIGADLEFMPAADFFALRQALPEVNWVDGSTVLKRLRAVKSQREIKLLRQAPAAAEAGLVEMAAAVRPGAALGQLSAAWKSGAQAYAAKSGFSLSGHWDFISVGPALSDMTAAVAPGTLIKADVGTLVDGYSSDGARTFSWGPVSPLAGDIFKALEAAFARGLDALRPGNTFGAVHAAMLASMRKDGFGEYYRGHFGHSVGGSVGIEEWPFFSHDNPELILPGMVVALEAPFYGEGVGALMIEDQFLVTASGAECMNSLPRTLRDLSAD

SEQ ID NO: 207323 - protein, 67 aa, Glycine max
  Coding DNA Sequence Number=SeqID_90545
MAPKKLSAKRSRRDVAAKGTSAASEFDSHRFRSAVHQQRFEPIKGWSFHRERRVQLRTMSTPIFRRR

SEQ ID NO: 207324 - protein, 87 aa, Glycine max
  Coding DNA Sequence Number=SeqID_90546
  Homolog annotation: Hit_ID=UPI000045E853; Match level="QueryCoverage =98%, HitCoverage=8%, E-value=5e-12, Identity=41%"; Hit description =COG0642: Signal transduction histidine kinase
MTQNIIRDHWMTIGTDNKANNIFTKQGRVKSGAKGIGRFALDKLGSKCEMTTIFNPSPEIHKPDTDINGSPTNYTGYNWEVNWEDFE

SEQ ID NO: 207325 - protein, 170 aa, Glycine max
  Coding DNA Sequence Number=SeqID_90547
MPVRPLQFCNSKEVLRIQTPRHLLVSRKAEGRLSFLFSHLTTVSQNNGDISLGKSRRKGFHGQKKGRKFGKADGTIPFYYDLGTTFLTPYDKFTPFLKRKAPRFRILKKCITRLEALKLIRNGPTHPAMMRMTEESEHKMEFPSWMRLTSGKNLFQDFLPYVELSLYYIT

SEQ ID NO: 207326 - protein, 165 aa, Glycine max
  Coding DNA Sequence Number=SeqID_90548
  Subcellular localization annotation: CTP_CleavageSite=47; ConfidenceScore=5.17e-01
MTLSSSQNKLNRYFMFKTLVMKGGKRLHHSTLLLLLLTRKVTRLISLATTPVGVERPLVHVDPATGKVDGPHRKKLRTYLGIVARDKVDVTYENWKQVPAAQKDLIWEDIQTVGEWWRQFKSDLTSKWALAADKDSVDDTVCKKYDISKKKWTQFVRFAETLRGR

SEQ ID NO: 207327 - protein, 103 aa, Glycine max
  Coding DNA Sequence Number=SeqID_90549
GNIDVAIVKEFYANLYDPKDRSPKQVRVRGHLIKFDEDTLNTFLKTPVIIKEGETLLAYSRFVLSRLDPQELAAKLYIPGRGFELNANGQPLKILRKNMTTLA

SEQ ID NO: 207328 - protein, 74 aa, Glycine max
  Coding DNA Sequence Number=SeqID_90550
MENGQLANNARQSIRGAPDSKAINSRGSRLDGGGRMNSARQSIHGSLNKMENGELANNARQSIRGAPDSMVEDA

SEQ ID NO: 207329 - protein, 89 aa, Glycine max
  Coding DNA Sequence Number=SeqID_90551
MNFEICQIVQQKAVKFVQQNCSTCAENACALLVMGKLGRVDGDPVLRGTRIRATLEYVSSVEGGQLGMVGSCLICGCGRVDLHHRPIAT

SEQ ID NO: 207330 - protein, 139 aa, Glycine max
  Coding DNA Sequence Number=SeqID_90552
  Subcellular localization annotation: CTP_CleavageSite=76; ConfidenceScore=5.19e-01
GRSLWKNASNAAFLRFLAFCWPFAHMFFPALSPDSVDNRITAFEKRKSAQYANRLSPRVGRFINAAGTTGFPTGKRAVSATQLIYDHDYEFELGTPQIGPKCPGMPLQNLFHMLQSVKSNKVGGRTTFRTTGSQMVIAQ

SEQ ID NO: 207331 - protein, 136 aa, Glycine max
  Coding DNA Sequence Number=SeqID_90553
  Homolog annotation: Hit_ID=Q9CA40; Match level="QueryCoverage=29%, HitCoverage=27%, E-value=2e-10, Identity=58%"; Hit description=Nudix hydrolase 1
SGLSQQRRWKDRLDEEEVIVGVLDLEGERKRGRRTTCHRGCHGGERRGQGQEGFGVEIETAKGREREGREVRIIGLERERERERKSRIVSVEEQVPQNLEPTKCDGWDWYEWDHLPHPLVGPLEKMVKGAFDPFPI

SEQ ID NO: 207332 - protein, 147 aa, Glycine max
  Coding DNA Sequence Number=SeqID_90554
MLSCLRCTITLSGSFFTNCSAEYLQSVALKYQTVTFILSSFGGREPEAQHSHVVIGQHVALAPVFVAHDEAEVAAVQSLLGAEDAAVEDRRQRPMANDERACGTIRTSQRSEGGKDEACYVFGVIEETTNVYSVMRIQTNALRVHSS

SEQ ID NO: 207333 - protein, 172 aa, Glycine max
  Coding DNA Sequence Number=SeqID_90555
  Homolog annotation: Hit_ID=Q1S746; Match level="QueryCoverage=55%, HitCoverage=20%, E-value=7e-16, Identity=50%"; Hit description =Putative serine esterase (DUF676), putative
  Pfam annotation: Domain name=DUF676; Domain location=71-172; Score= -32.4; E_value=2.9e-05; Accession=PF05057.5; Description=Protein of unknown function (DUF676)
  Subcellular localization annotation: CTP_CleavageSite=35; ConfidenceScore=5.06e-01
MTTCECWASYSVRFSPCSLFSFPTENEAFSSLRVPVQQTGSLPPNELSIKVTAPGVNRPRNEFKQFVKKLPDKVIVHRKQLSIPTSYQNLASPFHLHLKIGSECNSSKLTFDDVDTMGERLAEEVLSVVRRWLEVQKISFVAHSLGGSVATYAIGRLYDGSLLVKLLWRLDL

SEQ ID NO: 207334 - protein, 103 aa, Glycine max
  Coding DNA Sequence Number=SeqID_90556
  Homolog annotation: Hit_ID=Q1SWX1; Match level="QueryCoverage=83%, HitCoverage=17%, E-value=3e-09, Identity=34%"; Hit description=IMP dehydrogenase/GMP reductase
MGTNQIGKRFYQVKIKGLDVTSLKELGQLMGQLQRQAFHKAYGKIWDLVMVEVSIEAIASLAQYYDQPLRCFTFGDFQLSPMVEEFEEILGCPLGGRRPYLFS

SEQ ID NO: 207335 - protein, 191 aa, Glycine max
  Coding DNA Sequence Number=SeqID_90557
  Gene Ontology: Mol. function=zinc ion binding; Cellular component =integral to membrane
  Homolog annotation: Hit_ID=A0FK64; Match level="QueryCoverage=98%, HitCoverage=81%, E-value=7e-71, Identity=60%"; Hit description=PHD4
  Pfam annotation: Domain name=C1_3; Domain location=136-166; Score =7.9; E_value=0.06; Accession=PF07649.3; Description=C1-like domain
  Pfam annotation: Domain name=PHD; Domain location=137-187; Score =39.1; E_value=1.5e-08; Accession=PF00628.19; Description=PHD-finger
  Pfam module annotation: Pfam domain module=C1_3::PHD; Domain location= 136-166::137-187
VDKLYGLCDPGKENLCLYGHPNKAWEVTLPSEEVPPELPEPTLGINFARDDVSRRDWISLVAVHSDSWLLSVAFYLGIRLNHNERKRLFGLINILPTIFQVVTDNKPIKDNPTMDSGSKFWGSTEVAAVRNEHIEIFCGSCGGNYNKDEFWIGCDICEWWYHGKCIMMTPTKAETLKHYKCASCSLRRGRL

SEQ ID NO: 207336 - protein, 106 aa, Glycine max
  Coding DNA Sequence Number=SeqID_90558
  Homolog annotation: Hit_ID=Q8RV68; Match level="QueryCoverage=85%, HitCoverage=55%, E-value=2e-17, Identity=45%"; Hit description =Expressed protein
  Pfam annotation: Domain name=DUF842; Domain location=14-105; Score= -4.9; E_value=1.3e-05; Accession=PF05811.3; Description=Eukaryotic protein of unknown function (DUF842)
MDNTEAEEQFASEMLRPKLKELEEAVQPKISPVQDYASFTLQVLSGPFLQQKDFFKCGYECFDRSKRQEEVNNCVNNCIDLLTKAKKTLDNEMEMFEFDLMIQINH

SEQ ID NO: 207337 - protein, 61 aa, Glycine max
  Coding DNA Sequence Number=SeqID_90559
MEDDTNPSPENVPMGIWCLSTTLWVSSSPPQTFIVFVEATTPPCMTPGSLKHGLGFRWFRL

SEQ ID NO: 207338 - protein, 165 aa, Glycine max
  Coding DNA Sequence Number=SeqID_90560
  Homolog annotation: Hit_ID=Q70CE8; Match level="QueryCoverage=91%, HitCoverage=70%, E-value=4e-36, Identity=55%"; Hit description =Ankyrin-repeat protein
MASDSKKDFPADDKAGTEESKTSKDETSSKDSPAEQRATATFGPRPGPAGHPGNPFDLSAMSGLLNSWWGPGFGACGWTMMDPSIKELAEQIAKDPSFNQMAEQLQKTFQGAPQDAIPSFDNQQYFSTMQQVMQNPNFMTMAERLGNALMQNIDAVTGSVYVCHA

SEQ ID NO: 207339 - protein, 120 aa, Glycine max
  Coding DNA Sequence Number=SeqID_90561
  Homolog annotation: Hit_ID=O82467; Match level="QueryCoverage=37%, HitCoverage=6%, E-value=4e-07, Identity=60%"; Hit description =Peroxisomal targeting signal type 1 receptor
  Subcellular localization annotation: CTP_CleavageSite=63; ConfidenceScore=5.29e-01
MAMRDLVSGAAACGDSSSSSSNPLASLANALIGSSSKTQERLKEIPTSTPTDPASQFYSTALPANQLPGSEFDKPLLNLNSQLLGLLVFVSRGFQPTTSLSFPSPFTTPIVMILLNELSK

SEQ ID NO: 207340 - protein, 210 aa, Glycine max
  Coding DNA Sequence Number=SeqID_90562
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-24, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTPNLSGDYMSSISEDYMSSTSEDYTFSPLEDYMSLPYEGYTASPFEDYTPSPSEDYTGLHNLAFRGLDALAFRGVHILPLRGLHALAFVGLHTLTFKGVHILNFRGLYIVAIRGLNVLAFRGLHVLPFRGQHDLPFRGLHALALTGLHVLTFRGLLYLAFRGLYALAFRGVHILPLRGLHALAFVGGLYVVAIRGLHVLAFT

SEQ ID NO: 207341 - protein, 164 aa, Glycine max
  Coding DNA Sequence Number=SeqID_90563
  Homolog annotation: Hit_ID=Q4J4Q3; Match level="QueryCoverage=31%, HitCoverage=29%, E-value=8e-08, Identity=45%"; Hit description =Hypothetical protein precursor
  Subcellular localization annotation: CTP_CleavageSite=61; ConfidenceScore=5.50e-01
SAAAPAADAVLAAAAGLSAGRSAGRHFALSGGGVSGVGRRSALAWRAVWSGRSQWQSHPARSAGAGVTHDGSAGWRTSVSQVMVKRNTTPIRQAESSPMMAISLSSRDSIDISLRASVVGCRPQLIHNVSIRTKIIRVTEVTASTTMAKKEAFFSGIAAQSVME

SEQ ID NO: 207342 - protein, 120 aa, Glycine max
  Coding DNA Sequence Number=SeqID_90564
  Gene Ontology: Mol. function=siderophore-iron transporter activity; Cellular component=outer membrane; Biological process=siderophore transport
  Homolog annotation: Hit_ID=Q6D988; Match level="QueryCoverage=97%, HitCoverage=15%, E-value=2e-38, Identity=64%"; Hit description =Putative ferric siderophore TonB-dependent receptor
MKKTAGGTYDGKQAIGVPRYTYVLGAEYDIKPVEGLTATALLNHSGSQYANSANTLKLDSYTTLDLGMRYRMKVNQNDLVWRVAVENVTNEKYWSNVDDTGTYLAQGDPRTLKISMSYDF

SEQ ID NO: 207343 - protein, 263 aa, Glycine max
  Coding DNA Sequence Number=SeqID_90565
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q9ZRD1; Match level="QueryCoverage=97%, HitCoverage=75%, E-value=2e-88, Identity=60%"; Hit description=NTGP4
  Pfam annotation: Domain name=AIG1; Domain location=11-222; Score =388.5; E_value=1e-113; Accession=PF04548.7; Description=AIG1 family
  Pfam annotation: Domain name=MMR_HSR1; Domain location=11-126; Score =8.8; E_value=0.00015; Accession=PF01926.13; Description=GTPase of unknown function
  Pfam module annotation: Pfam domain module=AIG1::MMR_HSR1; Domain location=11-222::11-126
  Subcellular localization annotation: CTP_CleavageSite=41; ConfidenceScore=5.50e-01
MEKASSSNEVRTLVLVGRTGNGKSATGNSVLGRRAFKSRTSSSGVTSVCELQRTIMKDGSIVNVIDTPGLFAGTDSAGKEIVKCIDMAKDGIHAILMVFSVRTRFSEEEQATFLTLQALFGHQIVDYMIVVFTGGDDLEANEETLDDYLGCECPQPLKDILTLCGNRKVLFDNKTKDEKKRLGQVQELLNVVNMIISHNGGRPFTNELFIELKEKATIRDNQQKMVDSMGGYSKAETLGIKMQMQQKYDDELKRITNMILLKI

SEQ ID NO: 207344 - protein, 100 aa, Glycine max
  Coding DNA Sequence Number=SeqID_90566
  Gene Ontology: Mol. function=protein binding
  Homolog annotation: Hit_ID=Q1SRV7; Match level="QueryCoverage=79%, HitCoverage=27%, E-value=1e-14, Identity=58%"; Hit description=IMP dehydrogenase/GMP reductase
MKEEESTAIPIEDEDDPSSTLLDLTSYQLHDLDLVELPPSLTANRLSLLDPHIGNLSHLKKLSHCENLAVAPLSFPKTSSPLSSDFAEVLDVYERGDGLY

SEQ ID NO: 207345 - protein, 269 aa, Glycine max
  Coding DNA Sequence Number=SeqID_90567
  Gene Ontology: Mol. function=protein binding; Cellular component =signalosome complex; Biological process=red or far red light signaling pathway
  Homolog annotation: Hit_ID=Q8W1P0; Match level="QueryCoverage=59%, HitCoverage=50%, E-value=2e-62, Identity=73%"; Hit description=COP9 signalosome complex subunit 6b
MGGNNCRKVLTSDVVDVKKVRRLDHSSKACSGRGDLQYDEYLYTSGRTSRGYEGSCGVYDLGEGSVEGKSILEFLLAHDFTIANTSPFGVVLSAYCTEEINCVSAGAGYYNTELHVIDGIPQLIFVRSSYTIETVEAERISVDHVAHLKPSDGGSAATQLAAHLTGTHSAIKMLHSRIKVLHHYLLAMQKGDVPCENSLLRQVSSLLRRLPAIESGKFQDDFLMEYNDTVLISYLAMLTNCSSSMNELVDKFNIAYDRHSRRGGRTAFM

SEQ ID NO: 207346 - protein, 126 aa, Glycine max
  Coding DNA Sequence Number=SeqID_90568
MDFTVKGSLKIDMGVSNFFLNIRKYSLGTSLSTWLMNSLIHDFLGVVVVLGFHTSSVAVGNQIKVILVNRKVVQANQAVCDAPDVGSCAGPLVRLESAMFYGTKKFYTNYTKITCLCMTGWVAVKF

SEQ ID NO: 207347 - protein, 890 aa, Glycine max
  Coding DNA Sequence Number=SeqID_90569
  Gene Ontology: Mol. function=protein serine/threonine kinase activity; Cellular component=integral to membrane; Biological process=protein amino acid phosphorylation
  Homolog annotation: Hit_ID=Q9ZWC8; Match level="QueryCoverage=97%, HitCoverage=92%, E-value=0.0, Identity=56%"; Hit description =Serine/threonine-protein kinase BRI1-like 1 precursor
  Pfam annotation: Domain name=LRR_1; Domain location=112-134; Score =13.9; E_value=0.59; Accession=PF00560.23; Description=Leucine Rich Repeat
  Pfam annotation: Domain name=LRR_1; Domain location=13-35; Score =16.9; E_value=0.074; Accession=PF00560.23; Description=Leucine Rich Repeat
  Pfam annotation: Domain name=LRR_1; Domain location=135-157; Score =12.2; E_value=1.5; Accession=PF00560.23; Description=Leucine Rich Repeat
  Pfam annotation: Domain name=LRR_1; Domain location=159-181; Score =13.5; E_value=0.77; Accession=PF00560.23; Description=Leucine Rich Repeat
  Pfam annotation: Domain name=LRR_1; Domain location=183-205; Score =3.1; E_value=75; Accession=PF00560.23; Description=Leucine Rich Repeat
  Pfam annotation: Domain name=LRR_1; Domain location=208-230; Score =17.8; E_value=0.038; Accession=PF00560.23; Description=Leucine Rich Repeat
  Pfam annotation: Domain name=LRR_1; Domain location=232-254; Score =10.4; E_value=3.2; Accession=PF00560.23; Description=Leucine Rich Repeat
  Pfam annotation: Domain name=LRR_1; Domain location=256-278; Score =9.5; E_value=4.7; Accession=PF00560.23; Description=Leucine Rich Repeat
  Pfam annotation: Domain name=LRR_1; Domain location=280-302; Score =13.6; E_value=0.74; Accession=PF00560.23; Description=Leucine Rich Repeat
  Pfam annotation: Domain name=LRR_1; Domain location=372-394; Score =13.9; E_value=0.59; Accession=PF00560.23; Description=Leucine Rich Repeat
  Pfam annotation: Domain name=LRR_1; Domain location=38-60; Score =16.4; E_value=0.1; Accession=PF00560.23; Description=Leucine Rich Repeat
  Pfam annotation: Domain name=LRR_1; Domain location=396-418; Score =18.2; E_value=0.031; Accession=PF00560.23; Description=Leucine Rich Repeat
  Pfam annotation: Domain name=LRR_1; Domain location=420-442; Score =11.2; E_value=2.2; Accession=PF00560.23; Description=Leucine Rich Repeat
  Pfam annotation: Domain name=LRR_1; Domain location=444-465; Score =10.0; E_value=3.9; Accession=PF00560.23; Description=Leucine Rich Repeat
  Pfam annotation: Domain name=LRR_1; Domain location=62-85; Score =10.0; E_value=3.8; Accession=PF00560.23; Description=Leucine Rich Repeat
  Pfam annotation: Domain name=LRR_1; Domain location=87-110; Score =11.6; E_value=1.9; Accession=PF00560.23; Description=Leucine Rich Repeat
  Pfam annotation: Domain name=Pkinase; Domain location=591-865; Score =156.1; E_value=9e-44; Accession=PF00069.15; Description=Protein kinase domain
  Pfam annotation: Domain name=Pkinase_Tyr; Domain location=591-865; Score=125.8; E_value=1.2e-34; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::Pkinase::Pkinase_Tyr; Domain location=112 -134::13-35::135-157::...
  Pfam module annotation: Domain location=159-181::183-205::208 -230::232-254::256-278::280-302::372-394::38-60::396-418::420 -442::444-465::62-85::87-110::591-865::591-865
MEIPSEILVSLKSLKSLFLAHNKFSGEIPSELGGLCETLVELDLSENKLSGSLPLSFTQCSSLQSLNLARNFLSGNLLVSVVSKLGSLKYLNAAFNNMTGPVPLSSLVNLKELRVLDLSSNRFSGNVPSLFCPSELEKLILAGNYLSGTVPSQLGECKNLKTIDFSFNSLNGSIPWEVWSLPNLTDLIMWANKLNGEIPEGICVEGGNLETLILNNNLISGSIPKSIANCTNMIWVSLASNRLTGQIPAGIGNLNALAILQLGNNSLSGRVPPEIGECRRLIWLDLNSNNLTGDIPFQLADQAGFVIPGRVSGKQFAFVRNEGGTSCRGAGGLVEFEDIRTERLEGFPMVHSCPLTRIYSGRTVYTFASNGSMIYLDLSYNLLSGSIPENLGEMAYLQVLNLGHNRLSGNIPDRFGGLKAIGVLDLSHNSLNGSIPGALEGLSFLSDLDVSNNNLNGSIPSGGQLTTFPASRYENNSGLCGVPLPACGASKNHSVAVGDWKKQQPVVAGVVIGLLCFLVFALGLVLALYRVRKAQRKEEMREKYIESLPTSGSSSWKLSSFPEPLSINVATFEKPLRKLTFAHLLEATNGFSAESLIGSGGFGEVYKAKLKDGCVVAIKKLIHVTGQGDREFMAEMETIGKIKHRNLVQLLGYCKIGEERLLVYEYMKWGSLEAVLHERAKAGVSKLDWAARKKIAIGSARGLAFLHHSCIPHIIHRDMKSSNILLDENFEARVSDFGMARLVNALDTHLTVSTLAGTPGYVPPEYYQSFRCTAKGDVYSYGVILLELLSGKRPIDSSEFGDDSNLVGWSKKLYKEKRINEIIDPDLIVQTSSESELLQYLRIAFECLDERPYRRPTMIQVMAMFKELQVDTDNDMLDSFSLRDNVIDEA

SEQ ID NO: 207348 - protein, 346 aa, Glycine max
  Coding DNA Sequence Number=SeqID_90570
  Gene Ontology: Mol. function=nucleic acid binding; Cellular component= beta-galactosidase complex; Biological process=DNA integration
  Homolog annotation: Hit_ID=Q1RSI0; Match level="QueryCoverage=79%, HitCoverage=33%, E-value=1e-56, Identity=41%"; Hit description=IMP dehydrogenase/GMP reductase
  Subcellular localization annotation: CTP_CleavageSite=84; ConfidenceScore=5.15e-01
LTPTPTPFVPRRSSQPIKPNVLPADYICSIKTQPNQSSSTCLYPLQSVLSYSNISEFKRHYIMNLSSGVEPRSYQKASLSPCSVEAMKDEIEALKLNNTREIVDTLAGVKPIGCKCFYKIKRKSNGSVERYKARLVAKGFSLVEGIDFFETFSPVVKMATIYFILALAFANKCQLQQLDVSNAFLHGDLSEEVYMTIPQGLQDHGSSQSCKLKKSLYGLKQASLKDLGALKYFLGLEINHSADGIYVSQCKYCLELLADFGMMGCKPCSTPMDSSLRLHQDDSSDLLDDPLSYRHLVGRLVYLTTTRPNIGSPSKGLQFKRDTPIHLIGFSDADWATYVDTRRSIT

SEQ ID NO: 207349 - protein, 153 aa, Glycine max
  Coding DNA Sequence Number=SeqID_90571
  Gene Ontology: Mol. function=sequence-specific DNA binding; Cellular component=nucleus; Biological process=regulation of transcription
  Homolog annotation: Hit_ID=Q94IB3; Match level="QueryCoverage=100%, HitCoverage=19%, E-value=5e-36, Identity=52%"; Hit description=WRKY DNA-binding protein
MAGIDDNVALTGDWGLASPSPRTFFSRMLEEDSVTRSISEHSGSGRTGDPFSGHREPSEMRKENMKDRAQDGDSGAQLTDVSFQTEQKPSSRGGLVERMAARAGFNAPRLNTESIRSTDLSLNSDIQSPYLTIPPGLSPTTLLDSPVFLANSL

SEQ ID NO: 207350 - protein, 287 aa, Glycine max
  Coding DNA Sequence Number=SeqID_90572
  Gene Ontology: Mol. function=sequence-specific DNA binding; Cellular component=nucleus; Biological process=regulation of transcription
  Homolog annotation: Hit_ID=Q94IB3; Match level="QueryCoverage=97%, HitCoverage=59%, E-value=2e-80, Identity=51%"; Hit description=WRKY DNA-binding protein
  Pfam annotation: Domain name=WRKY; Domain location=158-216; Score =141.4; E_value=2.4e-39; Accession=PF03106.6; Description=WRKY DNA -binding domain
MVNGNMRHSELSSDAPEKCKHNGFDDIYTSSFAFKPATDSGSSFYHGAGRKINPTTLPQQSLPGVEVSAQSENSFQCQSVDAVKAQTENKSGLHLQEDFVESPPQKDNGIKMFSANQRAFHAVGSGIEHSTPVEEQADEEGDQRVNGDSMAGGVGAPSEDGYNWRKYGQKQVKGSEYPRSYYKCTHPNCQVKKKVERSHEGHITEIIYKGTHDHAKPPPNRRSSIGSVNLHTDMQVDNPEHVEPHNGGDGDLGWANVQKGNIAGAANWKHENIEATSSASVGPEYCN

SEQ ID NO: 207351 - protein, 45 aa, Glycine max
  Coding DNA Sequence Number=SeqID_90573
MAVPEIRQIHSSIGGGTMSTEPGIKSASLHGMQSSKNLSGLQFPR

SEQ ID NO: 207352 - protein, 94 aa, Glycine max
  Coding DNA Sequence Number=SeqID_90574
MKNKKVVVAGVSLSETCALSENHPLSEALNLLSKLGESGGESVKHLRAQRGENDAKRAFEDRKPLKAEVGKKIGRCLRAYAIERRNRAREHRKP

SEQ ID NO: 207353 - protein, 138 aa, Glycine max
  Coding DNA Sequence Number=SeqID_90575
MKKILGLQALMELTSLLMLLCSKDPSPKQARARGHLVKIDTNILNTFLETLVVIEEGETLPTYSRYCRLPSDHREIEAAFCIPGRGFILNAEGHPGSILRKDLTTLAQVWSVLSCSNLAPTSHTSDLTMDRARLIFGL

SEQ ID NO: 207354 - protein, 108 aa, Glycine max
  Coding DNA Sequence Number=SeqID_90576
  Subcellular localization annotation: CTP_CleavageSite=23; ConfidenceScore=5.56e-01
MSAFTFSCTSSALPITLALAQVRRSNDVTQSIFCPNFCKMVTSILQLDSMNLFVKARAWFNPITQGMAILIANTSSTFHKDERLGNTHAMHGKCNSEMEMPEETSFLS

SEQ ID NO: 207355 - protein, 276 aa, Glycine max
  Coding DNA Sequence Number=SeqID_90577
  Homolog annotation: Hit_ID=Q47522; Match level="QueryCoverage=15%, HitCoverage=53%, E-value=8e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDAHVVALAAKQQVKLLIFPELSLTGYEPELARKLGITLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 207356 - protein, 355 aa, Glycine max
  Coding DNA Sequence Number=SeqID_90578
  Gene Ontology: Mol. function=hydrolase activity; Biological process =metabolic process
  Homolog annotation: Hit_ID=Q00VH2; Match level="QueryCoverage=54%, HitCoverage=76%, E-value=4e-44, Identity=45%"; Hit description=[R] KOG2961 Predicted hydrolase
MLSTTAAAQLPSCWYLIPSHLNVHHHAQQKRKLTTLSLANADSRIPLRNFYGLSLPQTHNCSKGKESNNRARYNSNLNQNHRHLLFLQFFPDSDTEDSNNQNPRTRNHCQHQVDEQREFKENKEARLLFSNMWWVDVKAALGQRINLEGILCSTMVILKDPKLAMPHISVPDIRYVDWAELRRKGFKGVVFDKDNTITAPYSLKSWPPLESSLECCKSEFGHDIAVFSNSAGLHEYDHDGSKARMLEGAIGIKVIRHRVKKPAGTAEEIEKHFGCEASQLIMVGDRPFTDIVYGNRNGFLTILTEPLSLAEEPFIVKQVRKLETSFVSFWSRRGLDPLSQKLLSDPKPCVKEPYH

SEQ ID NO: 207357 - protein, 69 aa, Glycine max
  Coding DNA Sequence Number=SeqID_90579
MTIYGRGVLVLMPGEQIPSFIALPAPAPCCREPMSWPIQELRSYHLAVCKIEASSETITDEHSRIIKVA

SEQ ID NO: 207358 - protein, 172 aa, Glycine max
  Coding DNA Sequence Number=SeqID_90580
  Gene Ontology: Mol. function=nucleic acid binding
  Homolog annotation: Hit_ID=Q1SKZ9; Match level="QueryCoverage=90%, HitCoverage=36%, E-value=2e-29, Identity=42%"; Hit description=Zinc finger, CCHC-type
MEKCGHRQALGKEDWLQSLRDTIESVVGRTIEKVPWLIYDHYLTLREWSPDLHSTNEAIEEVAVRVRFSKLPIEYYDAKLLQVIGDRIGRPMHVDRNTLTQERGKHARLCVEVDLTKPLLALFEINNRCYKIEYERLHFLCLTRCRFGHYMEGCLDKVVNTWYGKGTRRWGS

SEQ ID NO: 207359 - protein, 88 aa, Glycine max
  Coding DNA Sequence Number=SeqID_90581
  Pfam annotation: Domain name=zf-CCHC; Domain location=8-25; Score =18.3; E_value=0.00093; Accession=PF00098.13; Description=Zinc knuckle
MQEKTSSIKCFKCLRRGHITSQCLTKKVMIMRGQDIYNSQDEATTSPSSSESEEAKGEESSEEVYHQEEGQPLMGEKECKEIYTLQQQ

SEQ ID NO: 207360 - protein, 61 aa, Glycine max
  Coding DNA Sequence Number=SeqID_90582
MPRSFQFVRIRTADGSTPTSSFPQDIWKELGSGYDKVSVEAIASLTQYYDQSLRCFMFGDF

SEQ ID NO: 207361 - protein, 98 aa, Glycine max
  Coding DNA Sequence Number=SeqID_90583
MAKEGVDDHDLSPRAIGLDCLWMVKVRMMAKEAANDHDLSPRAIRLDCLCMAKRLKKGADDHNLSPRAIGLDCLGIAKRVRMTIWLLTSAPDRTSSIK

SEQ ID NO: 207362 - protein, 401 aa, Glycine max
  Coding DNA Sequence Number=SeqID_90584
  Gene Ontology: Mol. function=RNA-directed DNA polymerase activity; Cellular component=membrane; Biological process=RNA-dependent DNA replication
MNLWQEKGQRVGKRDISDHCPIWLECSNLNWGPKPFRFNNCWLEHDDFKSFIVEEWKKIQITGRKAYVIKEKLKIIRESLKKWNKEVFGWLDLNIENIVAEMNKLDRGIEEGCNLNEVVKKKEAKALFWQQLMMKESLLKQKSRLRWIKEGDYNTKFFHSCLQDRRRKNQILSLQVEGRCVEQVGEVKMEVRRFFEEGFKEASFSRPVLGGIEFQTLGSEENSFLVAPFSEEEIKDVVWSCDGNKCPGPDGFNLRFIKKCWEFVKDDIVEFLQEFQITGRQILDGVLMINEAVDLAKRRKDECLLFKVDFEKAYDSVSWSFLTYMLNRMGFDKRWIGWIQACVFSSSMSVLVNGSPTDEFTAHKGLRQGDPLSPFLFLIVAQGLSGLVQKAIQVGNFDGYQ

SEQ ID NO: 207363 - protein, 97 aa, Glycine max
  Coding DNA Sequence Number=SeqID_90585
  Homolog annotation: Hit_ID=Q5CDC4; Match level="QueryCoverage=42%, HitCoverage=32%, E-value=6e-16, Identity=100%"; Hit description =LacOPZ-alpha peptide from pUC9
MGAAWLMLQRIMLLHNRLSERLPAKPNNFRNKCVLSSVWLHQAYRYRRPRGGARYQLLFPLVRVNFELGVIMVIAVSCVKLLSAHNSTQHTSRKHKV

SEQ ID NO: 207364 - protein, 134 aa, Glycine max
  Coding DNA Sequence Number=SeqID_90586
  Gene Ontology: Mol. function=GTPase activator activity; Cellular component=intracellular; Biological process=signal transduction
  Homolog annotation: Hit_ID=Q10RP7; Match level="QueryCoverage=99%, HitCoverage=29%, E-value=7e-54, Identity=72%"; Hit description=Appr -1-p processing enzyme family protein, expressed
EFEPLIQKPFSIVYFHSAASLQMQPDLGWMRRLQQILGRKHQRNLHAIYVLHPTFGLKAAVFGLQMFVDSVVWKKVVYADRLLQLFRYIPREQLTIPDFVFQLSLYVFTRHDLEVNGGTGLIVDPRTKYVYNRP

SEQ ID NO: 207365 - protein, 75 aa, Glycine max
  Coding DNA Sequence Number=SeqID_90587
MSQPTLRRGCEKAKIDGPKRFVSKATNIYLSKTLEKTKKGFTSFENEGSGVVYAWGRGLPLLLRILRCDEEFKPT

SEQ ID NO: 207366 - protein, 452 aa, Glycine max
  Coding DNA Sequence Number=SeqID_90588
  Homolog annotation: Hit_ID=Q66HX8; Match level="QueryCoverage=41%, HitCoverage=30%, E-value=2e-17, Identity=35%"; Hit description =Ganglioside induced differentiation associated protein 2
MISAYFIVSLLNAASILKYDFCFKLAIVYKCLKGGTVRRFLEKQKNNIIAVVFCTVSTTDTEIYKRLLPLYFPRDKHEEQVALSKLPADVGDENGETISDERKIRIKPLPKRIVSRPPEFPADHPVSDVGLVSRNSSHLDSFLDPAFMSMIKDPDQRRMEQWEKTAEAQRGWNCAKLIGYGDLGGPSLSAAEEYSLHSRYLSKANSLNLSEIAEMKIVINTALVRDYSAFVIFSQCNIQISFLFSILSTWYLELSDPFSWLPQILMQLWLTPATLVRSDSSKQHRCDSVSSEQLRFDSTQHCSDESRYFHFVVPYEFYFFLHQITKKLNDKNFLLWRQQIKSAITMRGLNRFVVNPQIPPQYVFDEDCDLDRVNPLFSMCQRSRARCLLVFLDRQLIDALASVGDAATYREHMDAILEGLPRNFDSTIALIESRLPHITIEEAEGYILVQEL

SEQ ID NO: 207367 - protein, 77 aa, Glycine max
  Coding DNA Sequence Number=SeqID_90589
MSLQLIHSEMQLAASLDHIFPFPLRNCSQHHHKVTETEKDGLKRHGRDKAKSEKSLKCVTRNIGSILSGKILVMCSR

SEQ ID NO: 207368 - protein, 177 aa, Glycine max
  Coding DNA Sequence Number=SeqID_90590
  Gene Ontology: Mol. function=nucleic acid binding
MGGNVENVDFHNFEYESSSDNEEESCGVDDKSFGIDFDFIPTVENQMHGIDEGYNNKELFSNIDDDEEEHSNGKQNLGITKSRNIVRRLIMDLIEGDATKQYTLLWRYDVELTKRYRGNTCKLQLERPSLALQPRFGSFYLCLDGCKKGFVVGCRPFIGLDGCHIKTKYGGSIIGCY

SEQ ID NO: 207369 - protein, 48 aa, Glycine max
  Coding DNA Sequence Number=SeqID_90591
MRKDRCWFTLGVDQQSHMLGRSPMVMGVDGTLAHRGALLWWWHVRAVV

SEQ ID NO: 207370 - protein, 63 aa, Glycine max
  Coding DNA Sequence Number=SeqID_90592
MAVSKLRNDAKEGGREEMAFFQSYTVYKAQNAQVINALGKRNVAHTPDVFSKIPTINLWTVVL

SEQ ID NO: 207371 - protein, 96 aa, Glycine max
  Coding DNA Sequence Number=SeqID_90593
  Gene Ontology: Mol. function=oxidoreductase activity; Biological process=response to oxidative stress
  Homolog annotation: Hit_ID=O49943; Match level="QueryCoverage=50%, HitCoverage=17%, E-value=2e-19, Identity=89%"; Hit description =Peroxidase
  Pfam annotation: Domain name=peroxidase; Domain location=1-96; Score=- 47.6; E_value=2.3e-05; Accession=PF00141.13; Description=Peroxidase
MDGCDASILLDSTPKNLAEKDGPPNLSVHAFYVIDEAKAKLEKACPHTVSCADIIAIAARDVVALVITQLSLQAILELLNSCMALIGGNCYSSTVS

SEQ ID NO: 207372 - protein, 887 aa, Glycine max
  Coding DNA Sequence Number=SeqID_90594
  Gene Ontology: Mol. function=RNA-directed DNA polymerase activity; Cellular component=nucleus; Biological process=RNA-dependent DNA replication
MVSHEYYVFEHERVGRQFKEKEVGQNHQFRGLWVVKSNFSGHGFIGVCVEFKSKLFFFVNVYAPCNTAGRRLLWETLYNLKYGSSAGEWCLVGDFNAVSNREERTGRSENWGYIDMVDFNAFVNEMNLIDPPLHGNKFTYFCSDGIAASRLDRFLVSDGIMNLWQSFIVEEWKKIQITGRKAYVIKEKLKIIRESLKKWNKEVFGWLDLNIENIVAEMNELDRGIEEGCNLNVVVKKKEANALFWQQLMMKESLLKQKSRLRWVKEGDSNTKFFHSCLQDRRRKNQILSLQVEGRCVEQVGEVKMEVRRFFEEGFKEASFSRPVLGGIEFQTLGSKENSFLVAPFSEEEIKDVVWSCDGNKCPGPDGFNLRFIKKCWEFVKDDIVEFLQEFQITGVLPKAITASFLALIPKVLASRLKKVIAKLISPCQSAFISGRQILDGVLMINEVVDLAKRRKDECSLFKVDFEKAYDSVSWSFLTYMLNRMGFDKRWIGWIQACVFSSSMSVLVNGSPTDEFTAHKGLRQGDPLSPFLFLIVAQGLSGLVQKAIQVGNFDGYQVADGLNLSLLQFADDTILLGKGSWKNLWSIKTIFRSFELVSGLRVNFHKSKLIGLSINEGFLESASIFLSCCMTLIPFKFLGVPVGANPWRRSTWKPVVDSMRAKLSCWRGRNLSIEGKVTLINSVLSSLPLYLFSVFKAPKVVIKELTQIQRDFLWGSHEEERKICWVSWEDICKPKKEGGLGVKNLEIFNISLLAKWKWRCIHDHNALWRDLLAFRYGNLIAKQTCSLDRSWGTKDSIWWQDLMLLEKDLSQNQNFFQRAVSCDVGDGQSILFWYNKWLGSEPLKDAFPELFAISSQQSVSIGNAGSWRRDQWTWGLTWKRQLNPNEE

SEQ ID NO: 207373 - protein, 79 aa, Glycine max
  Coding DNA Sequence Number=SeqID_90595
MHHLLKEQVSNMTSNIIFITWCCDLPFGGRATRGSRLLAKPICQLSEPSAERTTPMAEHEEESGRRMSWTHALSDGLSR

SEQ ID NO: 207374 - protein, 182 aa, Glycine max
  Coding DNA Sequence Number=SeqID_90596
  Gene Ontology: Mol. function=RNA-directed DNA polymerase activity; Cellular component=signal recognition particle, endoplasmic reticulum targeting; Biological process=RNA-dependent DNA replication
MYGFNPLTPLDLLSLPNTFVLKHKDGKSRAEYVRKLHEQVKAQIENKIESYVKHSNKGRKKVVFEPSDWVWVHMRKERFPSQRKSKLQPREDGIFQVLSKINDNAYKIDLPCEHGVTNTVNVSDLSPFDVGDEDFNSRSNSLKEEGDDENQTRNEDIEAIQGLGRPMTRAHSYKAKEILNQM

SEQ ID NO: 207375 - protein, 99 aa, Glycine max
  Coding DNA Sequence Number=SeqID_90597
MSHGLYSPLPIPEFPWIDLSLDFVVGFPQTRNDKDSIFVVVDRGCPSALGPSRPIKKLQHEATNLPERAELAWVSMLLLEEASSKPGRAGQQRPPLFFL

SEQ ID NO: 207376 - protein, 108 aa, Glycine max
  Coding DNA Sequence Number=SeqID_90598
MNLVSGVENKAYLLKSASTTTLDLPFLCLITYRKMFLLFMDEIQDPPLVILRLYSICSFINGQMYQDVATRDGQQTRGILVTYVSQEEVSSSREGLQIYEYFRVFGLA

SEQ ID NO: 207377 - protein, 104 aa, Glycine max
  Coding DNA Sequence Number=SeqID_90599
  Subcellular localization annotation: CTP_CleavageSite=33; ConfidenceScore=5.71e-01
MGSPPASTPPLPPPPPPPSDVTTSPSAVKRTCKASRLQSLSTRTPGAERPVVHVDPATGKADGPHRKKLRTYLGIVARDKVDITYENWNEVPTAQKDLIWEDIQ

SEQ ID NO: 207378 - protein, 144 aa, Glycine max
  Coding DNA Sequence Number=SeqID_90600
MGSKIYPKVHENPRAFFSSSSPNFLESSIQYPWGVGLHHFAVPFFHVYGFTFSLGAIVLSEMVVVMESFSLKAMLGAMERKETKKAFKAMLPNILVIQLGVDGVVLTNELSNILCCKHKIHMCLLGRFLADSFLGRYKTIGIFA

SEQ ID NO: 207379 - protein, 75 aa, Glycine max
  Coding DNA Sequence Number=SeqID_90601
MKNLMQNSKRDVYLGAYLNEPNNYLKGIINSALKGLDDTPQPKSKAGARWIVVKTIGSREIEGASHPMGTVLSQS

SEQ ID NO: 207380 - protein, 394 aa, Glycine max
  Coding DNA Sequence Number=SeqID_90602
  Gene Ontology: Mol. function=hydrolase activity, acting on glycosyl bonds; Cellular component=cellular_component; Biological process =carbohydrate metabolic process
  Homolog annotation: Hit_ID=O80559; Match level="QueryCoverage=97%, HitCoverage=97%, E-value=1e-125, Identity=54%"; Hit description =Putative polygalacturonase
  Pfam annotation: Domain name=DUF1083; Domain location=193-302; Score=- 118.8; E_value=0.057; Accession=PF06452.2; Description=Domain of unknown function (DUF1083)
  Pfam annotation: Domain name=Glyco_hydro_28; Domain location=57-393; Score=412.9; E_value=4.6e-121; Accession=PF00295.8; Description =Glycosyl hydrolases family 28
  Pfam module annotation: Pfam domain module=DUF1083::Glyco_hydro_28; Domain location=193-302::57-393
  Subcellular localization annotation: CTP_CleavageSite=84; ConfidenceScore=5.39e-01
MAHYTHHFILLFLATISFFSFTFSKDAPSINVLSFGAKPNGNFDSTTSFVKAWSSACKSKEPATFYVPKGFFLLKQVIFEGPCSSNIKFRIAGTIVAPSDYSSLGNKSGFWIMFRNLNGFSVQGGTFDGKGDSYWRCRKSGSSCPAGARSITFSSCNDVKVRGLTSLNSQSMHIAVEQCKNILFKDVNIKAPSTSPNTDGIDVTLSTGVTVIDATIRTGDDCIALIQGSTNVWIERVTCGPGHGISIGSLGTSEDEAGVQNVTVINSIFDGTQNGVRIKSWAKPSNGYASDIVFRNLTMLNAYNPIIIDQKYCPGDKNCPQQNSGVKISKVSYEHIRGTSACPQAINFDCSKSNPCEGIKLQDIDLVYDNGSSTSTCKNADGITRGEVIPKSCL

SEQ ID NO: 207381 - protein, 101 aa, Glycine max
  Coding DNA Sequence Number=SeqID_90603
MKNKKVAMAGVSLSEAYALREQHPLSEASTRLASEKNLEENLPCMHALSASSARSANRLSSHALSMPSSLSGISLTRAQHENGAKRAFEDRKPLKAEVGEK

SEQ ID NO: 207382 - protein, 266 aa, Glycine max
  Coding DNA Sequence Number=SeqID_90604
  Subcellular localization annotation: CTP_CleavageSite=41; ConfidenceScore=5.48e-01
MTESTKKRKGSSSTTTAAGHRRHGPSEAPTAPVPPSVSSPRSSTLFSSDDQCLRMGTIVDDWKFDYSSHDARRMVCNDQADITGKLLVGSLTFDCRIIHYIIVRNLLPRSSNLAQVSEEDLILMWAFLTNRQIDWAHLVRYCMHKALQTNASLSYSHLVTFFLLRHFQIPLDDEPFVQWIHKKDFLLPIPDERTPSPPPQRVDSSSLLTEVLTELRGGENLRVEFIMNLGINLRGVRVVSMHYQLPIVYLDFRLLSSSKGGEIDNR

SEQ ID NO: 207383 - protein, 43 aa, Glycine max
  Coding DNA Sequence Number=SeqID_90605
MESGAVFINVRISNLMSKWRTLMIKSLHQYTTALQEEQDKFFF

SEQ ID NO: 207384 - protein, 172 aa, Glycine max
  Coding DNA Sequence Number=SeqID_90606
MKKKKKVRKLILKNLMIKMQIKTELVVIQSPVATEPFQDDLNVEDNTNVSIKLRIVESNLEKECIKKEQESPMKTGEDATDTEKTLMAKAGEKIPLGSVKDFVFNTENMQNLFNFPIFDTFVKDACELLKVFENIPYSHIPTPPPISTSLPKSLESRLTSMEKQVRKYRSNC

SEQ ID NO: 207385 - protein, 461 aa, Glycine max
  Coding DNA Sequence Number=SeqID_90607
  Gene Ontology: Mol. function=ionotropic glutamate receptor activity; Cellular component=integral to membrane; Biological process=ion transport
  Homolog annotation: Hit_ID=Q8LGN0; Match level="QueryCoverage=90%, HitCoverage=47%, E-value=7e-81, Identity=39%"; Hit description =Glutamate receptor 2.7 precursor
  Pfam annotation: Domain name=ANF_receptor; Domain location=1-240; Score=52.7; E_value=1.2e-12; Accession=PF01094.18; Description =Receptor family ligand binding region
MAQNDSSQVKAIAAIVEAYGWREVVLIYENTEYGNGLVPHLIDALDAVDTKVPYRSVIDPIFEESHILEELENLKENSTRIFIVHMTGEHGSRFFSAVEKAGMMSEGYGWIVTEGLSVELDPSALERMDNMQGVLGVRTIVRNNEKLDDFKKRWKTLSFMENNIKYHAYRTHTITLFGLWAYDTVWALAMAVENATNYGKQSASLVNAILATKFQGLSGYVDLKGGQLESSVVEVFNVIGHKERIIGYWSPKRGLFQDDQEKQKVRQPVWPGYTMDQPPKLRFGVPVRKGFTEFVKVETIFNTTKVSGFVVDVFLEVLKALPFSVSYEFVPLENYGALAGPIANNKSMKFDAGVGDITIVYDRTNYLNFTLPYLESVVSMVVSMKHDEKRNMWVFLKPLSWGLWLTTGAALVLIGFVAYNTPEEYHEALSKGTNNGGVAAIFDESPYINVFLSKYDTGYAT

SEQ ID NO: 207386 - protein, 44 aa, Glycine max
  Coding DNA Sequence Number=SeqID_90608
MGVWAGERDGLVAEKEIMGMPSSRPRKHFTKDDPLNILVGSSHQ

SEQ ID NO: 207387 - protein, 166 aa, Glycine max
  Coding DNA Sequence Number=SeqID_90609
  Gene Ontology: Mol. function=ionotropic glutamate receptor activity; Cellular component=integral to membrane; Biological process=ion transport
  Homolog annotation: Hit_ID=Q8LGN0; Match level="QueryCoverage=76%, HitCoverage=13%, E-value=9e-25, Identity=48%"; Hit description =Glutamate receptor 2.7 precursor
MSNLHESLSLHYSLLCLFFLLLCLWGRPFMAKEAIPIPIGIVLDLNSSIGSMSNSCIWMAYQDFYERHPHYKTRLALQTRDSRDNVVTAASVAQELLNEKVHAIIGPQTSEQAWFVIELGSKAQVPVISFSATSPSLSSTQKPYFIRAARDDSSQVEAIAAIVQGN

SEQ ID NO: 207388 - protein, 64 aa, Glycine max
  Coding DNA Sequence Number=SeqID_90610
LVAGVSLSEACALSKNHALSEALSPLSELGESGGEHEKHLHTQHVFSSLNEAFVSSCAKCAQLA

SEQ ID NO: 207389 - protein, 80 aa, Glycine max
  Coding DNA Sequence Number=SeqID_90611
MYKDNWTQPWPMGSEIYPKVHENPRAFFSSSSLILLEPLAHGSSDWSLPREDCIREPIHRESIPTSSPKGMRYDYEHTSS

SEQ ID NO: 207390 - protein, 279 aa, Glycine max
  Coding DNA Sequence Number=SeqID_90612
  Homolog annotation: Hit_ID=Q10Q33; Match level="QueryCoverage=89%, HitCoverage=73%, E-value=5e-13, Identity=27%"; Hit description =Expressed protein
  Pfam annotation: Domain name=Remorin_C; Domain location=165-277; Score=111.3; E_value=2.8e-30; Accession=PF03763.4; Description =Remorin, C-terminal region
MELATAVAAAAFAIFSLEGSLIPQQKKKRETPLTRGKSKVDDTKPPISQFGGTSRQFSGFKNDQSNNATVDLKRPEKTMTPAPSMRRSSTFGEKVKSSTDGKKPEIQAPKRTTTFGDEHSVNTGEIKPETPLPRVAPPVHQQMPLRPPPPPLPPPPPPPIRQTSARPGTNGTKADAWEREELEKIKERYEKLLETIDSWEKRKKAKAIRKLNKHQHSESERKRAKVLKKYQDKMSYISQIAGGARAQAEERRRSEVLKAKEKANIIRTTGKIPGPCSCF

SEQ ID NO: 207391 - protein, 56 aa, Glycine max
  Coding DNA Sequence Number=SeqID_90613
MDEHIVVFQDLTNEVASLLCGVEPSANRFSVDGLPDAILPRKGPVTRAMSKRLQED

SEQ ID NO: 207392 - protein, 176 aa, Glycine max
  Coding DNA Sequence Number=SeqID_90614
MASEESQNKPPSEQSTTELITSAKLVAEAAQSALKSDSDKVDKAKVADAAGDLLDAAGKYGKLDDKQGIGQYVDKAADYLHNYQGDNTTAPSQPAESKGEESGGGLGGLANLAGGFFKKYWKIGLRTLKTQPIWMTTSLEELVFVLLVLKPKEPKLVSLFPPGEGFLKAHCYCNDK

SEQ ID NO: 207393 - protein, 92 aa, Glycine max
  Coding DNA Sequence Number=SeqID_90615
MPLENRHQEQERKMLLRWLQIRSNPVSASLLQAVLTKFFLSAEEDFHQELARHLGLSFDEHKPSSDNTKFVKDISENAATSPTMMGKDNIAS

SEQ ID NO: 207394 - protein, 56 aa, Glycine max
  Coding DNA Sequence Number=SeqID_90616
  Homolog annotation: Hit_ID=P53535; Match level="QueryCoverage=91%, HitCoverage=4%, E-value=3e-07, Identity=73%"; Hit description=Alpha -1,4 glucan phosphorylase L-2 isozyme, chloroplast precursor
MDKWKLLKTGLRYYLYALIHSKRREMKNPWEILRNDVSYPIKCYGEVISGPNGSIQ

SEQ ID NO: 207395 - protein, 120 aa, Glycine max
  Coding DNA Sequence Number=SeqID_90617
  Gene Ontology: Mol. function=transferase activity, transferring glycosyl groups; Cellular component=intracellular; Biological process=carbohydrate metabolic process
  Homolog annotation: Hit_ID=P53535; Match level="QueryCoverage=74%, HitCoverage=9%, E-value=2e-31, Identity=71%"; Hit description=Alpha -1,4 glucan phosphorylase L-2 isozyme, chloroplast precursor
QIDYHKINPKSHPPLLSTHQAHGVLGVRSNQIYYVLYPSVESIEGKTLRLKQQYTLCSAYLQDIIAHFEKRSGKRENWDTLPDKLVVQMNDTQLSLCIPELIRILVDVKGLSWEKALEYY

SEQ ID NO: 207396 - protein, 372 aa, Glycine max
  Coding DNA Sequence Number=SeqID_90618
MACHSEKEKRTTTTTIKFEEEKLVMDSRSDTETCAPTTHPRRSKRMRVKKTINLSNHNPFFSFSSSSSSGVVPLANGSSPVSEVEQEEQEEVARCLMLLSRDSSFNFKGGRFASVTESSDNNSVILEAKLSSPDTRIGVSNGNNNNNFVSNNHAYDLVAKKLLKVKDIKFKSAEFGASDNYSGSRFFRYGPKTKMVDSDFSNDEFRWSKVEGKSSKYTASVVKKLGVEDLDYDTTHGTTRKFDSIKRNNYDLVGVSSKKIASGFGNEVYKNGTRGWKYECFEVERDNDSYDSIDDESNENSSETESFPAPRSHHKSKALNGKKCTKPKKKLKPSKKSKDHECPICYKIFKSGQALGVTKDHISLEVLKKTLW

SEQ ID NO: 207397 - protein, 75 aa, Glycine max
  Coding DNA Sequence Number=SeqID_90619
MRSETTGSELDLRHIDDHKHEADVASDGSYAGDDPVNAKGDAVNVRDEVVDNDGVVERGGATKPRAETKPRAALR

SEQ ID NO: 207398 - protein, 80 aa, Glycine max
  Coding DNA Sequence Number=SeqID_90620
MRSRSMSLYNVSCRYDYGALHHYYVAKVVMAETGEVNREDFGTRATTAEAEGFSRRLLHRDVLLQPPPPPLRCERTKGPT

SEQ ID NO: 207399 - protein, 61 aa, Glycine max
  Coding DNA Sequence Number=SeqID_90621
MVICGEVERMSMLNRFGEDVNELSLRWRKKEDVVAVGLSVALAVLRKMMEESTPTTKGPLA

SEQ ID NO: 207400 - protein, 96 aa, Glycine max
  Coding DNA Sequence Number=SeqID_90622
MPHNTFLRKKRRRKKLILSLKMREQESPRKTEEDATDTKKTLVAKAGEKILVGSVKDSVFNTINMQNLNFPIFDTSVKVARGHLPLLHFLHSLLNL

SEQ ID NO: 207401 - protein, 136 aa, Glycine max
  Coding DNA Sequence Number=SeqID_90623
  Gene Ontology: Mol. function=cation:chloride symporter activity; Cellular component=membrane; Biological process=transport
  Homolog annotation: Hit_ID=Q1SN47; Match level="QueryCoverage=82%, HitCoverage=16%, E-value=2e-57, Identity=92%"; Hit description=Amino acid permease-associated region; Amino acid/polyamine transporter I; Interleukin-6/G-CSF/MGF
MGAALQSLTGAPRLLAAIANDDILPILNYFKVGDASEPHVATFFTAFLCIGCVVIGNLDLITPTVTMFFLLCYTGVNLSCFLLDLLDAPSWRPRWKFHHWSLSLVGALLCIAIDVRDSALLCCSWWCSTERPLSAT

SEQ ID NO: 207402 - protein, 110 aa, Glycine max
  Coding DNA Sequence Number=SeqID_90624
MEKIELEVADVDMPGQLDMCVGLSGQLDMCKDGHDVHVEGSFYHGSLGLRVEGQPLRLKCRRIKGLVVVVLLVAGGGFHLKPAAMGIHRERTKGAKRGGVGEVGTEHKWM

SEQ ID NO: 207403 - protein, 84 aa, Glycine max
  Coding DNA Sequence Number=SeqID_90625
MYHDEEEIEELLFDYLSDLFQTFNPQHMEEVIDLVQSRISQSMGNILSHPFTIEEVKDALFQMHPTKVPRVDGIQASFAKDLGI

SEQ ID NO: 207404 - protein, 150 aa, Glycine max
  Coding DNA Sequence Number=SeqID_90626
  Homolog annotation: Hit_ID=Q1S6A6; Match level="QueryCoverage=98%, HitCoverage=38%, E-value=4e-08, Identity=34%"; Hit description=FAR1
MSHNVDVNSDENDNGDKGDVGIENVEDREDATNEEDRRIVGLVSDEINVLDFGSEEHAFIFYREYARSHGFVVRKYDVSQNVAGNINKCQFICNKEDKAQVDSLHSFGSRTCQIMGYLLAKKGGYGSIRSLKNDLHNHKKKSLIIKNDDV

SEQ ID NO: 207405 - protein, 536 aa, Glycine max
  Coding DNA Sequence Number=SeqID_90627
  Gene Ontology: Mol. function=DNA binding; Cellular component=nucleus
  Homolog annotation: Hit_ID=Q2HUC6; Match level="QueryCoverage=37%, HitCoverage=29%, E-value=8e-31, Identity=38%"; Hit description=ELM2; AT-rich interaction region; Homeodomain-related
  Pfam annotation: Domain name=ELM2; Domain location=135-227; Score =11.6; E_value=0.015; Accession=PF01448.14; Description=ELM2 domain
  Pfam annotation: Domain name=Myb_DNA-binding; Domain location=257 -307; Score=18.2; E_value=0.031; Accession=PF00249.21; Description =Myb-like DNA-binding domain
  Pfam module annotation: Pfam domain module=ELM2::Myb_DNA-binding; Domain location=135-227::257-307
MGYKRCHEANEFEDLSLNKAKRFECNNELVSLADIVTPNKAFAQTVIKGDDEDGFYNIQWHDPLETDAAKEFPYTGDKNVQTSGHFSCYSSEDDTGSGATSLSSASSCCLEFDIPQKAFVPFDDDYLAFGCSPRKSVPIGPNHQATVPVWRGKVNKMSELGIYNHDSPSSGLVSAHTIDEDEERLMGTSVLSMDESSFHLLSSNDIGQGRTECNCMDRGSIRCVRQHVREARENLMETLGEEKFVNLGFCDMGEDVSRQWTEEEEDMFHEVVYSNPASLGRNFWKHLSVTFPSQTNKEIVSYYFNVFMLRRRAAQNRSRFLDIDSDDDECQTRNPRIFGFENSDDSAIESLGDQDVRMENQDNSDDDDDNNSDDGTEDNVHGSDMGNTTEIEGEIDESPSNLQVNSQIEPWSNPDEHVNGTPGILNYNIAVGDDSCMSFECDANMDVSCHSHGLGDASSALQARGFKCDQSPHMKEKLDLSSNEMDHVYLLEPCVAKDWWYPGYSTCPTPSTDLDFLPTSNLIEEFFGHGTRDKET

SEQ ID NO: 207406 - protein, 161 aa, Glycine max
  Coding DNA Sequence Number=SeqID_90628
  Subcellular localization annotation: CTP_CleavageSite=101; ConfidenceScore=5.45e-01
MNCVFVHVSSTFEFGAVFHGCLSADPQGNPPFSPFFRSSMNCVFVHVSSTFEFGAVFHDCLSADPQGNPPFSPFFRSSMNCIFVHVSSTFEFGVVFHDCLSADPQGNPPFSPFFRSSMNCVFVHVSSTFEFGVVFHDCLSADPQGNPPFSTFFGSPMNVIG

SEQ ID NO: 207407 - protein, 86 aa, Glycine max
  Coding DNA Sequence Number=SeqID_90629
MGVIFRDHLGQLLAAATFLDINCYQPQVAESLAFKWSIQVANQLLLPHVVYETDCQDLTQACHFARLSSNAGKFSSYFTYPYKESS

SEQ ID NO: 207408 - protein, 118 aa, Glycine max
  Coding DNA Sequence Number=SeqID_90630
  Gene Ontology: Mol. function=RNA-directed DNA polymerase activity; Biological process=RNA-dependent DNA replication
MSSVMRSKYFPRVHPLEAQIGSNPSYVGRSIMAVKDITLHGTIWRIGNGRQVRVWRDKWIVDAADNMLHPNPDKEIDESLMVAELIDVDTGRWDVEKISQDTDWQKSLWTMTRDLPAL

SEQ ID NO: 207409 - protein, 1088 aa, Glycine max
  Coding DNA Sequence Number=SeqID_90631
  Homolog annotation: Hit_ID=Q2QN61; Match level="QueryCoverage=99%, HitCoverage=99%, E-value=4e-15, Identity=31%"; Hit description =Expressed protein
  Pfam annotation: Domain name=DUF863; Domain location=157-1078; Score =320.0; E_value=4.1e-93; Accession=PF05904.2; Description=Plant protein of unknown function (DUF863)
MYQIIHDGMGTKVQTLPGYYSMRDLNEESSSCGWHLYYGDKTLANGQYYHSYLSSGAADACSAHDKDNLKQTMLEHEAIFKNQVFELHRLYRVQRDLMDEVKMKDLHRNHISVETSFSTGPLASQLTSEDGKKWHVPGFPIVGSSTCARPSISGVEGIHSPLSSNKGISKQAVLFPSPNGSSSPKDVEILGFRPSKVRRKMFDLHLPAYEYIDTEENEKPGDEKISATTNFLSDRNYKHEKGANMNLFSGNGGKTAGQEDISRSKQSLRSGNGLADLNEPVHVEETNDVAYVSPQNHNSYQGGTECSDLSAKQKSRFFGLSKEDLLNSHHGTESWARNNGYLDNDRNRKMWISSIESGQAKSNPKPIPQLLKQDQSLLSSQSMQDELGKSHEPRSDCRTNRSKTDLLREKMPSGLDISERNHEYSANKLSESVASSHRHGLFAIAPSSDLARSWSHLSWDMASSTLNQKLISVQTPPSRCVNASGSLSRSSQSHQSNGMLGDSWPLNINSKINPGFLCEASGKNGFYPRTLSGSKELSVNISSISYLNHDSDCKKFPEHFNNGPANCYKSSNLNSNGNDMKSAKNINLNGILSNASSNTLVSQSGLGIMDGEQKHEEQLAVLPWLRPKTTCKNVAQNAGGLNVFQLASSSNKDESGKGSNGKFIHNVTTGLCSNDLEPKRREVSDSSSKRKILGVPIFDISHISAKESSSFTSSSVSVPNPSDVELVENNQRKHILDINLPCDASVPEFDEQAVAQVIVCETGSSTTKANSRKQIDLNLCMNEDEAFVTNIPATNLETKAEIDLEVPAVPEAEEDAIPEEKKLETPLVSPLGPQDTVEKLQDELMRHAAEAIVVLSSSCCQQVDDVISSPSEGPVVDSLSWFVDIVSSCVDDLQKKSDNSREKDGEDNEESSSDGMDYFESMTLKLTETKEEDYMPQPLVPENFKVEETGTTSLPTRTRRGPARRGRQRSDFQRDILPGLASLSRHEVTEDLQTFGGLMKATGHTWNSGLNRRSGCGRGRRRSQPQVTPTPPPPPVANIETNTPLIQQLNNIEVVGLEDRSLTGWGKTTRRPRRQRFPAGNPPSIRLI

SEQ ID NO: 207410 - protein, 107 aa, Glycine max
  Coding DNA Sequence Number=SeqID_90632
MKENVKNEIKRAQRKLGAANGGSPKLAKGFEFWGRNGVKMASPFPFLCFLVRPRSPRCYCVQFYLNAYNTPLIEPNGSGFSEEDRECMFLKTIKCKGHNTGGRDANH

SEQ ID NO: 207411 - protein, 155 aa, Glycine max
  Coding DNA Sequence Number=SeqID_90633
MESELLLKLDCGIGRCFLDVALGVDHFIGYLREIIEISSLLSSSSSLGALDYMLGPSDVGEDFEHAVSAMLSLTPIAKDDEIEEDPEMLEEDPLEAIEYPFDLIMVDGIAIVNGELSYGEVGWLMKESSEEDPDKNRWDVSLGSLAVKDLLVVDS

SEQ ID NO: 207412 - protein, 103 aa, Glycine max
  Coding DNA Sequence Number=SeqID_90634
  Homolog annotation: Hit_ID=Q2QN88; Match level="QueryCoverage=72%, HitCoverage=7%, E-value=1e-09, Identity=89%"; Hit description =Asparagine synthase family protein, expressed
MYFLKVAELLGLYEAAVLPKRAILLFHSFNNSVLYSAGSPVYWNHIAFSLDLILVQELLGNQIGRILEAIEQQIRHRLAVVLIISVRRIGFPELPLTPELPRA

SEQ ID NO: 207413 - protein, 463 aa, Glycine max
  Coding DNA Sequence Number=SeqID_90635
  Gene Ontology: Mol. function=nucleic acid binding; Cellular component= intracellular; Biological process=transport
  Homolog annotation: Hit_ID=Q2PEP2; Match level="QueryCoverage=98%, HitCoverage=97%, E-value=1e-141, Identity=60%"; Hit description =Putative ras-GTPase-activating protein SH3-domain binding protein
  Pfam annotation: Domain name=NTF2; Domain location=16-132; Score =156.0; E_value=1e-43; Accession=PF02136.11; Description=Nuclear transport factor 2 (NTF2) domain
  Pfam annotation: Domain name=RRM_1; Domain location=299-366; Score =34.4; E_value=3.8e-07; Accession=PF00076.12; Description=RNA recognition motif. (a.k.a. RRM, R
  Pfam module annotation: Pfam domain module=NTF2::RRM_1; Domain location=16-132::299-366
MAEMAVSEGSPTPQTVGNAFVEQYYSILHQKPDQVHRFYHESSILSRPEEDGTMTMVTTTLEINKKILSLDYTSFRVEILSADAQPSYKDGVIVVVTGCLTGSDNLKRKFTQSFFLAPQDKGYFVLNDVFRYVDEYKSVDIESVPANDAADESAPTDAFVPEPEAIHVAEDVPASQTDVVDADIGVSKEVSQPLENGNLSVTEKVVPVDHVKECSHQEHHSHAEKAASNNSLEDTPKKSFASIVNALKENAAPFHVRVSPVKLLEQPRVSSIPAPEAPAPSTDSPPEKNNEIGGKAYAIFVANLPMNATVEQLERVFQKFGPIKRDGIQVRSNKQQQSCFGFVEFESATSMQSALEQLFIWRLLLLLPWMDVDFQLKSDEQIMIGGGIHQEGAVTGMTETITSGAVATSVVAMVAVMETGNDSFEKRSEFSGRPRGGNNGGRSNGEAVPRSYQNGGAKVTVNQ

SEQ ID NO: 207414 - protein, 121 aa, Glycine max
  Coding DNA Sequence Number=SeqID_90636
  Gene Ontology: Mol. function=RNA-directed DNA polymerase activity; Cellular component=membrane; Biological process=RNA-dependent DNA replication
MRKRSDETSRYMRTTWSSSLKAYPNMCGGKFLGFIITHRGIEANPDKCTVILEMRSSTNIQEVQKLKGRLASLSRFLTKLAEKVKPFYKMLKKIEVFSWDNTCEEAFMAFKKTIATPPVLS

SEQ ID NO: 207415 - protein, 170 aa, Glycine max
  Coding DNA Sequence Number=SeqID_90637
  Gene Ontology: Mol. function=hydrolase activity; Biological process =aromatic compound metabolic process
  Homolog annotation: Hit_ID=Q011V0; Match level="QueryCoverage=69%, HitCoverage=35%, E-value=3e-18, Identity=44%"; Hit description=[R] KOG1454 Predicted hydrolase/acyltransferase
MGIYHNQRSWRPETGDGYVRPPVKVRFSENPIMSSCVKPLMQNMVNPVVLLHGFDSSCLEWRYTYSLLEEAGFETWAVDILGWDFSDLEKLPSSCDAVAVISLSSEEMFWKSHIKGAMILVGPNLDSAVASDFAVEKLVLIDASVYAEGTGNLATLPRAAAYAGVRRYPT

SEQ ID NO: 207416 - protein, 62 aa, Glycine max
  Coding DNA Sequence Number=SeqID_90638
MAKNERKVKRMEVESWLCRAGGGGDRGEAVVRCCKSMASYEYVLYALRFVWDTKMNLACKTV

SEQ ID NO: 207417 - protein, 208 aa, Glycine max
  Coding DNA Sequence Number=SeqID_90639
MDDDVEVPLILGRIFMKTTRDLIDMDDVQFKIRVQDEEVVCNVFKAVKHLNDDKSCLRVDVLDEMYVNSLKQVSNSSSLEKALIDAFEALNEEEEMEIEDCLKSLDTLKEIPKEGVLEPLDMRRFMSRSKQQRYAELESRSLICERKVDLKAKEYEEFQATITKKKWDILVELEMKFNEEIDGIDDDEGGDEEEDEEFFKNVSHRGDD

SEQ ID NO: 207418 - protein, 234 aa, Glycine max
  Coding DNA Sequence Number=SeqID_90640
  Gene Ontology: Mol. function=protein domain specific binding; Cellular component=germline ring canal; Biological process =intracellular signaling cascade
  Homolog annotation: Hit_ID=Q9C5W6; Match level="QueryCoverage=95%, HitCoverage=83%, E-value=1e-107, Identity=87%"; Hit description=14-3- 3-like protein GF14 iota
  Pfam annotation: Domain name=14-3-3; Domain location=1-217; Score =430.2; E_value=2.8e-126; Accession=PF00244.10; Description=14-3-3 protein
MVECMKTIAKLDLELTVEERNLLSVGYKNVIGARRASWRIMSSIEQKEESKGNESNAKLIKNYRQKVEEELSKICSDILSIIDQHLVPSSTSGEATVFYYKMKGDYYRYLAEFKTDQDRKEAAEQSLKGYEAALATASTDLPSTHPIRLGLALNFSVFYYEILNSPERACHLAKQAFDEAIAELDTLSEESYKDSTLIMQLLRDNLTLWTSDLPEDGGMIMIETWHKMHLDSAS

SEQ ID NO: 207419 - protein, 254 aa, Glycine max
  Coding DNA Sequence Number=SeqID_90641
  Gene Ontology: Mol. function=helicase activity; Biological process =viral genome replication
  Homolog annotation: Hit_ID=Q1RUB6; Match level="QueryCoverage=98%, HitCoverage=31%, E-value=1e-53, Identity=44%"; Hit description =Peptidase, cysteine peptidase active site; Nucleic acid-binding, OB- fold
MESALDVFQKNSMEQQLLTKMDSQFIGEEMMDVHTSIKYLFKYINKGSDRITAALGNHHNNNGNNTQVQDEIKQYLDCRYVSPPEACWKIFAFPMHARSPAVERLYFHLENQQHVYWTDDQQIGEVLSKNTIKESMFTAWMHSNKIYSYGRDLTYHQYISRFVYVTRKRCWQPRKQGNTIGRLIWVPPSAGELFYLRMMLSTAKGAQSYNDIRTVNGVVYPTFRETCFAKGFLGSDQEFISALQEANNWGTAHT

SEQ ID NO: 207420 - protein, 37 aa, Glycine max
  Coding DNA Sequence Number=SeqID_90642
MFIDYILPSSMTGEHVAQPSSPRDGEDISITAGLPKR

SEQ ID NO: 207421 - protein, 153 aa, Glycine max
  Coding DNA Sequence Number=SeqID_90643
  Gene Ontology: Mol. function=cation:chloride symporter activity; Cellular component=integral to membrane; Biological process=sodium ion transport
  Homolog annotation: Hit_ID=O22526; Match level="QueryCoverage=72%, HitCoverage=11%, E-value=1e-10, Identity=42%"; Hit description =Cation-chloride co-transporter
MDRENGDGDIEGGGGADDGGFRSPIGRKYHPVLANDRAVLEMSSMDQGPSSSSSAFPDQHPNIRKVNTSVNGSSDAKEENPSHENQPNGSLQQESKLELFGFDSLVNILGLKRYIWAFLAATVTPLQSLDVAFKVCIQYYCYPFEFEGGLDKL

SEQ ID NO: 207422 - protein, 59 aa, Glycine max
  Coding DNA Sequence Number=SeqID_90644
MALELLTDTTKTSTSFDSSSAISKDIIEMPSFYHRQWAPEYPKFVNFRYDGTIYQIRLR

SEQ ID NO: 207423 - protein, 643 aa, Glycine max
  Coding DNA Sequence Number=SeqID_90645
  Gene Ontology: Mol. function=signal transducer activity; Cellular component=membrane; Biological process=response to light stimulus
  Homolog annotation: Hit_ID=Q6AST7; Match level="QueryCoverage=96%, HitCoverage=98%, E-value=0.0, Identity=69%"; Hit description=NPH3 family protein
  Pfam annotation: Domain name=BTB; Domain location=23-125; Score=2.9; E_value=0.0022; Accession=PF00651.21; Description=BTBPOZ domain
  Pfam annotation: Domain name=NPH3; Domain location=212-478; Score =444.3; E_value=1.6e-130; Accession=PF03000.5; Description=NPH3 family
  Pfam module annotation: Pfam domain module=BTB::NPH3; Domain location= 23-125::212-478
MTCVKLGSKADAFQRQGQAWFCTTGLPSDIVVEAGEMSFHLHKFPLLSRSGVLEKMIAEASESEEECVISLSDIPGGAKTFELVAKFCYGVKLELTASNVVYLWCAAERLEMNEEYGEGNLISQAETFFNQVVLHSWKDSLRALQTCDDVLAHAEELHIVKRCIESLAAKASTDPNLFGWPVLERGGPLQSPGGSVLWNGISTGARPKHSSSDWWYEDVTNLSLPLYKTLIAVMESRGIRQEIIAGSLAFYAKTYLPGLNRRQVSGESSSRPSQVAMGSPLSEYDQKILLEEVDGLLPMQKGLVQTKFLFGLLRTAMILRVSPSCISNLEKRIGMQLDQATLEGLLMPNFSYSMETLYNVDCVQRILDHFLAMDQVTGCASPCSIDDGQLIGSPSLTPITMVAKLIDGYLAEVAPDINLKLPKFQALAAAVPEYARPLDDGLYRAIDIYLKSHPWLVESEREQLCRLMDCQKLSLEACTHAAQNERLPIRIIVQVLFFEQLQLRTSIAGCFLVSDNLDGSRQLRSGFVGSTEGGWASAVKENQVLKVGMDNMRMRVSELEKECSNMRQEIEKLGRTKGSSAWGTVSKKLGFKLKSQMCSAQEGSVSNQNNANNNVEKLKERHVKHKKGSSISDKASVSSIVHS

SEQ ID NO: 207424 - protein, 103 aa, Glycine max
  Coding DNA Sequence Number=SeqID_90646
MTLLVLVSCSRSEKKKESKKILLTQLEEENKNKEEYEFLASRDMYEIPLSRMELKFILDTSMWDGEKILDTFIYDGEGSRTSFHEILAHRPFEESQIYNSFES

SEQ ID NO: 207425 - protein, 364 aa, Glycine max
  Coding DNA Sequence Number=SeqID_90647
  Gene Ontology: Mol. function=RNA-directed DNA polymerase activity; Cellular component=chromatin; Biological process=chromatin assembly or disassembly
  Pfam annotation: Domain name=RnaseH; Domain location=91-212; Score= -26.9; E_value=0.018; Accession=PF00075.14; Description=RNase H
MVFGQGVEQVASKIAAIQQWPPPCSTKAVRSFLGLAGFYRKFIQGYATIAAPLVAVTTLESFQWSPQAQAAFDNLKQALSTALILALPDFTRPFTVETDASGVGMGAVLSQKGHLIAFFSKLFTSKLLGASAYVCELCAITIAVKKWRQYLLGHHFIIITDHRSLKELLTQVIQTPEQHMYLARLLGYDYEIQYRSGSHNQAADALSRLPESESSLSMILSMPSLTFLEELCQQLEDNQEYRILRQSLRDNPQQHPQFTLSQDLVLHSGRIWLPRDIPIAPILLVEYHTTPIGGHAGVTKTLPHISKNFHWAGFREDVKRLLILHIELGALWIGHVLDRWPNIHGLSTNKEAFGLPIIYLLSMV

SEQ ID NO: 207426 - protein, 51 aa, Glycine max
  Coding DNA Sequence Number=SeqID_90648
MGNVQFNDQEVSVVEMRKLIHEKVGWRGSNSERVIERIREQEEEGSLWRPR

SEQ ID NO: 207427 - protein, 165 aa, Glycine max
  Coding DNA Sequence Number=SeqID_90649
MKLWINSIPCRAYNKGTYVPLLVCFVHGEIGSYPRESGCSGLDDFRAPLEELFAVLQNSQKESATALGHRMLVYLKYCFIGLLIPPGRKSIPPTRLPSLRRELVEFLLKDSYTPKSHTVSDFVSRRPCLNLYLLLQPINLYRKQKRKMIMALKLKMLWFRLAINL

SEQ ID NO: 207428 - protein, 351 aa, Glycine max
  Coding DNA Sequence Number=SeqID_90650
  Gene Ontology: Mol. function=zinc ion binding; Cellular component =cellulose and pectin-containing cell wall
  Homolog annotation: Hit_ID=Q6Z692; Match level="QueryCoverage=99%, HitCoverage=58%, E-value=1e-121, Identity=55%"; Hit description =Putative early-responsive to dehydration stress protein
  Pfam annotation: Domain name=DUF248; Domain location=4-346; Score =195.5; E_value=1.2e-55; Accession=PF03141.7; Description=Putative methyltransferase
  Pfam annotation: Domain name=Methyltransf_11; Domain location=209 -307; Score=7.3; E_value=0.01; Accession=PF08241.2; Description =Methyltransferase domain
  Pfam annotation: Domain name=Methyltransf_11; Domain location=3-77; Score=3.7; E_value=0.024; Accession=PF08241.2; Description =Methyltransferase domain
  Pfam module annotation: Pfam domain module=DUF248::Methyltransf _11::Methyltransf_11; Domain location=4-346::209-307::3-77
MAVCIAAYEATGSQVQLSLERGLPAMIGNFISRQLPYPSLSYDMVHCAQCGIMWVEKNGMFLIEVDRVLKPGGYFVLTSPTSRPQGSSREKKRIMANPMEGLTQQLCWTLLAQQDETFIWQKTADIDCYASRKQRTIQVCKGDDTQSYYRPLLPCIRVQPEEFYEDFQYWRSAVNNYWSLLTPLIFSDHPKRPGDEDPLPPYNMIRNVMDMSANFGGLNAALLEEKKSVWVMNVVPARASNALPLILDRGFAGVMHDWCEPFPTYPRTYDMLHAYGLISHLSSERCSMVDLFLEMDRILRPEGWVILSDTMGAIEMARMFATQVRWDARIVDLQNGSDQRLLVCQKPFVKK

SEQ ID NO: 207429 - protein, 77 aa, Glycine max
  Coding DNA Sequence Number=SeqID_90651
MELEGEIKKKGLEHETVGVQKLMGDYRVLRAILSHWPLPDHLILPHHLVLGTLSLAETLFIPHHHVGNVFSSAFDPG

SEQ ID NO: 207430 - protein, 502 aa, Glycine max
  Coding DNA Sequence Number=SeqID_90652
  Gene Ontology: Mol. function=transcription factor activity; Cellular component=nucleus; Biological process=regulation of transcription, DNA-dependent
  Homolog annotation: Hit_ID=Q5NE24; Match level="QueryCoverage=98%, HitCoverage=97%, E-value=0.0, Identity=72%"; Hit description =Nodulation signaling pathway 2 protein
  Pfam annotation: Domain name=GRAS; Domain location=81-409; Score =357.5; E_value=2.1e-104; Accession=PF03514.5; Description=GRAS family transcription factor
MEIDMDMDFSGYSTITNTIPSSDDDYGCNWNHWSPVVNWDAFTGAHDDFHHLIDSIMCDSAAAEEDNLSPDDHAASNSPSASVTEEEDDDADEETGPVDDSKGLRVVHLLMAAAEALTGAPKSRDLARVILVRLKELVSHAAPPHGSNMERLAAYFTDALQGLLEGASGGAHNNKRHHHYNIITSSCGPHHRDDHHNHQSNTLAAFQLLQDMSPYVKFGHFTANQAILESVAHERRVHIVDYDIMEGVQWASLMQALASNKTGPPGPHLRITALSRTGSGRRSIATVQETGRRLTAFAASLGQPFSFHHCRLDPDETFKPSSLKLVRGEALVFNCMLNLPHLSYRAPDSVASFLSGAKALKPRLVTLVEEEVGSSAGGFVGRFMESLHHYSAVFDSLEAGFPMQGRARALVERVFFGPRIVGSLGRLYRTGEEERGSWGEWLGAAGFRGVPMSFANHCQAKLLIGLFNDGYRVEELGTNKLVLDWKSRRLLSASLWTQINSF

SEQ ID NO: 207431 - protein, 125 aa, Glycine max
  Coding DNA Sequence Number=SeqID_90653
MDPDKFGVYYVIDDINSFVENLGINELVPIVEDDVGSNGNCPIQVDEVYVSDGDLTSKGLSEGSSSDSEYSPFDKYAELTNGDALSDFDESVDVKNEKYRVTVECKADDGIWRIHASPATNKETY

SEQ ID NO: 207432 - protein, 222 aa, Glycine max
  Coding DNA Sequence Number=SeqID_90654
  Gene Ontology: Cellular component=membrane
  Homolog annotation: Hit_ID=Q8RYE2; Match level="QueryCoverage=83%, HitCoverage=43%, E-value=2e-30, Identity=42%"; Hit description =Expressed protein
MGWLGVVFKADTSRVSEHLAIGPTTGYLGSLTTFSGWNQKMVELIATRHWLLFVLGFLIGLLLVGSSITFGVETAKGFKWFLRWLNMRPGSGTFISKVNWKVDIFLRHLVVTIVYVVILGLLWGVAGALEKVEFKHGGNAAWLWLACIVGSLGGRLKWLQFETLIADAYASWVVAALAIVKKSVFTLFLSMFCYTHLCQAALTELKASRIRISLGERGFMAD

SEQ ID NO: 207433 - protein, 170 aa, Glycine max
  Coding DNA Sequence Number=SeqID_90655
  Gene Ontology: Mol. function=nucleic acid binding; Biological process= regulation of transcription, DNA-dependent
  Homolog annotation: Hit_ID=Q3HRT2; Match level="QueryCoverage=96%, HitCoverage=98%, E-value=1e-24, Identity=37%"; Hit description =Putative glycine-rich protein
  Pfam annotation: Domain name=CSD; Domain location=6-73; Score=114.3; E_value=3.6e-31; Accession=PF00313.12; Description='Cold-shock' DNA -binding domain
  Pfam annotation: Domain name=zf-CCHC; Domain location=105-122; Score =33.1; E_value=9.9e-07; Accession=PF00098.13; Description=Zinc knuckle
  Pfam annotation: Domain name=zf-CCHC; Domain location=148-165; Score =36.3; E_value=1e-07; Accession=PF00098.13; Description=Zinc knuckle
  Pfam module annotation: Pfam domain module=CSD::zf-CCHC::zf-CCHC; Domain location=6-73::105-122::148-165
MAESRRSTGTVKWFNSQKGFGFITPQDGTDDLFVHFTSIRSDGYRSLSEGQSVEFLLDYGDDGRTMAVDVTSAVRSRRPGGFRGGGGRGRGGGRGGGFGRRGGGPECYNCGRIGHLARDCYHGQGGGGGVDGDGRNRRRGGGGGGGGRGCFNCGEEGHFVRECPDVGERK

SEQ ID NO: 207434 - protein, 69 aa, Glycine max
  Coding DNA Sequence Number=SeqID_90656
MWAQLMIKDWMVINFRRVMKLEFDGDGMDDNSLIVVTLNLNGANIIRFLPPTLHEEAWHEIEKVTALFL

SEQ ID NO: 207435 - protein, 694 aa, Glycine max
  Coding DNA Sequence Number=SeqID_90657
  Gene Ontology: Mol. function=protein binding; Cellular component =integral to membrane; Biological process=electron transport
  Homolog annotation: Hit_ID=UPI000065D5E2; Match level="QueryCoverage =95%, HitCoverage=70%, E-value=5e-46, Identity=24%"; Hit description =UPI000065D5E2 related cluster
  Pfam annotation: Domain name=PQQ; Domain location=146-183; Score=8.7; E_value=1; Accession=PF01011.11; Description=PQQ enzyme repeat
  Pfam annotation: Domain name=PQQ; Domain location=55-92; Score=3.7; E_ value=4.9; Accession=PF01011.11; Description=PQQ enzyme repeat
  Pfam annotation: Domain name=PQQ; Domain location=96-135; Score=6.6; E_value=1.9; Accession=PF01011.11; Description=PQQ enzyme repeat
  Pfam module annotation: Pfam domain module=PQQ::PQQ::PQQ; Domain location=146-183::55-92::96-135
MAMTIRVFLILLLFLSSTHLSYSLYEDQVGLMDWHQQYIGKVKHALFHTQKSGRKRVLVSTEENVVASLDLRRGEIFWRHVLGTNDVVDGLDIALGKYVITLSSDGSILRAWNLPDGQMVWESFLQGSVASKSILYIPKNLKADKDDLILVFGKGCLHAVSSIDGEVLWKKDFVGESIEVNHIIQSTDEIYVAGFVGSSKFYVYGLNAKNGELLKNDHKALPCDTFGELLSVSGDKFVVLDKTRSKILTINIKNGEISYKQKPISDLIEDSSGQAVILPSRLPELFALRINSHVLLIKVTNEGELVLVDKINNAAAVSDALSIPEGQHAFAFVQHEDSKIHLFVKDVNDWNGDLLKERVVIDHQRGNVDKIFINNYVRTDRSYGFRALMVMEDHSLLLVQQGEIVWSREDGLASVVDVTASELPVEKEGVSVAKVEQNLFEWLKGHVLKLKGTLMIASAEDVVAIQALRLRSSEKSKMTRDHNGFRKLLIVLTRAGKVFALHTGDGRVVWSILLHTLRKTEVCEHPIGLNIYQWQVPHHHALDENPSILVVGRCGPSLAAPSVLSFIDAYTGKELNSLSLAHTVAQVIPLPYTDSTEQRLHLIIDINRYAYLYPRTSEAIGILQREFSNVYWYSVDADNGVIRGHALKSNCIHKVVDEYCFDFRNLWSIVFPSESEKIIATVTRKSNEVWCLWH

SEQ ID NO: 207436 - protein, 142 aa, Glycine max
  Coding DNA Sequence Number=SeqID_90658
  Subcellular localization annotation: CTP_CleavageSite=63; ConfidenceScore=5.86e-01
MPIRNPKMISLPPNSSTSLSFSHSSISLSPNSMMISLSSSSTSIILNQLSILLLLTNGQHSLLSSTVLSRSPKHRQQLHALHPQEGDAIEDLACCIKENLHHIKGYHQGLPPDEELSSRNEEAEMVMAEKEKQVEAKEEKRK

SEQ ID NO: 207437 - protein, 125 aa, Glycine max
  Coding DNA Sequence Number=SeqID_90659
  Gene Ontology: Mol. function=protein binding; Cellular component =nucleus; Biological process=ubiquitin cycle
  Homolog annotation: Hit_ID=Q94DM8; Match level="QueryCoverage=97%, HitCoverage=84%, E-value=7e-36, Identity=68%"; Hit description =Probable ubiquitin-fold modifier 1 precursor
  Pfam annotation: Domain name=UPF0185; Domain location=5-117; Score =162.4; E_value=1.2e-45; Accession=PF03671.5; Description =Uncharacterised protein family (UPF0185)
  Subcellular localization annotation: CTP_CleavageSite=28; ConfidenceScore=5.34e-01
MAGGGKVSFKVTLTSDPKLPFKVFSVPEAAPFTAVLKFAAEEFKVPPQTSAIITNVTSTDLVSPSYVVTFGIYCCTTKSVVLFIEKEKKYGKDGVGINPQQSAGNVFLKHGSELRLIPRDRVGAF

SEQ ID NO: 207438 - protein, 177 aa, Glycine max
  Coding DNA Sequence Number=SeqID_90660
  Homolog annotation: Hit_ID=Q338Y6; Match level="QueryCoverage=41%, HitCoverage=17%, E-value=1e-10, Identity=47%"; Hit description =Expressed protein
MVDIISDANLKDEGNIGKSKTTLNWSESFNEDDDEDLQEIEANEALLAKVRQSKAIENRLNQSGQLSILDNLHITGLSPSHKRVWLLHCLAFSYEPQASIFQVGKGCRFSYVYMESVNDEIFLYLEVESDPQVAFIVVLGFRIGKTVLQCQVYISQHQTKVKKNQFNKAKVVAASTY

SEQ ID NO: 207439 - protein, 49 aa, Glycine max
  Coding DNA Sequence Number=SeqID_90661
MVGSTSTDLQLRPIIWVNLQLHDGVVVVGVIDREQGLPNVECLCVACFN

SEQ ID NO: 207440 - protein, 50 aa, Glycine max
  Coding DNA Sequence Number=SeqID_90662
MTVVMNIFGDPKYRKSGQNGVGAACPADGAVVQVSQVARISILMDGKDFH

SEQ ID NO: 207441 - protein, 451 aa, Glycine max
  Coding DNA Sequence Number=SeqID_90663
  Gene Ontology: Mol. function=zinc ion binding; Cellular component =nucleus; Biological process=chromatin modification
  Homolog annotation: Hit_ID=Q8SA95; Match level="QueryCoverage=79%, HitCoverage=97%, E-value=2e-79, Identity=42%"; Hit description =Putative SET-domain transcriptional regulator
  Pfam annotation: Domain name=SET; Domain location=4-201; Score=6.5; E_ value=0.00021; Accession=PF00856.18; Description=SET domain
  Pfam annotation: Domain name=zf-MYND; Domain location=58-98; Score =33.5; E_value=7.6e-07; Accession=PF01753.9; Description=MYND finger
  Pfam module annotation: Pfam domain module=SET::zf-MYND; Domain location=4-201::58-98
MEDLQSGLQNRKLSLSTLPEKGRSLLATRDFYPGEVIISQEPYVCVPNNSSVSPQKRCDGCFTTINNNVLSRCSRCQLAFYCGTACQRSEWKLHRLECEVLSSLHKYKRKSLTPSIRLMLRLYLRRKLQNDKFACNAHTICDSELRPVGTGLYPVISIINHSCLPNSVLVFEGSSALVRAVQHIPSGTEVLISYIETAESTMTRQKALKEQYLFTCTCPRCSKVGQYDDIQESAILEGYKCKSEKCGGFLLRTTVTNGAGTLDRSFSILQIDHTILSNIALKVYFIAGVYPAVHPLPGLQYYTCGKLEWYLGDTEEAVKSLTKAVDILRITHGTNTPFMKDLLMKLEEARTEASYKFSSKDESHESQSDELLTAKEMDGNYGTIYFLLVGRYLSNVRAAEYRVLTFGTAVLAVDLVNIVSKLFSQEEQEKDVGVAEEFSTFDCDPMLDTSS

SEQ ID NO: 207442 - protein, 737 aa, Glycine max
  Coding DNA Sequence Number=SeqID_90664
  Gene Ontology: Mol. function=protein serine/threonine kinase activity; Cellular component=cAMP-dependent protein kinase complex; Biological process=protein amino acid phosphorylation
  Homolog annotation: Hit_ID=Q019E0; Match level="QueryCoverage=45%, HitCoverage=32%, E-value=8e-74, Identity=47%"; Hit description=[T] KOG0578 p21-activated serine/threonine protein kinase
  Pfam annotation: Domain name=Pkinase; Domain location=345-653; Score =211.0; E_value=2.7e-60; Accession=PF00069.15; Description=Protein kinase domain
  Pfam annotation: Domain name=Pkinase_Tyr; Domain location=345-653; Score=-62.2; E_value=1.2e-08; Accession=PF07714.7; Description =Protein tyrosine kinase
  Pfam module annotation: Pfam domain module=Pkinase::Pkinase_Tyr; Domain location=345-653::345-653
MQSNCIRPKRPLLPQRASNISSSSDATNSQEEASSKDSLITVVPAQNLDAQKKVQFSVRSNAALQDGKATELENLSSHMSSLGFAEMEWVEGSQIESSSSSSLGCIQLENVPQAAFDASLKCESGVSSVLPKRSLVTQDHLQQFRSFLSQPATQSSVVGPSCATTTSVHSTSAPMLNSATRYSHLRQDGGSSVAAEPLGEVNANPCPITEGVVKSVDVSIKETNRMSVDRGAEAEVRASGSCIDDAGLLSKGSNRSKEQQGGVLKESGNSKYTSCDDAKGKEAVDVATVQTQAPLPTTITSSSDMKLGSSKEEKREKTASSKGASGTRKRTYDPDLFFKVNGKLYQRLGKIGSGGSSEVHKVISSDCRIYALKKIKLKGRDYATAYGFCQEIEYLNRLKGKDNIIQLIDYEVTDKALLEEVMKGSFSNKDGRVKDDGCIYMVLEYGEIDLAHMLSQKWKELDGNNKTIDENWLRFYWQQILLAVNTIHEERIVHSDLKPANFLLVKGSLKLIDFGIAKAIMSDTTNIQRDSQESGRIEHYRFGLPIQVGTLSYMSPEAFLCNETDANGNIIKCGRPSDIWSLGCILYQMVYGRTPFSDYKTFWAKFKVITDPNHKITYEPVSNPWLLDLMKRCLAWDRNQRWRIPQLLQHPFLVPPVPSNPSLPQDHTCKLLQLISETCTYDPEATQLCSQLQRLLSDPLEKTTCSLYSRDQQLKLLSQMSELCIQLHERLTNTENK

SEQ ID NO: 207443 - protein, 714 aa, Glycine max
  Coding DNA Sequence Number=SeqID_90665
  Gene Ontology: Mol. function=phospholipid binding; Cellular component= membrane; Biological process=steroid metabolic process
  Homolog annotation: Hit_ID=Q8LN57; Match level="QueryCoverage=94%, HitCoverage=90%, E-value=0.0, Identity=66%"; Hit description =Putative oxysterol binding protein
  Pfam annotation: Domain name=Oxysterol_BP; Domain location=316-688; Score=194.9; E_value=1.9e-55; Accession=PF01237.9; Description =Oxysterol-binding protein
  Pfam annotation: Domain name=PH; Domain location=43-138; Score=57.2; E_value=5.4e-14; Accession=PF00169.19; Description=PH domain
  Pfam module annotation: Pfam domain module=Oxysterol_BP::PH; Domain location=316-688::43-138
MPPLPAAAAASAVRSDLAPRHSHSGSQREQPVVDVKINDLVGNGISGILYKWVNYGKGWRPRWFVLQDGVLSYYKIHGPDKIVVNQETEKGSMVSTIRESKSDEKRFSVFTGTKRLHLRAETREDRVAWTEALQAVKDMFPRMSNSELMAPVDNVTVSTEKLRVRLMEEGVSEAAIQDSEQIIRTEFAALQSQLVLLKQKHSALIDTLRQLETWNDVASWVKSWTEKVDLEDTVVDESQRQRNDEEASSRLAQEKFSEGTASESEDDNERNDAAEEETDEDDNAFFDTRDILSSSSFKSNGSDYRVSSFSSDDEGFYAFESEDDVDPSIRYVGTNYPHVKRRKKLPDPVEKEKGVSLWSMIKDNIGKDLTKVCLPVYFNEPLSSLQKCFEEMEYSYLLDQAYEWGKRGNSLMRILYVAAFAVSGYASTEGRVCKPFNPLLGETYEAHYPDKGLHFFSEKVSHHPMIVACHCEGTGWKFWGDSNLKSKFWGRSIQLDPVGTLTLEFDDGEVFQWSKGNQEHSCKLKFKEQSIIDRNPHQVHGIIQDSNGKTVSTLFGKWDESMHYVNGDYTGKGKGHDTLSDARLLWKRSRAPKFPTRYNFTRFAITLNELTPGLKEKLPPTDSRLRPDQRYLENGEYDMANVEKSRLEQRQRQARKMQESGWKPRWFAKDKASGTYRYVGGYWEARQRGNWDSCPDIFDQIPSDHISDEGQITF

SEQ ID NO: 207444 - protein, 109 aa, Glycine max
  Coding DNA Sequence Number=SeqID_90666
MADTQQKGCMKKRENIFISLRRKRSCDVAVSAEVDGGGADQVKRHAKHGVAITTGTGAWREIKTVMFVSGLEDTGYKMPPPPSARDTWGDAMWKQNVFHVLEGIQFRFG

SEQ ID NO: 207445 - protein, 68 aa, Glycine max
  Coding DNA Sequence Number=SeqID_90667
MQEPIAKKQEKSEMCWMELIDDLNCEGSKDDVDGGGKLKLVGELVLNVVLKLKQFGGGAAVEQQGLNF

SEQ ID NO: 207446 - protein, 585 aa, Glycine max
  Coding DNA Sequence Number=SeqID_90668
  Gene Ontology: Mol. function=RNA-directed DNA polymerase activity; Cellular component=chromatin; Biological process=chromatin assembly or disassembly
  Pfam annotation: Domain name=Chromo; Domain location=514-563; Score =11.8; E_value=0.039; Accession=PF00385.14; Description='chromo' (CHRromatin Organisation MOdifier
MKFVFKGTLIELKGNSDNALLALTPPQLRQLNQTHSASEYFHIRLCSSASSPPPTHPAILTLTHQFSSLFQTPIALPPSRTTNHSIHLSPHSLLVNVRPYRYPHFQKQEIESQHNGSWRFCVDYKALNAITIKEHSLIPMVDKPLDELGGAWWFSKLDLLQGYHQILMTLVEPGVEPVLAKVEVVLQWPTLTLVRALRGFLGLSGFYRRFIQGYATLEAPLTSLLAKDSVHWSTIAKQAFFQLKEGLCKAPVLRLPDFSLPFVVETDASGTRFDFEERANLVTTRNLIHPHYPCGISLNAHRQPHRGHEDSSTGSRELHLAVGGPLPRLYCGTVELLRAFDYPSSGRPGPLLHEPFLAGIIQGQWNKALYEFGVPFSDRRADRGHELCYRTIPQSLCSSVTINVGMILDMDRMGTSNVEAVDERFKQRDQMLAGLAKKLTKAQQRMKVYVDKQHCDLNFEVGDWVLGSCVQIRIAANFKDSSCVSLLLIKTIPVHHHRPALELPALSEDNQPLIKPLTILDTKWEQTASGRQLLVLVQWMGLLVEDTSWEKWESLKIHYNLEDKVVLEAWRNVMNENAEQDTNVE

SEQ ID NO: 207447 - protein, 141 aa, Glycine max
  Coding DNA Sequence Number=SeqID_90669
MSRNFMDYAVMGVKRLKVINQGANNRKVSPHATRLSDRWIAKDADNRKVSPHATGFSGRRIEKGADNHKVSSHATVLSGHRIAKVNGSSFLGDPTASEGKDENSYPGSRFMADELRFWLKRLVERPDMMYVRVLVWPVVQG

SEQ ID NO: 207448 - protein, 91 aa, Glycine max
  Coding DNA Sequence Number=SeqID_90670
MSEKEKNNGRGGTRGKRNRRLQIEALHVCVSVLESDEEEKPTMTLMSAKTTKMPASVGPSYPFPFDPKPFTHLLFFEDKYPQNMRKNQIII

SEQ ID NO: 207449 - protein, 111 aa, Glycine max
  Coding DNA Sequence Number=SeqID_90671
  Subcellular localization annotation: CTP_CleavageSite=62; ConfidenceScore=5.38e-01
VKKRLNFELQKVVVGLSSTDGLSAYPSLSTASARLVHSAKLNSRLALSPNPLLALSARVALSAASRFQSLFKAYLVQNYGTPFVTTSTERPGHKIPEQPQCLFGEKSPRSK

SEQ ID NO: 207450 - protein, 63 aa, Glycine max
  Coding DNA Sequence Number=SeqID_90672
MRQSKNQTTLDQHKFNQQQLYPAKSFCKESCKTRKGKHHIVRQDNHNNYFKNAKMGIHLQDNE

SEQ ID NO: 207451 - protein, 45 aa, Glycine max
  Coding DNA Sequence Number=SeqID_90673
MQDSGSLEAKEAKAYALLRAIKGAQELNISKNKDDSYSKLNGEFS

SEQ ID NO: 207452 - protein, 1052 aa, Glycine max
  Coding DNA Sequence Number=SeqID_90674
  Homolog annotation: Hit_ID=Q9LI74; Match level="QueryCoverage=97%, HitCoverage=98%, E-value=0.0, Identity=60%"; Hit description =Similarity to pherophorin
GGSYGLRHLLWRFWEMGGGLGLIVAASLAAFTVKQLNVKSSKPELKDECTEEEHVLQENERVEEEEKEEVKLISSIINRANDFEDDILPEFEDLLSGEIEFPLPPDKDEKDKVYEIEMANNASELERLRQLVKELEEREVKLEGELLEYYGLKEQESDIVELQRQLKIKTVEIDMLNITINSLQAERKKLQEELTQGASAKKELEVARNKIKELQRQIQLEANQTKGQLLLLKQQVSTLLVKEEEAARKDAEVEKKLKAVNDLEVAVVELKRKNKELQHEKRELTVKLNVAESRAAELSNMTESEMVAKAKEEVSNLRHANEDLLKQVEGLQMNRFSEVEELVYLRWVNACLRYELRNNQTPQGKVSARDLSKSLSPKSQEKAKQLMLEYAGSERGQGDTDLESNFSHPSSPGSEDFDNASIDSSTSKYSSLSKKTSLIQKFKKWGKSKDDSSALSSPARSFSGGSPRRMSVSVKQRGPLESLMLRNASDSVSITSFGLRDQEPTDSPETPNDMRRVPSSDSLNSVASSFQLMSKSVDGSLDEKYPAYKDRHKLALAREKQLKEKAEKARVLRFGDNSGLNMTKAERGSPISLPPKLTQIKEKPVVSGTPNDQSDDGKNVDNQTISKMKLAHIEKRPTRVPRPPPRPSGGAAVTATANPSNGVPSAPPPPPPPPGAPPPPPPPPGGPPPPPPPPGSLSRGGMDGDKVHRAPQLVEFYQTLMKREAKKDTSSLLVTSASNASDARSNMIGEIENRSSFLLAVKADVETQGDFVMSLAAEVRAASFSDINDLVAFVNWLDEELSFLVDERAVLKHFDWPEGKADALREAAFEYQDLMKLENRVSTFVDDPNLPCEAALKKMYSLLEKVEQSVYALLRTRDMAISRYKEFGIPVNWLMDSGVVGKGHAVLRECSNHGIGTGLQEHSNRMTPKAYTLKSPSGPLPPDSAIVAFLVLSRAPPPIALLGFLCEEERGTELSSVQLAKKYMKRVASELDELSGPDKEPAREFLVLQGVRFAFRVHQFAGGFDAESMKAFEELRSRIQTSQAGEDSKSET

SEQ ID NO: 207453 - protein, 321 aa, Glycine max
  Coding DNA Sequence Number=SeqID_90675
  Gene Ontology: Mol. function=protein binding; Cellular component =nucleus; Biological process=carbohydrate metabolic process
  Homolog annotation: Hit_ID=Q6Z6T3; Match level="QueryCoverage=76%, HitCoverage=79%, E-value=1e-115, Identity=80%"; Hit description =Nuclear protein-like
  Pfam annotation: Domain name=DUF572; Domain location=11-293; Score =190.3; E_value=4.5e-54; Accession=PF04502.3; Description=Family of unknown function (DUF572)
MSSLAAARADNFYYPPEWEPSQGSLNKFHGQHALRERARKLDQGILIIRFEMPFNIWCGGCNSMIAKGVRFNAEKKQVGNYYSTKIWSFAMKSACCKHEIVIQTNPKNCEYVIISGAQKKTEDFDIEDAETFELPADEERGKLADPFYRLEHQEEDLKKKKEAEPVIVRLQRQSDARHSDDYYLNKTLRAQLRSQKKRVTEEENASKKRGLGIRLLPATEQDSATAKSVKFSAKFDKNRKDKRALISSESIFSGVSSYSMSDKRKRELESKRRKICATSASSLLAGRVKPSSWSQPSSKQKGTELRLMAGTVIIVEQIEES

SEQ ID NO: 207454 - protein, 124 aa, Glycine max
  Coding DNA Sequence Number=SeqID_90676
  Gene Ontology: Mol. function=DNA binding; Cellular component=beta -galactosidase complex; Biological process=DNA integration
  Homolog annotation: Hit_ID=Q1SD84; Match level="QueryCoverage=99%, HitCoverage=12%, E-value=1e-39, Identity=47%"; Hit description =Integrase, catalytic region
MEVVCSKRGIVVSQQKYILDLLEETGMSGCRPADTPIDPNGKLWEKGSVPVDIGRYQRYLKSNPGKGLFFKRNSDLEKNKKQGVVAKSSAEAKFRAMAQGICEGLWIYRVLEEVEMAIELPLKL

SEQ ID NO: 207455 - protein, 702 aa, Glycine max
  Coding DNA Sequence Number=SeqID_90677
  Gene Ontology: Mol. function=phosphatidylinositol phosphate kinase activity; Cellular component=plasma membrane; Biological process =phosphatidylinositol metabolic process
  Homolog annotation: Hit_ID=Q9LLS0; Match level="QueryCoverage=95%, HitCoverage=90%, E-value=0.0, Identity=69%"; Hit description =Putative phosphatidylinositol 4-phosphate 5-kinase
  Pfam annotation: Domain name=MORN; Domain location=106-128; Score =29.1; E_value=1.5e-05; Accession=PF02493.10; Description=MORN repeat
  Pfam annotation: Domain name=MORN; Domain location=129-151; Score =32.8; E_value=1.2e-06; Accession=PF02493.10; Description=MORN repeat
  Pfam annotation: Domain name=MORN; Domain location=152-174; Score =34.4; E_value=3.9e-07; Accession=PF02493.10; Description=MORN repeat
  Pfam annotation: Domain name=MORN; Domain location=175-197; Score =40.9; E_value=4.4e-09; Accession=PF02493.10; Description=MORN repeat
  Pfam annotation: Domain name=MORN; Domain location=37-59; Score=27.4; E_value=5e-05; Accession=PF02493.10; Description=MORN repeat
  Pfam annotation: Domain name=MORN; Domain location=60-82; Score=36.6; E_value=8.9e-08; Accession=PF02493.10; Description=MORN repeat
  Pfam annotation: Domain name=MORN; Domain location=83-105; Score =34.8; E_value=3.1e-07; Accession=PF02493.10; Description=MORN repeat
  Pfam annotation: Domain name=PIP5K; Domain location=392-698; Score =543.1; E_value=2.8e-160; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=106-128::129-151::152-174::175 -197::37-59::60-82::83-105::392-698
MRQALLLRDDTERDTYGWSRRVSPSIEVAELANGDVYMGSFSGNAPSGSGKYLWRDGCMYEGDWKKGKACGKGKFSWPSGATYQGQFKSGRMDGFGTFTGSDGDTYRGSWSSDRKHGYGQKRYANGDLYEGSWKRNVQEGEGRYVWKNGNEYYGEWKNGVIFGRGTLIWANGNRYDGQWENGVPKGQGVFTWPDGSCYVGCWNKDLKVNQLSGTFYPGSGDTLTVTMRKRSSVDGARGSAVKSFPRICIWESEGEAGDITCDIIDEVSLLYRDSSGTGSDRGDVKPFRRNPCLSGEVKRLGQTISKGHKNYDLMLNLQLGIRYSVGKEASISRELKPSDFDPKEKFWTRFPAEGSKITPPHQSVVFRWKDYCPMVFRQLRKLFQVDPADYMLAICGNDALRELSSPGKSGSFFYLTQDDRFMIKTVKKSEVKVLLRMLRSYYQHVSKYENSLVTKFYGVHCVKPIGGQKTRFIVMGNLFCSEYPIHRRFDLKGSSHGRTTDKTKEIDESTTLKDLDLNFVFRLQNNWFQDFIKQIERDCEFLEAEGIMDYSLLVGLHFRDDNTYEKMGLSPFLLRTGKWDSYQSEKFMRGYRFLEAELQDRDRVKSGRKSLIRLGANMPARAERMARRSDFDQYTPCCSGETYDVVIYCGIIDILQDYDISKKLEHAYKSLQVDPSSISAVDPKLYSKRFRDFVGRIFIEDW

SEQ ID NO: 207456 - protein, 523 aa, Glycine max
  Coding DNA Sequence Number=SeqID_90678
  Gene Ontology: Mol. function=ferrochelatase activity; Cellular component=chloroplast; Biological process=porphyrin biosynthetic process
  Homolog annotation: Hit_ID=P42044; Match level="QueryCoverage=75%, HitCoverage=77%, E-value=1e-163, Identity=74%"; Hit description =Ferrochelatase-2, chloroplast precursor
  Pfam annotation: Domain name=CbiK; Domain location=197-417; Score= -162.2; E_value=0.087; Accession=PF06180.2; Description=Cobalt chelatase (CbiK)
  Pfam annotation: Domain name=Ferrochelatase; Domain location=96-420; Score=617.0; E_value=1.6e-182; Accession=PF00762.10; Description =Ferrochelatase
  Pfam module annotation: Pfam domain module=CbiK::Ferrochelatase; Domain location=197-417::96-420
  Subcellular localization annotation: CTP_CleavageSite=58; ConfidenceScore=5.16e-01
MSTCSKHWLRIYHLFCSDIQNPGYVDCHSNCNKSTSQASLFLCSDSNSRRNGVFGRPLCVNPSGRRNLVGPAFYSLETSAYDVAALESPSRVAEEKVGVLLLNLGGPETLSDVQPFLFNLFADPDIIRLPRLFRFLQRPLAKLISVLRAPKSKEGYAAIGGGSPLRKITDDQALAIKMALEAKGISSNVYVGMRYWYPFTEEAIQQIKRDRITRLVVLPLYPQFSISTTGSSIRVLEHIFREDAYLSKLPVSIINSWYQREGYIKSMANLIQKELQSFSEPKEVMIFFSAHGVPVSYVEEAGDPYRDQMEECIFLIMQELKARGISNEHTLAYQSRVGPVQWLKPYTDEVLVELGQKGVKSLLAVPVSFVSEHIETLEEIDMEYKELALESGIKNWARVPALGVTPSFITDLADAVIEALPSATAIYAPTRTSEDVDHDPHRAIRKQFFALDYNENLHLGLKRIQRIIIVDQDLFRSQEALSPSPILNPEQINITPYDYAKCNFLSDMILAIVDKFYKYYFSR

SEQ ID NO: 207457 - protein, 71 aa, Glycine max
  Coding DNA Sequence Number=SeqID_90679
MLDYPNRWQVEVVKCKRHSADCYILFWGHANLLCIVPILSDVPEGTISDAVHLIINANIVYYDNRWRKQGS

SEQ ID NO: 207458 - protein, 133 aa, Glycine max
  Coding DNA Sequence Number=SeqID_90680
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q9SP38; Match level="QueryCoverage=61%, HitCoverage=38%, E-value=2e-41, Identity=97%"; Hit description=NADH ubiquinone oxidoreductase PSST subunit
MGNQSGGVDCNNQWWAVDGSKNPRKGIEGILAKSGSHLVGESASDDHAIRLARAGPENDAEAVEIVAGGAGVHHFDGAAGEAEGHGPDGAAPGPVHQIVNLRDHELRRLRHAGGRGSGRRRWRGIWGGRGCGC

SEQ ID NO: 207459 - protein, 208 aa, Glycine max
  Coding DNA Sequence Number=SeqID_90681
  Gene Ontology: Mol. function=RNA binding; Cellular component =cytoplasm; Biological process=regulation of translation
  Homolog annotation: Hit_ID=Q9T0G5; Match level="QueryCoverage=81%, HitCoverage=23%, E-value=1e-35, Identity=45%"; Hit description =Putative DNA-directed RNA polymerase
  Pfam annotation: Domain name=KH_1; Domain location=112-178; Score =80.5; E_value=5.3e-21; Accession=PF00013.19; Description=KH domain
  Pfam annotation: Domain name=KH_1; Domain location=23-85; Score=51.1; E_value=3.6e-12; Accession=PF00013.19; Description=KH domain
  Pfam annotation: Domain name=KH_2; Domain location=112-164; Score =14.1; E_value=0.0025; Accession=PF07650.7; Description=KH domain
  Pfam module annotation: Pfam domain module=KH_1::KH_1::KH_2; Domain location=112-178::23-85::112-164
MAEDYAPLKRKYEDQPSGIELAKQRANGRVGVIVGKGGETIKYLQLQSGAKIQITRDIDADPNSSTRMVELMGTPDAIASAEKLINEVLAEAESGGSGIVTRRLTGQAGSDEFVMKIPNNKVGLIIGKGGETIKNMQASTGARIQVILLHLPLGDTSTERTLKIDGTPEQIESAKQLVYQVISGEKSNNLECLIKIGEFMSMLYVIVR

SEQ ID NO: 207460 - protein, 375 aa, Glycine max
  Coding DNA Sequence Number=SeqID_90682
  Gene Ontology: Mol. function=RNA binding
  Homolog annotation: Hit_ID=Q6Z8B6; Match level="QueryCoverage=91%, HitCoverage=86%, E-value=5e-21, Identity=36%"; Hit description=High molecular weight glutenin subunit x-like protein
MSGGYPQQGYQSRPPSDWAPPAPMQQAGYGYVQPGAYSGPSPHNLVDIPPIGTSLLHHLHQQSTHGGGYDYYSQQPQQPQNPGGTAPPADGSAYNYSQPPSSGCNQSGQQGSAQDSYNAYNAQSHSGYGQPPTFDQQQGYGPATGYGSGSNPAQEGHTANYAARGDSAQAPSAQPTTVVQQGYPTNQQPSSNTVNYSLQGTPQPGYGVPPTSQAAYGNQPQPGYGTPQSQKPTGNPPVYGESQFPSAGGGYDQSAYPVQPPPSGYAQPESGSQRAPASGYGGAVQPGYGHQIYGAPQGGQPGYGQASPSYSNSSFGAGYTHTLEYTGDGDGNAQAPHSAVAKASPKSLYFCHPSPPLLIDYFYCLSPFIVPVTPM

SEQ ID NO: 207461 - protein, 61 aa, Glycine max
  Coding DNA Sequence Number=SeqID_90683
MLDQSGGKSCISVEKEWSLEACKDLEARVMLLGWDVDRAGFLGKRRVGYRESHGGTISIYK

SEQ ID NO: 207462 - protein, 134 aa, Glycine max
  Coding DNA Sequence Number=SeqID_90684
MHILIIREHKKEWSLWKLFNPKWYRIQVGSKILSDRSFSPYTSTIALSLSIGSSKLPNFGNPPFRAAEGCRSGHEGALKGYESGRESSGHVGGGNTCAGNKDIEESKFSDAYGDEEGQRHMVKMRLVKVKRIEV

SEQ ID NO: 207463 - protein, 51 aa, Glycine max
  Coding DNA Sequence Number=SeqID_90685
MVKPKVPTKHGEKELRQPHNLSVKQETWGTECTLSSMESWKYMTRVLLPVD

SEQ ID NO: 207464 - protein, 88 aa, Glycine max
  Coding DNA Sequence Number=SeqID_90686
MLHRCGIDTGLKKHSNPYIILQISTVGMPKMSFEGGAIFQDDPMVNKSEIVVLLGKVWVYAGKNEDFGRRRRKNEFGRKRKRRNISLM

SEQ ID NO: 207465 - protein, 83 aa, Glycine max
  Coding DNA Sequence Number=SeqID_90687
MKAFEVWRTSTLVEVFLAILLVFSRHLQPLMVVKGEVFPHPTVGTKCSYQVWQNLLMVVILRELLHEQGWGTSKVTSTLKSKV

SEQ ID NO: 207466 - protein, 573 aa, Glycine max
  Coding DNA Sequence Number=SeqID_90688
  Gene Ontology: Mol. function=sequence-specific DNA binding; Cellular component=nucleus; Biological process=regulation of transcription, DNA-dependent
  Homolog annotation: Hit_ID=P48731; Match level="QueryCoverage=54%, HitCoverage=62%, E-value=2e-68, Identity=50%"; Hit description =Homeobox protein ATH1
  Pfam annotation: Domain name=Homeobox; Domain location=473-531; Score= -3.2; E_value=0.011; Accession=PF00046.19; Description=Homeobox domain
  Pfam annotation: Domain name=POX; Domain location=290-430; Score =75.3; E_value=2e-19; Accession=PF07526.2; Description=Associated with HOX
  Pfam module annotation: Pfam domain module=Homeobox::POX; Domain location=473-531::290-430
MESDMYTAALGISGRDARVIDEISQHSTSNPLVQCYSLDLNNQSHIINGISMLSGEQGEPINNVHGDACFINPSIIADSSPLVTSQGKTIVGDASSPMENTEFQEHLVGGMSITPSSLVAILAARIGFEENLENSSSALPPSLCSIGALGAFFNNLQGTSNSNPLSATFEDCGYNEVPGNWNANKFPKAPEIHGTGCQPYSSLANLDPNEWTSSNLANMANHANHSSSFSKELSLSLATSTTTGQCSEVSCSNVTPCMNGTMSGLEQAFCGSSRELSMNLGGDKYVQFSPKVLESRYLIGIREILAQIARYSFENLEQLNYSASGNRSGGNKSSSAFPPKRRILIDNNANSTYEAHAEPPLQRHAAESKKAQLLALLQLADNRYSQCLDEIHTVVSAFHAATELDPQIHAHFALQTISILYKDLRERISNYILAMGSNFNNSCSEENEWSAETSFLQKQWALQQLNRKDQLWRPQRGLPERSVWVLRAWMFQNFLHPYPKDAEKHLLAVKSGLTRSQVSNWFINARVRLWKPMIEEMYAEMNKRKACRNEEGMQSNHGNRISMSNQRFNQCQL

SEQ ID NO: 207467 - protein, 296 aa, Glycine max
  Coding DNA Sequence Number=SeqID_90689
  Gene Ontology: Mol. function=molecular_function; Cellular component =cellular_component; Biological process=cell differentiation
  Homolog annotation: Hit_ID=Q2XP03; Match level="QueryCoverage=94%, HitCoverage=88%, E-value=1e-106, Identity=70%"; Hit description =SF21D2 splice variant protein
  Pfam annotation: Domain name=Ndr; Domain location=1-254; Score=251.0; E_value=2.5e-72; Accession=PF03096.5; Description=Ndr family
MADSVSVDMEAISPPPELGAAAIDPDDPILSADDLVDQIAEVLNYFGHSTVMCMGVTAGAYILTLFAMKYRHRVLGLILVSPLCKAPSWTEWLYNKVMSNLLYFYGMCGVVKEILLKRYFSKEVRGSDYLPESDIVQACQRSLDERQSLNVWRFLEAINGVEFSAGYQLLPETSMPSMRYDISEGLRKLECRSLIFVGDMSCFHGEALHMTSKLDRRLSALVEVQACGSMVTEEQPHAMLIPMEYFLMGYGLYRPSKLSVSPRSPLSPSCISPELYSPESMGLKLKPIKTRISEEI

SEQ ID NO: 207468 - protein, 78 aa, Glycine max
  Coding DNA Sequence Number=SeqID_90690
MESERNPGEERGIPGTGILREMHHAPLPELFIVRLGSLNSQGRTQQNPWPGLHTQRGKDLLGFSSVKILLEVQEAEKK

SEQ ID NO: 207469 - protein, 183 aa, Glycine max
  Coding DNA Sequence Number=SeqID_90691
  Gene Ontology: Biological process=response to biotic stimulus
  Homolog annotation: Hit_ID=Q6H5Z4; Match level="QueryCoverage=93%, HitCoverage=87%, E-value=6e-59, Identity=62%"; Hit description=Bet v I allergen-like
MLEVARKCGSSHSDLAEFLKVKFDDSVNKHLSIDTGVSFGYVDDVRFQNNGVNLTVVGVLELVDGGDGAVVVEAVFAADDAEAEEVLVVVEDLEALGAGGGGEARHDGDLADAADAAVAGAHVAALDEVLVLLRVLEAPDEGPHRVCRRVDALRYDGAADFRGRFELVVRVDDAFEFREFLWG

SEQ ID NO: 207470 - protein, 225 aa, Glycine max
  Coding DNA Sequence Number=SeqID_90692
  Gene Ontology: Mol. function=nucleic acid binding; Cellular component= nucleus; Biological process=regulation of transcription
  Homolog annotation: Hit_ID=Q1SX77; Match level="QueryCoverage=96%, HitCoverage=98%, E-value=1e-46, Identity=46%"; Hit description=Myb -like DNA-binding region, SHAQKYF class
  Pfam annotation: Domain name=Myb_DNA-binding; Domain location=111 -158; Score=51.0; E_value=3.9e-12; Accession=PF00249.21; Description =Myb-like DNA-binding domain
  Pfam annotation: Domain name=zf-CCHC; Domain location=5-22; Score =19.0; E_value=0.00073; Accession=PF00098.13; Description=Zinc knuckle
  Pfam module annotation: Pfam domain module=Myb_DNA-binding::zf-CCHC; Domain location=111-158::5-22
  Subcellular localization annotation: CTP_CleavageSite=20; ConfidenceScore=5.61e-01
MGIARKCSYCGNLGHNARTCKSTLSQGQLKLFGVQLDVSSFSSSSNSFSSSPSYSAMKRSFSTNYLLSSWPSSSVPSSFSSPSLLGANENLDGYLLNANSLISTIQDAKKGVPWTEEEHQIFLIGLEKLGKGNWRGISRSFVTTRTPTQVASHAQKYYLRQSQNSFNKRKHRPSLLDNWLSLRPHSVLNWATTSTSTNCTVQRANPDLDLKLATPTPFELPVADT

SEQ ID NO: 207471 - protein, 227 aa, Glycine max
  Coding DNA Sequence Number=SeqID_90693
  Gene Ontology: Mol. function=metal ion transporter activity; Cellular component=integral to membrane; Biological process=metal ion transport
  Homolog annotation: Hit_ID=O04089; Match level="QueryCoverage=98%, HitCoverage=57%, E-value=8e-58, Identity=63%"; Hit description=Zinc transporter 4, chloroplast precursor
  Pfam annotation: Domain name=Zip; Domain location=21-224; Score=47.1; E_value=6.1e-11; Accession=PF02535.12; Description=ZIP Zinc transporter
MGRCLGKKKAVECTSWGCMHMLHIIDITILMAIMHVMALATSRNTPTPTPTSKKEKKLTFDTSSFLSGDNITGVCAGVGAWDCITFGYNWVVFRSFAKSLYIRPLIAALSFHQFFEGFALGGCISQAQFKASSATIMAWFFALTTPLGVGIGTAISSGYNPYSPGALITQGILDSSSSGILVYMALVDLIAADFLSKRMSCNFRLQILSYCMLFIGAGLMSSLAIWA

SEQ ID NO: 207472 - protein, 712 aa, Glycine max
  Coding DNA Sequence Number=SeqID_90694
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=P26969; Match level="QueryCoverage=99%, HitCoverage=66%, E-value=0.0, Identity=88%"; Hit description=Glycine dehydrogenase [decarboxylating], mitochondrial precursor
  Pfam annotation: Domain name=GDC-P; Domain location=1-181; Score =80.4; E_value=4.9e-21; Accession=PF02347.6; Description=Glycine cleavage system P-protein
MGVDIVVGSAQRFGVPMGYGGPHAAFLATSQEYKRMMPGRIIGVSVDSSGKPALRMAMQTREQHIRRDKATSNICTAQALLANMAAMYAVYHGPEGLKTIAQRVHGLAGVFAQGLKKLGTVEVQDHPFFDTVKIRTANAHAIADAACKNEINLRVVDGNTITVAFDETTTLEDVDNLFKVFSNGKPVSFTAASLAPEVQTALPSGLTRKSPYLTHPIFNTYHTEHELLRYIHRLQSKDLSLCHSMIPLGSCTMKLNATTEMMPVTWPSFANIHPFAPIEQAQGYQEMFENLGKLLCTITGFDSFSLQPNAGAAGEYAGLMVIRAYHLARGDHHRNVCIIPVSAHGTNPASAAMCAMKIVSVGTDAKGNINIDELRKAAETHKDNLAALMVTYPSTHGVYEEGIDEICKIIHDNGGQVYMDGANMNAQVGLTSPGWIGADVCHLNLHKTFCIPHGGGGPGMGPIGVKKHLAPFLPSHPVVPTGGIPAPGKSQPLGTISAAPWGSALILPISYSYIAMMGSKGLTEASKTAILNANYMAKRLENHYPVLFRGVNGTVAHEFIIDLRGFKNTAGIEPEDVAKRLMDYGFHSPTMSFPVPGTLMIEPTESESKAELDRFCDALISIRQEIAEIEKGKADINNNVLKCAPHPPSVLMGDAWTKPYSREYAAFPASWLRVSKFWPSTGRIDNVYGDRNLVCTLLPTSQVVEEQAAATA

SEQ ID NO: 207473 - protein, 322 aa, Glycine max
  Coding DNA Sequence Number=SeqID_90695
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=P49361; Match level="QueryCoverage=92%, HitCoverage=33%, E-value=3e-73, Identity=47%"; Hit description =Glycine dehydrogenase [decarboxylating] A, mitochondrial precursor
MRMHEPEGLENIAQRVHGLAGVFAQGLKKLGTVEVVDVNIVSVAFCCIISAEYVFLSLEYGAWLLFRSLLRSMKQPPGRMLIIFSMFFSEGKPVSFTAESLAPESKDLSLCHSMIPKLNATEMMPLTWPSFANIHPFAPTEQAQGYQEMFENLGKMLCTITGFDFFSLQPNAGASGEYVGLMIIHAYHLARGDHHHNVCIIPVSAHGTNPASVNIEELGKTLRTTYLHLWYNLLPILEFYLHYLDNLGIWKGGVTYPSTRGVYEEGIDEICKIIHDNGEPEDVVKSLMDYGFNNPTVSFPVPGTFKIETVLKVFKYITYASN

SEQ ID NO: 207474 - protein, 189 aa, Glycine max
  Coding DNA Sequence Number=SeqID_90696
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=P49361; Match level="QueryCoverage=75%, HitCoverage=14%, E-value=4e-34, Identity=56%"; Hit description =Glycine dehydrogenase [decarboxylating] A, mitochondrial precursor
MYDLKHLFFDAKLFMCDDISDSVSPSLKTLNDMSFRRIDFGTVASMRESRLSKPHVWAILLCSSEVAELWRRGNVSLGLSASSEMNRDGTLCESFRLFPIGFSGLGNEKEWEIDEREREWELTLAEEISLLRIALFASLRARSMNANVEKEKSGISKLTELEEGFNLISEWWVRMRQDAEAGYKNIGRS

SEQ ID NO: 207475 - protein, 98 aa, Glycine max
  Coding DNA Sequence Number=SeqID_90697
  Homolog annotation: Hit_ID=Q7XTK4; Match level="QueryCoverage=49%, HitCoverage=8%, E-value=2e-16, Identity=85%"; Hit description =Putative mitogen-activated protein kinase 1
MLVGQRSAEKEHDDNHPLFCVSDGFFFAVKEVSLLDQGTQGKQSVYQLEQEIALLSQFEHDNIVQYYGTEMIWKLPITFYNVYNISGMFVVKSQGMMS

SEQ ID NO: 207476 - protein, 158 aa, Glycine max
  Coding DNA Sequence Number=SeqID_90698
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9CA16; Match level="QueryCoverage=92%, HitCoverage=59%, E-value=1e-20, Identity=31%"; Hit description =Putative endo-1,3-beta-glucanase; 56885-55794
  Pfam annotation: Domain name=Glyco_hydro_17; Domain location=1-152; Score=-118.5; E_value=0.00026; Accession=PF00332.9; Description =Glycosyl hydrolases family 17
MAQDQNAANTWVQTNVIPYIKDVNFGYIIIGDEITPGPVAPYVAKAGTFINETTNIIKQIATILLQHGSPVMINSYPYLAYSSDPQHVSLDYALFKSTSPVVTDDGGYNARYEPYTSKLNAQVYNKNSVQRVIGGKGNSRRPGVELIYWILVQMIKLI

SEQ ID NO: 207477 - protein, 234 aa, Glycine max
  Coding DNA Sequence Number=SeqID_90699
  Gene Ontology: Mol. function=sequence-specific DNA binding; Cellular component=nucleus; Biological process=regulation of transcription, DNA-dependent
  Homolog annotation: Hit_ID=Q9SZI6; Match level="QueryCoverage=73%, HitCoverage=57%, E-value=2e-23, Identity=40%"; Hit description =Putative GATA transcription factor 20
  Pfam annotation: Domain name=GATA; Domain location=97-132; Score =71.8; E_value=2.2e-18; Accession=PF00320.17; Description=GATA zinc finger
MDGKLVFHIGPSNNNNQVCNSSSVKLQPKPVKADSSSECGHHNVSLYKIEDEENKRDHDYEKWMSSTARLTRKMMRLPSTSSDLATKKALNNITRVCADCNTTSTPLWRSGPNGPKSLCNACGIRQRKARRAMAEAVNGFAPSVNSSSTKIRVHHKEKKSRTNHFARFRLKCKLATTSTAEGTSQQENVKIDLNDFGLSLRDSSALKQQVFPIMDEVAQAAMLLMDLSCGFVYC

SEQ ID NO: 207478 - protein, 287 aa, Glycine max
  Coding DNA Sequence Number=SeqID_90700
  Homolog annotation: Hit_ID=Q5JMS6; Match level="QueryCoverage=82%, HitCoverage=87%, E-value=1e-42, Identity=38%"; Hit description =Membrane protein-like
MGLGWVAKPNNQQCRRWTTIRIWGATFICCMCLIFFTPRIPRSPKHHQFVDMRNLLDSPGVPNTLNVMTNFPFLVVGVLGLVLALEEGVFNISSQGEVWTWALFYAGIAGVAFGSAYYHLKPDDHRVLWDTLPMMVAFSSLLSSLVVERLGQRIGLCCMFALNLAAFLCVIYERIYNDVRFCMMFQLTLPLAIPVIAVLYRSKYTHSRYWFFSTEKENMKWAFFGTLVLSTDPDFTQRNAHQQGTKVSKVAIEDSRFTLTKVKARVGALDAHLAKYMLPSHAVALSF

SEQ ID NO: 207479 - protein, 545 aa, Glycine max
  Coding DNA Sequence Number=SeqID_90701
  Gene Ontology: Cellular component=chloroplast thylakoid membrane
  Homolog annotation: Hit_ID=Q9FF91; Match level="QueryCoverage=73%, HitCoverage=41%, E-value=3e-58, Identity=31%"; Hit description =Arabidopsis thaliana genomic DNA, chromosome 5, P1 clone:MRO11
  Pfam annotation: Domain name=SLH; Domain location=218-275; Score =12.8; E_value=0.021; Accession=PF00395.10; Description=S-layer homology domain
  Subcellular localization annotation: CTP_CleavageSite=27; ConfidenceScore=5.09e-01
MWSATSSPSIFLPHSLLRPLPRRRPLCASLSWASPDPSDGLGGWALLDAPAQPDNNKVAAFPSYAVVGFGTSLALVLAVFAASRKGFSFRFPRPMWGAVETRRDQNDAPEFDVSSGSKSTLSEADPESNVTVTQADKSVAVEKPERVVIPVSVDSTQEEALSVLKSLKIIEDDVEANELCTRREFARWLVKSNSSLERSPKHMIAPIVSLSGSVVTAFDDVGIDDPDFRSIQVLAEAGVIPSKLSWNNSFNYGGSDSQENINFYPDRFISRQDLIDWRAQLEYDFFSGVVDELLIPDIFTVQISIKKAGYMDVKEITSPAVYVDMLAGDTSILRKVFGQSKRFQPNKPSTKAQAAVALTSGRMKEAISAELSRIEAENSARLAEAGEIWSELLSRGEIQRFWDEKLIEEKNRGFDVERLYHVEVKNLEEEEINQDKISAEYLKEKATMDCQKQLLLNLKKEVDEISEKVASERVTYVDERDVVQKLHEDLEFKHEELLNTKSTLEAEKEALQILRSWVEDEARRSQARAAVLEEVGRRWKWDDQA

SEQ ID NO: 207480 - protein, 122 aa, Glycine max
  Coding DNA Sequence Number=SeqID_90702
RELIRRNWHKQLTNLTGGSIDVTIVKEFYANLYVPDDKFPKQVRVRGNLIKFDVDSLNTFLETPVVVEQGESLPFYSRFAKLRPDPQELAARLCIPGRGFVLNVEGLPWKLLRKYLTTLAQT

SEQ ID NO: 207481 - protein, 171 aa, Glycine max
  Coding DNA Sequence Number=SeqID_90703
  Gene Ontology: Mol. function=RNA-directed DNA polymerase activity; Biological process=electron transport
MREFEVEGDWNLVWNLHIPPKVRVFLWKACRDYLSTRIRLQNRAQVTLVEWKSSQNVNSTRIQEVMQQPLSDWIKPPEGFMNCNIDATFFMEHGLAGFGAFIRENLGQFVLARIGCMEVVMSVREGEAFAILQSLLWNIDLQLFSVIIETDCKFIADQEDILECGGNSQSH

SEQ ID NO: 207482 - protein, 244 aa, Glycine max
  Coding DNA Sequence Number=SeqID_90704
  Gene Ontology: Mol. function=nucleoside-triphosphatase activity; Cellular component=membrane; Biological process=protein catabolic process
  Homolog annotation: Hit_ID=Q1SX89; Match level="QueryCoverage=86%, HitCoverage=30%, E-value=3e-79, Identity=73%"; Hit description=DNA repair protein RadA; Peptidase M41, FtsH
  Pfam annotation: Domain name=Peptidase_M41; Domain location=12-198; Score=251.6; E_value=1.7e-72; Accession=PF01434.8; Description =Peptidase family M41
MELQLLSLNNRSEHKSAIISEENRRITGFHEGGHALVAMHTAGALPVHKATVVPRGSALGMVTQLPDKDQTSISCKQMLAYLDVSMGSRVDEELIFGESEVTSGLSSDISHATNLARKMVTRYGMSNKVGLVTHDYNDNGKSMSSETRLLIENEEKRLLERAYINAKTILSTHDKELRAIANAFPEHETLAGNQIKALLEKVRSKQQQHQKTIESQSSSLSNPIASSTAAAAASKAQGATPVGS

SEQ ID NO: 207483 - protein, 93 aa, Glycine max
  Coding DNA Sequence Number=SeqID_90705
  Gene Ontology: Mol. function=nucleic acid binding
  Homolog annotation: Hit_ID=Q1SIY6; Match level="QueryCoverage=98%, HitCoverage=8%, E-value=5e-29, Identity=73%"; Hit description =Integrase, catalytic region; Zinc finger, CCHC-type
MKEFETIKGYLDRLLGIANKVRLLGITFANSIIVEKIMVMVPERYEASITNLEIIKDLSKISLIEVIHALQSQDQRRLMRDESIVEGTLLVKH

SEQ ID NO: 207484 - protein, 269 aa, Glycine max
  Coding DNA Sequence Number=SeqID_90706
  Homolog annotation: Hit_ID=Q1SX88; Match level="QueryCoverage=91%, HitCoverage=94%, E-value=1e-101, Identity=74%"; Hit description =Heavy metal transport/detoxification protein; Harpin-induced 1
MLGRSRGSIKHRCIEENETQRSGELPDLDSKIHLTLGVDDGGHRRRLAGGNGSSDSVAGDSNSDLLALEPIHLHLHLGVHLNLHGETSLHLQPRSQASQRVRVQILRPRQHRAEARLVVLVRSKRRNGTVPDGDGVREHRHGERVVEEDEVVVRVLRDESEVEERGEVGRGVGGSGEVHLRNAEVCDGEFGTVRAVEYVKCGADNGGEESHREEGEDGPEAAAAAEVAVGALAATVVVRLRPVNLTVGVVELRLNGSGIAVSGGRGVSV

SEQ ID NO: 207485 - protein, 83 aa, Glycine max
  Coding DNA Sequence Number=SeqID_90707
  Homolog annotation: Hit_ID=Q1XA87; Match level="QueryCoverage=57%, HitCoverage=36%, E-value=7e-12, Identity=69%"; Hit description=Salt tolerant protein
MDLLELWAIFGPGVAGAVFGAGWWIWLDAVVCSTVTVPFLHYLPGIFASLAALMFNCVRKEDIDYSPYDEGEWSEFMFPQLVG

SEQ ID NO: 207486 - protein, 535 aa, Glycine max
  Coding DNA Sequence Number=SeqID_90708
  Gene Ontology: Mol. function=zinc ion binding
  Homolog annotation: Hit_ID=Q0WNG8; Match level="QueryCoverage=70%, HitCoverage=84%, E-value=1e-78, Identity=42%"; Hit description =Putative phorbol ester / diacylglycerol binding protein
  Pfam annotation: Domain name=PHD; Domain location=284-333; Score =36.8; E_value=7.6e-08; Accession=PF00628.19; Description=PHD-finger
MTGDRCHPWEGMVEVGDAAAVERRCEANFPAEIPRNSAAVREIDYLSQARKALAERSPFDVAEETSTSAAAVTLPGGLASLLNRQGDNRRRLKKSHSGANKRKSSNRANQKKPEDSNIWTETEEYFRDLTLADIDTLFEASRTSSLVSQDCFTIPCLGNAPRHNAVTSNSGNEMEPVPKFNVVVSSEDGEKGEDENKDGEAVESEDELLVIEAIDDVAVEQAPPQDDKSQDISDSSVSLEWFLGCRNRVSLTSERPTKKRRLLGVEAGLEKVVMTCPFDEGQLFCHYCGRGDTGRDSNRLIVCASCKVAVHRKCYGVHDDIDEAWLCSWCKQKVDVDVSVNPCVLCPMKGGALKPVNSSAEGVGSVPFVHLFCSLWMPEVYIDDLKKMEPVMNVGEIKETRKKLVCSVCKAKCGACVRCSHVFHWLLRVEHNTPSFPSFETGYEIIGSCRASFHPLCAREARHRMEVWAKYGNDNVELRAFCLKHSALPENRSIFPLEGSIAVRNDISEAKGFPVTLPLSGEQNLKDLQESRISL

SEQ ID NO: 207487 - protein, 53 aa, Glycine max
  Coding DNA Sequence Number=SeqID_90709
MSQWHQFRMVELTSCSSSDPKNGNIGEDTSHAGTGHGVFTNHGYNFALVRNDK

SEQ ID NO: 207488 - protein, 66 aa, Glycine max
  Coding DNA Sequence Number=SeqID_90710
MAFTRKKMDRVEDEKNKGVLGFGNENEGQSEREKGRLNTSRLSLPFPVINYIASEKLRKLSGSRNN

SEQ ID NO: 207489 - protein, 32 aa, Glycine max
  Coding DNA Sequence Number=SeqID_90711
MGNRQSNWRVPTARRQGAGTQRSRKAAVVQSF

SEQ ID NO: 207490 - protein, 103 aa, Glycine max
  Coding DNA Sequence Number=SeqID_90712
  Gene Ontology: Cellular component=chloroplast thylakoid membrane
  Homolog annotation: Hit_ID=Q69VD1; Match level="QueryCoverage=68%, HitCoverage=18%, E-value=2e-19, Identity=67%"; Hit description=SOUL heme-binding protein-like
LPNPNQETARLRKVEGGIVAIMKFSGKPTEDIVREKEKTLRANIIKDGLKPQPGCLLARYNDPGRTWTFIMVDHEIQDGISLKIPYYVPLDVYLYFYFPSESR

SEQ ID NO: 207491 - protein, 99 aa, Glycine max
  Coding DNA Sequence Number=SeqID_90713
  Subcellular localization annotation: CTP_CleavageSite=44; ConfidenceScore=5.25e-01
MTLKAVDSHSSFVVFCTSSLLVQIMNSGYTNGSVKVLSQYMKVKSVIVWCLRTIPKSIFKKLPPTSLLEYKYKVKSYHRVKMKNLNIIFRDLVEQKEVE

SEQ ID NO: 207492 - protein, 207 aa, Glycine max
  Coding DNA Sequence Number=SeqID_90714
  Gene Ontology: Mol. function=zinc ion binding
  Homolog annotation: Hit_ID=Q69T47; Match level="QueryCoverage=66%, HitCoverage=13%, E-value=2e-11, Identity=28%"; Hit description=PHD finger protein-like
MEFFFTIWQLIDKINGMNLTKSEDIFHEVQGNASGCVSEDKSTACLQNASVLSDHCVVHSASEPPDFGFIKKDAISSYIHPYINKKLLQIRDGVPLEDIICSSDEGNSSLVESFGGSACSSTQNQNLTQVDFSKPDEVNMEQLVRAIKMGLFEFSPQDELEGELVYFQHRLLQNAVAKKRHIDNLIYSVAKSLPHEIDKAHQQRWDE

SEQ ID NO: 207493 - protein, 83 aa, Glycine max
  Coding DNA Sequence Number=SeqID_90715
MKTRARGHAIYRCLGTPDILGVKRKAGSPRLGIVANNIKPPRKLMPRLIPIDWTLTREDPSLITRPTKKCLNEETVNGNASRE

SEQ ID NO: 207494 - protein, 135 aa, Glycine max
  Coding DNA Sequence Number=SeqID_90716
  Gene Ontology: Mol. function=zinc ion binding
MDTDPKLDDDCSTSQSRYNHKILDRSPFSGKKVPQRAAASRNISDEGGWRSKSRKHSETFGKELVMTSDEASMKNSMLPKGYAYVPADCLSNEKHSNEDVYASEPVEHDSLSNSERDRARYQIHRAYKLYLTPTS

SEQ ID NO: 207495 - protein, 400 aa, Glycine max
  Coding DNA Sequence Number=SeqID_90717
  Gene Ontology: Mol. function=zinc ion binding
  Homolog annotation: Hit_ID=Q9LT31; Match level="QueryCoverage=83%, HitCoverage=64%, E-value=1e-106, Identity=61%"; Hit description =Similarity to vacuolar protein sorting-associated protein VPS9
  Pfam annotation: Domain name=VPS9; Domain location=71-177; Score =137.3; E_value=4.1e-38; Accession=PF02204.8; Description=Vacuolar sorting protein 9 (VPS9) domain
MVVIDRELNASSCTYGLEKYVMTKLFARVFASLPDDVKFDDQLSEKMALIQQFIRPENLDIKPAFQNESSWLLAQKELQKINMYKAPRDKLVCILNCCRVISNLLLNASVASRENPPGADEFLPVLIYVTIKANPPQLHSNLLYIQRFRHQSRLVAEAAYYFTNMLSAESFISNIDAKAISMDEAEFEGNMEFARAMLSGISADTQDPGSPYQNNGHHTRAEPTKHKALIDHNDPALRTPSSVVKSESKKVTFADESLITKVPSLSDLENKGASMILKEDKLNAVFGEFPYLFASVGDLTVGDVEDLLNNYKQLVFKYVSLSKGLGISPTSLPPSNSQDNSEGHAEVDSSDGGPLDDNNKSEESIDTTEDSSDKVSLEERKIESGLPKDEPVAPEGDAPP

SEQ ID NO: 207496 - protein, 562 aa, Glycine max
  Coding DNA Sequence Number=SeqID_90718
  Gene Ontology: Mol. function=DNA binding; Cellular component=nucleus; Biological process=regulation of transcription, DNA-dependent
  Homolog annotation: Hit_ID=Q84WU6; Match level="QueryCoverage=94%, HitCoverage=90%, E-value=1e-124, Identity=46%"; Hit description =Auxin response factor 17
  Pfam annotation: Domain name=Auxin_resp; Domain location=278-361; Score=104.0; E_value=4.5e-28; Accession=PF06507.4; Description=Auxin response factor
  Pfam annotation: Domain name=B3; Domain location=122-227; Score =101.0; E_value=3.6e-27; Accession=PF02362.12; Description=B3 DNA binding domain
  Pfam module annotation: Pfam domain module=Auxin_resp::B3; Domain location=278-361::122-227
MPRQPPPSPPSQPGVLDPALWLVCAGTTVEIPTLHSRVYYFPQGHFDQASSAPRNLSPLLLSKPAVLCRVESVQFLADPLTDEVFAKLILHPVADCFASGPSAVAPAAASASAQTGENNVVSFSKVLTASDANNGGGFSVPRFCADSIFPPLNFQADPPVQNLLVTDVHGFVWEFRHIYRGTPRRHLLTTGWSTFVNNKKLVAGDVVVFMKNSGGGLFVGIRRATRFSMGKGGDRGGMRIRVDEEEEEEEEEEEEEEVREVFSRDGRGKLSAKVVAEAAELAARNMPFEVVYYPKERWSEFVVKTEAVNEAMKVAWSPGIRVKIAAETDDSSRVSWCQGTVSSVALHGNGQWRGSLWRMLQVTWDEPEGLQIAKWVSPWQVELVSTTPALHSAFPPIKRIKAAHDSGVFTNGERDPFPMTGFTNSTMGQLNQALLSYGTFPAGMQGARHDAFSASRFCNYPTDMSRLCMGNSFGKSTFPWLKTLETEVNVGSSQSDELSPDSRGSLQSCGTDLVGNSRKLGSVSFQLFGAVIQTEQPVENGLQGTGCTCTGDECQCQRALNS

SEQ ID NO: 207497 - protein, 335 aa, Glycine max
  Coding DNA Sequence Number=SeqID_90719
  Gene Ontology: Mol. function=glycine hydroxymethyltransferase activity; Cellular component=vacuole; Biological process=L-serine metabolic process
  Homolog annotation: Hit_ID=Q8RYY6; Match level="QueryCoverage=92%, HitCoverage=52%, E-value=1e-142, Identity=77%"; Hit description =Putative hydroxymethyltransferase
  Pfam annotation: Domain name=SHMT; Domain location=1-323; Score =501.1; E_value=1.3e-147; Accession=PF00464.10; Description=Serine hydroxymethyltransferase
MEALGSHLSNKYSEGMPGAKYYTGNQYIDEIEFLCCQRALLAFDLHPNNWGVNVQPYSCTSANFAVYTGILHPGDRIMGLDSPSGGHLSHGYYTLGGKKVSAASIFFETLPYKVNPQSGYIDYDKLEEKALDFRPKILICGGSSYPREWDYARFRQVADKCGAVLMCDMAHISGLVAAKEVASPFDYCDIVTSTTHKSLRGPRGGIIFYRRGAKPRKQGFVHNHGDDSNYDFEEKINFALYPSLQGGPHNNHIAALAIALKQVATPEYKAYMQQVKRNAQALASALLRRNFRLVTDGTDNHLLLWDLTALGLIVTSYYLVYWCLKMGNDSSTEVA

SEQ ID NO: 207498 - protein, 113 aa, Glycine max
  Coding DNA Sequence Number=SeqID_90720
  Gene Ontology: Mol. function=glycine hydroxymethyltransferase activity; Cellular component=vacuole; Biological process=L-serine metabolic process
  Homolog annotation: Hit_ID=Q8RYY6; Match level="QueryCoverage=95%, HitCoverage=18%, E-value=4e-39, Identity=69%"; Hit description =Putative hydroxymethyltransferase
MYVRVSIPNRNYEKVCEACRITLNKCAIYGSISPGGVRIGTPAMTSRGCLEEDFETIADFLRRAAQITSIVQREHGKSCKDFLKGLQNNKDISELRNRVETFSSQFAMPGFDI

SEQ ID NO: 207499 - protein, 96 aa, Glycine max
  Coding DNA Sequence Number=SeqID_90721
VPVPGIGVHDVDGQVAAAGGGGDRAHGRLAGDASARVSEVEGGHGGAERGVREKRVRVSGSGVGESGADNIVAQLDDFFDEIVEGRKRLLDFCSHR

SEQ ID NO: 207500 - protein, 58 aa, Glycine max
  Coding DNA Sequence Number=SeqID_90722
MLKGIAMGCNGAFTFTNERGYYNDDVGPMTKGVASMTMTNAIGSKGWGALSKEMRCFK

SEQ ID NO: 207501 - protein, 187 aa, Glycine max
  Coding DNA Sequence Number=SeqID_90723
MAAPSVPIPGKRGVAQKGRFLGVEMEAARGGSGGGGGDCDGDGLGHHHVWNWKKKGGAAAAEWMLIIMHHSVRSSLLLAAHPAFQFFSSSPTQIFFSLSSKVLAQKSLSSSNSPRQADGRCCHHEMVQSIVGIIGGRRIVAGGRCCRQGEGSVRWLKGVRFRYGVWDSTPQVYMFGYGCSWVDSSRF

SEQ ID NO: 207502 - protein, 657 aa, Glycine max
  Coding DNA Sequence Number=SeqID_90724
  Gene Ontology: Mol. function=nucleic acid binding; Biological process= ripening
  Homolog annotation: Hit_ID=Q40161; Match level="QueryCoverage=89%, HitCoverage=94%, E-value=1e-178, Identity=52%"; Hit description =Polygalacturonase-1 non-catalytic subunit beta precursor
  Pfam annotation: Domain name=BURP; Domain location=440-656; Score =345.2; E_value=1.1e-100; Accession=PF03181.6; Description=BURP domain
  Subcellular localization annotation: CTP_CleavageSite=71; ConfidenceScore=5.36e-01
MSGETTNLLSPGPNFSPLPTQHAHNFFRMSIHYFFCFFLSLSSFHVSLAIKGRILPQPQTTHELINPFSPKASLIRYWNTRVSNNNQIPHFLLSKASPLTPQNYAVLNKLLTNQKPRPNENLHHSLCSSPNLLCSFDDTPNAQTRKNDDANFALYNNKRFANYGSSRVGGVDSFKNYSNGLNANNDAFRRYSAASTRRGEQFNNYADNGNVANTNFSSYGSAANQTSGEFSNYDKTVNVPNLGFTTYDSGASNHKLSFSSYGNETNSGSQSFTSYGKRVRGGTSEFASYADDANILQSEFNSYGDLSTGASNDSFKFYSFNGNNPRHVFKSYAAGSASGVDNFISYRNRANVGDDSFQSYAARSKSGAATFANYGMSFNVGNDSFTEYGKGATGKTSFGFKSYGLGRGFKVYNKDGASFSEYRNFSAASGKVVNKRVEPGKFFRESTVREGNVIPMPDIKDKMPARSFLPLAIASKLPFSSSRIDEMREIFHAREGSSTERVMVNALKECEREPSKDETKRCVSSGEEMIGFAVSVLGPNVAVRSTENVNGSGSSVMIGKVYAIDGGKVTKSVSCHQSLYPYLLYYCHSVPKVRVYEAEILDVDTKEMINHGVAICHLDTSAWGPQHGAFLALGFGPGKIEVCHWIFENDMTWTTAN

SEQ ID NO: 207503 - protein, 564 aa, Glycine max
  Coding DNA Sequence Number=SeqID_90725
  Gene Ontology: Cellular component=chloroplast
  Homolog annotation: Hit_ID=Q93YW0; Match level="QueryCoverage=98%, HitCoverage=79%, E-value=4e-82, Identity=34%"; Hit description =EXECUTER1 protein, chloroplast precursor
MGFQLDDAIEKEDFEEAVKLKRALVEATSKDTVAEVMDQLKARAAQFSAIDDERYHDASRLCKCTGSGLNTPNGRSEWECSVDKVGWWVGYPKASDDPFGRIIHISPGMGRFIGKSYSPRQLMRASTGTPIFEIYVVKNADDTYHMQVVYLRQAKGKSRRNPQSVPAKGPSKPEVENASAVEVQEPEEKIERNDEKNTNIEGVTEEGIKSVINFLKEKIPGLKIKVMNVSVEEEAAENNDSIKQLMEEDSNKTGSSENHEEEVNNLDEPDAVTLERDGDATEEEKDLEMKLLIGGVVHNNEDTPVKDEFIRLPAEIKNMEKDSFVFHFDCGNVDYGIKEDKIPNIKVAALAAQGVSELMPPDVANAFWSSDKVSSKISKSMRDIVRVAMSQAQKRTKLSGDTNFSRIICSRGDSDPFDGLYVGAFGPYGMEIVHLRRKFGHWNEVDNENKTSDVGFFEYVEAVKLTGDLNVPAGLVTFRAKIGRGNRITNQGMYPDDLGVVASYKGQGRIADYGYRNPKWVEGELLQLNGKGMGPYMKGADLGFLYVVPEQSFLVLFHRLKLPE

SEQ ID NO: 207504 - protein, 178 aa, Glycine max
  Coding DNA Sequence Number=SeqID_90726
  Gene Ontology: Mol. function=heat shock protein binding; Biological process=protein folding
  Pfam annotation: Domain name=DnaJ; Domain location=13-53; Score= -11.8; E_value=0.061; Accession=PF00226.21; Description=DnaJ domain
MNITSQYILTLFTLQVYDGRGTLEEGETAEARFIKIQAAYELLIDGERRRQYDMDNWVNPMKASQAWMEWLIKKRKAFDQRGDMAIAAWAEQQQRELNLRVRQLSRSKIDPDEARRILAREKKASAEYYSNTLKRHTLVLKKRDLMRRKAEEEKKKTISRLLAAEGLELDDSDSDEAL

SEQ ID NO: 207505 - protein, 261 aa, Glycine max
  Coding DNA Sequence Number=SeqID_90727
  Gene Ontology: Mol. function=phosphopantothenate--cysteine ligase activity; Cellular component=membrane; Biological process=coenzyme A biosynthetic process
  Homolog annotation: Hit_ID=Q69S81; Match level="QueryCoverage=84%, HitCoverage=71%, E-value=8e-79, Identity=64%"; Hit description =Putative chain A, crystal structure of phosphopantothenoylcysteine synthetase
  Pfam annotation: Domain name=DFP; Domain location=46-260; Score =228.8; E_value=1.2e-65; Accession=PF04127.5; Description=DNA pantothenate metabolism flavoprotein
MDAAKGLEASGETLRAEVKTFFDSAPPLQNSDEITQKLNQFIQRNSSARRIVCVTSGGTTAPLEQRCVRYVDNFSSGHRGATSTEYFLKAGYAVIFLYRKRSFQPFCRSLPDDPLLECFKPNHESNIQVCEAYSETVKRAIVDHHTAVAGGLLLKLPFNTIFEYLQMLQTIAMSMRCIGPRAMFYLAAAVSDYYVPWKEMVEHKIQSGSSHLLDVKLVQVPKMLSVLRKDWAPLAFCISFKVVVNKSVKKSIWTYTILTKL

SEQ ID NO: 207506 - protein, 413 aa, Glycine max
  Coding DNA Sequence Number=SeqID_90728
  Gene Ontology: Mol. function=serine-type endopeptidase activity; Cellular component=integral to membrane; Biological process=beta -lactam antibiotic catabolic process
  Homolog annotation: Hit_ID=Q9LYP1; Match level="QueryCoverage=70%, HitCoverage=84%, E-value=4e-53, Identity=38%"; Hit description =Membrane protein
  Pfam annotation: Domain name=Rhomboid; Domain location=99-243; Score =140.1; E_value=5.8e-39; Accession=PF01694.12; Description=Rhomboid family
MAECIDVKLSPAPDQRIPLMRSRRGRRRGDTWVVSVFVIIQIGVFIATMLVNDCWNNSHGDCVLQPLGRFSFQPLPENPLLGPSQSKLDEMGALRWNLLTEHHQTWRLFTFPFLHAGLFHLLLNLSSVIYVGVNLEHHFGPIRIGIIYALSAFVGSLVASLFLQNIPAVGASGALYGLLGTLLSELVWNWKFHSNKISAIASLVFVFVCNFVLGFLPYVDNFASMGGFISGFLLGSVFLLCPQIQPVAPNKGGLIDYGVKSYVKLKLKEKLDRPVLRIVSLILFSLLLAGCLVAVLHGINISSYCTWCPYVDCIPFTSWHCKDTETSCEPPHLQLKAIKPEMSALTLNNPQCGPMPAKYALGSKLLYIKMPKSSEQIGHLHKSQPRASSPFGATISFWRHVASSHHGEVKEVE

SEQ ID NO: 207507 - protein, 203 aa, Glycine max
  Coding DNA Sequence Number=SeqID_90729
MTGRLLAGSLALESCILHYLIVRILLPRSSNLAQVSKEDLIVMWAFHTGRQIDWAHLVQYRMHKALRLNAHLPYPHLVTLLLQHFNIPLDSESYVPIKRSFLIGVAMVASFGYRKERDGSWVKKGAQTNDDEGNLSVEGDSSLLQSILDMFDELQTYVGERFDSLERQVDTRFEEMNSRIAKVEEDVTIIRDCFDLPPSPPSV

SEQ ID NO: 207508 - protein, 155 aa, Glycine max
  Coding DNA Sequence Number=SeqID_90730
  Gene Ontology: Mol. function=mismatched DNA binding; Cellular component=nucleus; Biological process=response to DNA damage stimulus
  Homolog annotation: Hit_ID=Q9ZRV4; Match level="QueryCoverage=100%, HitCoverage=21%, E-value=7e-58, Identity=76%"; Hit description=MLH1 protein
  Pfam annotation: Domain name=HATPase_c; Domain location=30-130; Score= 25.1; E_value=0.00014; Accession=PF02518.16; Description=Histidine kinase-, DNA gyrase B-, and HSP90-like ATPase
MEESENQRRMEPPKIQRLSESVVNRIAAGEVIQRPVSAVKELVENSLDAASSSVSLLIKDGGLKLIQVSDDGHGIRFEDLPILCERHTTSKLSSFEDLQRIKSMGFRGEALASMTYVAHVTVTTITKPQLHGYPIEMVSWSTNPGHVLLLKERRL

SEQ ID NO: 207509 - protein, 333 aa, Glycine max
  Coding DNA Sequence Number=SeqID_90731
  Homolog annotation: Hit_ID=Q9ZRV4; Match level="QueryCoverage=45%, HitCoverage=18%, E-value=1e-44, Identity=66%"; Hit description=MLH1 protein
PVTVQLGFGNGGDGDVSDVGHAGESLAAKAHRLNALQVLKRGQLGGRVALAEYGQLEAKARDVSNEKKRRREGVTDTDSVAVVGDLDEFEAAILDEEADGGGGGVEAVLHELLHGGDGALDDLAGGDSVHHRLAQPLNFRGLHSPLILALFHSDRFNVLNAKGSNSSLNAFIHNFSIRLASPLRGLLRDGPWNFDKHLLNLGPINDNEDPVVQVSLFHIPLWVQKVGEGLGNYVAKFREYDDKGNLNFLRAFMRIRVMLDVTKPVIKSKKVKKIEEGGALICVQKIARQEAMEGHNYGEFNANINNGLHVNEEDLIKRWVIDNSGVSLLIVTF

SEQ ID NO: 207510 - protein, 56 aa, Glycine max
  Coding DNA Sequence Number=SeqID_90732
FGAEPDMMMQTSAKKTMITKDWGFEKYIEGFIRKNKMDSPSEDLTFHSCKSKGYFC

SEQ ID NO: 207511 - protein, 191 aa, Glycine max
  Coding DNA Sequence Number=SeqID_90733
  Gene Ontology: Mol. function=mismatched DNA binding; Cellular component=nucleus; Biological process=response to DNA damage stimulus
  Homolog annotation: Hit_ID=Q9ZRV4; Match level="QueryCoverage=100%, HitCoverage=25%, E-value=6e-75, Identity=72%"; Hit description=MLH1 protein
  Pfam annotation: Domain name=DNA_mis_repair; Domain location=63-180; Score=138.2; E_value=2.2e-38; Accession=PF01119.9; Description=DNA mismatch repair protein, C-terminal domain
MAARRKTLQNSSDDYSKIVDLVSRFAIHHINVSFSCRKHGAVRADVHTVAMSSRLDAIKSVYGVSVARNLIEIEASDNDPSTSVFEMHGYMSNANYAAKKITMVLFINDRLVECSALKRAIEIVYAATLPKASKPFIYISIVLPPENIDVNVHPTKREVSLLNQEVIIEKIQSVVESTLRSSNEARTFQEQ

SEQ ID NO: 207512 - protein, 81 aa, Glycine max
  Coding DNA Sequence Number=SeqID_90734
MVAIAKGKCGFFHQLIMKLYGGARKRHEKGSEVNWYKKEEKTQPKLTYSQTGWFRLSQQVKTFMMFPPCMKGHGCWVQGMW

SEQ ID NO: 207513 - protein, 271 aa, Glycine max
  Coding DNA Sequence Number=SeqID_90735
  Gene Ontology: Mol. function=protein serine/threonine kinase activity; Biological process=protein amino acid phosphorylation
  Homolog annotation: Hit_ID=Q2QW75; Match level="QueryCoverage=78%, HitCoverage=74%, E-value=9e-68, Identity=59%"; Hit description =Uncharacterized plant-specific domain TIGR01627 family protein, expressed
  Pfam annotation: Domain name=DUF579; Domain location=1-224; Score =452.0; E_value=7.9e-133; Accession=PF04669.4; Description=Protein of unknown function (DUF579)
APPSLANAIIHYATANVTPQQTLHEISVSARVLEKKSPCNFLVFGLGHDSLMWTSLNYGGRTVFLEEDKSWIDQIQEKVPSLESYHVMYDTQVHQAEELMKTGMKEDCQKVTDPRFSRCPLAHKGLPSEVYDIDWDVIMVDAPTGYFDEAPGRMSAIYTAGLIARNKERGQTDVFVHDVDRKVEDMFSKAFLCEGYFKEQEGRIRHFNIPSHRSRSEWVLAATCTNEGLYVLTYEQRCILGEAAAVLRNNDGEVGSSRREPSGASCACGWK

SEQ ID NO: 207514 - protein, 435 aa, Glycine max
  Coding DNA Sequence Number=SeqID_90736
  Gene Ontology: Mol. function=zinc ion binding; Cellular component =plastid; Biological process=peroxisome organization and biogenesis
  Homolog annotation: Hit_ID=Q9LRB5; Match level="QueryCoverage=96%, HitCoverage=99%, E-value=1e-118, Identity=47%"; Hit description =Amino acid transporter-like protein 2
  Pfam annotation: Domain name=Aa_trans; Domain location=43-422; Score =348.5; E_value=1.1e-101; Accession=PF01490.8; Description =Transmembrane amino acid transporter protein
  Pfam annotation: Domain name=Trp_Tyr_perm; Domain location=43-417; Score=-261.7; E_value=0.011; Accession=PF03222.4; Description =Tryptophantyrosine permease family
  Pfam module annotation: Pfam domain module=Aa_trans::Trp_Tyr_perm; Domain location=43-422::43-417
MYVEAVNKKGNEHANRNATTGDQTMPASEQQNLENWLPISASRKAKWWYSTFHNVTAMVGAGVLGLPFAVAQLGWIPGVFMIMFSWILTFYALWQLIHLHEVVPGKRFDRYFELGKHVLGPKKGFWLVMPQQLTVQVASAIVYTVTGGKSLKKLLLSQTPNFNKLKSVSSLAALMSVCYSMVASCMSIVEGIGRHHHHHHIDYGVRSHTTPGIVLDAFNALGTIAFAFAGHSVALEIQATLPSTEEKPSNIPMWRGVRVAYTIVIICYISVAVSGFWAYGNAVDDDVLITLEHPNWLIAIANFMVFIHVLGSFQVFAMPVFDTIETTLVKSWNFTPSRILRLVSRSIFVCVVGIIGMCIPFFGGLLGFFGGLAFTSTSYMIPSILWLAEKSPKRWSFHWIASWICVIVGGIIAVVAPIGGVRTIIVSAKTYKLFS

SEQ ID NO: 207515 - protein, 499 aa, Glycine max
  Coding DNA Sequence Number=SeqID_90737
  Gene Ontology: Mol. function=transcription regulator activity; Cellular component=nucleus; Biological process=regulation of transcription
  Homolog annotation: Hit_ID=Q1T4J2; Match level="QueryCoverage=84%, HitCoverage=99%, E-value=1e-175, Identity=66%"; Hit description =Tetratricopeptide-like helical
  Pfam annotation: Domain name=PPR; Domain location=149-183; Score =14.3; E_value=0.15; Accession=PF01535.11; Description=PPR repeat
  Pfam annotation: Domain name=PPR; Domain location=211-245; Score =40.4; E_value=6.3e-09; Accession=PF01535.11; Description=PPR repeat
  Pfam annotation: Domain name=PPR; Domain location=246-280; Score=6.1; E_value=1.4; Accession=PF01535.11; Description=PPR repeat
  Pfam annotation: Domain name=PPR; Domain location=312-346; Score =23.1; E_value=0.00099; Accession=PF01535.11; Description=PPR repeat
  Pfam annotation: Domain name=PPR; Domain location=349-383; Score=0.2; E_value=7.1; Accession=PF01535.11; Description=PPR repeat
  Pfam annotation: Domain name=PPR; Domain location=417-450; Score=1.8; E_value=4.6; Accession=PF01535.11; Description=PPR repeat
  Pfam annotation: Domain name=PPR; Domain location=451-485; Score=2.7; E_value=3.6; Accession=PF01535.11; Description=PPR repeat
  Pfam module annotation: Pfam domain module=PPR::PPR::PPR::PPR::PPR::PP R::PPR; Domain location=149-183::211-245::246-280::312-346::349 -383::417-450::451-485
MTGTYSRISCMTQHLCSMLELKQVQAIITKAGLHSHLPFTAKLIFFSALSPMGNLSHAHSLFLQTSMHNSFICNTMIRAFANSSYPLQALYIYNHMHTTQWGEVPCTVLKLGLDQDPSIQNSLLCMYSQCGLVHVAQHLFDEISNRSLVSWNIMISAYDRVNDSKSADYLLESMPHKNVVSWNPVIGRYIRLGDIEGARRVFQIMPQRDAVSWNSLIAGCVSVKDYEGAMGLFSEMQNAEVRPTEVTLISVLGACAETGALEMGSKIHESLKACGHKIEGYLGNALLNMYSKCGKLNSAWEVFNGMRIKTLSCWNAMIVGLAVHGYCEEALQLFSEMESGLDTVRPNRVTFLGVLIACSHKGLVDKARWNFDHMAKQYKILPDIKHYGCIVDLLSRFGLLEEAHQMIKTAPLQNSAILWRTLLGACRTQGNVELAKVSFQQLAKLGRLTDGDYVLLSNIYAEAERWDEVERVRSEMIGLHVPKQVAYSQIDMTESDKLP

SEQ ID NO: 207516 - protein, 80 aa, Glycine max
  Coding DNA Sequence Number=SeqID_90738
MRNNILPTFRNDVNRAEEVVKGRRKGTNNNKDASANEKRKGSVRVEEFPEQPVQEKGKISQSLIESGGLATEETVIGMNL

SEQ ID NO: 207517 - protein, 188 aa, Glycine max
  Coding DNA Sequence Number=SeqID_90739
  Gene Ontology: Mol. function=mismatched DNA binding; Cellular component=nucleus; Biological process=response to DNA damage stimulus
  Homolog annotation: Hit_ID=Q9ZRV4; Match level="QueryCoverage=98%, HitCoverage=24%, E-value=6e-72, Identity=68%"; Hit description=MLH1 protein
MDISFAILQMNTELLKQKAEMLEEYFGIHIDEHGNVSRLPVILDQYTPDMDHVPEFALCLGNDVDWEDEKNCIQAVSAALGNFYAMHPLMLPNPSGEGLLFYKKRKMMDGYAEENTCDNTGSDVIDNKVEHEMFSEAETAWAQREWSIQHVLFPSMRLFFKPPASMATDGTFVQVTSLEKLYKIFERC

SEQ ID NO: 207518 - protein, 1058 aa, Glycine max
  Coding DNA Sequence Number=SeqID_90740
  Gene Ontology: Mol. function=protein transporter activity; Cellular component=COPI vesicle coat; Biological process=intracellular protein transport
  Homolog annotation: Hit_ID=Q1S9I3; Match level="QueryCoverage=94%, HitCoverage=94%, E-value=0.0, Identity=75%"; Hit description =Coatomer WD associated region; Coatomer alpha subunit, C-terminal; Cytochrome cd1-nitrite ...
  Homolog annotation: Hit description=reductase-like, C-terminal haem d1
  Pfam annotation: Domain name=COPI_C; Domain location=620-1021; Score =767.5; E_value=8.2e-228; Accession=PF06957.2; Description=Coatomer (COPI) alpha subunit C-termin
  Pfam annotation: Domain name=Coatomer_WDAD; Domain location=151-597; Score=863.3; E_value=1.2e-256; Accession=PF04053.4; Description =Coatomer WD associated region
  Pfam annotation: Domain name=WD40; Domain location=52-90; Score=35.8; E_value=1.5e-07; Accession=PF00400.22; Description=WD domain, G-beta repeat
  Pfam annotation: Domain name=WD40; Domain location=8-46; Score=35.6; E_value=1.7e-07; Accession=PF00400.22; Description=WD domain, G-beta repeat
  Pfam module annotation: Pfam domain module=COPI_C::Coatomer _WDAD::WD40::WD40; Domain location=620-1021::151-597::52-90::8-46
MPFGSPDAVVKYVLEGHDRGVNWASFHPALPLIVSAADDRQLKLWRMNDTKAWEVDTLRGHMNNVSCVLFHAKQDIIVSNSEDKSIRVWDATKRTGIQTFRREHDRFWILAAHPEMNLLAAGHDSGMIVFKLERERPAFAVSGDALFYTRDRFLRFYEFSTQRETQVLPIRRPGSPSLNQSPRTLSYSPSENAVLLCSDIDGGSYELYCISKDGYGRGDLQDAKKGVGVSAVFVARNRFAVLDRSSNQVLLKNLKNEIVKKTVLPIATDAIFYAGTGNLICRSEDRVVLFDLQQRIVLGELQTPFVKYIVWSSDMETVALLSKHAIIIANKKLVHQCTLHETIRVKSGAWDDNGVFIYTTLNHIKYCLPNGDSGIIKTLDVPIYITKVSGNTIFCLDRDGKKRAIAIDSTEYIFKLSLLKKKYDHVMNMIKNSQLCGQAVIAYLQQKGFPEVALHFVNDERIRFNLALESGNIQIAVASATAIDEKDYWYRLGVEALRQGNAGIVEYAYQRTKNFERLSFLYLITGNLEKLSKMLKIAEVKNDVMGQFHNAMYMGDVRERVKILENVGHLPLAYITASVHGLHDVAERLAAELGNNVPSLPGGKVPSLLMPPSPLTCGGDWPLLRVMRGIFDGGLDNMNRGAADEEYEAADADWGEELDLVDVDDLQNGEVAAILEDGEVADENEEEGGWEMEDLELPPEADTPKAFLSTRSVFVAPTPGLPVSQIWIQKSSLAADHAAAGNFDTAMRLLNRQLGITNFSPLRSTFLDLSTGSHSYLRAFSSAPVISFAIERGWTESSSANVRGLPALPLRLPQLDERLRAGYKSTTAGKFTEALKAFTSILHAIPLIVVESRREVDEVKELIIIVKEYVLGLQMELKRREMKDNLTRQQELAAYFTHCNLQTPHLRLALLNAMTVCFKAKNLASAANFARRLLETNPTVETQAKTARKVLAAAETNMTDAKPLNYDFRNPFVTCGATYVPIYRGQKDVSCPYCTSRFVPSQEGQLCTGASGLCLSFVMTIKMDIEHQLLQKIPETEAVEPIANEETNLVGTRFGGMA

SEQ ID NO: 207519 - protein, 370 aa, Glycine max
  Coding DNA Sequence Number=SeqID_90741
  Gene Ontology: Mol. function=hydrolase activity, acting on ester bonds; Cellular component=nucleus; Biological process=lipid metabolic process
  Homolog annotation: Hit_ID=Q0R4F7; Match level="QueryCoverage=89%, HitCoverage=91%, E-value=1e-104, Identity=56%"; Hit description=GDSL- lipase 1
  Pfam annotation: Domain name=Lipase_GDSL; Domain location=38-352; Score=242.6; E_value=8.4e-70; Accession=PF00657.12; Description=GDSL- like LipaseAcylhydrolase
MTLTFTVTWIFWLCQIRGRCLSQVVQPRVPPGQQVPCFYIFGDSLVDNGNNNGILTLARANYRPYGIDFPGGATGRFTNGRTYVDALAQLLGFPTYIAPYSRARGLELLRGANYASGAAGIREETGSNLGAHTSLNEQVANFGNTVQQLRRFFRGDNESLNSYLNKCLFFSGMGSNDYLNNYFMSDFYSTSSDYTVKAFASVLLQDYSRKLSQLYSLGARKVMVTAVGQIGCIPYQLARFHGNSSRCNEKINNAISLFNSGLKTMVQNFNGGQLPGAKFVYLDFYQSSQDLSSNGTSYGFDVIDKGCCGVGRNNGQITCLPQQQPCENRQKYLFWDAFHPTELANILLAKATYSSQSYTYPINIQQLAML

SEQ ID NO: 207520 - protein, 154 aa, Glycine max
  Coding DNA Sequence Number=SeqID_90742
  Gene Ontology: Mol. function=protein transporter activity; Cellular component=COPI vesicle coat; Biological process=intracellular protein transport
  Homolog annotation: Hit_ID=Q1S9I3; Match level="QueryCoverage=92%, HitCoverage=24%, E-value=2e-81, Identity=69%"; Hit description =Coatomer WD associated region; Coatomer alpha subunit, C-terminal; Cytochrome cd1-nitrite ...
  Homolog annotation: Hit description=reductase-like, C-terminal haem d1
MERGAHDVVVVAGEDGNAGAGLPVPDADGLVVAGGDDPGALVVELDGADVIKVAQEAEEAAVELVVPQLDLVVVAAGDEEGLGVVEVDATDGALVLLEAIDQGAHAVVPQLDHAAVEARKDPWTLLVEAQALHTVALRLEFRQHQEEDKQTNKR

SEQ ID NO: 207521 - protein, 53 aa, Glycine max
  Coding DNA Sequence Number=SeqID_90743
MTYKKEEQVQRKTFGPLDFDYKATKNCNRAEQLVFYKYFVVLNKNEMPPIDVI

SEQ ID NO: 207522 - protein, 238 aa, Glycine max
  Coding DNA Sequence Number=SeqID_90744
MKSRSDDGDQCDGNASRVVCVNFTCQGPMWGCVQRCFELAVHVDGVMVFGDGRQWSRLHALRCTGNASSIEAVWCVFKTCMRECRWFVLDAVNTFLNSNIQTNADCLCFSLTSIFLMLDGATNQSVCAEGCSIFHGFDKERFSILFVLDDTFLCSTIFTGWMPTILRAGRGMTRWEHSRPDPPPGKLELFSYENNPNARIVREALCELELPYILQNVGEGSPRMKLLLDASGSKEVRI

SEQ ID NO: 207523 - protein, 48 aa, Glycine max
  Coding DNA Sequence Number=SeqID_90745
MKNSAPLKQTKLSQGKGAFDIEYGAMDFVPHANLDKLAKEDVASYHSS

SEQ ID NO: 207524 - protein, 55 aa, Glycine max
  Coding DNA Sequence Number=SeqID_90746
MEREGGISPRVSITFGTGMLLQKCIGSKGHKTKDHHIDNMVAKKNIHCGNNKIST

SEQ ID NO: 207525 - protein, 255 aa, Glycine max
  Coding DNA Sequence Number=SeqID_90747
  Gene Ontology: Mol. function=hydrolase activity
  Homolog annotation: Hit_ID=Q1T171; Match level="QueryCoverage=96%, HitCoverage=73%, E-value=3e-84, Identity=64%"; Hit description =Dienelactone hydrolase
  Pfam annotation: Domain name=DLH; Domain location=55-254; Score= -24.5; E_value=1.4e-05; Accession=PF01738.9; Description=Dienelactone hydrolase family
  Pfam annotation: Domain name=Peptidase_S9; Domain location=104-252; Score=-80.7; E_value=0.056; Accession=PF00326.11; Description=Prolyl oligopeptidase family
  Pfam module annotation: Pfam domain module=DLH::Peptidase_S9; Domain location=55-254::104-252
MFSEKSNFNLQKPVQDAADSKISCSLLNVEGGIDDEACELVSGVELSLVEGDEDIRDYLFKAVKNAMEPANCFFQMFSGLRILSLEILHIGEIASKQICSILVPDLFRGCPWTKDQPDVFEQWIARQNPERIAEDITRWTKWLVDEFMAVGISKKLGIIGFCFGGGQVLKVLAKDQGACFGTGISFCGTRMDPLAASDIKAPVLFILGDNDPLCKVSEIENVQKKIRRGSKVVIFPGRGHGFAHRPDLLNKPTLL

SEQ ID NO: 207526 - protein, 344 aa, Glycine max
  Coding DNA Sequence Number=SeqID_90748
  Gene Ontology: Mol. function=methylenetetrahydrofolate reductase (NADPH) activity; Cellular component=cytosol; Biological process =methionine metabolic process
  Homolog annotation: Hit_ID=O80585; Match level="QueryCoverage=94%, HitCoverage=54%, E-value=1e-157, Identity=81%"; Hit description =Methylenetetrahydrofolate reductase 2
MAALEPIKDNEEAVKAYGIHLGTEMCKKILAHGIKTLHLYTLNMEKSALAILMVNLGLIEESKVSRSLPWRRPANVFRVKEDVRPIFWANRPKSYISRTIGWDQYPHGRWGDSCNPSYGALSDYQFMRPRARDKKLVEEWAVPLKSVEDIYERFRLYCLGKLRSNPWSELDGLQPETKIINEQLEKINTKGFLTINSQPAVNGEKSDSPTVGWGGPGGYVYQKAYVEFFCSKEKLDALVDKCKDRTSLTYMAVNKDGSWKSNVGQTDVNAVTWGVFPAKEIIQPTIVDPVSFNVWKDEAFEIWSRGWASLYPEDEASRKLVEEVDARVLRILSICVTGWGQSLL

SEQ ID NO: 207527 - protein, 100 aa, Glycine max
  Coding DNA Sequence Number=SeqID_90749
  Subcellular localization annotation: CTP_CleavageSite=50; ConfidenceScore=5.04e-01
MPPPFSVTPLSPKMRPPPPAMTIPYIPLLYCASTNDLAATTPLGGEVVVSATMDPVGYMGVHDDTCRVGNRLYYVVAKQDALGNGRVFETMEVEGAPPMP

SEQ ID NO: 207528 - protein, 277 aa, Glycine max
  Coding DNA Sequence Number=SeqID_90750
  Gene Ontology: Mol. function=methylenetetrahydrofolate reductase (NADPH) activity; Cellular component=mitochondrial large ribosomal subunit; Biological process=methionine metabolic process
  Homolog annotation: Hit_ID=Q9SE94; Match level="QueryCoverage=94%, HitCoverage=40%, E-value=1e-119, Identity=80%"; Hit description =Methylenetetrahydrofolate reductase 1
  Pfam annotation: Domain name=MTHFR; Domain location=6-267; Score =361.6; E_value=1.2e-105; Accession=PF02219.7; Description =Methylenetetrahydrofolate reductase
MKIIEKIRAASADPNRVVFSFEFFPPKTEDGVDNLFERMDRMVAHNPSFCDITWGAGGTTADLTLEIANKMQNIVCVETMMHLTCTNMPVEKIDHALHTIKSNGLQNVLALRGDPPHGQDKFVQVEGGFACARDLVQHIRAKYGDYFGITIAGYPECFSAPFSTIIFSYSPFSFSSEAHPDVIESDGLATPEGYRNDLAYLKSKVDAGADLIVTQLFYDTDIFLKFVNDCRQIGITCPIVPGIMPINNYKGFIRMTGFCKTKDLGGGWFSKEALKVT

SEQ ID NO: 207529 - protein, 129 aa, Glycine max
  Coding DNA Sequence Number=SeqID_90751
  Pfam annotation: Domain name=DUF543; Domain location=1-65; Score =89.3; E_value=1.2e-23; Accession=PF04418.3; Description=Domain of unknown function (DUF543)
MAEKKEMIPKQYDIDAKWDACIDLTVRRFVYSASAGSPVTRWASIAFGAGVGIGSAYAECSRLFDGPPTNLPLPKVSETATQDPIARYGTLVPHWKYGIVAFLRLWALQWLAYAYGVVLLRFLSYNHLA

SEQ ID NO: 207530 - protein, 518 aa, Glycine max
  Coding DNA Sequence Number=SeqID_90752
  Gene Ontology: Mol. function=phosphotransferase activity, alcohol group as acceptor; Biological process=nucleobase, nucleoside, nucleotide and nucleic acid metabolic process
  Homolog annotation: Hit_ID=Q6ZND8; Match level="QueryCoverage=92%, HitCoverage=86%, E-value=0.0, Identity=87%"; Hit description=CDNA FLJ16191 fis, clone BRTHA2013610, moderately similar to Arabidopsis thaliana ...
  Homolog annotation: Hit description=deoxyguanosine kinase -related (At1g72040) mRNA
  Pfam annotation: Domain name=dNK; Domain location=296-443; Score =103.1; E_value=8.4e-28; Accession=PF01712.9; Description =Deoxynucleoside kinase
  Subcellular localization annotation: CTP_CleavageSite=66; ConfidenceScore=5.80e-01
MQKLLRPSSVPFLSISVTVATPFLSLPPKVANQPMSAAAAGSSLKRQLSYSRYLALSSTNTCSVCRCLSLTHTHSHPKNNKTLLLLNHSRNRSLHSASEGSFITQPDPVEYGSLVDSKEKPFNSRLNRRQKGSTSSSPAPSNPDLLAIPGVGPRNFRKLVQKGIAGVAQLKQLYKDKFFGKSSDKMVEYLQNSVGIIHKNHAESITTFIKQSVDEEELEDNSSSSVQKKRLTFCVEGNISVGKTTFLQRIANETIELRDLVEVVPEPISKWQDVGPDHFNILDAFYAEPQRYAYTFQNYVFVTRVMQERESSAGIKPLRLMERSVFSDRMVFVRAVHEANWMNGMEISIYDSWFDPVVSSLPGLIPDGFIYLRASPDTCHKRMMLRKRTEEGGVSLDYLCDLHEKHESWLFPSQSGNHGVLSVNQLPHHIDNSLHPDIRDRVFYLEGGHMHSSIQKVPALVLDCEPNIDFSKDIEAKRQCLCPNCKVWDLIPTSQSLLGTRLVHSLAMCAGTGEHSGM

SEQ ID NO: 207531 - protein, 282 aa, Glycine max
  Coding DNA Sequence Number=SeqID_90753
  Gene Ontology: Mol. function=transcription factor activity; Cellular component=nucleus; Biological process=regulation of transcription, DNA-dependent
  Homolog annotation: Hit_ID=Q949Q9; Match level="QueryCoverage=99%, HitCoverage=48%, E-value=2e-83, Identity=57%"; Hit description =Putative growth regulator protein
  Pfam annotation: Domain name=DUF246; Domain location=156-282; Score= -209.6; E_value=0.019; Accession=PF03138.5; Description=Plant protein family
  Subcellular localization annotation: CTP_CleavageSite=31; ConfidenceScore=5.57e-01
MHGYSRLGGAARSPPSSPRFRHGRSKSSSWCSSKESNSMEKLVFILMSAVFRRRGLLLFAPLLYISGMLLYMGSLSIDVVSIKNGVVLVHKRAPPGSVYRSPQLFQNLWPFMEADNGTTLNVLMRAWTKKELREWKPCANRSVPEIELPKSNGFLIIEANGGLNQQRLSICDAVAVAGLLNATLLIPIFHLNSVWRDSRIGQMGYQLRTVKGNFGDIFDENFFIQSLGNRVHVVRELPDDILQRFDNNISNIVNLRVKGWSSSAHYLQKVLPQLLEMGCVPI

SEQ ID NO: 207532 - protein, 142 aa, Glycine max
  Coding DNA Sequence Number=SeqID_90754
MTITLDDVSCLLHLPIRGCILDHVEMSYTKKVIKDLLRLNLDIMTDHKTDVATSVGSMVLLSWLEGLYHTYVASALYVWATRVYLLHLLDNTIFADKSSTHAYMFEHLPTIPADEKVLEYDHKQPLAARWLLLRGYRKCYCD

SEQ ID NO: 207533 - protein, 595 aa, Glycine max
  Coding DNA Sequence Number=SeqID_90755
  Gene Ontology: Mol. function=DNA binding; Cellular component =chromatin; Biological process=DNA integration
  Homolog annotation: Hit_ID=Q1T2W1; Match level="QueryCoverage=98%, HitCoverage=97%, E-value=1e-159, Identity=43%"; Hit description =Integrase, catalytic region; Asp/Glu racemase
  Pfam annotation: Domain name=rve; Domain location=1-121; Score=56.1; E_value=1.2e-13; Accession=PF00665.16; Description=Integrase core domain
  Pfam module annotation: Pfam domain module=RVT_2::rve; Domain location=163-356::1-121
MVEKSEALAAFKNFKVLTEKEVGSLIKVLSTDRDGEFNSHEFANFCETHGIKRQFTAAYTPQQNGVCERKNRTIMNMVRSILTRSGVSKTFWPEVVNWSIHILNRSPTLAVQNMTPEEAWSGERPAVDHFKIFGGNREERQEPSENVQPATIEQQPTGNPHISTAETEDERPQRVKQRPAWMADFKWVYKTKLKENDEVEKFKAPLVAKGYKQEFGIDYKEVFAPIARHDTIRLVISLAEQKSWSIFQLDVKSTFLHGDLEEQVFVDQPPGYIKTGNEHKVYKLRKALYGLKQAPQKSMMIEFDMTELGMLHYFLGIKVVQSAVGIFIFQKKYVQEILDRFQMTNCNFVNTPVEYGLKLTKDHGGKKVDNTLYKQIVGTLMYLTATGPDVMYAVSLISRYMDTPADMHLLAAKRIFRYLQGTVDYGLFYKMGLKIDLVDFTDSDYAEDLDNRKSTSGYAFMLGSGAVSWSSKKQPIVTLSTTEAEFVAATTCSCQAIWMRKILEDLHFERQGPTTIFCDNNSTIKLSKNPILHGRSKHIDVKYHFLRKLTRNGTLDLIYCRSEDHIADIFTKSLKWPMFQKLRKLLGVSKLENLV

SEQ ID NO: 207534 - protein, 88 aa, Glycine max
  Coding DNA Sequence Number=SeqID_90756
  Gene Ontology: Mol. function=phosphotransferase activity, alcohol group as acceptor; Biological process=nucleobase, nucleoside, nucleotide and nucleic acid metabolic process
  Homolog annotation: Hit_ID=Q6ZND8; Match level="QueryCoverage=92%, HitCoverage=16%, E-value=3e-32, Identity=85%"; Hit description=CDNA FLJ16191 fis, clone BRTHA2013610, moderately similar to Arabidopsis thaliana ...
  Homolog annotation: Hit description=deoxyguanosine kinase -related (At1g72040) mRNA
MLGIVPKPYPDGHSPIFITSRYARQVAEFFEFVKKRNEVSSKEGSSQAQPQVLLPHEGGLWLPDGKPFPREALKSLDFRQAATSFMSG

SEQ ID NO: 207535 - protein, 185 aa, Glycine max
  Coding DNA Sequence Number=SeqID_90757
  Homolog annotation: Hit_ID=Q9FVW3; Match level="QueryCoverage=86%, HitCoverage=47%, E-value=4e-44, Identity=57%"; Hit description =Polyneuridine aldehyde esterase, putative; 10297-12282
MGNRFICMTKKESKDVGSRSKRMGRSQRKLVSEEELHLQALSMALQQHQLSQRFEGSMSRRIGSSRRHAVSESFSANKQVPVNLENIKIKKFVLIHGEGFGAWCWYKTVALLEEAGLLPVALDLTGSGIDLTDTNNVTTLADYSKPLTVYLQNLPEDEQVWMCDIELKHVIVHHTAIFPEDGNFA

SEQ ID NO: 207536 - protein, 94 aa, Glycine max
  Coding DNA Sequence Number=SeqID_90758
MVSSLLLTESRTLVLGETWMSNDGFDDEESYHEFYDNSEGNEVILHTSLADDDEQSSDYSYHSKYLQTPNSTSDEGCSSKAVVYHQYNEGTKFY

SEQ ID NO: 207537 - protein, 121 aa, Glycine max
  Coding DNA Sequence Number=SeqID_90759
  Gene Ontology: Mol. function=catalytic activity
  Homolog annotation: Hit_ID=Q9FVW3; Match level="QueryCoverage=73%, HitCoverage=25%, E-value=1e-39, Identity=85%"; Hit description =Polyneuridine aldehyde esterase, putative; 10297-12282
METKVLLQCAVFAYLCFIKIGFVTNLTRLFHDVALAMVSMRHSPLGPIMEKLSLSADKYGTGRRFYIQTLDDRALSPDVQEKLVRENPPEGVFKIKGSDHCPFFSKPQSLHKILVEIAQIP

SEQ ID NO: 207538 - protein, 103 aa, Glycine max
  Coding DNA Sequence Number=SeqID_90760
MANTCCPIELEPRTLNQVQFTQAREVAAEVVQKLQPREASALFIEGLMHPIQEVMHMDENGNLTEKLVDCMKKAESIPDDKACHCQCSCAAVNPFKEPLSAPF

SEQ ID NO: 207539 - protein, 38 aa, Glycine max
  Coding DNA Sequence Number=SeqID_90761
MESSVKQQHNGGLSLGKKTGFVAVTPPIGSKLAGFLCC

SEQ ID NO: 207540 - protein, 311 aa, Glycine max
  Coding DNA Sequence Number=SeqID_90762
  Gene Ontology: Mol. function=nucleotide binding
  Homolog annotation: Hit_ID=Q1SL19; Match level="QueryCoverage=62%, HitCoverage=34%, E-value=4e-15, Identity=36%"; Hit description =Nonsense-mediated decay UPF3
  Subcellular localization annotation: CTP_CleavageSite=62; ConfidenceScore=5.35e-01
MKATEATVKQQNVQSGNSPISTPAKQNQRREASGRLIRSILLNNEARQSQSTTGTQHKIQILSSENGQRPSRRFGSRSGLNNQVSNHDAAQINSEGDSRRALDEKFIKRDLHGLGSSAKTEKRTRNKDRPDRGVWTPLRRSDVSHAGNDYSSSSLAQPTQSNPESAEGEVKENVPSGNRGGEFSASAGGHGGNPSIENGSQRNFIHHGASYVVKDDGAVSSISKGKPSKKSVGHSAHESGHHSCYGLRIGRNPQLIQVNLSLSDLKGWLSVRGSHLGSWGRIDICSPTPQPERLFIELEPVTCKLQGSNLK

SEQ ID NO: 207541 - protein, 102 aa, Glycine max
  Coding DNA Sequence Number=SeqID_90763
MNRCLAAGNLGEESAESEKQAYAASRCKNTGEVVATAVAGGGLCNFLVTEAANPKMPHCMNGYRTPKIRLTNPRLILPEPGLPGKAALDLLQTFATADEAYH

SEQ ID NO: 207542 - protein, 151 aa, Glycine max
  Coding DNA Sequence Number=SeqID_90764
  Gene Ontology: Mol. function=DNA binding; Biological process =regulation of transcription, DNA-dependent
  Homolog annotation: Hit_ID=Q1SH54; Match level="QueryCoverage=67%, HitCoverage=42%, E-value=6e-32, Identity=59%"; Hit description =Transcriptional factor B3
  Pfam annotation: Domain name=B3; Domain location=2-82; Score=28.5; E _value=2.4e-05; Accession=PF02362.12; Description=B3 DNA binding domain
MQRIPEEFIKRFGDELSNVATVTVPDGRVWKMRLKKCGKDVSFRSKWREFVEYYSLGYGSYLVFRYEGNSKFRVLIFDTTSAEICYPDLDNRKRSKVDDQTRKKEHKEAIDEDDVNLKAWKKESDCSEIAKDASTKPKHPSVTCTIQPYRL

SEQ ID NO: 207543 - protein, 191 aa, Glycine max
  Coding DNA Sequence Number=SeqID_90765
  Gene Ontology: Mol. function=nucleotide binding; Cellular component =intracellular; Biological process=translation
  Homolog annotation: Hit_ID=Q1SL19; Match level="QueryCoverage=86%, HitCoverage=32%, E-value=7e-52, Identity=61%"; Hit description =Nonsense-mediated decay UPF3
  Pfam annotation: Domain name=Smg4_UPF3; Domain location=3-172; Score =242.0; E_value=1.3e-69; Accession=PF03467.6; Description=Smg-4UPF3 family
MKVRSEREKTKVVIRHLPPSLTQSDLFQHIDSHFASRYNWFSFRPGNNSHKRQRHSRAYIDFKCPDDVFEFAEFFDGHVFVNERGAQHKVIVEYAPSQRVPKPSAKKDGREGTIFKDPDYLEFLKLIAKPQEHLPSAEIQLERKESEQVGASKETPIVTPLMEYIRQKRAVDSGMQVLLQGAFTSELNFID

SEQ ID NO: 207544 - protein, 109 aa, Glycine max
  Coding DNA Sequence Number=SeqID_90766
  Gene Ontology: Mol. function=sequence-specific DNA binding; Cellular component=nucleus; Biological process=regulation of transcription, DNA-dependent
  Homolog annotation: Hit_ID=Q533R8; Match level="QueryCoverage=76%, HitCoverage=36%, E-value=5e-17, Identity=56%"; Hit description=MADS box protein AGL11
MSIQSERIKLSVRKGVWLILLQEFIEHVKLILENDWYAANRCISSEIQRKKREVKDMITDVERIQQVNMVSGPELNVIQALASRNFFNPNMLDGGTVYPQTDKKILHLG

SEQ ID NO: 207545 - protein, 72 aa, Glycine max
  Coding DNA Sequence Number=SeqID_90767
  Gene Ontology: Mol. function=sequence-specific DNA binding; Cellular component=nucleus; Biological process=regulation of transcription, DNA-dependent
  Homolog annotation: Hit_ID=Q533R8; Match level="QueryCoverage=78%, HitCoverage=25%, E-value=7e-25, Identity=98%"; Hit description=MADS box protein AGL11
  Pfam annotation: Domain name=SRF-TF; Domain location=9-59; Score =120.1; E_value=6.2e-33; Accession=PF00319.9; Description=SRF-type transcription factor (DNA-binding and dimerisation domain)
MGRGKIEIKRIENTTNRQVTFCKRRNGLLKKAYELSVLCDAEVSLIVFSSRGRLYEYSNNKNSSSVIIKMVN

SEQ ID NO: 207546 - protein, 103 aa, Glycine max
  Coding DNA Sequence Number=SeqID_90768
  Subcellular localization annotation: CTP_CleavageSite=50; ConfidenceScore=5.73e-01
MHCLAKTFTSSTWFGKKSHSSLAGPLSCLSLSVCLSLSVSLSSTYTNKVRAINRRDGSGRKSIAKFHFFGLEIFPKADREASQARLMHLLVLKQKVFGLISSS

SEQ ID NO: 207547 - protein, 151 aa, Glycine max
  Coding DNA Sequence Number=SeqID_90769
  Gene Ontology: Mol. function=methyltransferase activity; Biological process=metabolic process
  Homolog annotation: Hit_ID=O80543; Match level="QueryCoverage=73%, HitCoverage=32%, E-value=2e-41, Identity=73%"; Hit description =Uncharacterized protein At1g22800
MDGGILINDICAATRELRIACTLAQMEREGGISPRVRDAGNLLTRAGFTLPGVDVDEYVVKYESALELIEHLRAMGETNALYQMNNILKRDTALATAAIYDSMFSAEDGTVPATFQPCRFNGTKDIGKNLSPILVRDKVKIEYISERQPSP

SEQ ID NO: 207548 - protein, 242 aa, Glycine max
  Coding DNA Sequence Number=SeqID_90770
  Gene Ontology: Mol. function=cyclopropane-fatty-acyl-phospholipid synthase activity; Biological process=lipid biosynthetic process
  Homolog annotation: Hit_ID=UPI00005F7239; Match level="QueryCoverage =96%, HitCoverage=61%, E-value=4e-93, Identity=70%"; Hit description =COG2230: Cyclopropane fatty acid synthase and related methyltransfera ses
  Pfam annotation: Domain name=CMAS; Domain location=115-242; Score =64.0; E_value=2.2e-20; Accession=PF02353.10; Description =Cyclopropane-fatty-acyl-phospholipid synthase
MTFRPRIVMDSLSDDELAQKKDRWYRIVEEMLAEAGVAINGPRAWDIRVHNPALFKRILQEGSLGFGEGYMDGWWECERLDMLFTRILQAGVDERLPKSLSDIARIAYARLFNRQSRKRAWQVGKEHYDIGNDLFRAMLDPYMQYSCGYWKEAQTLEQAQQAKLRMICEKLQLKPGMTLLDIGCGWGGLAQFAAQNYGVSVHGVTISAEQQKLAQARCAGLDVEILLQDYRDLDRQFDRIVS

SEQ ID NO: 207549 - protein, 267 aa, Glycine max
  Coding DNA Sequence Number=SeqID_90771
MEAMMSMKKIMEANAVAVAATSIVAKVNPKSPSGLNQMNHPTSAMTHEIPHHNLADFEPWLGYATEGQAVGGIPLENTSEGPQLMVIEGGEDYANLEELFLVPNIITPLKFKVLDFDKYKGITCPKNHLKMYCRKMGACAKDEELLIHSFQENLTGDATTEHVQKEGTDLSKDTPKDGETWQLKWHLNDEKMMTMIVDTLPVFYYGKWWVTHLQALRIWSSPAEGSKRGEDEGEARAVTAIPIQPSFPPTQQCHYSANNQPSPYPPP

SEQ ID NO: 207550 - protein, 493 aa, Glycine max
  Coding DNA Sequence Number=SeqID_90772
  Gene Ontology: Mol. function=glutamate decarboxylase activity; Cellular component=membrane fraction; Biological process=carboxylic acid metabolic process
  Homolog annotation: Hit_ID=Q1S578; Match level="QueryCoverage=97%, HitCoverage=96%, E-value=0.0, Identity=70%"; Hit description =Pyridoxal-dependent decarboxylase
  Pfam annotation: Domain name=Pyridoxal_deC; Domain location=33-381; Score=462.8; E_value=4.5e-136; Accession=PF00282.9; Description =Pyridoxal-dependent decarboxylase con
MVFPKPASESDLFLHSNFASRYARDSLPRFSIPEDSMPKEAAYQNIHDELQLDAIPKLNLASFVTTSMEEECNKLIMESINKNYVDMDEYPITTDLHNRCVNMIARLFHAEIGENEIATGAGTVGSSEAIMLAGLAFKKKWQNKRKEEGKPYDKPNLVTGSNVQVCWEKFARYFEVELREVEVREGYYVMDPAKAVEMVDENTICVAAILGSTYNGEFEDVKLLNDLLLEKNKQTGWDTPIHVDAASGGFIAPFLYPELEWDFRLPLVKSINVSGHKYGLVYAGIGWVIWRTKDDLPEDLVFHINYLGADQPTFTLNFSKGSSQIIAQYYQLIRLGQEGYRSIMENCRENAMVLKEDLEKSGHFNILSKDDGVPVVAFSLKDRSRYDEFKISEMLRRHGWIVPAYPMPPAAQHINVLRVVIRAEFSRTLAERLAFDIHNVMDELEKLHPPIVTKNTKEENKAMVENGVKNTALDAHREIIAQESNKRQKIMAA

SEQ ID NO: 207551 - protein, 217 aa, Glycine max
  Coding DNA Sequence Number=SeqID_90773
  Homolog annotation: Hit_ID=Q9ZUM2; Match level="QueryCoverage=50%, HitCoverage=46%, E-value=1e-37, Identity=56%"; Hit description =Expressed protein
  Pfam annotation: Domain name=DUF1084; Domain location=9-214; Score =97.1; E_value=5.2e-26; Accession=PF06454.2; Description=Protein of unknown function (DUF1084)
MVARGVPAMAVVAVAALDLTESSNWWRDINRSPLWQDRIFHLLSILYGIVAAVALVQLVRIQWRVPEYGWTTQKVFHFLNFIVNGVRCFVFVFRRDVQKLQPEARAVSTDGLRPSFYTINAVVYVIQDKAYKKFVSGVNEGEPLIVVACVGTESPATTFPEACAHNPYRLPPPPMQLLTIGHPYFHHPSTPSLEMCSTSLSVEFYFSGVGFKIQRNY

SEQ ID NO: 207552 - protein, 240 aa, Glycine max
  Coding DNA Sequence Number=SeqID_90774
  Gene Ontology: Mol. function=RNA-directed DNA polymerase activity; Biological process=RNA-dependent DNA replication
MINSFWWVPNKQQRRGINQLNWDKMTMKKEDDGMRFRHLHAFNFAMLGKQGWRFMANQKYLVEAIFSHHDAEKILALPLLNVMENDKIIAILEVKGIGCSFGSFGNSKNKALLTETFKLVITLNMYGWKQDYGTSLNKSGIVEIAFSLLFLLSCRNPFHKLESKLERSFGVFGRHATQSFGNKYPLHLGLPTPLQCKTSLNGKKSKNQTIQQYSQTSSNITSWSPLQQNYFKCNLDAATF

SEQ ID NO: 207553 - protein, 852 aa, Glycine max
  Coding DNA Sequence Number=SeqID_90775
  Gene Ontology: Mol. function=transferase activity, transferring hexosyl groups; Cellular component=mitochondrion; Biological process= metabolic process
  Homolog annotation: Hit_ID=Q9LVQ5; Match level="QueryCoverage=74%, HitCoverage=79%, E-value=6e-82, Identity=26%"; Hit description =Similarity to salt-inducible protein
  Pfam annotation: Domain name=PPR; Domain location=182-216; Score =16.3; E_value=0.087; Accession=PF01535.11; Description=PPR repeat
  Pfam annotation: Domain name=PPR; Domain location=217-251; Score =20.1; E_value=0.0079; Accession=PF01535.11; Description=PPR repeat
  Pfam annotation: Domain name=PPR; Domain location=252-286; Score =50.1; E_value=7.4e-12; Accession=PF01535.11; Description=PPR repeat
  Pfam annotation: Domain name=PPR; Domain location=287-321; Score =58.8; E_value=1.7e-14; Accession=PF01535.11; Description=PPR repeat
  Pfam annotation: Domain name=PPR; Domain location=322-356; Score =43.9; E_value=5.4e-10; Accession=PF01535.11; Description=PPR repeat
  Pfam annotation: Domain name=PPR; Domain location=357-391; Score =49.2; E_value=1.4e-11; Accession=PF01535.11; Description=PPR repeat
  Pfam annotation: Domain name=PPR; Domain location=392-426; Score =38.4; E_value=2.5e-08; Accession=PF01535.11; Description=PPR repeat
  Pfam annotation: Domain name=PPR; Domain location=427-461; Score =35.4; E_value=2e-07; Accession=PF01535.11; Description=PPR repeat
  Pfam annotation: Domain name=PPR; Domain location=462-496; Score =41.0; E_value=4.1e-09; Accession=PF01535.11; Description=PPR repeat
  Pfam annotation: Domain name=PPR; Domain location=497-531; Score =19.2; E_value=0.015; Accession=PF01535.11; Description=PPR repeat
  Pfam annotation: Domain name=PPR; Domain location=532-566; Score =41.4; E_value=3e-09; Accession=PF01535.11; Description=PPR repeat
  Pfam annotation: Domain name=PPR; Domain location=567-601; Score =43.6; E_value=6.9e-10; Accession=PF01535.11; Description=PPR repeat
  Pfam annotation: Domain name=PPR; Domain location=602-636; Score =48.9; E_value=1.7e-11; Accession=PF01535.11; Description=PPR repeat
  Pfam annotation: Domain name=PPR; Domain location=637-671; Score =34.2; E_value=4.6e-07; Accession=PF01535.11; Description=PPR repeat
  Pfam annotation: Domain name=PPR; Domain location=672-706; Score =41.0; E_value=4.1e-09; Accession=PF01535.11; Description=PPR repeat
  Pfam annotation: Domain name=PPR; Domain location=707-741; Score =14.0; E_value=0.16; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =182-216::217-251::252-286::287-321::322-356::357-391::392-426::427 -461::462-496::...
  Pfam module annotation: Domain location=497-531::532-566::567 -601::602-636::637-671::672-706::707-741
  Subcellular localization annotation: CTP_CleavageSite=73; ConfidenceScore=5.84e-01
MLLFARNIGGRASLRVSSFHSSPLQNPFPLFLTPSSLSSQNSIFARPVIWFTSFLCVIRYPFVSKPSFDDIASESMRSFLQQDGPHLSDSALAPIWVSKALVKLKGDPKSALKFFKEAGARAGFRHAAESYCVLAHILFCGMFYLDARSVIKEWILLGREFPGCDFFDMLWSTRNVCRPGFGVFDTLFNVLVDLGMLEEARQCFWKMNKFRVLPKVRSCNELLHRLSKSSKGGLALSFFKDMVVAGLSPSVFTYNMVIGCLAREGDLEAARSLFEEMKAKGLRPDIVTYNSLIDGYGKVGMLTGAVSVFEEMKDAGCEPDVITYNSLINCFCKFERIPQAFEYLHGMKQRGLQPNVVTYSTLIDAFCKAGMLLEANKFFVDMIRVGLQPNEFTYTSLIDANCKIGDLNEAFKLESEMQQAGVNLNIVTYTALLDGLCEDGRMREAEELFGALLKAGWTLNQQIYTSLFHGYIKAKMMEKAMDILEEMNKKNLKPDLLLYGTKIWGLCRQNEIEDSMAVIREMMDCGLTANSYIYTTLIDAYFKVGKTTEAVNLLQEMQDLGIKITVVTYGVLIDGLCKIGLVQQAVRYFDHMTRNGLQPNIMIYTALIDGLCKNDCLEEAKNLFNEMLDKGISPDKLVYTSLIDGNMKHGNPGEALSLRNRMVEIGMELDLCAYTSLIWGFSRYGQVQLAKSLLDEMLRKGIIPDQVLCICLLRKYYELGDINEALALHDDMARRGLISGTIDITVPSCLTAVTKLHKLCASQSGTDFHRTANLYLADVEEFSHSGMPFSPLGHARLFTCLEAEALYAPDMCTSLHAGRRLLLDDMDPRGLELEICESFQWVESFRLILFSP

SEQ ID NO: 207554 - protein, 214 aa, Glycine max
  Coding DNA Sequence Number=SeqID_90776
  Gene Ontology: Mol. function=oxidoreductase activity; Cellular component=phragmoplast; Biological process=metabolic process
  Homolog annotation: Hit_ID=Q012U0; Match level="QueryCoverage=66%, HitCoverage=38%, E-value=5e-34, Identity=42%"; Hit description=[J] KOG2335 tRNA-dihydrouridine synthase
  Subcellular localization annotation: CTP_CleavageSite=22; ConfidenceScore=5.42e-01
MMKLAGYSLAVSFAPISSNVVKSNKRFTVGISHRNRCSYRLFSTHAQKHQLHEKPGVVARYHLPPWFSVAPMMDWTDHHYRTLARLISKHAWLYTEMLAAETIVHQKDNLDRFLAYSPDQHPIVLQIGGSNIENLAKATELANAYCYDEINLNCGCPSPKVAGHGCFGVSLMLNPKVSSLSPTKHFIIHSRKALLNGISPAENRSIPPLKYVLI

SEQ ID NO: 207555 - protein, 208 aa, Glycine max
  Coding DNA Sequence Number=SeqID_90777
METRTRFPELVIQEEKRVRFVVVNGLRIVEKPNNVPIDDAEWFKRLTGRSEVAISANDYKFYSPRHKYRRGASISLSNIQDIPSIISYQPQNQQQTPCKHHLQSLPHQPQLHPVLQNNQTMHQSQHAGPYSHNPQSGPSHLPEISHAHQPISISQHMTCLQPLTGGNVGGRLHMLPTTPAKFCDECGAPYLRETSKFCSECGSKRLGT

SEQ ID NO: 207556 - protein, 96 aa, Glycine max
  Coding DNA Sequence Number=SeqID_90778
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q38PK4; Match level="QueryCoverage=62%, HitCoverage=95%, E-value=2e-24, Identity=88%"; Hit description =Vacuolar ATP-related protein
  Pfam annotation: Domain name=ATP-synt_F; Domain location=13-81; Score= -8.5; E_value=0.037; Accession=PF01990.7; Description=ATP synthase (F14-kDa) subunit
MELRVSLTFIVPLVYHLQSYQMANRVQIPTNNSALIAMIADEVANMIRFLVDSYNKPVPAILEIPSKDHPYDPAHDSVLSRVKYLFNTESVASGRR

SEQ ID NO: 207557 - protein, 127 aa, Glycine max
  Coding DNA Sequence Number=SeqID_90779
MLSATAIGALLGLGTQMYSNALRKLPYMRHPWEHVVGMGLGAVFVNQLLKWEAQVEQDLDKMLEKAKAANERRYIGSPFLFNPNYSCEESGTFFEVVRKLKLNWSLQWLFWRKRIEGASAGMVDVDC

SEQ ID NO: 207558 - protein, 400 aa, Glycine max
  Coding DNA Sequence Number=SeqID_90780
  Gene Ontology: Mol. function=ATP-dependent DNA helicase activity; Biological process=DNA repair
  Homolog annotation: Hit_ID=A0BFS2; Match level="QueryCoverage=35%, HitCoverage=8%, E-value=3e-17, Identity=36%"; Hit description =Chromosome undetermined scaffold_104, whole genome shotgun sequence
MAVKETYGINSAAIPCLNHDKEYKENSTMNDRPVLLQLFVTVSPKLCQAVKHHVVRLKRIICGGNISAERNSIEEDIVDVDTSIQFKNTPDSFMNLPIDSYPLVITFQKFLMMLDGTVGISYLERFSDLSSDAKNLSARSVALETFIRKKEYTKKLDSSRVFTEIISHIKGGMQGVESSDGKLSREEYLSLSENQGSSLTRPKREIIHDVYQSYEKMKNDKGDFDLADIVIYLHRRLKMNKYEGDKMHFLYIDEVQDLTMTQIALFKYVCQNVEEGFVFCGATAQTIARGLDFRFQDIKSLFYMKFVLESKGNTYNQGKDVLLYNFFDSSPLKNRGRVIYEYMKEQDMLEPTEHKSYPNFRDSKHNLLSSELKQLYVAITLTRQRLWICENTEEYSRPMF

SEQ ID NO: 207559 - protein, 1272 aa, Glycine max
  Coding DNA Sequence Number=SeqID_90781
  Gene Ontology: Mol. function=protein serine/threonine kinase activity; Cellular component=integral to membrane; Biological process=protein amino acid phosphorylation
  Homolog annotation: Hit_ID=Q6L3I5; Match level="QueryCoverage=98%, HitCoverage=99%, E-value=0.0, Identity=58%"; Hit description=Leucine Rich Repeat family protein
  Pfam annotation: Domain name=LRRNT_2; Domain location=29-70; Score =39.5; E_value=1.2e-08; Accession=PF08263.3; Description=Leucine rich repeat N-terminal domain
  Pfam annotation: Domain name=LRR_1; Domain location=113-135; Score =16.7; E_value=0.084; Accession=PF00560.23; Description=Leucine Rich Repeat
  Pfam annotation: Domain name=LRR_1; Domain location=137-159; Score =13.3; E_value=0.92; Accession=PF00560.23; Description=Leucine Rich Repeat
  Pfam annotation: Domain name=LRR_1; Domain location=161-183; Score =15.5; E_value=0.19; Accession=PF00560.23; Description=Leucine Rich Repeat
  Pfam annotation: Domain name=LRR_1; Domain location=185-207; Score =11.3; E_value=2.2; Accession=PF00560.23; Description=Leucine Rich Repeat
  Pfam annotation: Domain name=LRR_1; Domain location=209-231; Score =8.9; E_value=6; Accession=PF00560.23; Description=Leucine Rich Repeat
  Pfam annotation: Domain name=LRR_1; Domain location=233-255; Score =9.1; E_value=5.6; Accession=PF00560.23; Description=Leucine Rich Repeat
  Pfam annotation: Domain name=LRR_1; Domain location=257-279; Score =14.7; E_value=0.33; Accession=PF00560.23; Description=Leucine Rich Repeat
  Pfam annotation: Domain name=LRR_1; Domain location=281-303; Score =9.3; E_value=5.3; Accession=PF00560.23; Description=Leucine Rich Repeat
  Pfam annotation: Domain name=LRR_1; Domain location=305-327; Score =17.3; E_value=0.057; Accession=PF00560.23; Description=Leucine Rich Repeat
  Pfam annotation: Domain name=LRR_1; Domain location=329-352; Score =8.0; E_value=9.1; Accession=PF00560.23; Description=Leucine Rich Repeat
  Pfam annotation: Domain name=LRR_1; Domain location=354-376; Score =10.2; E_value=3.5; Accession=PF00560.23; Description=Leucine Rich Repeat
  Pfam annotation: Domain name=LRR_1; Domain location=378-400; Score =13.2; E_value=0.93; Accession=PF00560.23; Description=Leucine Rich Repeat
  Pfam annotation: Domain name=LRR_1; Domain location=402-424; Score =9.8; E_value=4.2; Accession=PF00560.23; Description=Leucine Rich Repeat
  Pfam annotation: Domain name=LRR_1; Domain location=426-448; Score =8.9; E_value=6.1; Accession=PF00560.23; Description=Leucine Rich Repeat
  Pfam annotation: Domain name=LRR_1; Domain location=450-472; Score =13.5; E_value=0.79; Accession=PF00560.23; Description=Leucine Rich Repeat
  Pfam annotation: Domain name=LRR_1; Domain location=474-496; Score =8.9; E_value=6.1; Accession=PF00560.23; Description=Leucine Rich Repeat
  Pfam annotation: Domain name=LRR_1; Domain location=498-520; Score =10.8; E_value=2.8; Accession=PF00560.23; Description=Leucine Rich Repeat
  Pfam annotation: Domain name=LRR_1; Domain location=522-544; Score =15.3; E_value=0.22; Accession=PF00560.23; Description=Leucine Rich Repeat
  Pfam annotation: Domain name=LRR_1; Domain location=546-568; Score =9.7; E_value=4.4; Accession=PF00560.23; Description=Leucine Rich Repeat
  Pfam annotation: Domain name=LRR_1; Domain location=570-591; Score =9.8; E_value=4.2; Accession=PF00560.23; Description=Leucine Rich Repeat
  Pfam annotation: Domain name=LRR_1; Domain location=617-639; Score =12.8; E_value=1.2; Accession=PF00560.23; Description=Leucine Rich Repeat
  Pfam annotation: Domain name=LRR_1; Domain location=641-663; Score =16.8; E_value=0.079; Accession=PF00560.23; Description=Leucine Rich Repeat
  Pfam annotation: Domain name=LRR_1; Domain location=665-687; Score =12.3; E_value=1.4; Accession=PF00560.23; Description=Leucine Rich Repeat
  Pfam annotation: Domain name=LRR_1; Domain location=689-712; Score =9.7; E_value=4.4; Accession=PF00560.23; Description=Leucine Rich Repeat
  Pfam annotation: Domain name=LRR_1; Domain location=713-735; Score =13.3; E_value=0.88; Accession=PF00560.23; Description=Leucine Rich Repeat
  Pfam annotation: Domain name=LRR_1; Domain location=737-759; Score =14.3; E_value=0.43; Accession=PF00560.23; Description=Leucine Rich Repeat
  Pfam annotation: Domain name=LRR_1; Domain location=761-783; Score =6.8; E_value=15; Accession=PF00560.23; Description=Leucine Rich Repeat
  Pfam annotation: Domain name=LRR_1; Domain location=785-808; Score =1.9; E_value=1.2e+02; Accession=PF00560.23; Description=Leucine Rich Repeat
  Pfam annotation: Domain name=LRR_1; Domain location=810-832; Score =18.5; E_value=0.025; Accession=PF00560.23; Description=Leucine Rich Repeat
  Pfam annotation: Domain name=LRR_1; Domain location=834-856; Score =10.1; E_value=3.7; Accession=PF00560.23; Description=Leucine Rich Repeat
  Pfam annotation: Domain name=LRR_1; Domain location=89-111; Score =6.1; E_value=21; Accession=PF00560.23; Description=Leucine Rich Repeat
  Pfam annotation: Domain name=Pkinase; Domain location=966-1252; Score= 144.6; E_value=2.6e-40; Accession=PF00069.15; Description=Protein kinase domain
  Pfam annotation: Domain name=Pkinase_Tyr; Domain location=966-1252; Score=84.8; E_value=2.6e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::Pkinase::Pkinase_Tyr; Domain location=29 -70::113-135::137-159::161-183::185-207::209-231::233-255::257 -279::281-303::305-327::...
  Pfam module annotation: Domain location=329-352::354-376::378 -400::402-424::426-448::450-472::474-496::498-520::522-544::546 -568::570-591::617-639::641-663::665-687::689-712::713-735::737 -759::761-783::785-808::810-832::...
  Pfam module annotation: Domain location=834-856::89-111::966 -1252::966-1252
MTKFSTFAIAFLLCFSSMLLVLGQVNSDSESILRLLLEVKKSFVQDQQNVLSDWSEDNTDYCSWRGVSCELNSNSNSISNTLDSDSVQVVVGLNLSDSSLTGSISPSLGLLQNLLHLDLSSNSLMGPIPPNLSNLTSLQSLLLFSNQLTGHIPTELGSLTSLRVMRLGDNTLTGKIPASLGNLVNLVNLGLASCGLTGSIPRRLGKLSLLENLILQDNELMGPIPTELGNCSSLTIFTAANNKLNGSIPSELGQLSNLQILNFANNSLSGEIPSQLGDVSQLVYMNFMGNQLEGAIPPSLAQLGNLQNLDLSTNKLSGGIPEELGNMGELAYLVLSGNNLNCVIPKTICSNATSLEHLMLSESGLHGDIPAELSQCQQLKQLDLSNNALNGSINLELYGLLGLTDLLLNNNSLVGSISPFIGNLSGLQTLALFHNNLQGALPREIGMLGKLEILYLYDNQLSEAIPMEIGNCSSLQMVDFFGNHFSGKIPITIGRLKELNFLHLRQNELVGEIPATLGNCHKLNILDLADNQLSGAIPATFGFLEALQQLMLYNNSLEGNLPHQLINVANLTRVNLSKNRLNGSIAALCSSQSFLSFDVTENEFDGEIPSQMGNSPSLQRLRLGNNKFSGEIPRTLAKIRELSLLDLSGNSLTGPIPAELSLCNKLAYIDLNSNLLFGQIPSWLEKLPELGELKLSSNNFSGPLPLGLFKCSKLLVLSLNDNSLNGSLPSDIGDLAYLNVLRLDHNKFSGPIPPEIGKLSKIYELWLSRNNFNAEMPPEIGKLQNLQIILDLSYNNLSGQIPSSVGTLLKLEALDLSHNQLTGEVPPHIGEMSSLGKLDLSYNNLQGKLDKQFSRWPDEAFEGNLQLCGSPLERCRRDDASRSAGLNESLVAIISSISTLAAIALLILAVRIFSKNKQEFCWKGSEVNYVYSSSSSQAQRRPLFQLNAAGKRDFRWEDIMDATNNLSDDFMIGSGGSGKIYKAELATGETVAVKKISSKDEFLLNKSFIREVKTLGRIRHRHLVKLIGYCTNKNKEAGWNLLIYEYMENGSVWNWLHGKPAKANKVKRSIDWETRFKIAVGLAQGVEYLHHDCVPRIIHRDIKSSNVLLDTKMEAHLGDFGLAKALTENCDSNTESNSWFAGSYGYIAPEYAYLLHATEKSDVYSMGIVLMELVSGKMPTNDFFGAEMDMVRWVEMHMDIHGSAREELIDPELKPLLPGEEFAAFQVLEIALQCTKTTPQERPSSRKACDRLLHVFNNRTVNFEKMNLDHYK

SEQ ID NO: 207560 - protein, 42 aa, Glycine max
  Coding DNA Sequence Number=SeqID_90782
MAMQVEKEDAVSPAMQNKRPYENHPTRSIASMVIINKLKETR

SEQ ID NO: 207561 - protein, 124 aa, Glycine max
  Coding DNA Sequence Number=SeqID_90783
MAKSLRSKREKRLRAIRREIVEPFYDKKEAAKLAAQEAALAAPKLEVPSKPNTAMEASASTDNTNMDVEVADGSQSMASLKPVGGIGKKSKKKLKIAKNKRRGNGKHRRTRSGILNHEDSSNFD

SEQ ID NO: 207562 - protein, 175 aa, Glycine max
  Coding DNA Sequence Number=SeqID_90784
MAMLEHNNFSPSTSNKEGAKKRNTKVVASAREESEQNSKKDMALGDTGKGSIHVPKREHSQHSQSQNRIFNASAHEVPSGPNPISNSERRNEGKEQETSLNHNIVLREKVYMDLASKAAYEGSISFFLNIPKYPHHFLWNSLGTLCPIPFKIEAKHGKLSLNSYISIQCLFLLVG

SEQ ID NO: 207563 - protein, 237 aa, Glycine max
  Coding DNA Sequence Number=SeqID_90785
MEGSTTPPSLSSPQHSDFSTGYLEDALIESCERSKRRRVLPCAADEHSKSFIDDLEQSFWNFNPLWNQPVENFNFYCMNQIERFCGFSDEHISTSRSEEANILLADTKTPEETISASESLNSSSSSYKQPVTCKTTDPTVAPTENDDTRNKKVVTRVVYPFAMVKPGGREGDVTLNDINERILMPPTRPVRHPVGDFACRPCVSAEGPGLSGKAVVALTRIHTQGGRGTITIIRTKG

SEQ ID NO: 207564 - protein, 203 aa, Glycine max
  Coding DNA Sequence Number=SeqID_90786
  Gene Ontology: Mol. function=transporter activity; Cellular component= integral to membrane; Biological process=oligopeptide transport
  Homolog annotation: Hit_ID=Q9ZTX4; Match level="QueryCoverage=98%, HitCoverage=35%, E-value=9e-89, Identity=72%"; Hit description=LeOPT1
  Pfam annotation: Domain name=PTR2; Domain location=37-203; Score= -90.2; E_value=0.014; Accession=PF00854.12; Description=POT family
SHEGNVSSARNISIWLGTSYLTPLIGAVLADGYWGRYWTIAVFSAGMCTLTLSASLPALKPSECLGSVCPSATPAQYSVSYFGLYVIALGIGGIKSCVPSFGAGKFDNTDPKERVKKGSFFNWYYFSINLGAIVSCSIVVWIQDNAGWGLGFGIPTLFMVLSVVSFFRGTPLYWFQKTGGSPVTRMCQVLCTFVQKWNLVVPQ

SEQ ID NO: 207565 - protein, 412 aa, Glycine max
  Coding DNA Sequence Number=SeqID_90787
  Gene Ontology: Mol. function=histone-lysine N-methyltransferase activity; Cellular component=nucleus; Biological process=chromatin modification
  Homolog annotation: Hit_ID=Q9ZUM9; Match level="QueryCoverage=97%, HitCoverage=96%, E-value=1e-100, Identity=47%"; Hit description =Histone-lysine N-methyltransferase ASHR2
MAAPSSLLKVEEIQGRGRGMVASQPLKAGQIVLRDSPILLYSALPLVRQSLSSSSSSASTSCFCDHCFRILSPSLQGDSSSSTVLCPNCRHHCFCNSNCLSNALNSSHSSWVCQALSHLRANSLLLEQPLEHQVQVNFLVAAYNLANISPSDFQIMLSLQGSPDDSTIAAAQFLHPLISSLCSLALIGPQNGFSLELTSAILAKDKLNAFGIMQPFSEHDDQRSVRAYGIYPYASFFNHDCLPNACRFDYVDANPSDDSHNTDFIIRMIHDVPQGREICLSYFPVNEKYSSRQKRLIEDYGFTCNCDRCNVESNWSDNDSVEDNAEEEEEVMDEDQCETMAASDTDDHPHEDNNDFPHAYFFLKYMCDRTNCWGTLAPLPPQGDTPCNVMECNVCGKLKSDNTFDIDEGQDE

SEQ ID NO: 207566 - protein, 584 aa, Glycine max
  Coding DNA Sequence Number=SeqID_90788
  Gene Ontology: Mol. function=transporter activity; Cellular component= integral to membrane; Biological process=oligopeptide transport
  Homolog annotation: Hit_ID=Q7XAC3; Match level="QueryCoverage=99%, HitCoverage=100%, E-value=0.0, Identity=84%"; Hit description =Peptide transporter 1
  Pfam annotation: Domain name=MFS_1; Domain location=51-533; Score =10.8; E_value=0.0001; Accession=PF07690.6; Description=Major Facilitator Superfamily
  Pfam annotation: Domain name=PTR2; Domain location=113-517; Score =568.4; E_value=7e-168; Accession=PF00854.12; Description=POT family
  Pfam module annotation: Pfam domain module=MFS_1::PTR2; Domain location=51-533::113-517
MGSTENELSLAEEALLQDDESKQYTGDGSVDFKGRPVLKRNTGNWKACPFILGNECCERLAYYGIATNLVTYLTQKLHEGNVSAARNVTTWQGTCYLAPLIGAVLADAYWGRYWTIAIFSTIYFIGMGTLTLSASVPALKPAECLGTACPPATPAQYAVFFFGLYLIALGTGGIKPCVSSFGADQFDDTDPQERIKKGSFFNWFYFSINIGALVSSTFIVWIQENAGWGLGFGIPALFMALAIGSFFLGTPLYRFQKPGGSPITRMCQVVVASVWKRNLVVPEDSNLLYETPDKSSAIEGSRKLGHSDELKCLDRAAVVSDAESKSGDYSNQWRLCTVTQVEELKILIRMFPVWATGIVFAAVYAQMSTLFVEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAKRYKQKKSA

SEQ ID NO: 207567 - protein, 90 aa, Glycine max
  Coding DNA Sequence Number=SeqID_90789
MKVSKLRMMQTQAETIKEQAQNHGYLEGKPRRVPLGVGFQRRTMAVFDGYWWLWVMEKELGTLEMDLEERRRRKWRFSKATWTIRLKTHK

SEQ ID NO: 207568 - protein, 44 aa, Glycine max
  Coding DNA Sequence Number=SeqID_90790
  Pfam annotation: Domain name=KNOX2; Domain location=4-37; Score=23.0; E_value=0.00023; Accession=PF03791.4; Description=KNOX2 domain
MAGGTASIDEDPEVDQFMEAYCEMLIKIECQFKSLTISSSLDTT

SEQ ID NO: 207569 - protein, 203 aa, Glycine max
  Coding DNA Sequence Number=SeqID_90791
MERRLLIGSLAGRKEESGFYLHAKDVQMSLDGTRGCINYNPVLAIRQLGYPMRGVPSDESITPFIARGFSDHNARDRELRGSSNGIIGGYHKWLRVRTQGLDWLPNLKTVRDDEVKASEESDEVQALKAELERARVVEEKFKSIAIKESSRVKGMISEEVKGIITGQRHDLEGRAKGNMWAIIDKCKEKLNLAATHEQRLEDE

SEQ ID NO: 207570 - protein, 311 aa, Glycine max
  Coding DNA Sequence Number=SeqID_90792
  Gene Ontology: Mol. function=riboflavin synthase activity; Cellular component=riboflavin synthase complex; Biological process=riboflavin biosynthetic process
  Homolog annotation: Hit_ID=P61714; Match level="QueryCoverage=50%, HitCoverage=100%, E-value=4e-70, Identity=87%"; Hit description=6,7 -dimethyl-8-ribityllumazine synthase
  Pfam annotation: Domain name=DMRL_synthase; Domain location=165-309; Score=306.6; E_value=4.5e-89; Accession=PF00885.10; Description=6,7 -dimethyl-8-ribityllumazine synthase
  Pfam annotation: Domain name=RibD_C; Domain location=1-135; Score =17.8; E_value=1.6e-07; Accession=PF01872.8; Description=RibD C -terminal domain
  Pfam module annotation: Pfam domain module=DMRL_synthase::RibD_C; Domain location=165-309::1-135
PVRVVIDSQQRVTPQHRLIAQPGETWLMRTEADAQSWPPGVSQIEVPPRGEQLDLVAMMMLLGQRQINSVWVEAGAGLAGALLQAGLVDELIVYLAPKLLGNAARGLCALPGLETLADAPALNFSDVRQPERVAEEYDRIRPLLRGHKTNTQRICMKVIEAAVATPDANIAIVIARFNNFINDSLLDGAVDALKRIGQVKAENITVVWVPGAYELPLAARALAKTGKHDAIVALGTVIRGGTAHFEYVAGEASSGIAHVAMNSEIPVTFGVLTTENIEQAIERAGTKAGNKGAEAALTALEMINVLKAIKA

SEQ ID NO: 207571 - protein, 66 aa, Glycine max
  Coding DNA Sequence Number=SeqID_90793
MGVKYLEAVKRGSHAIKQWSPDEIRIHRIPLVKNIVFLKTSMQHGQAYIPIVRFPDLNYGIKNYKQ

SEQ ID NO: 207572 - protein, 150 aa, Glycine max
  Coding DNA Sequence Number=SeqID_90794
  Gene Ontology: Mol. function=transporter activity; Biological process= transport
  Homolog annotation: Hit_ID=Q0BAX0; Match level="QueryCoverage=95%, HitCoverage=29%, E-value=7e-11, Identity=30%"; Hit description=Outer membrane efflux protein precursor
MVARALAYSRELRAASAEVLASDYMVDQRSKVVAKQYVGRMKELVTMLSQITQADRGRESELVQAKAKLMSAQASLDNIEHQLSASKIKLVRLLGIEPELPEGISWHDTVIPASVALSALDKNPMMLNLQSKVRAAEYEAESIKSSALPQ

SEQ ID NO: 207573 - protein, 84 aa, Glycine max
  Coding DNA Sequence Number=SeqID_90795
  Subcellular localization annotation: CTP_CleavageSite=20; ConfidenceScore=5.21e-01
GSNWAASSSTFLKNGFRGFRGFRNTSVKFPKTLGKHIPLNIGEREEKKDERGSNWAASSSTFLKNGFRGFRDFRNTSVKFPKTL

SEQ ID NO: 207574 - protein, 80 aa, Glycine max
  Coding DNA Sequence Number=SeqID_90796
TGDSTVLKIGNSAKVVIKQDMKGRRHKYGFNNNKREKVEKKRVVDDETGDKNQLDEHQERLRKKLALEEERTFAANEQLS

SEQ ID NO: 207575 - protein, 204 aa, Glycine max
  Coding DNA Sequence Number=SeqID_90797
  Gene Ontology: Mol. function=transferase activity
  Homolog annotation: Hit_ID=Q1FMU9; Match level="QueryCoverage=89%, HitCoverage=67%, E-value=7e-20, Identity=39%"; Hit description =Glycosyltransferase
MAMVTMRWRGNAQINMRKRYSVGHVAGQICDRRESRFRRQKIDRRLDEDDYWKTYVELNYKGIQKKIIGEKYIESANGHGPEDYKIYCFRGVPYCTLLCVGRDTGSPKYYFFDKDFKFLCYSDDCLALSQEEIDAFVKPEGYDELFEYASRLSAPFEFVRVDFYISQGRIIFGELTFTPSAGLDTDILPPTDVLLGEMLTLQQH

SEQ ID NO: 207576 - protein, 52 aa, Glycine max
  Coding DNA Sequence Number=SeqID_90798
MSMQVEGSSQNGRKQGTDETATAKNSESHIGKRLLESLVADETVTILILEPV

SEQ ID NO: 207577 - protein, 113 aa, Glycine max
  Coding DNA Sequence Number=SeqID_90799
YILYGTSKGYIYLGVVILRTREGTSLVDQFKWRVHPLGYSKRTREGTSLVDLWLVKDFTRLKRNLKNHRPLDPTPEGLARMINGFLSSSYGLLLPSDDQWVPILFSNSGVDRV

SEQ ID NO: 207578 - protein, 49 aa, Glycine max
  Coding DNA Sequence Number=SeqID_90800
MCAEDARRFSETFARDPQLASRTARRNWRPTSPGRKVKRKIRRASAVAR

SEQ ID NO: 207579 - protein, 60 aa, Glycine max
  Coding DNA Sequence Number=SeqID_90801
MENWRTALRNNFAGLQIPLGNNIHGAPKKSGEWRIGEQRYAITSRGSRLEGGGCMNSARQ

SEQ ID NO: 207580 - protein, 105 aa, Glycine max
  Coding DNA Sequence Number=SeqID_90802
  Gene Ontology: Mol. function=nucleic acid binding; Biological process= DNA integration
  Homolog annotation: Hit_ID=Q1SEE1; Match level="QueryCoverage=88%, HitCoverage=10%, E-value=5e-14, Identity=37%"; Hit description =Integrase, catalytic region; Zinc finger, CCHC-type; Peptidase aspartic, catalytic
MKALLDMYEKPLATNKVYLMRRLFNLKMGEVSSSTKENTLKLSDIRDLILSEDVRKRDLRESSNHVSNSALNTKGRGRTTQKGQNGRGRSSGLRIIKNRGGGGVN

SEQ ID NO: 207581 - protein, 140 aa, Glycine max
  Coding DNA Sequence Number=SeqID_90803
  Gene Ontology: Mol. function=DNA-directed DNA polymerase activity; Cellular component=intracellular; Biological process=DNA replication
  Homolog annotation: Hit_ID=Q1SZC3; Match level="QueryCoverage=69%, HitCoverage=4%, E-value=7e-35, Identity=73%"; Hit description=DNA -directed DNA polymerase; Helicase, C-terminal
MELWGIGVDLERCIQARKLLIKRLKHLEKEAYKLAGTTFSLNMPADIARVLYEHLKLPIPDVRNKGKQHPSTSKHCLDALRGFLIPIDWLYKRVGNLIVRNRGRHAVDKITCHEKHITSEEKRNIMVKKGTGSPSANSFF

SEQ ID NO: 207582 - protein, 113 aa, Glycine max
  Coding DNA Sequence Number=SeqID_90804
  Homolog annotation: Hit_ID=Q1SZC3; Match level="QueryCoverage=73%, HitCoverage=3%, E-value=2e-36, Identity=89%"; Hit description=DNA -directed DNA polymerase; Helicase, C-terminal
MAKLLNSTLGSICSLARLSVSTQKYTLHGHWLQTSTATGRLSMEEPNLQCVEHAVEFKMKDENEGDADESYCTINARDFFVPTQMVSESIPCWTIVPPAIRPPTDVQSCKLHV

SEQ ID NO: 207583 - protein, 594 aa, Glycine max
  Coding DNA Sequence Number=SeqID_90805
  Gene Ontology: Mol. function=DNA-directed DNA polymerase activity; Biological process=DNA replication
  Homolog annotation: Hit_ID=Q1SZC3; Match level="QueryCoverage=96%, HitCoverage=26%, E-value=0.0, Identity=65%"; Hit description=DNA -directed DNA polymerase; Helicase, C-terminal
MTALNLHYTYVIHINRLIREIPVGEVCEAFKVARGMVQALQENAGRFASMVAVFCERLGWHDLEGLVAKFQNRVSFGVRAEIVELTTIPYVKGSRARSLYKAGLRTPHAIAEASIPEIVKALFESSSWATEGSAQRGFQFGIAKKIKNGARKIVFDKAEEASNAAFSAFKSLGFNVPQFDPQILSTAARDSIRLGTGSTSGSDTTDTSHSFVNADCIDNTNKFTLDKEKEDLIKLSVNGTVASVEGKSRSRMICSLSSVPVAGPKMDELNRTSDHTKNADMTILSVQLQKPNDKSGVHDGCDAHCTEEAHKNGNLASGNAGSSSQKGPINAVSSPGGLDSFLDLWDSMPEFYFDIHYIKRLELHSTAPFEIHGIAVCWENSSVYYINLPRDILLSDSIKDGCLSLSACSHKKKVSSSNSKQDLEIARSRWNRISKIIGKINVRKFTWNLKIQMQVLKRPAFSVQRFGCLDTLGKSMDLEVVDNSYVLLPPIHVKDAIDMCIVAWILWPDEESSSSPNLDKEVKKRLSSEDAAVANQSGRWRNQMRRAAHNGCCRRVAQIRALSSVLWKLLVSEKLVEVLMDIEIPLFTFSEECK

SEQ ID NO: 207584 - protein, 299 aa, Glycine max
  Coding DNA Sequence Number=SeqID_90806
  Gene Ontology: Mol. function=RNA-directed DNA polymerase activity; Cellular component=chromatin; Biological process=chromatin assembly or disassembly
MVHWPMPTNTHSFCDFLGLTRFYSNFIKGYASITTPLTSLLQKEKFHWSDAAQTAFDNLKHAITQAPILALLDFSVPFTLETDAFGLAMGAVLMQHGHPLACFSNFFCPRLQCASTYVRELHAITTAIRKWCQYLLGHPFIILTDHKSLYKLMNQVIQTSKKQVYLSKLLRYDYSIQYKFGKAIVVANALSRLPQYSSGQCLILSMPHPLFLDAIRAYIRTHTSVQDHIHKVTSSTNFVQYKFGMENVVADFKFHGRLLFFKNKIWLDPDHLFRTSQIEEFHSTPIGGHIGFAKTLHRL

SEQ ID NO: 207585 - protein, 153 aa, Glycine max
  Coding DNA Sequence Number=SeqID_90807
  Pfam annotation: Domain name=zf-CCHC; Domain location=81-98; Score =34.1; E_value=5e-07; Accession=PF00098.13; Description=Zinc knuckle
MELQRLNQNEETDKRKRSIALKASSSMQEEEEEEEEEEESDDEEDFSLLVKKFHKFVKNRRMERSHNFNNGKRSQEVSPTLKCYKCNQPGHIKANCPSNESWSEKNEKKSYKERRSKKVYISWDDNDSSNDSEKEINLLSKDYESDENISQED

SEQ ID NO: 207586 - protein, 166 aa, Glycine max
  Coding DNA Sequence Number=SeqID_90808
  Gene Ontology: Mol. function=transferase activity; Biological process= DNA integration
MAEPSKKHKGSSSRSQRHSEVQDTPIPSSISSSSLFSSEEQHIRNYLDVHLFSTTVDLMALIILQWFNQMMVVVGMRRNWESQTISHDTNSFSDLEGPIILFGKLVESGPGQGCLAVRAKLNLYPITNVRAINKVQRSWRVVSMLSMASTCDDPGMYVVMESGALP

SEQ ID NO: 207587 - protein, 187 aa, Glycine max
  Coding DNA Sequence Number=SeqID_90809
MWGSRKGGSILGGVSGYQEVDDVREGWFHSRGDEKWRYGRKLRQNGIRLKCNRTADMVELHGQCVVVGDDRPELFQPLMGNVVTREDGVITDGDLKRGSGTGKGVETYEGMGWVKRRWDRWFGNIGFEWDSGARIVGNQQKEMSATTMGWRPGWVVKVGKGGNGPPTYPPGVWQERRPAEEIWVAKL

SEQ ID NO: 207588 - protein, 97 aa, Glycine max
  Coding DNA Sequence Number=SeqID_90810
MGLKWCFWGPHQRDIILKFQSCQCDRGSTKGSTPCGGRATSGGGSWWSPMAVGGGGGGFRGEISLAYVSWPNLNSHKVAIKRDIRAKGNFSFDWNCI

SEQ ID NO: 207589 - protein, 86 aa, Glycine max
  Coding DNA Sequence Number=SeqID_90811
MTQTKSNPYIPLNNLEGIISKSFFFSNKFLNYHITNLLPLELSELSGLVQFKLDDYWECTPCHKVMTRFLPTRLWLAFVRIAKLAP

SEQ ID NO: 207590 - protein, 106 aa, Glycine max
  Coding DNA Sequence Number=SeqID_90812
MSNEELKLQDPRCRIQCPDILPENTGVAAQCISQDKMKNDRSPPAQAVAAQIRTLLYNHGGCTSFVPSPGLKSYFVSLGLECFVSHLDGTLTSSVGPECVELISSV

SEQ ID NO: 207591 - protein, 93 aa, Glycine max
  Coding DNA Sequence Number=SeqID_90813
MYKDNWTQPWPMGSEICPEVHENPRAFFSSSSPILLEPLAHGSSDWSLPREDCIMDDPTRKREKVNPSPTREETSSAIPKSRRHRAKRKRPKA

SEQ ID NO: 207592 - protein, 150 aa, Glycine max
  Coding DNA Sequence Number=SeqID_90814
MGINLKEDPTTLMEEQPLAQLMATHSGNNYLKWKTCRTRTMPNKNLTKRLNNNAPRQRCKKREVEERKSQADTISALASLSQMRLTKWWWIDVAPCGACRPWIFFINRFLCFLRSDCSGMEKEKDEWRRHFKLKMSLEEAHHHRKPWIRA

SEQ ID NO: 207593 - protein, 712 aa, Glycine max
  Coding DNA Sequence Number=SeqID_90815
  Homolog annotation: Hit_ID=Q1SQN7; Match level="QueryCoverage=42%, HitCoverage=54%, E-value=3e-11, Identity=27%"; Hit description=RNA -directed DNA polymerase
GASKARVPKRIGVVVHMEKKECLFNSLVDTLNDPKMFDKLRVAIVLEECFTSLMGMFQALVADDDETVKIKRLDTTQLLVCISYSSQMGSLEGVIGMDQASSDLKCNQDEVGEGESARWSKPKFLDEEGVRVYLVVNENLIINGLVETVVQDTLGIDTLSQIRVSVEGSSELVVQPINLDVEGMLDPGTNACLKEGGPIGASSSSLSAGSKFKQSSLGCTTTLYPRNKKEEVTKEVCYALWGNNEVQWSFVASEGELGGMLCLWDTPNFEVTSCFIGEVYIGLEDFNCVISPNEKEGEGDLDYGRAEWEEFNDFIDSMEVEEVLVIVGKLKVELNLLHCADDTLFFGEATLANVITIKTLGVVQIFLESYASVMNCKIIKLHFIYLGIPVGANPRKEETGGANYGENYRETTILEAQNSIFYGKGVGEFERKIMWVKWLAVCRPKSHGGLGVRVLVMQSYPPRVLDRRLQKDWARATKEGPRVLMNLRLSSSFFRNILKESSQGASSSIFLSKAILGGEAPSSLAYSLVDGASPLLFSFAFRCISMVELVDANSSKKASIWAKIVEVSLREELSEMPSHISLKRHEEDSWLWLCDSSGVYLVHSTYLAISVMKEGSQACPMFSSIWKAQVSQKLCPPGNCNISFLATRGSYLEQQSKVRMVVWGSNSLEYLGTSFVVQVEGTSTWVVDCEQERDFYKVERNLKDRRSLGDWM

SEQ ID NO: 207594 - protein, 114 aa, Glycine max
  Coding DNA Sequence Number=SeqID_90816
MRIQGTNRLRILCLNTLEGTSFVVQVEGTSTWVVILRTKEGTSLVDQFKWRVHPLGCSKRTREGTSLVDLWLVKDFTRLKEISRIVGCLGTGCRHGLWPNQYKSCVCHLLPYTL

SEQ ID NO: 207595 - protein, 154 aa, Glycine max
  Coding DNA Sequence Number=SeqID_90817
MGDSQENNKGKSRDKDNYVSWTMEDTNELLHLLVDAMNRGLRDANGSLSKQNFRNQYNMMSTLMRNNSGFGWDPIGKTFTAHEDVWKDYLKSHPSHSKLRGKSMVDYEYLKIVVGGGVSSGNNSISVDPDDTDATTFEPENRTVGIEEFSYDPN

SEQ ID NO: 207596 - protein, 96 aa, Glycine max
  Coding DNA Sequence Number=SeqID_90818
  Gene Ontology: Mol. function=oxygen transporter activity; Biological process=oxygen transport
  Homolog annotation: Hit_ID=Q7Y079; Match level="QueryCoverage=91%, HitCoverage=52%, E-value=2e-39, Identity=84%"; Hit description=2-on -2 hemoglobin
  Pfam annotation: Domain name=Bac_globin; Domain location=26-93; Score= 24.9; E_value=4.8e-06; Accession=PF01152.11; Description=Bacterial -like globin
MQSLQQKASEWSGVSIDDAFGIDDTNLFQKLGLQTFINLSTNFYNRVYDDEEEWFRSIFANSEKENAIQNQYEFFVQRMGGPPLFSQRRVDSVIAP

SEQ ID NO: 207597 - protein, 56 aa, Glycine max
  Coding DNA Sequence Number=SeqID_90819
MLVVQKECGERETECDERKREGGNQWSVVKKMGSVLPKGSVQGKGECLKKGFGLTA

SEQ ID NO: 207598 - protein, 71 aa, Glycine max
  Coding DNA Sequence Number=SeqID_90820
MNVKKREYMVGVLPKRRILMRYGESQGNWDTMTYNTIPDHNIQSMVQGMAQALCVDKHLHHVIDSDGCSAD

SEQ ID NO: 207599 - protein, 108 aa, Glycine max
  Coding DNA Sequence Number=SeqID_90821
  Homolog annotation: Hit_ID=Q8RUI1; Match level="QueryCoverage=94%, HitCoverage=93%, E-value=8e-10, Identity=40%"; Hit description =Expressed protein
MKDIKKYWFNASSPSTTQSIRLGRSYTKPHYESNRDGTKPMWQMLWRKLKRDHKKKGFGSMEGIYDPESYSMNFDHGTGWMEPDNLPRSFSSRYADPSRILPPRHLLD

SEQ ID NO: 207600 - protein, 1097 aa, Glycine max
  Coding DNA Sequence Number=SeqID_90822
  Gene Ontology: Mol. function=DNA-directed DNA polymerase activity; Cellular component=intracellular; Biological process=DNA replication
  Homolog annotation: Hit_ID=Q1SZC3; Match level="QueryCoverage=91%, HitCoverage=45%, E-value=0.0, Identity=72%"; Hit description=DNA -directed DNA polymerase; Helicase, C-terminal
  Pfam annotation: Domain name=DEAD; Domain location=581-768; Score =63.3; E_value=8e-16; Accession=PF00270.19; Description=DEADDEAH box helicase
  Pfam annotation: Domain name=Helicase_C; Domain location=892-969; Score=42.4; E_value=1.5e-09; Accession=PF00271.21; Description =Helicase conserved C-terminal domain
  Pfam annotation: Domain name=ResIII; Domain location=575-764; Score= -39.3; E_value=0.092; Accession=PF04851.6; Description=Type III restriction enzyme, res subunit
  Pfam module annotation: Pfam domain module=DEAD::Helicase_C::ResIII; Domain location=581-768::892-969::575-764
  Subcellular localization annotation: CTP_CleavageSite=55; ConfidenceScore=5.04e-01
MCHNLRQGVVGECFQHSLHINCIGTIDAFSQGATPKSTNRSVRRVSSTRLSRSIKATHYATLYDASSFSCLAQGEEEEQQRNTTLLVLHMASPSHRSRIDQFYASKKRKAASPVPKAGRFEKGARHGADESPSAKGTLEGYLVSSQDGGGDGCGDANTVKVKRNLTSEIGGSLDNELNKHTVSLGQGCGDSQSIQPSEIGQGVAKSERKQFAADFLSLYCSVLHPSVGLPLEMKMDDHKRHGSPTLVEGNSVLLRKNNDTAGELCFGGENTLLSVKIDEDIKSGVVGNNNSMGCVPGSCTKVSGGGDTTGFETGFRKCNNTPKPSMKLAEYYNTPGSLIVKASVRETPKSTRGSSSFSPGEAFWNEAIQLADGLCVPMGNDPSKVMGESNVVEEEPEMKNSCNLQNYDGKPRKILDQSKNRIRNREMGAPLGLVGMHTKDSVKEASSLPVKHFDFSFEDNNLEENTLQDCRVGDSINVTCVAGKQYDSCSMIGHTYEKMNEVQENTLVDTLGKRVCQDNVSMTSNSPHNEVRTPISAHASDEASTPSTSVSLNDHFDLNSWLPPEICSIYRKKGISRLYSWQVDCLRVDGVLQRRNLVYCASTSAGKSFVAEILMLRRVIITGKMALLVLPYVSICAEKAEHLERLLDPLGKHVRSYYGNQGGGTLPKDTSVAVCTIEKANSLVNRLLEEGRLSEMGIIVIDELHMVGDPRRGYLLELMLTKLRYAAGEGIPKSSDGESSGGSSDKADPAQGLQIVGMSATMPNVAAVADWLQAALYQTEFRPVPLEEYIKVGNSIYNKSMELCRIISKAAELGGKDPDHVVELCNEVVQEGHSVLIFCSSRKGCESTARHIAKFLKSFTVDANDCEFADITSAINSLGKCPAGLDPILQETLPSGVAFHHAGLTVEEREIVETCYRKGLLRVLTATSTLAAGVNLPARRVIFRQPRIGCDFLDGTRYKQMAGRAGRTGIDTKGESILICKPEELKKVSGLLNESCPPLHSCLSEDMNGMTHAILEVVAGGIVQTASDINRYVRCTLLNSTKPFLDVVKSAQESLRWLCQRKFLEWNEDTKLYSTTPLGRASFGSSLCPQESLNSSL

SEQ ID NO: 207601 - protein, 141 aa, Glycine max
  Coding DNA Sequence Number=SeqID_90823
MAQSNSSRLGFPALITALCRSRGVASDSLVFERLSPVINLAYIRKNYWNPDDPTVIIRGARRPRARPTKAPSTLVAPHPASTSAAPPPARMKAVPSTLSLADFQHFEAMLRSIHQGLARDSASSSQGIQRSHHSGTPSAKG

SEQ ID NO: 207602 - protein, 98 aa, Glycine max
  Coding DNA Sequence Number=SeqID_90824
ELDPRPTPIEIFPCAVQVNFALEGIPGSSELQPEEVGSGINFLSQTSLIGETSTKALIRRILVCKAFDLKGASVGETVPVAKVKPVHSFMAIGLVRKK

SEQ ID NO: 207603 - protein, 148 aa, Glycine max
  Coding DNA Sequence Number=SeqID_90825
  Subcellular localization annotation: CTP_CleavageSite=69; ConfidenceScore=5.40e-01
YMLAQLKPPSYSASSSDLASSTTDADNASSLPTKAAKQKSLLSLSSDIKLATDSPTDSGTETATGTETSAAYLTTLAYPDSPTDSETYSVDAATADSDSSSSASSGERETRRAYLWHRAFFLSSGWNFRAFEIIAVALSFFHREGTYP

SEQ ID NO: 207604 - protein, 116 aa, Glycine max
  Coding DNA Sequence Number=SeqID_90826
MGDLEEVQEQMKADMSALKEQMASMMDAMLGMKQLMESNAATATAVSSTTEADPTLLTAAHHPIPNMVSYVTTRVMFLPSYLKGSLLDIWTWSTRIIESMLRETSTPTPRFPLRGQ

SEQ ID NO: 207605 - protein, 332 aa, Glycine max
  Coding DNA Sequence Number=SeqID_90827
MPTDIREIEAALCIPGQGFILNAEGHSGNILRKDLTTLAQVWSVLSYSNLALTSHTSDLIMDRARLIFGLVTQLDMNVGALIFGQITSMAQSNSSRLRFPTLIATLSRTKGVSSNSLVFERLSPVINLAYIRKNCWNPNKPTIIIRGARRPRARPAKAPYTSAVPHLASTSAAPSSTCIAAAPSTPPPADFNVSKPCFEAYIRGRLFCCKVSNWTRPPPHRDNEDPAAQVPHQPADESSESSTPEPLIRKRRVVVTQEAAATPEKSPEATPEPPTPMADTTSPQQAANPSTPEDQTTPVQSPNTSLVSTLVLHLTDEEEVQTQDTQNQSHDF

SEQ ID NO: 207606 - protein, 68 aa, Glycine max
  Coding DNA Sequence Number=SeqID_90828
MTNANCLQESLHSVSNRNLRLWKSIHYCFKSEGPSQIDNICARAKGHEDEDNLWILCFGKRHISFESS

SEQ ID NO: 207607 - protein, 65 aa, Glycine max
  Coding DNA Sequence Number=SeqID_90829
  Subcellular localization annotation: CTP_CleavageSite=49; ConfidenceScore=5.34e-01
MGIAPTKTLGGPRKVKQSPGISSSGYGPLSVLQGARTPPARSRHHRDCACSGPEEVQQGLGVVKL

SEQ ID NO: 207608 - protein, 76 aa, Glycine max
  Coding DNA Sequence Number=SeqID_90830
MDLVLCLPLALDLVAYWSAMGQVNSRGGGGASIARYRPSQCYCGVSPCTRLGAQYFLMKARLVGGLMPLLEVTGTP

SEQ ID NO: 207609 - protein, 113 aa, Glycine max
  Coding DNA Sequence Number=SeqID_90831
  Gene Ontology: Mol. function=oxidoreductase activity; Cellular component=integral to membrane; Biological process=fatty acid biosynthetic process
  Homolog annotation: Hit_ID=UPI0000668CDA; Match level="QueryCoverage =80%, HitCoverage=24%, E-value=3e-29, Identity=68%"; Hit description =TRAP dicarboxylate transporter, DctM subunit
MCSGLAVLALVTGLCVFSRNYRHRPVYQLGNHIAICGKIIRRMMVSTMRKKNGSHHEEIVAEGRRDIRDLASDGVEHAEPDGVKAEALDQRYVKRRYDDQHGRIIKEHAQYDE

SEQ ID NO: 207610 - protein, 216 aa, Glycine max
  Coding DNA Sequence Number=SeqID_90832
  Gene Ontology: Cellular component=outer membrane-bounded periplasmic space; Biological process=transport
  Homolog annotation: Hit_ID=Q4FL44; Match level="QueryCoverage=95%, HitCoverage=58%, E-value=2e-71, Identity=61%"; Hit description=TRAP -type bacterial extracellular solute-binding protein
MGMSENSKLNKRDFLKKAGLTTVGALGASTLATPYVRAQSPIKWRLQTYAGPALAEHVIKPSIDAFNKAANGEMVIELYTADQLVPQGELFRAVQSGTIDAAQSDDDSMASPVDVAVFGAYFPFASRYSLDVPALFNWYGLNEIWEEAYKEIPGVTWLSAGSWDPCNFVTTKPIRSVADLKGLRVFTFPTGGRFLTKFGVVPVTLPWEDIEVAIQT

SEQ ID NO: 207611 - protein, 234 aa, Glycine max
  Coding DNA Sequence Number=SeqID_90833
  Gene Ontology: Mol. function=oxidoreductase activity; Cellular component=membrane; Biological process=metabolic process
  Homolog annotation: Hit_ID=Q0M6C4; Match level="QueryCoverage=99%, HitCoverage=92%, E-value=9e-76, Identity=63%"; Hit description=Short- chain dehydrogenase/reductase SDR
  Pfam annotation: Domain name=KR; Domain location=8-191; Score=-9.1; E_ value=8e-07; Accession=PF08659.1; Description=KR domain
  Pfam annotation: Domain name=Shikimate_DH; Domain location=6-128; Score=-27.6; E_value=0.084; Accession=PF01488.10; Description =Shikimate  quinate 5-dehydrogenase
  Pfam annotation: Domain name=adh_short; Domain location=7-175; Score =132.3; E_value=1.3e-36; Accession=PF00106.15; Description=short chain dehydrogenase
  Pfam module annotation: Pfam domain module=KR::Shikimate_DH::adh _short; Domain location=8-191::6-128::7-175
MNRISGKVVVITGASSGLGEATAIHLAAQGATMVVAARRKDRLDALVRKIVGDGGTALALQADVTKRQEVEAMIAQAVRQFGKIDVLVNNAGLMAIAPLSAVKVDEWERMIDINVKGVLYGIAATLPLFEKQQFGHYITISSIAGKKVFSPGGTVYSGTKFAVSAIAEGLRHEVGGKIRTTTIAPGLIDTELKQGSSHAESLQAVGELYQSQAISADAIARAIAYAIEQPSDVD

SEQ ID NO: 207612 - protein, 238 aa, Glycine max
  Coding DNA Sequence Number=SeqID_90834
  Gene Ontology: Mol. function=signal transducer activity; Cellular component=intracellular; Biological process=signal transduction
  Homolog annotation: Hit_ID=Q88D41; Match level="QueryCoverage=54%, HitCoverage=100%, E-value=2e-54, Identity=93%"; Hit description =Chemotaxis protein, putative
PRHDQPDGTDTGQDGTDQVGPGVEAFSVVHANTDLLRWAGFVRPSVPASSRVNRSHRDPTIPEGGALPVGAGLPAKRPCVLHPTQAQVAIARHAPAVPARPGPAPALPVRPPAPPPQQRQVAQTGITQGIEHHHACPLAAGCLATARGFEADQRQALLAPVDPAQVPGRLAALAHHIALATQLGHRHVGQHQGTVTQRQQKPGQAAALAGDQFKHGSGSSGQCSATGPTPDTACPGIR

SEQ ID NO: 207613 - protein, 113 aa, Glycine max
  Coding DNA Sequence Number=SeqID_90835
  Subcellular localization annotation: CTP_CleavageSite=48; ConfidenceScore=5.37e-01
MSSSFYSIVPSLFPSPPAGAQSSPVSRLSTRQDLSRDYELFPYSDRPQAGTLGEMQDFFFKELEQKLFTHAQLKPTSISSGGRSGGVVQLGLPFGKSGPPPVYSYAISITAKV

SEQ ID NO: 207614 - protein, 296 aa, Glycine max
  Coding DNA Sequence Number=SeqID_90836
  Homolog annotation: Hit_ID=Q47522; Match level="QueryCoverage=21%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMFSCIERLLSSLNVEKLVLPAARDAESIWTMKLGFRKMSEDQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 207615 - protein, 107 aa, Glycine max
  Coding DNA Sequence Number=SeqID_90837
MTGRLLAGSLALESRILYYLIVHILLPRSSNLAQRSFLISAAVVASFGYLKERDGSWVKKGTQPNDDEGQLPVEGDSSLLQSILDRFNGLLTYVGERFDALEQQVDM

SEQ ID NO: 207616 - protein, 261 aa, Glycine max
  Coding DNA Sequence Number=SeqID_90838
  Gene Ontology: Mol. function=two-component response regulator activity; Cellular component=chloroplast; Biological process=two -component signal transduction system (phosphorelay)
  Homolog annotation: Hit_ID=Q9PGH8; Match level="QueryCoverage=57%, HitCoverage=64%, E-value=1e-36, Identity=54%"; Hit description=Two -component system, regulatory protein
  Pfam annotation: Domain name=Response_reg; Domain location=54-129; Score=-3.0; E_value=0.0059; Accession=PF00072.14; Description =Response regulator receiver domain
  Pfam annotation: Domain name=Trans_reg_C; Domain location=161-234; Score=66.5; E_value=8.3e-17; Accession=PF00486.18; Description =Transcriptional regulatory protein, C
  Pfam module annotation: Pfam domain module=Response_reg::Trans_reg_C; Domain location=54-129::161-234
  Subcellular localization annotation: CTP_CleavageSite=71; ConfidenceScore=5.49e-01
TSALASVAVTLRVTTTPAALNAPLQGASHSPFRLRNCWEGRSGFPSHDVVKRRPVNCNTTHYRANWSSTAVAAALELVDPPGCRNSIKTPVLALTARIDIEDRVHALDAGADDYLAKPFDFRELEARCRALLRRPSVQAAGVLRFGDLVIDSAARQVSLAGQRIDLPKREYSLLEILLAGMNRAVSKAEIANKLFAFDDDAAPNAIEVYIARLRRKLEGSPLRIETQRGTGYLLKAVESSLSIPSTSRGGPVPAFVPFSEG

SEQ ID NO: 207617 - protein, 68 aa, Glycine max
  Coding DNA Sequence Number=SeqID_90839
MAPTRHPLDPEKSNRALGFPALITGLCQSYGVPVTPSKAQGNAHQAAGAPPPPQQADLAGPLGVEHYI

SEQ ID NO: 207618 - protein, 222 aa, Glycine max
  Coding DNA Sequence Number=SeqID_90840
MFLRGKPLLIALLLHLVVALLHWALIPLGMNWYRDHFGFTSHRDIGLGIAQFHLFWMFIGAQPLIAVLRPLFAKLLVLAIPLVFATWTLMHNHPLRLLYFTIGPGLLALAAIATLHPPVLAAGCVDLAGADRCTGQCRLHSGLLAAAPPGRRRAALSDQHRHRVRAAGSRRAGGGRADRAALETETPVAAPTDRVRVAGGVVDTVDAVGDAPAAGTRHAPAV

SEQ ID NO: 207619 - protein, 294 aa, Glycine max
  Coding DNA Sequence Number=SeqID_90841
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=5e-37, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAPLSSLQNGQVIKSKWSNERPSQRINLLLSCKVKVLWYLYLLARLQRTACPHLQRAHALAIRGLHVLTFRGLHVLTFVGLHALTFRGPHVLTFRGLHALAIRGLHVLTFRGLHALAIRGLHVLTFRGLHTLAIRGLHVLTFRGLHALAIRGLHVLTFVGLHALTFRGSHVLTFRGLHALAIRGLHVLTFRGLHALAIRGLHVVTFVGLHALTFGGLHVLTNRGLHALTFRGLHVLAFRGLHVLAFKGSCTFTFVGLHALTFKGLHVLSFRGLHVLAIRGLHVPNFQRGTCPHL

SEQ ID NO: 207620 - protein, 330 aa, Glycine max
  Coding DNA Sequence Number=SeqID_90842
  Gene Ontology: Mol. function=protein binding; Cellular component=SCF ubiquitin ligase complex; Biological process=protein ubiquitination during ubiquitin-dependent protein catabolic process
  Pfam annotation: Domain name=WD40; Domain location=121-157; Score =9.1; E_value=3.1; Accession=PF00400.22; Description=WD domain, G -beta repeat
  Pfam annotation: Domain name=WD40; Domain location=182-220; Score =27.3; E_value=5.5e-05; Accession=PF00400.22; Description=WD domain, G-beta repeat
  Pfam annotation: Domain name=WD40; Domain location=224-262; Score =42.3; E_value=1.6e-09; Accession=PF00400.22; Description=WD domain, G-beta repeat
  Pfam annotation: Domain name=WD40; Domain location=270-310; Score =11.5; E_value=1.7; Accession=PF00400.22; Description=WD domain, G -beta repeat
  Pfam annotation: Domain name=WD40; Domain location=81-117; Score =25.3; E_value=0.00022; Accession=PF00400.22; Description=WD domain, G-beta repeat
  Pfam module annotation: Pfam domain module=WD40::WD40::WD40::WD40::WD4 0; Domain location=121-157::182-220::224-262::270-310::81-117
MDFYGKRTLLSLMDTEKPEQPPQSPVHLRVQTHREISEQDVQFSPPRPSSTTTSDGMFPMMMPDSPWTLSPLPTPSPSLLYHCIASLHRHEGNIYAIAASKGLVFTGSNSSRIRVWKQPDCMDRGYLKASSGEVRAILAYSNMLFSTHKDHKIRIWTFTVSDSFKSKKVGTLPRKTSILLFPSRGKNTPKHKDSVSCMAYYHSEGLLYTGSHDRTVKAWRVSDRKCVDSFVAHEDNVNAILVNQDDGCVFTGSSDGSVKIWRRVYTEDSHTLTMTLKFQPSPVNALALSCSFNHCFHYSGSSDGMINFWEKERLCYRFNHGGFLQGSPFC

SEQ ID NO: 207621 - protein, 55 aa, Glycine max
  Coding DNA Sequence Number=SeqID_90843
MWCYEWKKSEALRVGRLNLDSVDLNWARLDEGKVWFSKSTLYAEFCCEIVQQNFA

SEQ ID NO: 207622 - protein, 60 aa, Glycine max
  Coding DNA Sequence Number=SeqID_90844
MCKVFHGCNYHKLDFVQQRNKEQPEEPIRVECHMFEKNTFCSGAAFVPRDGVLKNMTDGS

SEQ ID NO: 207623 - protein, 40 aa, Glycine max
  Coding DNA Sequence Number=SeqID_90845
LTTPFGRETTHCADRLANVNLVLEPPSFKDHNVSNYVLNC

SEQ ID NO: 207624 - protein, 579 aa, Glycine max
  Coding DNA Sequence Number=SeqID_90846
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q6Z251; Match level="QueryCoverage=97%, HitCoverage=95%, E-value=1e-144, Identity=42%"; Hit description =Putative Lignostilbene-alpha,beta-dioxygenase and related enzymes
  Pfam annotation: Domain name=RPE65; Domain location=75-577; Score =246.1; E_value=7.6e-71; Accession=PF03055.6; Description=Retinal pigment epithelial membrane protein
METHMALAASYMTLAPKYCCVQKRPFIITSGLSSAFKPILRALPQIPLQIDASKTFTDIKSKFLNAVVDSAFEFVDQLVLPSQSNFAPVEELGEAVAITNIEGDIPDHFPEGVFIRNGPNPLFGGLKSSKSILGRTNSVWVEGEGMLHALYFKRESDGCYTIVYNNRYVETETYKLEKQSAKPLFLPAVKGDSLAVLSSMLLNGLRFGQLNKDYSNTNVFEHSGKFYSVSENHMPQEIDIYTLSTLKYWDVNGACNRPFASHPKKVPGTGELVIFGVDATKPYLEIGIVSADGKELVHKEDIKLDRCSLCHDIGITSRYIAILDLPLIVDSNRLLKRGPLIKYEKEKYARIGIMPLYGDEKSTQWFEVEPNSTFHIINSFEDGHEVVLWGCRALDSIIPGPEDGLNESTMFSRCYEWRLNIKSGEVKEKYITGPEQFMDFPVINASFTGIKNRYGYTQVVDPAASYAADIPKYGALAKLYFREPCSEFPKGDTQQKPIRVEYHRFERNVFCTGSAFVPKEGGIEEDDGWIITFVHNEDTGISQVHIIETKKFSGEAVAKITMPFRVPYGFHGAFMPLSL

SEQ ID NO: 207625 - protein, 423 aa, Glycine max
  Coding DNA Sequence Number=SeqID_90847
  Gene Ontology: Mol. function=metal ion binding; Cellular component =integral to membrane; Biological process=ubiquitin cycle
  Homolog annotation: Hit_ID=Q9SL78; Match level="QueryCoverage=76%, HitCoverage=84%, E-value=3e-38, Identity=34%"; Hit description =Putative RING-H2 finger protein ATL2D precursor
MCNSNTLKFNPFKNRLLIMFVLVLSLPSNVQSQAKDSEEKNLPELPQMVHPSKGIIIAVLTTMFAIAFPLLLYVKFCRVIPHELLRQNSNLQNFQGLTRPRSRVSGIDKQVIETLPYFKFSSLKGSKEGLECTVCLSKFEDTETLRLLPKCKHAFHMNCIDKVEAGDMKNLNYSLSSRFLRVPSNPTEDISNLEIFVEREPSNRGSSRKGFWDVGKCKKQEPLLVDQGGGASKWNKHEHVMNHKIVISDVFTRSRWSDLNSSDLLSLNSEMINDVCVVCSTRFSSCPLESTDPSGRFHGTSSSNEKENLFTTLNNPAEKRCMSEIANVPRFAQMGKDNWIEEQSNCLQNKKGIYIKHVRKIFKSYIGCCLTHCLVFCFIACCFVWFNNITYPSEFYGFTRPEASQAQTFTFLVRGQHLPLYKS

SEQ ID NO: 207626 - protein, 454 aa, Glycine max
  Coding DNA Sequence Number=SeqID_90848
  Gene Ontology: Cellular component=membrane
  Homolog annotation: Hit_ID=Q1SRU7; Match level="QueryCoverage=61%, HitCoverage=55%, E-value=1e-83, Identity=49%"; Hit description =Exostosin-like
  Pfam annotation: Domain name=Exostosin; Domain location=189-454; Score=78.3; E_value=2.4e-20; Accession=PF03016.6; Description =Exostosin family
PRASASNTSGIAIGITTFANGTIHLGEGTAGLSSESEMVKNMTFLNEANSTGENTLEIVNETRTSEEKDSVSSTGLTSESGRESSRSLGFDERNESSTVECIERANNGSATEQIGNLGLSIYNNTISHSPSHAIAPPLSQTEVSPNITSPMLSNAYDETDFMEEERFRPSKDEFNIVGNNSSINRVPKETEMNELLLQNRASYCSMRPRWSSAVDQELLQARSEIENAPIGWFMRLMEASKQFVTKDPKKAQLCYLPFSSRRLEETLYVPNSHSSRNLIQYLKNYVDMIAGKHRFWNRTGGADHFLVACHDGAPTETRQHMARCLRALCNADVKEGFVLGKDVSLPETYVRNAPKPTRNVGGNRVSKRKTLAFFAGGMHGYVRPILLQHWENKNPAMKIFGRLPKSKGNRNYIQYMKSSKYCICAKGYEVNSPRVVEAIFHECAIHPLPLTNNE

SEQ ID NO: 207627 - protein, 144 aa, Glycine max
  Coding DNA Sequence Number=SeqID_90849
  Gene Ontology: Mol. function=DNA binding; Biological process=DNA integration
MLRRFDVRNAKPESIPLAKRFKLSVNQCLKTNDEVEYMSKVPYTNAIGCLMYAMVCTRPDLTHVSDPSIVGYVDSDYADDLDDKKSTIGTKHMDRFHKIRELMEFSQVLLKKVHTPENATHILTKIVTTDKFKHCLELLNVVQY

SEQ ID NO: 207628 - protein, 638 aa, Glycine max
  Coding DNA Sequence Number=SeqID_90850
  Gene Ontology: Mol. function=transferase activity; Cellular component= membrane; Biological process=metabolic process
  Homolog annotation: Hit_ID=Q1SRU7; Match level="QueryCoverage=68%, HitCoverage=70%, E-value=1e-150, Identity=57%"; Hit description =Exostosin-like
  Pfam annotation: Domain name=Exostosin; Domain location=296-585; Score=322.0; E_value=1e-93; Accession=PF03016.6; Description =Exostosin family
  Subcellular localization annotation: CTP_CleavageSite=59; ConfidenceScore=5.11e-01
MGLLQFLLLISLGAETTRLVSFVGITVAIVFMVQYSELPSSKFLSSVTTKFTSFTMDTSSSVNSKVEGNNLHLNGSNSNSTHALEETAISPQVPLFHNGSDSITSPAADTSKDLDSVVNFTARNDGSPVSSVQGREINLTSQGASSPQPMVPLPNRTSLDSETDSRSPVVSVTSAATSVKSNTDPVYKDGNSGSLPGNSNLTSNNVKPVTAKNSKKRPSKVVSISEMNLLLQHNHASSKLAKPARASAVDLEILHAQSEILNAPLIMNDPRLYPPLYRNVSMFRRSYELMENMLKVYIYQDGDRPIFHEPLLDGIYASEGWFMKLMEANKQFVTRDPGKAHLFYIPFSSRLLQQTLYVRNSHRRSNLIEYMKNYVDMIAGKYPFWNRTSGADHFVVACHDWAPAETRGRMLSCIRALCNADIEVGFKIGKDVSLPETYIRSSENPVKNIGGDPPSKRPILAFFAGGLHGYVRPILLKHWENKEPDMKISGPLPHVRGNVNYIQLMKSSKFCICARGHEVNSPRVVEAIFHECIPVIISDNFIPPFFEILNWESFAVFVKEEEIPNLRNILLSISEERYLEMHKRAKKVQEHFLWHAEPVKQVTVIDSLMMYRLFELTNEARTIWLEKKFIDSRENVIV

SEQ ID NO: 207629 - protein, 262 aa, Glycine max
  Coding DNA Sequence Number=SeqID_90851
  Homolog annotation: Hit_ID=Q10P22; Match level="QueryCoverage=21%, HitCoverage=17%, E-value=6e-13, Identity=61%"; Hit description=Rap8, putative, expressed
  Subcellular localization annotation: CTP_CleavageSite=57; ConfidenceScore=5.33e-01
MVKGVKSIAQDVSSKPKIDSLALKKKLNTSIKHPPDSKLKFVTTTVTKSEVKSKPVTTSSASSKTITKTTTTKTKVREKKVYSLPGQKHDPPEQKEPLRIFYESLSKQIPTSEMAEFWKPPCHLLTVYTPWKIVVAHFRYYTSLFSWWDLGATLLRSNRQSSLLPVWIQARKASEECFSKLMEHGLLSPEKAKKAFEKRQRKQKELRTGTPVKLSKPPTKTATSQKQQQVSKNGDIKAKKRIVNESDDDDDDFILSHKRRKW

SEQ ID NO: 207630 - protein, 273 aa, Glycine max
  Coding DNA Sequence Number=SeqID_90852
MEDLDWKKLQERVMATICLCLANKAPLSRDGVDIFREEHFKRDCPELKKSSEGSSRLANVIQTDDLDYYSEGNVHSGSCSQLTNAWILDCGCSYHMTPQKDWFTTYNKCEMAELHKRRVLKGVRSCKLVLCEYCLLGKQTRGPTRDSSLGDSHYFVTFIDDFSCKAWLPVILEKADQCSPRPKVTPTPRLGPVSPGGLHQEYNLVIDRDHHTIKHVIQYVFEELAKLIAFALLTSTRDPFYLLRGYEHPGERQMDECYGEEDGVFAEESKMGY

SEQ ID NO: 207631 - protein, 394 aa, Glycine max
  Coding DNA Sequence Number=SeqID_90853
  Gene Ontology: Mol. function=hydrolase activity; Cellular component =cytosol; Biological process=protein complex assembly
  Homolog annotation: Hit_ID=Q8U9C3; Match level="QueryCoverage=79%, HitCoverage=100%, E-value=1e-153, Identity=84%"; Hit description =Hypothetical protein myg1
  Pfam annotation: Domain name=AsnC_trans_reg; Domain location=1-47; Score=2.5; E_value=0.058; Accession=PF01037.11; Description=AsnC family
  Pfam annotation: Domain name=UPF0160; Domain location=75-375; Score =80.3; E_value=5.9e-21; Accession=PF03690.4; Description =Uncharacterised protein family (UPF0160)
  Pfam module annotation: Pfam domain module=AsnC_trans_reg::UPF0160; Domain location=1-47::75-375
MSSCHGHEGYMLKVMCGGLEDYERFIKDKIAKLKCVDTIETSFVMNTIKTRRIWVSGAPFSGGSSASNKAHPDMNPDFLVTHSGGFHADELLSSVVLTRLFPQARLIRSRAPEWLAAGADRIIYDVGGAYDAARGMFDHHQRGAPLRDDGQPYSSFGLIWKHFGRDYLAAFGVPEDHIETIHASFDAGFVLPVDLVDNGALSPSTAGPLAGLTLPVLLETLKPVFDDTDPEADNRDFHAALGIARSFVEAKITNSAAKLRAEALVKQAIVDAGEGHILELPMGMPFRPAIVKAGADHLLFVVHPRNNDWCLTGIRRADEGFALRADLPAAWAGLTDKDLEAVCGVEGATFCHNGRFVAAAKTRDAALAMAELAVKEALSFSNNAPATEPSNGGT

SEQ ID NO: 207632 - protein, 255 aa, Glycine max
  Coding DNA Sequence Number=SeqID_90854
MGFVTWWEKYYSTRSVGDTTIMISRLESGFTQPTVENIRSNLQARGKTIMTKKSAETSRADVRPKKPTGVKIQEGKQEEKEEKERPLIRKRKLPATSTKSAEQTEAGNSQAQMPKKKKKVKQVEPEPSVAVEGGEPIKKKKKKTKPSKEQGDNQPVDVQPPSTDIDGTEVEATPSVAEMGNPVDQPDSPQEQPAVEVQQNVSVEEIPSHARTSPTPETDAVNVEEQGEGQGIGSSSPHGSSQKSSSEETFPMKRP

SEQ ID NO: 207633 - protein, 49 aa, Glycine max
  Coding DNA Sequence Number=SeqID_90855
MTTLCKSKGRKSEHFHKDYLKCKSWFEKKSELNARVCFESNLTKVFHDT

SEQ ID NO: 207634 - protein, 299 aa, Glycine max
  Coding DNA Sequence Number=SeqID_90856
MEFILNAKGHPGRILKKDLTTLAQVWSVLSYSNLAPTSHTSDLTVDRARLIFGLVSHMDMNIGALISGQMTSITQSNCCRFWFPALITALCRARRVVSDSLTFERLSPAINLAYIRKYCWNIDYLTVAFQGTRRARARLADIPSSSAAPASTSAAPSVPAHVDSQHFEAMLQSINQGQILLLQSLHVVAPPGSILSVEQFLERVAWPGAQPSLDREGEGPAAQAGEEQARPETAATPKRSLEGTSWPPTLVADLSLSTPATDLSTPLLGIPKDQTTPILALNTSPPATPVLYLIDEEDD

SEQ ID NO: 207635 - protein, 59 aa, Glycine max
  Coding DNA Sequence Number=SeqID_90857
MEHPTQMMEESTMETVQTEDESQVSRSTRVRQPSKRYLSDEYVNLPDDREPQSFQEAIQ

SEQ ID NO: 207636 - protein, 57 aa, Glycine max
  Coding DNA Sequence Number=SeqID_90858
MMTKIIPTKKVEDCCQGAGTMVHTNYVGRGRKSHPSSINRKTCEELEHLIQREAKQE

SEQ ID NO: 207637 - protein, 357 aa, Glycine max
  Coding DNA Sequence Number=SeqID_90859
  Gene Ontology: Mol. function=nucleic acid binding; Cellular component= chromatin; Biological process=DNA integration
  Homolog annotation: Hit_ID=Q1RWN2; Match level="QueryCoverage=89%, HitCoverage=29%, E-value=4e-89, Identity=44%"; Hit description =Peptidase S8 and S53, subtilisin, kexin, sedolisin; Integrase, catalytic region; Zinc finger, CCHC-type
  Pfam annotation: Domain name=rve; Domain location=113-301; Score =87.3; E_value=4.7e-23; Accession=PF00665.16; Description=Integrase core domain
MAIQEGGKIESDIWYVDTGCSNHMSGLMGKGDVKIKTKNGFVETISNVLYAPNLKSNLLSAGQLQEKGYVITIQKGACEIYDPVRGAIAIVRMSSNRLFPLKIESIQTCFKADMEDPSWLWHFRYGHLNFSGLKTLQQKNMVTDLPQITIPSQVCEECVVGKQHRSQFPKGKSWRVKDVLELEKSEVFSTFKSFKASVENEAGKSIKTLCTDRGGEYCSKEFEIFCAEHGIRRELTTAYTPQQNGVSERKNRTIFNMVRSLLARGNVPKSFWPEAVNWSIHVLNRSPTFSVQNMTPEEAWKGRRPAVDHFRIFGCIAYAHVPEVKRKKLQNYKLGKISVTCIVLQQPPKDLVNSINI

SEQ ID NO: 207638 - protein, 172 aa, Glycine max
  Coding DNA Sequence Number=SeqID_90860
  Gene Ontology: Mol. function=nucleic acid binding; Biological process= DNA integration
  Homolog annotation: Hit_ID=Q1RWN2; Match level="QueryCoverage=68%, HitCoverage=9%, E-value=4e-36, Identity=63%"; Hit description =Peptidase S8 and S53, subtilisin, kexin, sedolisin; Integrase, catalytic region; Zinc finger, CCHC-type
MKRKYEDSVRVKRAQLQALRRDFETLAMKDGESVTNYFARTMEISNKMRFHGEKMTDATIVEKILRSLTTNFNYVVCSIEESKDIDVLSIDELQSSLLVHEQKMNRSSTTEERALKASTTTIFIPPISEEGGEGEVEVGVEEEENVETEKITRIPELILQAKAEDNTLTDPS

SEQ ID NO: 207639 - protein, 357 aa, Glycine max
  Coding DNA Sequence Number=SeqID_90861
SIIMQSLQSMGPPSIMSMDEFDTQVAWPGAQPSPSGEGGASTAQEPEPEEPTAAVEGEDELTPPKTFYFDAGVHMAQEEETSTDQIPKPSSIPIPDDSMPATPTSELEQPIPQDSPIAQKACLNSELVEFDMQWIVLYEMSPLEENEHVIGSMLENVSHFVRLIVKECIDCIPAMFDCDSHLAKKLTTRASSAGSLVQSKFVPNFGSNYQAVCRIFPLDLMMKSVQFQVKKRLSREVLRVTVKLSSSVGLSAHPSLSEALAHLARQENLAKHQYQCAKCSKLGYTITQIAFAENSKVLQPTLRREGDVELAGASSMEGKCAESPPTFIRGKRRKNRKRCGLRTLSVKGSGVVFMHGE

SEQ ID NO: 207640 - protein, 63 aa, Glycine max
  Coding DNA Sequence Number=SeqID_90862
MENEERITPTWLFILVHNIIPFPFRNITHLFKWCSKVMCCKVKWWLDKNIEMEITEATGLQMR

SEQ ID NO: 207641 - protein, 77 aa, Glycine max
  Coding DNA Sequence Number=SeqID_90863
MRKLIKERMENKVDNFVGLNKVVSGIKWMNEMVKQVDFLELWFERTRVEMIGRKESLFPARATHKGCESPLIQPGCS

SEQ ID NO: 207642 - protein, 73 aa, Glycine max
  Coding DNA Sequence Number=SeqID_90864
QEAEGEAEEMPEDTPVATPIEATEEGDGAIDADYVADMATAQSTWDPWPTPALDTSLPVQHAPSSPHDDPTPA

SEQ ID NO: 207643 - protein, 105 aa, Glycine max
  Coding DNA Sequence Number=SeqID_90865
MLWKCIYVKIGSKISCTHEMALKKLPAKRSRKDTSGEGSSAALQADMDFDHHRFRSAEHQQHFETIKGWSFLRERWVQLRDDEFPDFQEEIVVGSSGLRIIKNGG

SEQ ID NO: 207644 - protein, 247 aa, Glycine max
  Coding DNA Sequence Number=SeqID_90866
  Gene Ontology: Mol. function=ribonuclease H activity; Cellular component=mitochondrion; Biological process=DNA integration
  Homolog annotation: Hit_ID=Q1SAS4; Match level="QueryCoverage=83%, HitCoverage=9%, E-value=2e-69, Identity=63%"; Hit description=RNase H, putative
  Pfam annotation: Domain name=rve; Domain location=6-138; Score=42.7; E_value=1.2e-09; Accession=PF00665.16; Description=Integrase core domain
MALLYVGNRCNRSIEPRDSNGHRFILVVIDYFTKWVEAASYSSVTRSVVKIITDNAINLNNNMMKEMCKDFKIQHHNSTPYRPKMNGAVEAANKNIKKIVQKMMVSYKDWHEMLPFAEHGYRTSVHTSTRATSFLLVYNMEVVLPFEVDVPYLRILAEFGLKESEWAQARFDQLNLIEGKILAKRRRFALSDGQYHVEFKTKVNQGIVGDGLRPMVHPEVNGHVRLPLCPTFSCLKVAAIVESRDSL

SEQ ID NO: 207645 - protein, 78 aa, Glycine max
  Coding DNA Sequence Number=SeqID_90867
  Gene Ontology: Mol. function=ribonuclease H activity; Biological process=DNA integration
MESDCCIHVRKCHKCQAFADNVNALPMPLNVLAAPWPFSMWGIDVIGAIKPKASNGHRFILVAIETSPNGLKLLHTLA

SEQ ID NO: 207646 - protein, 245 aa, Glycine max
  Coding DNA Sequence Number=SeqID_90868
  Gene Ontology: Mol. function=nucleic acid binding; Biological process= RNA-dependent DNA replication
MKAFPFSWADTAKDWLYFNPASIKSWNDMKRQFLEKFFPASRTITIRKDISGTRQLSGETMHEYRDRIASSMERSMVDAASGGALMDKTATAARQWFFNMAHNSQQFSTRVLPSRGVHDETVAADYYGLENQITELTSLVKQLDIGQHQQVQEANIPPPRACGICTSLKHPSDACRTLQETKPTADVVGIITGPQYRPPQQQEKYDHPNLKYGSVQGNMLHTMNVPIPIHLFLMRHTGSLNQRKS

SEQ ID NO: 207647 - protein, 47 aa, Glycine max
  Coding DNA Sequence Number=SeqID_90869
  Gene Ontology: Cellular component=integral to membrane; Biological process=electron transport
  Homolog annotation: Hit_ID=Q9C540; Match level="QueryCoverage=83%, HitCoverage=16%, E-value=8e-13, Identity=77%"; Hit description =Cytochrome b-561, putative
MANGTVLVVDWLLELLAPRRGAHCEDKDLTMACVPWPIHLCIGNSNS

SEQ ID NO: 207648 - protein, 72 aa, Glycine max
  Coding DNA Sequence Number=SeqID_90870
  Subcellular localization annotation: CTP_CleavageSite=54; ConfidenceScore=5.13e-01
MYRGNGLKGKKPNTKSISNCTIFQKAGIGFRRDQLKVQVTSNLTLRLMGERLITDNSVGSSGLGIIKKGGLN

SEQ ID NO: 207649 - protein, 338 aa, Glycine max
  Coding DNA Sequence Number=SeqID_90871
  Gene Ontology: Mol. function=nucleic acid binding; Biological process= DNA integration
MDIDYAIRKEEPSAVIKTNTPDAVDLYEKWERSNRLSVTFIKTNIFAVRIYNPQEKKLDPRTISRYFIGYAEKSKGYRFYCPSHNARIMESRNAKFLENDLIIIHVPQVQVGVRQPIVEVPLVVEDDHVDQVVNEEQQANVEQLVEQQVPQQDNETTLRRSTRVKMSVILSDYQVYLQEPNYNIGAENDPETFSLAMSSTELNLWYNAMKDEMDFMASNRVWDLVEFPNGVNAIACVDHWKATKKVMRNLQGTKDYMFMYRRIDDLEVIDYFNLDYVGYIAMRKSTFGYVFMLVGGVVSWRSAKQSLATTSTMEAKSLKLYCDNSTAVFVAGNNKSGS

SEQ ID NO: 207650 - protein, 130 aa, Glycine max
  Coding DNA Sequence Number=SeqID_90872
  Gene Ontology: Cellular component=integral to membrane; Biological process=electron transport
  Homolog annotation: Hit_ID=Q9C540; Match level="QueryCoverage=66%, HitCoverage=36%, E-value=5e-33, Identity=77%"; Hit description =Cytochrome b-561, putative
  Pfam annotation: Domain name=Cytochrom_B561; Domain location=9-130; Score=-44.5; E_value=0.00042; Accession=PF03188.6; Description =Cytochrome b561
MATVSPSLLFFARVLGLAVAVLVLIWALAFKSSFLTPSLSQQDLIYAVLHPLLMVIGFILLSGEAILVHRWLVGSRGLKKLVHLWLQGVALASGIFGIWTKFQGKDGIVANFYSLHSWMGLASVSLFGAQ

SEQ ID NO: 207651 - protein, 128 aa, Glycine max
  Coding DNA Sequence Number=SeqID_90873
  Subcellular localization annotation: CTP_CleavageSite=53; ConfidenceScore=5.13e-01
MKACPVYVNKIDKNRGSPHGINVNFTSFSAAGVSLSLGHALSEYPPLSETSARLASKRNLEGNLPRKHALSALLARPMSQLPLLALSVPGSLRQSSLTRAKRENGAKRAFEDKKPFLKPKVKNQEMRA

SEQ ID NO: 207652 - protein, 275 aa, Glycine max
  Coding DNA Sequence Number=SeqID_90874
  Gene Ontology: Mol. function=DNA binding; Biological process=DNA integration
  Homolog annotation: Hit_ID=Q1SS72; Match level="QueryCoverage=51%, HitCoverage=10%, E-value=7e-10, Identity=26%"; Hit description =Integrase, catalytic region
  Pfam annotation: Domain name=zf-CCHC; Domain location=170-187; Score =18.3; E_value=0.00093; Accession=PF00098.13; Description=Zinc knuckle
YIFCGTSRVYIYLGYNTENKRGYISCGSVQVEGTSTWLFKENKGGYIPCGSLLVKDFTRLLEISRTGGCLGTGSLGEVYGIVKPNILMMDPLPSINKAYALVLQQEGQLQRNGTNDSKFFFTSSNQQNNLGNWRPQRRGGSSFGRGRGNGILGRGDGNAGRGREHNYTSKQCTYCNKFGHIVNQCYSKHGFPLGFKPRNNYAINNFVAPEGEQSQSEIDNSLQGSQGGTVTSSGVQFKPEQLQQLLTMLQQSSTKSTHLVSQISSGNVDESSSQQ

SEQ ID NO: 207653 - protein, 105 aa, Glycine max
  Coding DNA Sequence Number=SeqID_90875
  Gene Ontology: Mol. function=nucleic acid binding; Biological process= DNA integration
MVLVSPPLNANNYHIWSRGMFRALWSKNKLEFVDGTLPMPKMKDANYKAWQRCNIMVVSWITRSLSPQIAQSTIYIDNVKKLWDELKERFTKGNLWKQSFPSLFS

SEQ ID NO: 207654 - protein, 277 aa, Glycine max
  Coding DNA Sequence Number=SeqID_90876
  Gene Ontology: Mol. function=DNA binding; Cellular component=beta -galactosidase complex; Biological process=DNA integration
  Homolog annotation: Hit_ID=Q1S3I6; Match level="QueryCoverage=99%, HitCoverage=26%, E-value=3e-62, Identity=53%"; Hit description =Integrase, catalytic region
MNQRHITKPLSLRNGYKLWKVNYMHLRQIILVVGGSIRSNIRLMVQLRGIKLDWSPRQLDVDNAFLHGDLHKKQHGSSFIALLVYADDVILIGNSPFEITSIKQLLHHKFCIKDLGKLKYFLGLEVSRTSKGIHICQQKYALDILSESGMIASKPCSTPMIKGNKLLYDDTPPPYDQTAYRRLIGHLLYLTTTRPDISFVVQDLSQFMQSPRQPHFDVTTYVLRYIKCCPAQGLFFPADSDLQLKAFSDLDWATCPTTRQSITGYCIFLGSSLISWR

SEQ ID NO: 207655 - protein, 139 aa, Glycine max
  Coding DNA Sequence Number=SeqID_90877
  Gene Ontology: Mol. function=oxidoreductase activity; Biological process=electron transport
  Homolog annotation: Hit_ID=Q6YW66; Match level="QueryCoverage=82%, HitCoverage=36%, E-value=2e-36, Identity=58%"; Hit description =Putative Signal peptidase I
MEFSCKDFKVGKCEGEKVVDGETMPLVLKPPVPNKSDLESLLLALKNNKEWFEQMIIKNSAVLLRGYDVKNAEDFNEIVEICGWEDIRYVGPAPRTHIHKRVWTANEGPLSEFIYYHHEMVLLLTSSSSLHIFPNQSKL

SEQ ID NO: 207656 - protein, 175 aa, Glycine max
  Coding DNA Sequence Number=SeqID_90878
  Homolog annotation: Hit_ID=Q5ZFS5; Match level="QueryCoverage=60%, HitCoverage=34%, E-value=5e-27, Identity=61%"; Hit description=Nod factor-like protein
MAIIIEDVEEEGELGGGWWFGLLDGQGGLHPVTKFTEDFDFMAMNEKFKKDEVWGHLGKSKSHSKEKDGEENAFDEDYQDEDNDDVSNIEVKQPIYNKDDFFDSLSSNVHGNASQNGRTRYSEQIKIDTETFGDFVRHRGGRGGRGGRTRGGYYGRGGYGYNGRGRGRGMPSRNL

SEQ ID NO: 207657 - protein, 199 aa, Glycine max
  Coding DNA Sequence Number=SeqID_90879
  Gene Ontology: Mol. function=oxidoreductase activity; Biological process=electron transport
  Homolog annotation: Hit_ID=Q6YW66; Match level="QueryCoverage=99%, HitCoverage=61%, E-value=3e-77, Identity=70%"; Hit description =Putative Signal peptidase I
IKEFPKKVILFCEIPPPEGGETPFVPSFKVTEKMMEEFPEEVKEIEEKGLKYTFTAPSANNVSSMRGRGWEDTFGTEDRKEAEKRANALGMDVEWLPNGGIKTILGPRCLTKVFEGRKGRKMWFNTVVGMHGKEISSAMMADGTEIPEHVVKRCEEIIEEESIQFKWEKGDVLFFDNYALLHGRRPSLPPRKVLVATCK

SEQ ID NO: 207658 - protein, 352 aa, Glycine max
  Coding DNA Sequence Number=SeqID_90880
  Homolog annotation: Hit_ID=Q651K5; Match level="QueryCoverage=36%, HitCoverage=26%, E-value=7e-35, Identity=47%"; Hit description =AlphaSNBP(B)-like
MGIRPMCPSVRSFGTEGRKKDGPQIPPGDKVYEYILFRGTDIKDLQVKSSPPVQPIPQVNNDPAIIQSHYPHPVSTSTSLPSALGLPGANFQGPLPLYQPGGNIGSWGASPPAPNANGGRLAMPPMYWQGYYGAPNGLPQLHQQSLLQPPPGLSMPSSMQQPMQYPNFTPSLPNVSSNLPELPSSLLPVSASIPSITSASLPPAPSALAPAPSALPPAPSSLSSASSALSSVPSVTLASEILPVSVTNKAPIVSTSAAMLASNLLSLTISGPDINAIVPPISRKLHAISGSSLPYQTVSQLSSTVLGSSTSIHTETSAPSLVTPGQLLQPGPSIVSSAQPSQAPHKDVEVVQ

SEQ ID NO: 207659 - protein, 112 aa, Glycine max
  Coding DNA Sequence Number=SeqID_90881
MKMEALSSFKTQPKTKEKSVSEEDTKMKNKEWKQRKQIGGEMTQMKEAENKDKLASQVANNQGQNWRGKMTKKPAKVPDVKLSAMGTTDISLDFSFIIYLGLVVEFVQCMVF

SEQ ID NO: 207660 - protein, 202 aa, Glycine max
  Coding DNA Sequence Number=SeqID_90882
  Homolog annotation: Hit_ID=Q1STG1; Match level="QueryCoverage=15%, HitCoverage=34%, E-value=2e-09, Identity=90%"; Hit description =Hypoxia induced protein conserved region
MASRVIEHKLRTVGKISQSPTSFVLLFFLIHGCLILLISIFLRFLLFLFGPRCLWLSGILGSIAYNWSRPNMKTGVKIIHARVSVAQWLLELEVLLLISMKTWVIFNKQWKHWCCVKQHGKTQILVEAMSFKVILMMPKNLELSKFQIFKNLVSRIKIQDSRIKFQESRFKNNQDQDSRLKIQESREDSIKISTKKVFQNIE

SEQ ID NO: 207661 - protein, 114 aa, Glycine max
  Coding DNA Sequence Number=SeqID_90883
EEIYPQEEGQPLMLKEECKETLVSTATPLGLEVIPQVKELLDEGLVLKSLNPCALLVPKIGVPTDPKRIKIIPDWPTPPTPFIELVRNHVPSWEDVHERSVEGRSPEYEEPQDL

SEQ ID NO: 207662 - protein, 120 aa, Glycine max
  Coding DNA Sequence Number=SeqID_90884
MALKKLSTKRSRKDAPGEYSSAAQPADTDFERHRFRSAKHQQHFETIEGWSFLRERQVQRRDDEFPNFQEEVARRRWAPLVMQSDPARALDRRLQVDWAKDPREGPRVLMSLRVDFEPMG

SEQ ID NO: 207663 - protein, 52 aa, Glycine max
  Coding DNA Sequence Number=SeqID_90885
MEELINKTQLSPKIIPTSSRRLGDSTKESHFSYSTVVILFPQTKVRDHHRFN

SEQ ID NO: 207664 - protein, 160 aa, Glycine max
  Coding DNA Sequence Number=SeqID_90886
  Gene Ontology: Mol. function=hydrolase activity; Cellular component =soluble fraction; Biological process=aromatic compound metabolic process
  Homolog annotation: Hit_ID=Q7NXY2; Match level="QueryCoverage=99%, HitCoverage=47%, E-value=1e-47, Identity=60%"; Hit description =Epoxide hydrolase protein
MRMNRLSAIRHVSAAALCLSTLWSASVCAAEDAGAFDKVQQINAGDLNIGYVDMGPRDGQAVILLHGWPYDIQSYAQVAPALAQKGYRVIVPYLRGYGSTRFLSAKTPRNGQPSAMAADIVHLMDALNIKQADFAGFDWGARTADIVAALWPQRVKSLVS

SEQ ID NO: 207665 - protein, 67 aa, Glycine max
  Coding DNA Sequence Number=SeqID_90887
  Subcellular localization annotation: CTP_CleavageSite=39; ConfidenceScore=5.23e-01
MSPPPLGPHNRSQTHLKLSGQLPLPALVSTDLHTTNSLKLSGTWTFLSLELSRHAEASRKGQTPLKI

SEQ ID NO: 207666 - protein, 129 aa, Glycine max
  Coding DNA Sequence Number=SeqID_90888
  Gene Ontology: Mol. function=DNA binding; Biological process=DNA integration
  Homolog annotation: Hit_ID=Q1SKC8; Match level="QueryCoverage=99%, HitCoverage=38%, E-value=3e-36, Identity=60%"; Hit description =Integrase, catalytic region
MASSRKDWYTKLDDALWEYKTTYRTPIGLSPFQMVYGKGYHLPVELEHKAYWALMFLNLDLKASEEKSELQLLDMEEMRRNTYESSRLYKEQIKVYHDKKIQHKDAKPYGYQAIQCSGVRRPHYTKILD

SEQ ID NO: 207667 - protein, 152 aa, Glycine max
  Coding DNA Sequence Number=SeqID_90889
MAKRCGMTIICLRMSSGSPPLDDKRAQNDHNLSLRAIGHDRLGMAKRCGMTIICLRLSHDLRTYIVLDNCENPRAFPWISSPIYLESSTQCPCRIGLHHYLIQSNVVDKENGEDEENSGNYMRNAKIREWKWEVTVIVGRGSHPFLNKGERW

SEQ ID NO: 207668 - protein, 716 aa, Glycine max
  Coding DNA Sequence Number=SeqID_90890
  Gene Ontology: Mol. function=binding; Cellular component=nucleus; Biological process=keratinization
  Homolog annotation: Hit_ID=O04390; Match level="QueryCoverage=88%, HitCoverage=58%, E-value=1e-118, Identity=36%"; Hit description =Nuclear matrix constituent protein 1
  Pfam annotation: Domain name=M; Domain location=415-435; Score=6.8; E_ value=16; Accession=PF02370.7; Description=M protein repeat
  Pfam annotation: Domain name=M; Domain location=436-456; Score=9.0; E_ value=8; Accession=PF02370.7; Description=M protein repeat
  Pfam annotation: Domain name=M; Domain location=646-666; Score=5.6; E_ value=23; Accession=PF02370.7; Description=M protein repeat
  Pfam module annotation: Pfam domain module=M::M::M; Domain location =415-435::436-456::646-666
  Subcellular localization annotation: CTP_CleavageSite=22; ConfidenceScore=5.09e-01
MFTPQRKAWPAAVAFTPHRGGSASAKGKAVAEGPPPPPLGSLTETTVAVGLDPAGNVEDLEAVHRVGVAGRGCDAAEGPRGARGEEWSSMFDQLGQELAETQEILKREQSAHLIALFEVEKREENLKKALSTERQCGADLERALRAIQEEHAQVQSFSHTKLAEANALVDGIEEKSLAVDKKLLDAEAKLAEINRKNAELDMKLRQVDVQESLLQKERLSLATDRESFEATFYKQREDLKDWERKLKQREDMLCDGRQNLGEKEEKIVETEKNLRQKERDLEVLEKKIDSSNSLLKGKEAEIIKRVADLDVEEKKADSLKSMLEMKEKELLALELKLSAREREGIENLLGEQKATLDLKLQQVELEMEQKQKSLVEEFSSKEEVFEQREVEVNRREKKVGKEEQALNKKTERIKEQNKEIEAKLKSLKEKEKTMIIKEKELEKEKQKLLADRESLENLNAELGKMKAEISQKELQICQETENLKLTEDDRAEHSHLQLELKQEIEHTRLQKDFIMKEAENLREERQRFEKEWENSEERLKSEKQHMQDHIKKELEKLVLEKESFRDSMKQEKHLLSEKVKNEKAQMLQDFESKTRNLENEIQKRQEEMEKDLQERERNFQEEMLRELDNINNLKDVIEKEWEEVKAEGIRLENERKELESNKQQLKSGQHEMHEDSEMLMSLSRKVKKERECLVAERKHFLELVEKLRSCKGCGEV

SEQ ID NO: 207669 - protein, 342 aa, Glycine max
  Coding DNA Sequence Number=SeqID_90891
  Homolog annotation: Hit_ID=O04390; Match level="QueryCoverage=65%, HitCoverage=18%, E-value=2e-18, Identity=37%"; Hit description =Nuclear matrix constituent protein 1
  Subcellular localization annotation: CTP_CleavageSite=48; ConfidenceScore=5.22e-01
PPKNSQDNVASSEFNISGSVRPVSWLRKCTTKIFNLSPSKIADAVGASDMAGTSPLSDVNFSVENIDALPASLPNIGARVIFDERQPAGGMAHHSSDTPHLQSDNIDKEVGDEYSLSIGDHSHVDSFIDGDPGDSQQSVPKLGRCKPGRKSKSGIARTCSVKAVVEEAKEFLGKDPKKIENASLQSLNTDHIREDSREDSSFTEKAIGNTRRKRQWAQTSRITETELNAGDSEGHSDSITAGGAGKDSSTQNISNATKSVEKEAAAGKLEGDKNNPEVFETSLAVDDDNVQDTNLVQVSTVKTVEFSDDRAVRMEDGSTIHEVENDDDDEEEEEEEEEHLGE

SEQ ID NO: 207670 - protein, 465 aa, Glycine max
  Coding DNA Sequence Number=SeqID_90892
  Gene Ontology: Mol. function=receptor activity; Cellular component =integral to membrane; Biological process=protein amino acid phosphorylation
  Homolog annotation: Hit_ID=Q1SBD8; Match level="QueryCoverage=98%, HitCoverage=98%, E-value=1e-169, Identity=64%"; Hit description =Unnamed protein product; contains similarity to elicitor-inducible receptor EIR gene_id:T5M7.12
  Pfam annotation: Domain name=LRR_1; Domain location=144-167; Score =12.5; E_value=1.3; Accession=PF00560.23; Description=Leucine Rich Repeat
  Pfam annotation: Domain name=LRR_1; Domain location=169-191; Score =12.1; E_value=1.5; Accession=PF00560.23; Description=Leucine Rich Repeat
  Pfam annotation: Domain name=LRR_1; Domain location=193-215; Score =15.0; E_value=0.27; Accession=PF00560.23; Description=Leucine Rich Repeat
  Pfam annotation: Domain name=LRR_1; Domain location=217-239; Score =13.1; E_value=1; Accession=PF00560.23; Description=Leucine Rich Repeat
  Pfam annotation: Domain name=LRR_1; Domain location=241-263; Score =11.9; E_value=1.7; Accession=PF00560.23; Description=Leucine Rich Repeat
  Pfam annotation: Domain name=LRR_1; Domain location=265-287; Score =9.3; E_value=5.1; Accession=PF00560.23; Description=Leucine Rich Repeat
  Pfam annotation: Domain name=LRR_1; Domain location=289-312; Score =8.3; E_value=8.1; Accession=PF00560.23; Description=Leucine Rich Repeat
  Pfam annotation: Domain name=LRR_1; Domain location=314-336; Score =12.5; E_value=1.3; Accession=PF00560.23; Description=Leucine Rich Repeat
  Pfam annotation: Domain name=LRR_1; Domain location=338-360; Score =14.1; E_value=0.51; Accession=PF00560.23; Description=Leucine Rich Repeat
  Pfam annotation: Domain name=LRR_1; Domain location=362-384; Score =5.1; E_value=31; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=144 -167::169-191::193-215::217-239::241-263::265-287::289-312::314 -336::338-360::362-384
MRNFKAVGQAITALFIISLSAWCYGQVELDMAPMEKAERDALYSTIQGFVGDWWNGSDLYPDPCGWTPIQGVSCDLFNGFWYVTVLNIGPIHDNSLSCAKILEFRPQLFELKHLKALSLFKCFESQHRHQVTIPNANWEKLAGSLESLEFRSNRGLIGKIPSSFGALKNLQSLVLLENGLTGKIPPDIGKLNKLKRLVLAGNHFSGHIPDIFSALGELLILDLSRNSLSGTLPLTLGSLTSLLKLDVSHNHLEGNLLKEFAYLKNLTLMDLRNNRFSGGLTLSIQEMYSLEEMVLSNNAIGGDIRTLKWENLHNLIILDLSNMGLKGEIPESISELKRLRFLGLSDNNLTGNLSPNLSTLPCLNALYVSGNNLTGELKFSVEFYGKMRTRFGAWNNPSLCYPLGVISTSHVPYGVKPCQQEIKLLKSNTTDGDVKRTFHSIASLSHTPNSFWWIFLFFLISYLGL

SEQ ID NO: 207671 - protein, 673 aa, Glycine max
  Coding DNA Sequence Number=SeqID_90893
  Homolog annotation: Hit_ID=Q1T192; Match level="QueryCoverage=44%, HitCoverage=64%, E-value=3e-18, Identity=35%"; Hit description =Polynucleotidyl transferase, Ribonuclease H fold
MAWRVDCPKVANATVVFAEAVKSNHQLSSKVGRVLAKCLLTRLNSDELFKPYKDLQKEKDDLASKVESITAKKDELAKVVVDLEANKELEEKLLMYKKEVVEQHEKGFNKAVRRAEFFAKNLDLGFFDPFKDVIDDVLLDEEDVAAEEEADEEQDAEEQGDDANDLPTSLMVVFLVEPRPLTVVVVGGPWDFDVPTDLYSYIDKSSPRVDLGFDKPLEKRDSPRADLEFDEPLEKRSAMPFGEARLTKGAPWVLRAFGEARLMKDSPRTDLGLDKPLEKRDSPRADLGFDEPLEKRDSPRADLGETHQGQILGFVSLWRTNQGIIHPGDSPRVYLGFYDPLEKRESPRADLRFAEPVEIFAKAKLGDGKAHQRADLGLTSLWFPFFFILLFLEKQPLYQRFPNFNEDHGVYAICESIKSFISGSLTSTRIMASMPYGLEDNSVGCLCLSIGLAMLDRGVIVSDNDVKEAIPAYEVFPEWSQYVHSPDGEGPKGAQAVQIVRRGTWHVCKLLASVSSLGEVEGVNPECRPIVTDAHHFGVKGVSPVWFLLFSDHNFFNVYGRSLEFLLDDSLEVSDLFGASQLGEQVCFSVALPGYVVHLEAFEIVNEILGNMSDIVRAFEDDSRPTPLHVGHTINVKAPLVWGGLVVPNEFCQEVCHELCLDGATVFVLEIKL

SEQ ID NO: 207672 - protein, 320 aa, Glycine max
  Coding DNA Sequence Number=SeqID_90894
  Gene Ontology: Mol. function=ribonuclease H activity; Biological process=DNA integration
  Subcellular localization annotation: CTP_CleavageSite=27; ConfidenceScore=5.09e-01
MAKLTASSAIERYRSKGTPRLGRLRTVCRMASPSRQALGETWTGMLVYCSTFGLLGRWVGFYSPMHDHESQELTSVDPESAFFWVEVHVVFVEFSEDFFRKLSTWNSNAPLTSLPMLGKGLFDHDDVGELGRVPDFSDEVGFEELGQMASLWQIMLGWIPGMLDGCQANRSVFLCKTSTMRLCSWLVRSLLSYMHYPSLGPSCSLTSSSGSDWRPFVHTHDLSGTICCGVKLGRLPVMISPIKVENFIFRCSMETMAPSSLSVFLARLTGALPKGGKMRGVATNEGISTSHVDNSGAFAPTYPPSKRKSDLRSSFLYVNQ

SEQ ID NO: 207673 - protein, 228 aa, Glycine max
  Coding DNA Sequence Number=SeqID_90895
MVLFHLQEGEIMLRKWMMERDTLGYSGKRVGSLGIGVRCIHMWRSLPIVIHININVKDHQDLGGFAAKEQRTHPYNQQLSGIDDVEDVDALTSLVCLPVLGLEEPRHDLEFKLTSVGYDRQGNAFSYHVEPVSIIEVTEDRGDHSDKTFEEIKENKELLRQLEPLSEEQCDDPPRTSLRYNHGHQETERVVVAPGAPHATHDQHSLQAPLAQQDPKALSLELLHVTFD

SEQ ID NO: 207674 - protein, 241 aa, Glycine max
  Coding DNA Sequence Number=SeqID_90896
MHFEYPGQYIIPSSSEPACGQKRLSSVKGNCLMSGAWTSVVWAASVKLSEVDMLLVLQARSDVSEYIEEKHYVLSFAANVCSARAILLHTCHSWSRHILETWCMGEWGCVIIDESTSSLNGIDDTHHGASDSESSSSERLRVSCRVGGGASCLYGRVQPSVASPTGESVPITMILPLLLQGDQGTMVAGMLGCPPVCGIAIVLGRHPHYPPAKRTEESGRRISCTEALSECELAKRTAFNP

SEQ ID NO: 207675 - protein, 89 aa, Glycine max
  Coding DNA Sequence Number=SeqID_90897
MKGENLHSVVSCKGRGGKRWHEGGEGDSFLPFSSSSGDATYLFTATNPNKVGIRYEPVQLHHHVPRVRDITEKTTPHTMLKSLHPISQR

SEQ ID NO: 207676 - protein, 222 aa, Glycine max
  Coding DNA Sequence Number=SeqID_90898
  Gene Ontology: Mol. function=RNA-directed DNA polymerase activity; Biological process=RNA-dependent DNA replication
MEPPIQMNIWMLFSPEKFYGGLPPRSTDSFDTLVKRFNAQYATSWSHRVTPIALASQRQVDDEFLWKFMDRFGHIVVQIRNLNSEVALHFMLLTLMPAKSYIQMEEMSRFNNEVRQDRQKHNKQEGSTKTKSYKSDKRHKPDKRQPLPKGPRYECYTPPTPNHTTILKEAFNLEVPMKLPPPRPRRPGLDVTKYYGYHHSWTVMQQERDVEGTKRINIGIMT

SEQ ID NO: 207677 - protein, 60 aa, Glycine max
  Coding DNA Sequence Number=SeqID_90899
MAKMHIPLGSSGFYSLFFDNDNILRLLYDGLEVSAITGHIHGWHLGKLIRDAVHARRSSE

SEQ ID NO: 207678 - protein, 109 aa, Glycine max
  Coding DNA Sequence Number=SeqID_90900
MGLNQAQSFKKKFVQVKMRAKIKIMIAIKQEQKQMKADMEAMKEQMTTMMEAMMSMRKMMKEKRKDLCEDFKIQHHNLTPYRPKMIGAVEAANKNIKKIIQKMIVTYKD

SEQ ID NO: 207679 - protein, 56 aa, Glycine max
  Coding DNA Sequence Number=SeqID_90901
MKLNETREILKRKRNNQHGFPYKSMVFNFFPKGPVPPSGLQGFLSDQMSSPNRSDP

SEQ ID NO: 207680 - protein, 70 aa, Glycine max
  Coding DNA Sequence Number=SeqID_90902
  Gene Ontology: Mol. function=ribonuclease H activity; Biological process=DNA integration
MEVVLPFEVEIPSLRVLSEAELEEVEWVQECFDQLNPIEGKRLAIMSHEQLYQRRMKNAFDKKVLIAQIQ

SEQ ID NO: 207681 - protein, 79 aa, Glycine max
  Coding DNA Sequence Number=SeqID_90903
  Subcellular localization annotation: CTP_CleavageSite=19; ConfidenceScore=5.35e-01
MAFHSANMHNSSFFQILPRAQSRSVALSGWLAKLTAQKPSLVRLMKIYSWAKRDSNALSERTQKIIFCRIGLAEQACLA

SEQ ID NO: 207682 - protein, 251 aa, Glycine max
  Coding DNA Sequence Number=SeqID_90904
  Gene Ontology: Mol. function=protein transporter activity; Cellular component=membrane; Biological process=protein secretion
  Homolog annotation: Hit_ID=Q33YY8; Match level="QueryCoverage=97%, HitCoverage=75%, E-value=2e-46, Identity=39%"; Hit description =Secretion protein HlyD precursor
PEVPAKEQQAHGALAAAQPVPDKADEGARSEDIRAAEANWKRAEAGATLAEATYQRVQNLFNEGVMTRQKRDEAHAQATSSRELARAARAQYDMALAGAREQDKRAAQGQVQQAQGAVAEVNAARVEVEGRAPVAGEINKRMADPGELVPAGYPVFTLVDIDRMWVAMNLRESQMQGLKVGSKLQGSVPALGQDGEFEVYFINPAGDYATWRTTRQSSGYDVRSFEVRVRPVRRIEGFRPGMSVLFAWPQH

SEQ ID NO: 207683 - protein, 165 aa, Glycine max
  Coding DNA Sequence Number=SeqID_90905
MVSGNRLPGNRDGSLVIDYQIVMAALLIRDRVEMECLEGAWETLEGNTRCRFRGTIRFTATSLVHPDEPAWTLQRTVEWILPTPTPYRLVEPVQVIEVTSSEEDPEEDLEKLPPKPAVDALDFLEGDEDPLLEVDSPEEVMSASEADSTEDSGPGEMAISGGSSS

SEQ ID NO: 207684 - protein, 81 aa, Glycine max
  Coding DNA Sequence Number=SeqID_90906
MTIICLCVPSDTTVSRWQKVSGMTVICLRMSSGPPPLDDKRAQNDHNLSLRAIGHDCVWMAKGERNDHNLSLHVIGPAASG

SEQ ID NO: 207685 - protein, 100 aa, Glycine max
  Coding DNA Sequence Number=SeqID_90907
MSSTSSNPYEAKNKPTLEAINEEHEAYLDGGSGTDGWKRPQCRQQEHSTTTTQRKPMKKARRRRCSMRGRGDNTAYGRTEEQSGQKSKDHLIIHQDDVFC

SEQ ID NO: 207686 - protein, 161 aa, Glycine max
  Coding DNA Sequence Number=SeqID_90908
MKIKSKGAPKSVKSTKCEPSMWEHVDEMNTMVGSSVTPNVTCKGSIETMLGQGQESWFLVYQDLIQELQTWHSVYVQVFDSKERLLELIISLYVECGLVPYEKWMTIPDKGYAIANVSDGGGGEGRKGADEALNSVNASGRIPLITTRWEGDGGDGGRGTG

SEQ ID NO: 207687 - protein, 78 aa, Glycine max
  Coding DNA Sequence Number=SeqID_90909
MGVRITMRCLRVSSDLPSSNDEGADNHEVSPQKTLRSPTKGADDHIGFCVSSDLLPPDDEGADNHEVSPHVIGLAVSG

SEQ ID NO: 207688 - protein, 54 aa, Glycine max
  Coding DNA Sequence Number=SeqID_90910
MRGTMHEPQANLGADQNFSPVMSMHMHLCCPASQKIEENLFQELVDTTPSPRPR

SEQ ID NO: 207689 - protein, 197 aa, Glycine max
  Coding DNA Sequence Number=SeqID_90911
  Gene Ontology: Mol. function=helicase activity; Biological process =viral genome replication
  Homolog annotation: Hit_ID=Q9LW42; Match level="QueryCoverage=92%, HitCoverage=11%, E-value=7e-47, Identity=48%"; Hit description =Helicase-like protein
MLSDLTKNHLLGKVVALEIPSQEDDPELYKLVQNHMVHGPCGILRPASPRMKEGKCSRFYPKKFQLTTLIDGDGYPVDRRRNTGQTITKNEIIIDNRCIVPYNPKLLKKYQAHINIEWCNQNTSIKYLFKYINKGYDKVTAVMVHDDTRTVPHANTLNDEIKEYLDCMYEPSLIYTFLHVNLLGGSLVFQYMVENLL

SEQ ID NO: 207690 - protein, 142 aa, Glycine max
  Coding DNA Sequence Number=SeqID_90912
  Gene Ontology: Mol. function=unspecific monooxygenase activity
  Homolog annotation: Hit_ID=O04892; Match level="QueryCoverage=67%, HitCoverage=23%, E-value=9e-28, Identity=57%"; Hit description =Cytochrome P450 like_TBP
RDVAADGNVRESGDPAHPGNGSAGGRVQRLEEHRKSHASGRWNNVGKGSRQNGSVTSGKGLALRAGHGGPSPEPVGCRWTARAASAARAGRRVPVGGRIGNGPFGASSPGVEQSTQKCALNVKVKKFNQARVNGGSNHDSLK

SEQ ID NO: 207691 - protein, 262 aa, Glycine max
  Coding DNA Sequence Number=SeqID_90913
YPFEGHDTDMSASEYSFGGVAETHPHFSWPTMTPSQQHDALMATPNAPLASQWDVPGAIPDMGDLLGVDLRHEFSTEAEQQGQRQRARRNQDRLARSFGFGVWGLGFTTYGLGFRGLGIMVNGLGLRDLGLGLRVEDLGFRVSGKGLGVMGVMGLVYELGLGIRVLGGLGLGLRELGFGFRTQIFLKGTSFVVQVEGTSTWVVVTENKRGYISCGSVLVEGTYIRLFKENKGGYIPCGSLLVKDFTRLKRNLKDHRSLGDCM

SEQ ID NO: 207692 - protein, 38 aa, Glycine max
  Coding DNA Sequence Number=SeqID_90914
MAKIPLRHFTEHLVGAFLGTNTKGMGAMWLAPSSQYTT

SEQ ID NO: 207693 - protein, 75 aa, Glycine max
  Coding DNA Sequence Number=SeqID_90915
MQYVVLGARIPKATVAIAMVWSTDPTALAVHMLHCQTGKKYNIRRTLSPNARIACCASVGRQRPSEQLWAVSGKN

SEQ ID NO: 207694 - protein, 130 aa, Glycine max
  Coding DNA Sequence Number=SeqID_90916
MGEVVEKFLKKYFPESKTTKGKMEISSFHQFPDESLSEVLDHFHGLLRKTPTHGYSEPIKLKTPEEAMELIENMAASDQAILHDRTYVPTKRSLLELSTQDTTLAQNNDAPRMEGRMSLDNAQSNKIPLE

SEQ ID NO: 207695 - protein, 100 aa, Glycine max
  Coding DNA Sequence Number=SeqID_90917
  Gene Ontology: Mol. function=protein dimerization activity; Cellular component=endoplasmic reticulum; Biological process=proteolysis
  Homolog annotation: Hit_ID=Q46WW6; Match level="QueryCoverage=90%, HitCoverage=22%, E-value=1e-31, Identity=67%"; Hit description =Peptidase M20D, amidohydrolase
MAAAMHLAVVARTVFELVLFLHRQGVHVGAQHDGAVGSAALDDADHAGLGDAGVGLDAPAAQGVGHHLGGAVLLVAELGMGVQVAPQRHNIVEIGQVGHR

SEQ ID NO: 207696 - protein, 131 aa, Glycine max
  Coding DNA Sequence Number=SeqID_90918
  Homolog annotation: Hit_ID=Q1SM20; Match level="QueryCoverage=66%, HitCoverage=22%, E-value=3e-16, Identity=44%"; Hit description =Nucleic acid-binding, OB-fold
MTKKFDMIKDIDGKREILKIVVRITNLWFVQSVDKKRHLEMTVMDAQGDEIQVIVKNEELVRWESMLKDQTTYVMHNFKILPNKGQYKGSITITNLPKSWWSYKIMWMTVRSDRYIWIHRTPIPYFPTQKA

SEQ ID NO: 207697 - protein, 200 aa, Glycine max
  Coding DNA Sequence Number=SeqID_90919
  Gene Ontology: Mol. function=DNA binding; Biological process =regulation of transcription, DNA-dependent
  Homolog annotation: Hit_ID=Q7W9V8; Match level="QueryCoverage=34%, HitCoverage=29%, E-value=1e-25, Identity=81%"; Hit description =Probable esterase
RLVARTHRQEAGVAGRLRQPQHRRFGDRLDAVAAFGRQPQDVRLPPQAVGLELGIERQEALLQQGRQHAVRGGRRQAQVARHVGQADPARGRGPHVLEDAQHAEDALRAADRIGVARGGGGFGGTHRRAFNAPWCHRAATGSGPAPPPNCAAARKSAGARWRAGSGPDAVRGRRAWPRQWWNPRAARPAAPAPPGSRPPA

SEQ ID NO: 207698 - protein, 159 aa, Glycine max
  Coding DNA Sequence Number=SeqID_90920
  Homolog annotation: Hit_ID=O04892; Match level="QueryCoverage=48%, HitCoverage=14%, E-value=2e-14, Identity=53%"; Hit description =Cytochrome P450 like_TBP
  Subcellular localization annotation: CTP_CleavageSite=50; ConfidenceScore=5.13e-01
MSRRARRSLQNPGREPGRSGRRCRSWCLPTLETLSRSRSSGWKSTARRVVSGAPRGLNPEDRVPPTPVIITASVSKVNSLWAGHGGPSPEPVGCRWTARAASAARAGRRVPVGGRIGNGPFGASSPGVEQSTQNWYGQGESDCLIKQSIAMVPADVDAM

SEQ ID NO: 207699 - protein, 323 aa, Glycine max
  Coding DNA Sequence Number=SeqID_90921
  Homolog annotation: Hit_ID=Q1S3I6; Match level="QueryCoverage=22%, HitCoverage=5%, E-value=5e-21, Identity=71%"; Hit description =Integrase, catalytic region
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSILLPGSSSNKVCKLHKSLYGLKQASRQWFSKLSTALISLGYSPSSADHSLFTKLHNSHFTALLVYVDDIVLTSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 207700 - protein, 121 aa, Glycine max
  Coding DNA Sequence Number=SeqID_90922
GVPVAPSKGHQTPLPIELSSRSTAPPEQAQERNTTSTLGWPSSEAIDTPPPPLEFTSAHPQKGLSIAYTTWPTNRRPSPKPKGECCENFPGRPKWTRMNAQIDKRTYFGNIGLTKNRGNES

SEQ ID NO: 207701 - protein, 275 aa, Glycine max
  Coding DNA Sequence Number=SeqID_90923
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=1e-27, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEGVCLRGLHVLTFRGLHVLAFRGLHALAFRGLHVLTFRRLHILTFIGLHALTFRGLLALAYRGLHVRTFGGLHALAFRGIHVLTFRGLHALAFIGLHALTFRGLHRTTRPHLQRVVRPHLRRATRPHLQRVARPRLQRATRPRRLHVLAFRGLHLLTFRGLHALAFRGLHILTFRGLHAFAFIGLHALTFRGLHFISFRGLHALALRGLRILTFRWLHAHAFRGLHGLTFKGRHILNFRGLHTLFFRGLCVLIFSGLYICTLREFKVVCL

SEQ ID NO: 207702 - protein, 321 aa, Glycine max
  Coding DNA Sequence Number=SeqID_90924
  Homolog annotation: Hit_ID=P18148; Match level="QueryCoverage=71%, HitCoverage=95%, E-value=7e-70, Identity=56%"; Hit description =Protein psiA
  Pfam annotation: Domain name=PsiA; Domain location=80-317; Score =361.1; E_value=1.8e-105; Accession=PF06952.2; Description=PsiA protein
ALYAHPRQLPPGGVQSRRYQPGVDGGVCSRQRSPVLRHSCPERLAAGAGQPHPQPDGASRCGRLQPGQHHQYSGSGGRGMIPAHLSLVPFSPERRAAMEAIAEVERRRSRGAVSTMYPYASAFFRRLTGSTRISLREIHHFAPVLTARELRGSRDSWLRAIDALIESRGTCCWLPLPVGAGQRLFPEVAFQQAERVRCQDALRDEKYTRQRHKEQCQRERAYQALAGQAEIELAFHTPETVGSWSARWSGTELRQYDLEEMFWRWSERFPSLSGLDHWMFEGEPFWTVIAETKVLARESPESVRQLERWMVPNKLTMRDRV

SEQ ID NO: 207703 - protein, 323 aa, Glycine max
  Coding DNA Sequence Number=SeqID_90925
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=95%, HitCoverage=51%, E-value=1e-167, Identity=87%"; Hit description=DNA -directed RNA polymerase beta' chain
  Pfam annotation: Domain name=RNA_pol_Rpb1_2; Domain location=110-252; Score=245.1; E_value=1.4e-70; Accession=PF00623.11; Description=RNA polymerase Rpb1, domain 2
MVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRAYQQKRINFDSPLWLRWRLDQRIISSREVPIEVHYESL

SEQ ID NO: 207704 - protein, 51 aa, Glycine max
  Coding DNA Sequence Number=SeqID_90926
MATLQDHCRFFPGCALMRTGISAAPAGVRINAHRYKCRTCGGLKPDRGKQA

SEQ ID NO: 207705 - protein, 110 aa, Glycine max
  Coding DNA Sequence Number=SeqID_90927
MEAMKEEMATMMEAMMSMKKIMEVNATAVAAISVVSGVDPTPPSCLNLINHPTADTGDPHFVQAQNKQVFPPYGLPPNYTPPNENVNNFTSIPIESQQPQSDHAHVSQPM

SEQ ID NO: 207706 - protein, 210 aa, Glycine max
  Coding DNA Sequence Number=SeqID_90928
LHALTFRGLHVLAFRGLHVLAIRDYMSPIFKGRHALTFRGLHVLAIIGLHSLAFKRRHVLNFRGLHTLAFRGPRASSFLLSVPGSPPDIGGDRAHKTPSGPKEVQQGPWVSSSGYGPLSVPQGARSPSEESHPQRHPVDPEKFNRALGFPALGARSPRHGHIIIGIAPAGHPVDPKKSNRFYGVPVTSSKGIRPPTNQAFIKKYCVPRQA

SEQ ID NO: 207707 - protein, 238 aa, Glycine max
  Coding DNA Sequence Number=SeqID_90929
MVLAEGETLLAYSRYCRLPTDFREIEAALCIPGRGFILNSEGHPGRILKKDLTTLAQVWSVLSYSNLAPTSHTSDLTVNRARLIFGLVSHLDMNIRALISGQITSIAQSNTSRLGFPALIIALCRARGVVSDSLTFKRLSPVINLAYIRKNNWNPEDLTVSIRGARRARARLAKLPSTSAAPTPTSTSAAPSIPAQTNSQCFEAMLQSIHQGKIILLQSLQMMAPPDSIPTVEQFNEM

SEQ ID NO: 207708 - protein, 134 aa, Glycine max
  Coding DNA Sequence Number=SeqID_90930
  Subcellular localization annotation: CTP_CleavageSite=34; ConfidenceScore=5.25e-01
MASFSQMQSQFQSQMQSQGVALPPEPMVGPSGPRVSTKESCVDPSGNDPETGDSNKYGLYIEENPPCLVALGRVYEGSTVHNIPLLPGQVKVGVEECNYLTMFDQQTTVSPAKPSQRPDPEVDDPLYLMTLTIP

SEQ ID NO: 207709 - protein, 102 aa, Glycine max
  Coding DNA Sequence Number=SeqID_90931
MEELINKTQNNPNATTSDWQLLNRISLPTPYYCHSAPTNKVRNHHSLGHKGVPYQVTHPLVQSTYCHNLYYFPCHMRHETWAPSSTMTMDELKILSHSLGDA

SEQ ID NO: 207710 - protein, 66 aa, Glycine max
  Coding DNA Sequence Number=SeqID_90932
  Subcellular localization annotation: CTP_CleavageSite=51; ConfidenceScore=5.34e-01
MASLMTCGGTVRLSAPFVIPRQFLLSSFGDIQVQQRTRFFSTGRERLSLIACGNVVVIPFYRFQDT

SEQ ID NO: 207711 - protein, 228 aa, Glycine max
  Coding DNA Sequence Number=SeqID_90933
  Homolog annotation: Hit_ID=Q1SKD7; Match level="QueryCoverage=65%, HitCoverage=38%, E-value=2e-10, Identity=27%"; Hit description =Ankyrin
MAKYDPEVVMEFYANAWPTKEGVMDKHSGVRGQWIPYDIDAINQFLGHPLILEEGQRCKYTERRSQFSGFDEEAIDQLLCSPGHDFARSIVGRQVRIMHTSMTTLTQICMTLLLSNILPSDHNSDLTLPKCQLVYSIMTQISVHMAQLISDAIHQFVDITPPRYPVDPEKSNRALGFSTLITGLCQFYRVPVAPTKLIQPPINSIARTLTLTLTYSRAIQSHCRMAWG

SEQ ID NO: 207712 - protein, 262 aa, Glycine max
  Coding DNA Sequence Number=SeqID_90934
MKKRQHDTLMTENPALIEDPLSPIQRHVKWKMARTNQYGKMTSEAARQIADKIVNSNFNLDYNNFNFGLNDSLEEQVTQGEFVPQGRQDILNMAIGRPDHGGCVRAAGSGVTISQYYGRTSRASSTSSIAFTKEQLAEIVVTIREQVMKEIEEENKRSLQAWKNELKDAIITDIFNGDKDSAPANFDLNVLGARVSTKESNAEIVVNPSGEVHVGRVTPPMGLYVQSQDCTKLVALGKIHDGPSTIHCVAYANDVVRVSVEK

SEQ ID NO: 207713 - protein, 79 aa, Glycine max
  Coding DNA Sequence Number=SeqID_90935
KDALPPQDERTPSPPPQRDDSALMTEVLSELRGLRTYVGEHFDSLDTRFAGMDIRLTQLEKDVGYIRQSFDLPPPPPPS

SEQ ID NO: 207714 - protein, 164 aa, Glycine max
  Coding DNA Sequence Number=SeqID_90936
  Gene Ontology: Mol. function=protein-tyrosine kinase activity; Cellular component=integral to membrane; Biological process=protein amino acid phosphorylation
  Homolog annotation: Hit_ID=Q1SX72; Match level="QueryCoverage=99%, HitCoverage=53%, E-value=8e-50, Identity=36%"; Hit description =Tyrosine protein kinase, active site
  Pfam annotation: Domain name=LRR_1; Domain location=103-126; Score =12.1; E_value=1.5; Accession=PF00560.23; Description=Leucine Rich Repeat
  Pfam annotation: Domain name=LRR_1; Domain location=128-150; Score =14.4; E_value=0.42; Accession=PF00560.23; Description=Leucine Rich Repeat
  Pfam annotation: Domain name=LRR_1; Domain location=31-53; Score =12.0; E_value=1.6; Accession=PF00560.23; Description=Leucine Rich Repeat
  Pfam annotation: Domain name=LRR_1; Domain location=55-77; Score=5.1; E_value=32; Accession=PF00560.23; Description=Leucine Rich Repeat
  Pfam annotation: Domain name=LRR_1; Domain location=6-29; Score=14.7; E_value=0.34; Accession=PF00560.23; Description=Leucine Rich Repeat
  Pfam annotation: Domain name=LRR_1; Domain location=79-101; Score =11.6; E_value=1.9; Accession=PF00560.23; Description=Leucine Rich Repeat
  Pfam module annotation: Pfam domain module=LRR_1::LRR_1::LRR_1::LRR _1::LRR_1::LRR_1; Domain location=103-126::128-150::31-53::55-77::6 -29::79-101
MWSLRSLHALDLSQCLQLSGAIPNSIANLSNLSYLDLSTAKFSGHIPPEIGKLNKLGFLRIAENNLFGHIPREIGMLTNLKLIDFSANSLSGTIPETMSNMSNLNKLYLASNSLLSGPIPSSLWNMYNLTLIHLYANNLSGSIPASIENLAKLEELALDSNQIS

SEQ ID NO: 207715 - protein, 40 aa, Glycine max
  Coding DNA Sequence Number=SeqID_90937
MANIRRLPAPESVDWASLPGEPKLGIPYTLFFFDLGLAKR

SEQ ID NO: 207716 - protein, 80 aa, Glycine max
  Coding DNA Sequence Number=SeqID_90938
MGFGNFSEKERKNNLMAIITHGWFHAKERNIGGHSESVMPTSTWVPLPAESGASEKHALGTFNMPMHKKANCTSFLFKGI

SEQ ID NO: 207717 - protein, 345 aa, Glycine max
  Coding DNA Sequence Number=SeqID_90939
  Gene Ontology: Mol. function=DNA topoisomerase (ATP-hydrolyzing) activity; Cellular component=chromosome; Biological process=DNA topological change
  Homolog annotation: Hit_ID=Q10M67; Match level="QueryCoverage=93%, HitCoverage=38%, E-value=2e-64, Identity=44%"; Hit description =Expressed protein
  Pfam annotation: Domain name=DUF632; Domain location=1-235; Score =226.1; E_value=8e-65; Accession=PF04782.3; Description=Protein of unknown function (DUF632)
MISGSHASTLDRLYAWERKLYDEVKASEIVRKEYDMKCKFLRQLESKGEKTSTVDKTRAKVKDLHSRIRVAIHRINSISKRIAELRDKELQPQLEELIEGLNRMWEVMHECHKLQFQIMSAAYNNSHARITMHSELRRQITSYLENELQFLSSSFTKWIGAQKFYLEAINGWLHKCVRHEEKSFKRKRKHQSDLKYSDPPIYVTCAVWLNKLSDLPVKDVADSIKSLATDTAQFLPHQDKNQGKGAHPHMSTWKADIGGESADGLLRDDTSEDWVTGLDQFRRSLIRFLSQLNNLSGCSVKMYTELRQTIQEMIIKIPNLRVDPSELQLKWFRLKTNIHTIRELR

SEQ ID NO: 207718 - protein, 71 aa, Glycine max
  Coding DNA Sequence Number=SeqID_90940
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=73%, HitCoverage=11%, E-value=4e-20, Identity=90%"; Hit description =Ser/Thr protein kinase
MVLRKVGKYEIGRTVGEGTFAKVKFAQNTESGESVAMKVLDRSAIIKHKMVDQGLIWSIALYVLLLKSDDK

SEQ ID NO: 207719 - protein, 110 aa, Glycine max
  Coding DNA Sequence Number=SeqID_90941
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=52%, HitCoverage=25%, E-value=8e-11, Identity=51%"; Hit description =Protein ULTRAPETALA2
MIIGDPPKQKRSQGNEKKTEDDNISQGPSKRRKQFRVGDDGKILFDEEELKMILDFKRGEDYIEVLCGATNKKYGDYVGRLKINNEGQYFITCECCPECPLGTAESVDLF

SEQ ID NO: 207720 - protein, 107 aa, Glycine max
  Coding DNA Sequence Number=SeqID_90942
MSSGSPPLDDKKVENDHNFSLHAIGLDRLWMAKGVRMTIICLRMSSGSPPMDDKKVQNDHNLSLRAIRFDRLWMVKGSDCWAADKSKALAPTYPQFVMRNSDLRCSG

SEQ ID NO: 207721 - protein, 175 aa, Glycine max
  Coding DNA Sequence Number=SeqID_90943
  Homolog annotation: Hit_ID=Q1SP02; Match level="QueryCoverage=54%, HitCoverage=25%, E-value=1e-08, Identity=41%"; Hit description=IMP dehydrogenase/GMP reductase
MSRRRPLHGSWAVILHFSNAGYTSTFLQCIHPSFMMLMMRGAHGPAGGLQMPYGEHRGVRAFDLISSYTGQLRWGQIMVYVRPEWVLRQFGYLQTVPPPSVHCEGCQGMAQDLGAIVEDLERVINLRMVTEGTNLHEIMTHCPRRARGDAVDESLRPVPETPHRLGFIFLLYLNY

SEQ ID NO: 207722 - protein, 133 aa, Glycine max
  Coding DNA Sequence Number=SeqID_90944
  Gene Ontology: Mol. function=chitin binding; Cellular component =extracellular region; Biological process=chitin metabolic process
  Homolog annotation: Hit_ID=UPI0000612705; Match level="QueryCoverage =84%, HitCoverage=91%, E-value=3e-11, Identity=29%"; Hit description =UPI0000612705 related cluster
MIGPLDESISCFRIRVDPWVHALTFRGLHAFAFVGLDILKFRGLHVLAIRGLHILAFKGLYPLAFRGLHALALRGMHDLAFRGLHVLAVRGLYVLTFRGLHVLTFRGLHALAFRELHVLSVRGLYVLTFKGLH

SEQ ID NO: 207723 - protein, 169 aa, Glycine max
  Coding DNA Sequence Number=SeqID_90945
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=99%, HitCoverage=52%, E-value=1e-42, Identity=48%"; Hit description=E3 ubiquitin ligase PUB14
  Pfam annotation: Domain name=Arm; Domain location=46-86; Score=13.1; E_value=0.28; Accession=PF00514.13; Description=Armadillobeta -catenin-like repeat
  Pfam annotation: Domain name=Arm; Domain location=87-128; Score=8.4; E_value=1.1; Accession=PF00514.13; Description=Armadillobeta-catenin- like repeat
  Pfam module annotation: Pfam domain module=Arm::Arm; Domain location =46-86::87-128
TCPKTQQTLVHTALTPNYVLKSLIALWCESNGKKDAATAIFNLSIYQGNKARVVKAGIVAPLIQFLNDAGGGMVDEALAIMAILASHHEGRVAIGQAKPIHILVEVIRTDSPRNQENAAAAVLWSIFTGDPLQLKLAKERGAEAALQELSGNGTDRAKIKAGSILELLQ

SEQ ID NO: 207724 - protein, 167 aa, Glycine max
  Coding DNA Sequence Number=SeqID_90946
  Gene Ontology: Mol. function=iron ion transporter activity; Cellular component=outer membrane-bounded periplasmic space; Biological process=iron ion transport
  Homolog annotation: Hit_ID=Q8PIX1; Match level="QueryCoverage=46%, HitCoverage=35%, E-value=2e-13, Identity=54%"; Hit description=TonB -like protein
VASPHFDPARVAAWSAAIALHLLAFLLLLIPATYQAVQVPRDKTAVRLIEKIPPPPTPPVPIPPKEIVQVMPKPRTQPVRWTPTGSRRWSASSAAVARAAWTRLHASRCSGTGASSRPSVMAWPCRPSAWCRCSSRCRTEVIAGPATCRAGPSVRAGTDGTGSTVID

SEQ ID NO: 207725 - protein, 180 aa, Glycine max
  Coding DNA Sequence Number=SeqID_90947
GMTPMESRQPQSDHAHVSQPMGETREVPHHNLADFEPGLGYAAEGQAIGGVPLPNTLEDPQYHPQSQPLHFAMGRVPPAMVEMEKLDRIEERLRVTEGGRDHAFADMAELCLVPDVTIPPVATYPSAGGRRETRGMRVPRKEYARSRHQRLFEENVGKTGKDAIYELLSERFGSCIYARG

SEQ ID NO: 207726 - protein, 194 aa, Glycine max
  Coding DNA Sequence Number=SeqID_90948
MDILTLGQGLWDKGDVPHYFHDTHATMMIRKFYAKLVMHAPMWTLKHHVFCYLNICIFLKDHEQLGVSYYDLRNKRPSTIACLWLWTWSPSGRPRVVGHAPAFVDELRDSGGGGGASIARCQPSPGCCGVSPCACSGGAILLDESPINMGPDDLVGGDRHSIELTKARNQSWKPQDPVGLLRVPWVSCGCDPCK

SEQ ID NO: 207727 - protein, 185 aa, Glycine max
  Coding DNA Sequence Number=SeqID_90949
  Gene Ontology: Mol. function=transcription factor activity; Cellular component=membrane; Biological process=regulation of transcription, DNA-dependent
  Homolog annotation: Hit_ID=P0ACR7; Match level="QueryCoverage=88%, HitCoverage=58%, E-value=2e-53, Identity=58%"; Hit description =Putative HTH-type transcriptional regulator yfeR
  Pfam annotation: Domain name=LysR_substrate; Domain location=1-173; Score=82.2; E_value=1.7e-21; Accession=PF03466.10; Description=LysR substrate binding domain
MPQCIAAGEREYPEIRIMLRDQAQQQVLHSVRNAEVDFGIVVDPVQAVDLECEAVLHEPFLLLCRDDHPFAAQQEDYASGSRPLIDSALRQQGVEAQVVQEIGHPATLFPMVAEGIGISIFPALALPLPEGGRLRVRRLVPEINRALMLVRRKNRSLTPAAEAIWQVARQQAALLHQRRQENAEY

SEQ ID NO: 207728 - protein, 126 aa, Glycine max
  Coding DNA Sequence Number=SeqID_90950
  Subcellular localization annotation: CTP_CleavageSite=68; ConfidenceScore=5.72e-01
MTLSSWQNKLNRKMATPPSSPPLPPTDSTSHSPSTLKRTRKVTWLRSLATRPVGAERPLVHVDPATRKADADKDGVDDTVCEKYDINKEKWTQFCLIRKDPSWEDVQKKAQAIQKQNIVLPVLSRG

SEQ ID NO: 207729 - protein, 127 aa, Glycine max
  Coding DNA Sequence Number=SeqID_90951
  Gene Ontology: Mol. function=transcription factor activity; Cellular component=nucleus; Biological process=regulation of transcription, DNA-dependent
  Homolog annotation: Hit_ID=Q9LTC5; Match level="QueryCoverage=86%, HitCoverage=86%, E-value=2e-28, Identity=54%"; Hit description =Nicotiana EREBP-3-like protein
  Pfam annotation: Domain name=AP2; Domain location=21-86; Score=148.8; E_value=1.5e-41; Accession=PF00847.10; Description=AP2 domain
SKQKKSMEEHQKAGKLQGKEEVRYRGVRRRPWGKYAAEIRDPSKQGSRLWLGTFDTAEEAARAYDRAAFNLRGHLAILNFPSEYYSQIRGSPPYPPHLATPSSSSGAQQRPVFEIPCLDDKVLEDLL

SEQ ID NO: 207730 - protein, 81 aa, Glycine max
  Coding DNA Sequence Number=SeqID_90952
MAIEEGRSTRPEVRITNLTLGQLDPVSNGVCAKLLARIFTRLVSFFSPNVNFLKDVDRKDISLSKFKLFDIIKLLEAITLA

SEQ ID NO: 207731 - protein, 90 aa, Glycine max
  Coding DNA Sequence Number=SeqID_90953
MDVKITLILHHEGRFTPRASDGKVEYIGGEFDVWEDISADYMNTFILCDLVQAYPILEEVPLMLDLKCHPIPEASNEDDLDDVPVAGHEE

SEQ ID NO: 207732 - protein, 42 aa, Glycine max
  Coding DNA Sequence Number=SeqID_90954
MFPHGVEGRSLEFQESLDLSSNPFPRGEDDAIPPPKRCNPTP

SEQ ID NO: 207733 - protein, 354 aa, Glycine max
  Coding DNA Sequence Number=SeqID_90955
  Gene Ontology: Mol. function=catalytic activity; Cellular component =cytoplasm; Biological process=metabolic process
  Homolog annotation: Hit_ID=Q6C3G1; Match level="QueryCoverage=99%, HitCoverage=23%, E-value=1e-78, Identity=43%"; Hit description =Yarrowia lipolytica chromosome E of strain CLIB 122 of Yarrowia lipolytica
  Pfam annotation: Domain name=CPSase_L_chain; Domain location=173-285; Score=121.0; E_value=3.4e-33; Accession=PF00289.12; Description =Carbamoyl-phosphate synthase L chain, N-terminal domain
MQQEPVHYNSQFGTYTNFTNLADLSALALPGPFRADGLPAGITLIAPAWHDRALATFGLRWQQQLALPLGATGKALPPQPAALPPSPDHVRVAVVGAHLTGMPLNFQLTTRQAVWVEETQTASHYRLFALLDGPIKKPGLLHGDSGAAITVELWDIPLARFGEFVSEIPAPLGIAPFLIANRGEIACRAIRTLKRLGVTSVAVYSDADRNARHVTEADVAIALGGDKASDSYLRIDKILADAQQNGAQAIWPGYGFLSESLPFAAACEEAGIAFVGPTAQQIGEFGLKHRARELAASAGVPMTPGTPLLSSLQDALSAAEDIGYPVMLKSTAAGGGIGLTRCAVATALENAWES

SEQ ID NO: 207734 - protein, 281 aa, Glycine max
  Coding DNA Sequence Number=SeqID_90956
  Gene Ontology: Mol. function=RNA methyltransferase activity; Cellular component=intracellular; Biological process=RNA processing
  Homolog annotation: Hit_ID=Q1R238; Match level="QueryCoverage=76%, HitCoverage=91%, E-value=5e-66, Identity=59%"; Hit description =Hypothetical tRNA/rRNA methyltransferase LasT
  Pfam annotation: Domain name=SpoU_methylase; Domain location=2-153; Score=134.2; E_value=3.6e-37; Accession=PF00588.9; Description=SpoU rRNA Methylase family
MHFPLILVSPARPENIGAAARAMKTMGFSELRIVASDAWQDPAARRVAHGAGEILDHVKTYDTLSAALADVDFSVATTARSRAKFRYYATPAQVETILQEKRQWLNRIALVFGREDSGLTNEELEQVDLLTGIPMAQDYPSLNLGQAVMVYCYQLSALHQVAAAPVEAANAQQLQALRQRFHQLLVTLEVSNDAKLADWIDQRIGLLEQRDSAMLHLSDRASVTLPERSQSVSASAAQHCAAAPFGCKDKFVDLTCALLYFWKADGQDKDRQKKSQCVTTA

SEQ ID NO: 207735 - protein, 253 aa, Glycine max
  Coding DNA Sequence Number=SeqID_90957
  Gene Ontology: Mol. function=sequence-specific DNA binding; Cellular component=intracellular; Biological process=regulation of transcription, DNA-dependent
  Homolog annotation: Hit_ID=Q7CG68; Match level="QueryCoverage=100%, HitCoverage=87%, E-value=1e-102, Identity=72%"; Hit description =Right origin-binding protein
  Pfam annotation: Domain name=AraC_E_bind; Domain location=126-253; Score=1.2; E_value=0.0026; Accession=PF06445.5; Description =Bacterial transcription activator, eff
  Pfam annotation: Domain name=HTH_AraC; Domain location=61-105; Score =46.0; E_value=1.3e-10; Accession=PF00165.13; Description=Bacterial regulatory helix-turn-helix proteins, araC family
  Pfam annotation: Domain name=HTH_AraC; Domain location=9-55; Score =52.0; E_value=2e-12; Accession=PF00165.13; Description=Bacterial regulatory helix-turn-helix proteins, araC family
  Pfam module annotation: Pfam domain module=AraC_E_bind::HTH_AraC::HTH_ AraC; Domain location=126-253::61-105::9-55
MDQAGIIRDLLVWLESHLDQPLSLDNVALKAGYSKWHLQRMFKEVTGHAIGAYIRARRLSKAAVALRLTSRPILDIALQYRFDSQQTFTRAFKKQFNQTPAWYRRSSEWNSYGIRPPIRLDDYPMPQAQFVTLPETVLVGQTQSYTCTLEQISSYRDEMRIHFWKQFLLETDTVPPVLYGLHQVRASHEKDDEQEILYTTAVPADQQALSMQSNQSVILEAGEYVQFSYQGPRTALQEFILLLYGTCMPTLGL

SEQ ID NO: 207736 - protein, 119 aa, Glycine max
  Coding DNA Sequence Number=SeqID_90958
MGERKRKRKEGKKAPDQGSKENRRNVQRGLWTGQYLNNTELSPNETKKKGNHDLKWSSPFNYQPKSPCLHFSGENTETFSSLTSYPELRRSEFLIGGYVGARASLLSTTPPFIAITQEP

SEQ ID NO: 207737 - protein, 249 aa, Glycine max
  Coding DNA Sequence Number=SeqID_90959
EDPEEDPEELPPEPAVDALDFLEGDEDPLPEVDSPEEVMSASEADSTEDSGPREMATSGGSSSYPYQNGQNVYSQGLIYDMRSSGGKGGVVGVMRFSGRSVPPSIVLSFVGVGFFIILLGQYGIHSLFTKTLGLNPVIKWCIATVGSRFWIFNTNFLKCSMKVHNGRLVVNYVPNWAAKVSNESMVLGGRQAYLGDVYVYVFIWVCGSVILLNVLRDRGMVSEHTLKLVALGKPTTFDFTSPLSSRLTS

SEQ ID NO: 207738 - protein, 93 aa, Glycine max
  Coding DNA Sequence Number=SeqID_90960
MPADVGQEKMTDRGLKKKHDRMTPIERFLIDIVQVLFTPPGGIERTIASIGRLGFFVRAQPKLYFRRHRHVLVYSARNTLTHLGKKPLFSDTD

SEQ ID NO: 207739 - protein, 285 aa, Glycine max
  Coding DNA Sequence Number=SeqID_90961
  Gene Ontology: Mol. function=hydrolase activity, hydrolyzing O -glycosyl compounds; Biological process=carbohydrate metabolic process
  Homolog annotation: Hit_ID=Q8A1K2; Match level="QueryCoverage=83%, HitCoverage=29%, E-value=4e-69, Identity=52%"; Hit description=Alpha- xylosidase
MGGKDDIAYENGQKMLKELDKIGIKYMYTDYPGGHTWPVWRNSLHQFAQEQKIRFSVSEKNNVISLKTNELLLSINTKNGVITYALPSGKELLKETANDFKPFNDAGTQTYSVRQDFQLEKDEPIYGLGILQNEKMSQRNTDVKMIQNNTWDFVPFFQSVKGYGIFWDNYSPTQFTDTPQKTSFSSEVGDSIDYYFIYGKNADGVIAGMRDLTGNVPMLPLWTYGYWQSKERYKSQDELTEIVKKYRDLKVPLDGIIQDWQYWGNNYQWNAMDFISPDFPDAKKM

SEQ ID NO: 207740 - protein, 129 aa, Glycine max
  Coding DNA Sequence Number=SeqID_90962
  Homolog annotation: Hit_ID=Q2HRE8; Match level="QueryCoverage=48%, HitCoverage=15%, E-value=5e-12, Identity=46%"; Hit description =Lipopolysaccharide-modifying protein
  Pfam annotation: Domain name=DUF821; Domain location=14-129; Score= -311.9; E_value=0.0064; Accession=PF05686.3; Description=Arabidopsis thaliana protein of unknown function (DUF821)
MTIGFIVGFWIVIAPLLICRSWRGRVAERKEGKDRRCGEMELRITKAEINIKPWHILLGGLKEGTTRIPWLNREPYAYWKGNPAVAQTRQDLMKCNVSENQDWNARLFAQKLEITGKFKQHNGQYQYCI

SEQ ID NO: 207741 - protein, 116 aa, Glycine max
  Coding DNA Sequence Number=SeqID_90963
MSRNFTNYLTMGAKYLEVVKRGSHPNNGWSLDEIRVTGCTICGEAHETGQCILIEENTQEGPYNQQGQWRSHPNNQFIKDQGGPSNRPIQQGPNIFQRTTKLEETDSVYASNNVKS

SEQ ID NO: 207742 - protein, 205 aa, Glycine max
  Coding DNA Sequence Number=SeqID_90964
DSLDEQASQGSFVVHGCRNVLIVDIGRPEHPGRVRAARELLHDYIHGSLTLGAANTKNQGPARGINHKKYDLTTNVVLHPNAVLNAITGTRNCLLSLRLVLLLLVSTQRKVVSIPRGRTQTRMTQRNDKQGAEGPKKPIDRLDPDVDPLYLMALTIPQLFLKSLQVPWDATVFRVYDLDKYTSGECLCVWIPQATIHTEIWAIAI

SEQ ID NO: 207743 - protein, 122 aa, Glycine max
  Coding DNA Sequence Number=SeqID_90965
MGKKEKRRTLKWKGHHPHNHSPYQKLLRCFGKARTGESSFVVVIYCGGFLRHRFTWPDMRMNVDNIQQHLDKDLAIDAWQDSWPHVQVSAFPRYKFDHNPILVSYSSSQQSKRKNKSRPKLY

SEQ ID NO: 207744 - protein, 73 aa, Glycine max
  Coding DNA Sequence Number=SeqID_90966
MATFSNISQMFLCFMISSTLMVKIGLSQDAPEPSNAPGPLSSNEKYLTNCGSHLYPNCGDEDYPWIGPAVAES

SEQ ID NO: 207745 - protein, 70 aa, Glycine max
  Coding DNA Sequence Number=SeqID_90967
MDQYIRDIGNSVQREQVSLPEAWESFLKISHEKAHYDHDESTTTIIIDGTEALDYHGLTTTLLVDHNPFG

SEQ ID NO: 207746 - protein, 138 aa, Glycine max
  Coding DNA Sequence Number=SeqID_90968
MPLMLALKEWMPASLSLKRIRVFGYVLSHYSLNFVEAKLHGESKVIQRCFDDNNVTKDDDKGDDKKLKDQSKNNSSESRTIQEFKIESRRIQDSRRKLRVKNQDSRFKIPRIKIKIQESREGLIKISMKSFSQKLSST

SEQ ID NO: 207747 - protein, 86 aa, Glycine max
  Coding DNA Sequence Number=SeqID_90969
MPHRLVSQCETKIISRLSVNPIMNRSLKSIKCSLNSKLHVELVGLGSSSSIKSFASWRSMAAEWRRKKGDWRHHFKEKMSQEHRKP

SEQ ID NO: 207748 - protein, 88 aa, Glycine max
  Coding DNA Sequence Number=SeqID_90970
MEKMNEKRALGRGELRLTPEVTDLPRRAGSFSLKSFEGPGEPEASLGELGFRKINKKTLLPLLFGIFRIPDQNTEWFPALHCNWRSTL

SEQ ID NO: 207749 - protein, 56 aa, Glycine max
  Coding DNA Sequence Number=SeqID_90971
MHDAIKEQARELSAAMHHQKRKTLDEASLLSCESETQHDHRSTSTPYGSLLVVLYD

SEQ ID NO: 207750 - protein, 73 aa, Glycine max
  Coding DNA Sequence Number=SeqID_90972
  Subcellular localization annotation: CTP_CleavageSite=27; ConfidenceScore=5.17e-01
MHTFQHRKTSVRFIFATLLSPSAVIVTARHRTQVKYVNCDSVTIPELRFVIESFKFNSTVKGFIITVSKSMVL

SEQ ID NO: 207751 - protein, 101 aa, Glycine max
  Coding DNA Sequence Number=SeqID_90973
MKSVTKTAEGKPPQHGPQWIEAKSHVQIGNYECGYYVMHWLWCIVSGGLKDDWIHGGGEKDYKEVPPPPLFKPAGGHINQAVTFNRSYYKVISSMEKWLSH

SEQ ID NO: 207752 - protein, 83 aa, Glycine max
  Coding DNA Sequence Number=SeqID_90974
MWKKFRNWDLVEIGIKEIVQTNDEKKGNHACRIVQSSQVVAPKAEHVYDFKLSSVSAELVSVIVVISGKLDYEHTIQFNYVSE

SEQ ID NO: 207753 - protein, 143 aa, Glycine max
  Coding DNA Sequence Number=SeqID_90975
  Gene Ontology: Mol. function=transporter activity; Biological process= transport
  Homolog annotation: Hit_ID=Q38JB2; Match level="QueryCoverage=67%, HitCoverage=29%, E-value=2e-45, Identity=90%"; Hit description =Chloroplast lipocalin
MGSPSMGGSKRRLSSRGLGGALREQRARLYIIKRWKQHLSKKDLGKTETQLEKQEMIKEKCYLRFPTLPFIPKEPDDVIATDYDNFSLVSGAKDQSFIQIYSRTPNPGPELIEKYNSYLANYGYAPSKTKDTPGNLIQQISKH

SEQ ID NO: 207754 - protein, 96 aa, Glycine max
  Coding DNA Sequence Number=SeqID_90976
MRKPDLMANKNKMNNIKSKFRKGLWSLDEDERLVKKKKKPEENKVEEKKAEEEEKKEEEKKPEESKDDKESKEESAPPEIMQGTTFAMHGHFKHDF

SEQ ID NO: 207755 - protein, 93 aa, Glycine max
  Coding DNA Sequence Number=SeqID_90977
MKDRCTMYACVAVSPDCHPHDFATRSPFCQNMAIKVYKDVGDFSDNGDLTPSKIAFYLSVYGEEISKGEAVSPHEEWDSSGDESDHFEDMTSP

SEQ ID NO: 207756 - protein, 87 aa, Glycine max
  Coding DNA Sequence Number=SeqID_90978
MANLVMLGRYEGLKILRERNAEYGLNESKECFGTNGMVARKTTNVLRVKLRASFRHNGSDEMNFLEARNLPRLDHERNDGLRVVLRD

SEQ ID NO: 207757 - protein, 76 aa, Glycine max
  Coding DNA Sequence Number=SeqID_90979
MSLYSNLSRILCKSGLKGLSVREGTLSTILALSTKETIVSLSELHTRWVHAGMDELSSSLSLIAKPLLSRLAVWSR

SEQ ID NO: 207758 - protein, 147 aa, Glycine max
  Coding DNA Sequence Number=SeqID_90980
  Subcellular localization annotation: CTP_CleavageSite=28; ConfidenceScore=5.12e-01
MFYQSLVAFFSSSPTPSPTVTVSTLSINENELSALTKLENDMMNMEDLVTLQHIETTMKGRVGSESDACYGVLDDATSSEGRYVRIDATRITLISLRLVQQGTQREALTKFYQMPKVSLLKTKINSVSEQKDKNRHRPSKQFGPKLQ

SEQ ID NO: 207759 - protein, 74 aa, Glycine max
  Coding DNA Sequence Number=SeqID_90981
MEMKRWDAIHFVVLKMRIKKLVKKLKIYRKALFEEFWEVSRNYESIVHKKSRIRWLREGDANTNFFHSSVNWRR

SEQ ID NO: 207760 - protein, 167 aa, Glycine max
  Coding DNA Sequence Number=SeqID_90982
  Subcellular localization annotation: CTP_CleavageSite=53; ConfidenceScore=5.46e-01
MSFTISYKKKIVTCPYESLFTFFFLCSPSSAPCSAIAYRAMTVIVPSTAVVVRAVAAAVTVIVIMPFVFYCCCFFLLLLFRENDFCKMYFKMSRSAPSSSWLTTVNEELEMILAILPKLTIEEHGEWCKMAKTMSKVVAPPYAILNTIYGEISMSFAVRWEDILGGL

SEQ ID NO: 207761 - protein, 77 aa, Glycine max
  Coding DNA Sequence Number=SeqID_90983
LPAGSTPKCGIWKDLKEGKKLISGLNTHPPLSAIEESGRASISRPHAKREISVLSAVVVFSQDQRTTSVKLKSTYLR

SEQ ID NO: 207762 - protein, 113 aa, Glycine max
  Coding DNA Sequence Number=SeqID_90984
  Homolog annotation: Hit_ID=Q1S1S0; Match level="QueryCoverage=49%, HitCoverage=13%, E-value=5e-08, Identity=53%"; Hit description=GAT; ENTH/VHS
  Subcellular localization annotation: CTP_CleavageSite=81; ConfidenceScore=5.22e-01
MIVGKYNCFPMVVIVCPLNANTKSKVVTLGLYFLQRAGVQFAQKDQVVQPNNPTSQPSRTTNVPNREQASPRHEAIAQPVESQAVPEFLLLIQNMKIGSLYTYRDQQESNYNS

SEQ ID NO: 207763 - protein, 157 aa, Glycine max
  Coding DNA Sequence Number=SeqID_90985
  Gene Ontology: Mol. function=catalytic activity; Cellular component =membrane fraction; Biological process=metabolic process
  Homolog annotation: Hit_ID=Q7W0U0; Match level="QueryCoverage=99%, HitCoverage=75%, E-value=1e-78, Identity=89%"; Hit description =Putative isochorismatase
MQFAGHAEPRHQLRAGLFHAAPGGVAGDFVEGARGIGHHEYVEAFLQRRQGGEGHAHFGHHAGDDELLLAGGLDRLDEVFVVPGIDVAGAGDVGRLGEFVLQLLHQGAVGAVLETGGQDGGQLEIGGQVGQRQHVVFELIGLKVAHQGQQAGLMVDQ

SEQ ID NO: 207764 - protein, 48 aa, Glycine max
  Coding DNA Sequence Number=SeqID_90986
MFLVFNNALKGLDDTPQPKSKVAARWIVIKYFNDARPLEPKRSILSLT

SEQ ID NO: 207765 - protein, 120 aa, Glycine max
  Coding DNA Sequence Number=SeqID_90987
MVMGDFISRLSFPACLHFSGENTETFSSLTSYPELRRSEFLIGGYVGARASLLSTTPPFVAMTQELVTRGDTLQLSAPRHSVTPSVIHEQRAMWSSVPFPEMSASSGADFFKSHKLSRTT

SEQ ID NO: 207766 - protein, 54 aa, Glycine max
  Coding DNA Sequence Number=SeqID_90988
MATARWALKHPVYGIVILRLGIYTNRPNVSKTTFLNEKLYTVPKFQQTLLTTTK

SEQ ID NO: 207767 - protein, 145 aa, Glycine max
  Coding DNA Sequence Number=SeqID_90989
MTDPLDESISCFLIKVDPWVLVPITFRGLYVLAIRGLHILACRGLHALAFRGLRVLIFIPGPPPDIGGRPTVQAHPEREAITHLLCIPGQDFTRAAAKRRVRIMRTNMTPLTWIWMTLLFSNTLPSDHNANLSLQMCQLVCAVMT

SEQ ID NO: 207768 - protein, 163 aa, Glycine max
  Coding DNA Sequence Number=SeqID_90990
MGDQEEVQEQMKADMSTLKEQMDTMMDAMLGMRQLMENNVATAAAVSSAVEADPTLPATAHHPIPNVVGQERSTLGYISIPHLGYNRVAYPYGLPPNYMPPVIHDDAGHVPPPILEGEPPRQSDEVHEDRREHAQGDIDSYSPVPVEGPAPNTLPQPNLTGEP

SEQ ID NO: 207769 - protein, 370 aa, Glycine max
  Coding DNA Sequence Number=SeqID_90991
  Gene Ontology: Mol. function=lactaldehyde dehydrogenase activity; Cellular component=integral to membrane; Biological process =metabolic process
  Homolog annotation: Hit_ID=Q6DAY4; Match level="QueryCoverage=53%, HitCoverage=41%, E-value=8e-76, Identity=70%"; Hit description =Aldehyde dehydrogenase A
  Pfam annotation: Domain name=Aldedh; Domain location=185-370; Score= -152.2; E_value=3.7e-09; Accession=PF00171.12; Description=Aldehyde dehydrogenase family
MALTQSCANHFPRRSLIRITWEKSSEPGIEMKSKRLTLVLSQAVSRVMLDDIRAIVPPEALNVFINGLDSCHYATLDCVQSEENCALLASAIVVWRQLGHYDENPPRANPARLTLRMHMKIGLLFPIAIIVAGVSFLVWFIASGAMMPGRQRSSASLFLHISLTKPSVEPLHMTLHHQHYINGAFVEAHNDSWIEVINPATETLLSRVPQGSKQQAAAAITAAEAAQPGWEALPAVARGDWLHRIATAIRQREPELSTTLVAEGGKTQALAQTEVLFTADYFDYMAEWARRYEGEIVNSDRPNENIFVFKKAIGVTTGILPWNFPFFLIARKAAPALITGNTIVLKPSEITPNNAALFAAIIDDLGLPPG

SEQ ID NO: 207770 - protein, 39 aa, Glycine max
  Coding DNA Sequence Number=SeqID_90992
  Gene Ontology: Mol. function=sequence-specific DNA binding; Cellular component=intracellular; Biological process=positive regulation of transcription, DNA-dependent
  Homolog annotation: Hit_ID=UPI00005FA6BD; Match level="QueryCoverage =100%, HitCoverage=14%, E-value=3e-13, Identity=76%"; Hit description= COG2207: AraC-type DNA-binding domain-containing proteins
MAIVIAHKTDAAGAERLRLTIKYVDARALFHQHDFMKIM

SEQ ID NO: 207771 - protein, 214 aa, Glycine max
  Coding DNA Sequence Number=SeqID_90993
  Gene Ontology: Mol. function=sequence-specific DNA binding; Cellular component=intracellular; Biological process=positive regulation of transcription, DNA-dependent
  Homolog annotation: Hit_ID=Q8ZIZ9; Match level="QueryCoverage=58%, HitCoverage=43%, E-value=2e-37, Identity=57%"; Hit description=HTH -type transcriptional activator rhaR
TFALQLADDAARQRHAARGQTPAGGCLFILWRQQLLPVECQTEAIAAVENIVERQIVDAIKAVAITVADVKHVAAGDQPRPIVEDMQAITAPDNHNLAELMPVRWERGLRHAFCHGNRQIAGREVILARYAATNRSDRPALPTQFPHCSAHSASPASGAGGHPGPAPDHCAPPRAAAPAAAKSAVPAAPDVPATSWPAASSASPAAAPAPSLYG

SEQ ID NO: 207772 - protein, 102 aa, Glycine max
  Coding DNA Sequence Number=SeqID_90994
MRGIVHEPQVNIGADQKFSPVDVFKQEKEKGGQTLGFQWIDQTSNDSIPVTPKRSITLTIERTTRPRLERTTCPHLQRAARPHLQRTTCPRLERATRPHLGY

SEQ ID NO: 207773 - protein, 61 aa, Glycine max
  Coding DNA Sequence Number=SeqID_90995
MDTVELYTRAMKGTMREPQANLGAGQKFSPIDVFKQKKGSDKPWDFSGLIKRLHRHHSKIV

SEQ ID NO: 207774 - protein, 148 aa, Glycine max
  Coding DNA Sequence Number=SeqID_90996
GKPVVPAALMNRPTRGERRFAYWALAECILAYYVGTDEGVSEVLHVAGEKRLHRSVSKICDTGYIPLPRSLTRYARSFDCGERKWLTNGAEISWKMPGRYLTGKAFSPPGGLPSSAPPVPGPFGFTRWSIPAVMARRLSHFPTPLNTS

SEQ ID NO: 207775 - protein, 126 aa, Glycine max
  Coding DNA Sequence Number=SeqID_90997
MRGYPIVTCTFRQPGANEPVDAQRLTSSLAPLVVLTREVRITLWLPAPFVNQGANEPVDAKRRTSSFAPFVIQGQRVRWFLLSLSGNIQAQRRARFFSAKQGRSSAMAKGNVVVVQLCRFQDTEVC

SEQ ID NO: 207776 - protein, 159 aa, Glycine max
  Coding DNA Sequence Number=SeqID_90998
  Subcellular localization annotation: CTP_CleavageSite=73; ConfidenceScore=5.12e-01
YAANIYNRPPQPQQQNQPQQNNYDLSSNRYNPGWRNHPNLRWSNPSQQQQQQQQTYFQNVVGPSRPYVPPPIQQQQQQQPQKQQTVEAPPQPSLEELITFSICPESQKCESKEKQHIPLPFPPRAISNKKMEEAEKEILETFRKVEELCTNKRKLKGSE

SEQ ID NO: 207777 - protein, 309 aa, Glycine max
  Coding DNA Sequence Number=SeqID_90999
  Gene Ontology: Mol. function=hydrolase activity, hydrolyzing O -glycosyl compounds; Cellular component=cytoplasm; Biological process= carbohydrate metabolic process
  Homolog annotation: Hit_ID=Q5I3L8; Match level="QueryCoverage=100%, HitCoverage=64%, E-value=1e-154, Identity=79%"; Hit description=Aec45
  Pfam annotation: Domain name=Glyco_hydro_32N; Domain location=1-294; Score=477.3; E_value=1.9e-140; Accession=PF00251.10; Description =Glycosyl hydrolases family 32 N termi
MNDPNGLVWFDGWYHAFYQHHPYSTQWGPMHWGHARSKDLVHWEHLPVALAPEGAEDKDGCFSGSAVVDGDTLALIYTGHKFHGDPDDEANLYQVQCLATSRDGIHFSREGMVVDTPPGLHHFRDPKVWREGESWYMVVGARDGETGQVRVYRSEDLHAWQDMGVLAVAEKEMGYMWECPDFFTLNGKRVLMFSPQGVVAEGYKNRNLFQSGYLLGEWQPGQPFVREGEFVEMDRGHDFYAPQSFLTPDGRRIVIGWLDMWESPLPEQEDGWAGMLSLPRELTLSADNRLQMRPAREVEGLRGEWFPWP

SEQ ID NO: 207778 - protein, 93 aa, Glycine max
  Coding DNA Sequence Number=SeqID_91000
  Gene Ontology: Mol. function=3-dehydroquinate synthase activity; Biological process=aromatic amino acid family biosynthetic process
  Homolog annotation: Hit_ID=Q64YD2; Match level="QueryCoverage=63%, HitCoverage=16%, E-value=2e-10, Identity=53%"; Hit description=3 -dehydroquinate synthase
KTLNFGHTIGHAIESSCLEQGNPVLHGEAVAAGMICEAHLSHLEKLISKEDSEMIIDHIKRSSTSSYRKEIAHLCFGLQFQSRKQGEIRCCHH

SEQ ID NO: 207779 - protein, 57 aa, Glycine max
  Coding DNA Sequence Number=SeqID_91001
MPHPIRALCLDVLQHKVPYINSPSHLLPPNTKFKIITGSKHKQHTGMKNHPGALKST

SEQ ID NO: 207780 - protein, 90 aa, Glycine max
  Coding DNA Sequence Number=SeqID_91002
MSEEVDMNEKNEDEDGVNEEHVDSSYAFNTSQVFATCDDVLHWARFVAYEIGFVTVIMRSDINSGIREMTSFVLIGCERSGVYRAKKKDL

SEQ ID NO: 207781 - protein, 59 aa, Glycine max
  Coding DNA Sequence Number=SeqID_91003
TNVVHHHLSKQFQEGPCRCWINFIHAFMIPFKTLLMSKLMVIMDKWMNISNMGYVIASR

SEQ ID NO: 207782 - protein, 393 aa, Glycine max
  Coding DNA Sequence Number=SeqID_91004
  Gene Ontology: Mol. function=siderophore-iron transporter activity; Cellular component=outer membrane; Biological process=siderophore transport
  Homolog annotation: Hit_ID=Q2XMH9; Match level="QueryCoverage=49%, HitCoverage=24%, E-value=2e-27, Identity=37%"; Hit description=TonB -dependent siderophore receptor
  Pfam annotation: Domain name=TonB_dep_Rec; Domain location=1-217; Score=9.7; E_value=0.039; Accession=PF00593.14; Description=TonB dependent receptor
ALTDNLTLYANYTTGQEPGNDLFFLSPTQTDLPLTRARQWEAGAKGQFWGNKGEATLALYELRKDNLFVPDAQRPDALNAVGRQTSRGIELGVVLRPDERWELAGNAAYTHARYDDYRGGSPLRSYNGNRPAYIPDWTANLSVHYQATERLGLASSLRYVGSSYNDDANRRKMRAYTTLDLAADYQLTPIVDVGSDGVKRRLALLLCALGLGGGAPLRADAVSLQNCGVTHDYPQPPQRVLVYANPALENLLALGLAARAIGVVGYDRARDPAPTDDALQAPTSPAPPTAEALLLMRPDFVYSASYYWLHSPETPDRALLAAWGIGTYLSPGACSGQQSAIAAALTFEDIFTELRELARIFNVSRAGEALVERLRGQLRALEPQRAQLPHLRL

SEQ ID NO: 207783 - protein, 116 aa, Glycine max
  Coding DNA Sequence Number=SeqID_91005
  Gene Ontology: Mol. function=RNA-directed DNA polymerase activity; Biological process=RNA-dependent DNA replication
MMDSQNIAIGGHYMEVFNNFIHEWEVEDIPMIGRRYTWYISSSRSKNRSFFDHCPIILKNATNDWGPKPFRTLDCWFLEHGFKEKVKELWNSYVIQGKCVFVLKEKIKLLKKDQRK

SEQ ID NO: 207784 - protein, 124 aa, Glycine max
  Coding DNA Sequence Number=SeqID_91006
  Gene Ontology: Mol. function=RNA-directed DNA polymerase activity; Biological process=RNA-dependent DNA replication
DVVRKVLSHNVRGLGRRLKQRAIRDCIVKEGINFACLQETKIEKMTRHVCSNIWGDDDFERRQSHTSNSAGGLLCIWNKEVMDVNTSFVGKGFLGVQGVLKEGNVPCFIFNIYAPCDFKEKIRL

SEQ ID NO: 207785 - protein, 78 aa, Glycine max
  Coding DNA Sequence Number=SeqID_91007
  Subcellular localization annotation: CTP_CleavageSite=35; ConfidenceScore=5.29e-01
MSPPPLEPHNYSQTHLTFSGRLPLQAPFSAGGLVGACMLSATLNCLGRISEFWLSARLHAQLMDSNSALSGWLTKPTD

SEQ ID NO: 207786 - protein, 2548 aa, Glycine max
  Coding DNA Sequence Number=SeqID_91008
  Gene Ontology: Mol. function=heat shock protein binding; Cellular component=integral to membrane; Biological process=protein folding
  Homolog annotation: Hit_ID=UPI000034EDA4; Match level="QueryCoverage =98%, HitCoverage=99%, E-value=0.0, Identity=67%"; Hit description =GRV2; heat shock protein binding / unfolded protein binding
  Pfam annotation: Domain name=DnaJ; Domain location=1510-1578; Score =38.4; E_value=2.5e-08; Accession=PF00226.21; Description=DnaJ domain
MENAANASAAVISGPPPLEEPEYLARYMVVKHSWRGRYKRILCISSVTVLTLDPSTLSVTNSYDVATDFEGASPVLGRDENSNEFNLSVRTDGRGKFKATKFSSRYRASILTELHRIRWNRLVPVAEFPVLHLRRRAAQWVPFKLKVTYVGVELLDTKSGDLRWCLDFRDMDSPAIILLSDAFGKTNVDHGSGFVLCPLYGRKSKAFQAASGCTISAIISNLAVGAEDTPMGGWSVTRLRSAAHGTLNVPGLSLGVGPKGGLGEHGDSVSRQLILTKVSLVERRPENYEAVTVRPLSSVSALVRFAEEPQMFAIEFSDGCPIHVYASTSRDSLLAAVRDALQTECPSACLTSSDVYLQGQCAIPVLPRLTMPGHRIDPPCGRVFLQYGQQKPVTDAESASMHLKHLAAAAKDAVAEGGSVPGSRAKLWRRIREFNACIPYGGVPTNVEVPEVTLMALITMLPAAPNLPPESPPLPPPSPKAAATVMGFIACLRRLLASRSAASHVMSFPAAVGRIMGLLRNGSEGVASEAAGLVAALIGGGPGDANVTDSKGEWHATIMHTKSVLFANHNYIIILVNRLKPTSVSPLLSMTVVEVLEAMICDPHGETTQYTVFVELLRQVAGLKRRLFALFGHPAESVRETVAMIMRSIAEEDAIAAESMRDASLRDGALLRHLLHAFFLPSGERREVSRQLVALWADSYQPALELLSRILPPGLVAYLHTRADGVLAEDTNQEESSIGKRKRRLLQHRKGRIGRGLTSQEQPFPSANNFDASDSARQTVGAIVRGSDSYHKTVMDPGSGQASNIQSSVVHTSENLNNGSSTGEVQNGHSTFVDSAIAVSTNSNEAPGSEFSNSVDPDSNAVGLQNAGIPAPAQVVVENTPVGSGRLLCNWPEFWRAFDLDHNRADLIWNERTRQELRESLQAEVHKLDVEKERTEDIVPGGATLDMVSGVESVPQISWNYPEFSVRYPSLSKEVCVGQYYLRLLLESGSGGRAQDFPLRDPVAFFRALYHRFLCDADTGLTVDGAVPDELGASDDWCDMGRLDGFGGGGGSSVRELCARAMAIVYEQHYMTIGPFEGTAHITVLLDRTDDSALRHRLLLLLKALMKVLSNVEACVLVGGCVLAVDLLTAVHETSERTSIPLQSNLIAASAFMEPLKEWLYIDKDGAQVGPMEKDAIRRLWSKKAIDWTTRFWASGMLDWKKLRDIRELRWALALRVPVLTPPQVGDTALSILHSMVSARSDLDDAGEIVTPTPRVKRILSSPRCLPHIAQAFLSGEPSIVEAAAALLKAIVTRNPKAMVRLYSTGAFYFALAYPGSNLLSIGQLFSVTHVHQAFHGGEEAAVSTSLPLAKRSVLGGLLPESLLYVLERSGPAAFAAAMVSDSDTPEIIWTHKMRAENLIRQVLQHLGDFPQKLSQHCHVLYDYAPMPPVTYPELRDEMWCHRYYLRNLCDDIRFPNWPIVEHVEFLQSLLVMWREELTRKPMDLSEEEACKILEVSFEDVSSDGVNKRNSLEVMDEASSLSKQIENIDEEKLKRQYRKLAMKYHPDKNPEGREKFLAIQKAYERLQGQCILYRRHGDVLEPFKYAGYPMLLSAVTVDKDDNNFLSSDRALLLVAASELVWLTCASSSLNGEELVRDGGVHLLATLLSRCMGVVQPTTPGNEPSAIIVTNIMRTFSVLSQFEAARAEILEFSGLVEDIVHCTEFELVPAAVNAALQTIANVSISSELQDALLKAVHQGKGTLTNSKFGQEYDSTAEESDATESHGVGASVQIAKNMHAIKASHALSRLSGLCGDESATPYNQAAADAVRVLLTPKLSSMLKDQMSKDLLSKLNANLESPEIIWNSSTRAELLKFVDQQRAAQGPDGSYDIKDSHDFVYKALSRELFIGNVYLRVYNDQPDFEISEPETFCLALIDFISYLVHNQCVEDAGHKVEGTSSFFETFEHTSEAVDGSVNEQQVLENSGTMSEEQSLGKEELELIKNLRSALTSLQNLLTNNPNLASIFSNKDKLLPLFECFSVPEASLSNIPQLCLGVLSLLTAHAPCLQAMVADGSSLLLLLQMLHSSPSCREGSLHVLYALASTPELAWAAAKHGGVVYILELLLPLKGRRLQRAMAASLLGKLVSQPMHGPRVSITLARFLPDGLVSVIRDGPGEAVVVALEQTTETPELVWTPAMATSLSAQISTMASELYREQMKGRVVDWDVPEQASGQQEMRDEPQVGGIYVRLFLKDPKFPLRNPKRFLEGLLDQYLSSIAATHYEVQVIDPELPLLLSAALVSLLRVHPALADHVGYLGYVPKLVAAVAFEGRRETMSSGEVNNGRHAEQTYDPDKESAENTQTPQERVRLSCLRVLHQLAASTTCAEAMAATSVGTPQVVPLLMKAIGWQGGSILALETLKRVVVAGNRARDALVAQGLKVGLVEVLLGLLDWRAGGRNGFCSQMKWNESEASIGRVLAIEVLHAFATEGAHCTKVRELLNNSDVWSAYKDQKHDLFLPSNAQSAAAGIAGLIENSSSSRLIYALTAPPQSTTSRTPPSSSPDFNGKQDQPL

SEQ ID NO: 207787 - protein, 106 aa, Glycine max
  Coding DNA Sequence Number=SeqID_91009
MRSGSRIRPGGDTRGCGHVAHCGSGGRTRVPAAATMEVSIGVSMRKGGVRVAGIGKRKIESEQAVARWSERNSEREGRSGRRGRNRRGPNAPSDADQNDVAVSYSR

SEQ ID NO: 207788 - protein, 704 aa, Glycine max
  Coding DNA Sequence Number=SeqID_91010
  Homolog annotation: Hit_ID=Q2QYH0; Match level="QueryCoverage=98%, HitCoverage=98%, E-value=1e-115, Identity=38%"; Hit description =Expressed protein
  Pfam annotation: Domain name=DUF936; Domain location=1-700; Score =697.0; E_value=1.3e-206; Accession=PF06075.3; Description=Plant protein of unknown function (DUF936)
  Pfam annotation: Domain name=Rep-A_N; Domain location=3-107; Score= -24.1; E_value=0.025; Accession=PF04057.3; Description=Replication factor-A protein 1, N-terminal domain
  Pfam module annotation: Pfam domain module=DUF936::Rep-A_N; Domain location=1-700::3-107
MASLTPGILLKMLQAMNTNTRVTGDHRSPLLQVIGIVPALAGSDLWSNQGFYLNLSDSLNSTYVLLSHPDTDLILSNRLQLGQFVHVDRFHFDSPLPSVSNLRPLAGRHPFLGTPEPLITRISPSSRHFLIQPLSDSELDPLSHLSLNNNNNKSPIPNPNPNPNPEEPKQHHNHKDSTKERIISRDPLAPRDNNLPPQRFSSPATAKRSQSAGRNKSVITTAAERDPSPAGKGKRSASPVPSKCVVPSLVSAREENRKVSKEPAIIVPSRYRQPSPTGRKQPSPSPRRTSLSPGRRLSGGLKVSPLVVDSSGKKKMATIVAGISKVSDALVGSKSARKNWDEQPPATPVEAGGSKSKVDAQAILRTQAAMSRRLSDVSGKKPGSNDSSSNEKTKAGSPQSCVLEEKSNFAATGFTIHEKKWTDGSVPLDAVSGNLARLGKEAMQRKILASTAAAEALEEANATECIIRNLSMFSDLCSVCQARNPLPTIDRFFTIYDDVLKSTATVESVASRHNSETPDESIPTEHSKSLSLWVDAALATDLQIVSLLTGTTTDPPSTLQKSLSKRHSLGAAKNQKVPSSPQSSLSIGVWTRGSGMKETVELGANLLSEMQMWFLHFVEESLDAGFKVFGECTADGKKALPLDGGSIAVVLSHLKRVNAWLDRVVSKGDDSLTEKIEKLKRKIYGFVIQHVGTTFDSSVSSASS

SEQ ID NO: 207789 - protein, 231 aa, Glycine max
  Coding DNA Sequence Number=SeqID_91011
  Gene Ontology: Mol. function=thymidylate synthase activity; Biological process=dTMP biosynthetic process
  Homolog annotation: Hit_ID=Q1YFG6; Match level="QueryCoverage=50%, HitCoverage=34%, E-value=8e-21, Identity=44%"; Hit description =Possible thymidylate synthase
MRSNDAFKGLPHDIFAFTMFQEFIARVLNCELGKYYHYVSSMHLYEVDLDKVSDLQSEGFMSTRAIMEEMPLVTSLNYRYQLLEVERNLRENKLFDIDSEKMDDYWKDLMRIIKIHYLFRAKDEPSILEAKNEIDKLEIEMRRHEHVSSLVEDLKKFHKDEYPLNGLSSEECYITFAMQLTDSIRRIRYVEITSNPDRDINPLRSEPNSDYFEPLLSASLYHRAGNYDEAC

SEQ ID NO: 207790 - protein, 492 aa, Glycine max
  Coding DNA Sequence Number=SeqID_91012
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LK11; Match level="QueryCoverage=94%, HitCoverage=92%, E-value=1e-178, Identity=64%"; Hit description=Beta- 1,3-glucanase-like protein
  Pfam annotation: Domain name=Glyco_hydro_17; Domain location=29-355; Score=258.9; E_value=1e-74; Accession=PF00332.9; Description =Glycosyl hydrolases family 17
  Pfam annotation: Domain name=X8; Domain location=376-459; Score =139.0; E_value=1.3e-38; Accession=PF07983.3; Description=X8 domain
  Pfam module annotation: Pfam domain module=Glyco_hydro_17::X8; Domain location=29-355::376-459
MEQEKALCVRYLAAFLLVFFTMASCGSGVGVNWGTMATHKLPPNKVVKMLQENRIDKLKLFDAEEWIMAALMGTDIEVMLAIPNNMLEEMSRNPQVADSWVYENVTGYMYPGGLNIKLSSPMYIAVGNEPFLKEYNGAYLQSTLPALKNIQTALNSWGFGSQIKVTVPFNADVYYSPDSNQVPSAGDFRPEVRDQTIEIVQFLYANNAPFTVNIYPFLSLYGNDHFPFDFAFFDGSNRPLIDGNSAYTNVFDANLDTLLWALEKSGYPDIEVIVGEVGWPTDGDKNANVQNAKRFNMGLLKHALSGNGTPKRKGIIDIYLFSLVDENAKSIAPGNFERHWGIFEFDGKPKYELDLRGLEENNGLVPVEGIRYMEKQWCILDSNVKDLHNLAESIDYACSKSDCTALGYGSSCNSLSLQGNASYAFNMYYQVNNQKDWDCDFSGLATVTDEDPSEKGCQFPIMISYGSSLLQQERLTNILKKALGIYIFVILL

SEQ ID NO: 207791 - protein, 451 aa, Glycine max
  Coding DNA Sequence Number=SeqID_91013
  Gene Ontology: Biological process=viral procapsid maturation
  Homolog annotation: Hit_ID=Q66BK7; Match level="QueryCoverage=68%, HitCoverage=99%, E-value=1e-142, Identity=75%"; Hit description =Capsid portal protein [Enterobacteria phage 186] gb|AAC
  Pfam annotation: Domain name=Phage_portal; Domain location=184-447; Score=213.1; E_value=6.2e-61; Accession=PF04860.3; Description=Phage portal protein
MVAGGKFRVLERHQWQGMNFAAQAQKIKGLTEKYCVEYIGIDATTVGQGVFQLVREFFPAAREIKYTPEIKTAMVLKAKDTIGRGCLEYDTSHTDITAAFMAIRKTMTASGARSTYTASRSEEASHADVAQRPQQPEHFGVLLMSKRKGRKAFTPPAPAPAAEQKQDFEAFTFGEPSAVLDKREILDYIECTTNGKWYEPPISFDGLARSVRAAVHHSSPMYVKRNILASTFIPHRLLSQQEFSRYALDYLVFGNAYLEERQNRLGAPLQLKSSPAKYTRRGVERGAYCALNSAWLNEAATLFRRKYYQNGAHAGYILYMTDAAQSTSDVDRMRQAMRDTKGLGNFRNLFMYAPNGKPDGIKILPLSEVATKDDFFNIKNASRDDLLSAHRVPPQMMGIIPNNTGGFGDVKKAAQVFVRNELTPLQERMKEVNDWIGEEVIRFAPYELPTE

SEQ ID NO: 207792 - protein, 402 aa, Glycine max
  Coding DNA Sequence Number=SeqID_91014
  Homolog annotation: Hit_ID=P36933; Match level="QueryCoverage=34%, HitCoverage=89%, E-value=7e-33, Identity=50%"; Hit description=Tail completion protein R
  Pfam annotation: Domain name=P2_Phage_GpR; Domain location=158-286; Score=191.1; E_value=2.6e-54; Accession=PF06891.2; Description=P2 phage tail completion protein R (Gp
  Pfam annotation: Domain name=Phage_tail_S; Domain location=291-402; Score=28.7; E_value=1.4e-07; Accession=PF05069.3; Description=Phage virion morphogenesis family
  Pfam module annotation: Pfam domain module=P2_Phage_GpR::Phage_tail _S; Domain location=158-286::291-402
LAQRLPAVTALGVRQRRQIAGAGTASGGGAGPLPDRGRAMSRAIGWFLVLALVVAGWMKWQVVTLGDRPESARQENGRIAAALTDTRAAIDTLQAAAGYSMKISNYAIGLTLLCLLTLPGCTSAPASPAPRIIYVGCPKVSPCQIPASRPATNGDLSADIRQLENALAACAVQRNPENLQVRVERGNVAATLATSLSHEYRYTLNLLFLDYTGDLDLIMVPIQAWLRENQPDIMATEEKRRTGITFASDFNNNGSYDFSVSLQLTERVLVKEQGDGALHVEHLPEPPLPEDVTRPMQLFVHGELSRKSLAVAVSKRLRAGQQQHIKRQQAPDGTPYAPRKTRLRNKKRLRDRAMFSKLRTARYLKAQGNSDAAVVEFVGRVKRMVNVHHYGLRDRPTPHSEA

SEQ ID NO: 207793 - protein, 484 aa, Glycine max
  Coding DNA Sequence Number=SeqID_91015
  Gene Ontology: Mol. function=zinc ion binding; Cellular component =intracellular; Biological process=chromatin silencing at silent mating-type cassette
  Homolog annotation: Hit_ID=Q0Z9W1; Match level="QueryCoverage=69%, HitCoverage=84%, E-value=1e-119, Identity=62%"; Hit description =Histone deacetylase HDAC4
  Pfam annotation: Domain name=Hist_deacetyl; Domain location=36-339; Score=333.8; E_value=2.8e-97; Accession=PF00850.10; Description =Histone deacetylase family
MVYNTPCNSFSTVHCNLETLWCTLYMQQNDCSVALYWGLLYFGNILVEKKSTLHPERPDRLQAIAASLARAGIFPGKCYSIPAREITPEELITVHSLEHIESVEVTSESLSSYFTSDTYANEHSALAARLAAGLCADLASAIVSERAKNGFALVRPPGHHAGVRHAMGFCLHNNAAVAALAAQAAGARKDVHHGNGTQEIFEQNKSVLYISLHRHEGGKFYPGTGAAEEVGSMGAEGYCVNIPWSRGGVGDNDYIFSFQHVVLPIAAEFNPDFTIVSAGFDAARGDPLGCCDITPSGYAHMTHMLNALSGGKLLVILEGGYNLRSISSSATAVIKVLLGESPGCELENSFPSKAGLQTVLEVLKIQMNFWPALGPIFVTLESQWRVYCFGKKRKHIKKRHRILVPMWRWGRNWSGAVATWYNLGDNGSASCGLSLSGFPVQGSLYEPEDGDGMEVMANIDIDIAVDIKPPIPPSLLYKTQISCA

SEQ ID NO: 207794 - protein, 409 aa, Glycine max
  Coding DNA Sequence Number=SeqID_91016
  Gene Ontology: Mol. function=O-sialoglycoprotein endopeptidase activity; Cellular component=nucleus; Biological process=proteolysis
  Homolog annotation: Hit_ID=Q6K200; Match level="QueryCoverage=85%, HitCoverage=83%, E-value=2e-86, Identity=46%"; Hit description =Putative met-10+ protein
  Pfam annotation: Domain name=Met_10; Domain location=138-299; Score =136.9; E_value=5.6e-38; Accession=PF02475.7; Description=Met-10+ like-protein
MSPPPPPPSLSSDSVQFNSMLDESKFEVHLKLWALRIPCQHCKLATRILNGYLLDKPRVKPIAEDPTCDKNRYLILSDNVHNQDLSDIPKQKLDELKGLCEIEIVPYSLTLGSCAEADTAYWSGEEEFGLCSAVTTLSTWQGVWQNEKNYPRIKTIVNKVGTITNEFRVPEFEILAGEHNMITEVKQYGATFRLDYRLVYWNSRLEHEHKRLVSMFQAGQTICDMFTGIGPFAIPAAQKGCIVYANDLNPDSIHYLRINAKINKVDDRIYAYNMDARKFISQMMEVPNNEVTLETSHEVPILDTRDNAESNSENELLTGNLFLVNNCKYLNYDMRKCSLVINTNIPAVVDTKDLGDSNNSGLEDVKGSTRHTATSVIAGKRSSTSYHEGILQTATSHQAVTRCSCYLIF

SEQ ID NO: 207795 - protein, 202 aa, Glycine max
  Coding DNA Sequence Number=SeqID_91017
  Gene Ontology: Mol. function=metal ion binding
  Homolog annotation: Hit_ID=UPI00001632AD; Match level="QueryCoverage =99%, HitCoverage=57%, E-value=5e-46, Identity=44%"; Hit description =protein binding / ubiquitin-protein ligase/ zinc ion binding
WSNPVIHRNSREASSSSSTTITYLDWNSGLVVSTDENQHQGRMCSLQDIGGHFMKVPIIVFQVLLCMHLEGTPACAVHIPLPVIFSPLFLLQGAGVMLSASKLGEKLVLLLRSGAGGGIYFRFSSRAHDCLGFLHHGSRRKCYAEFVSRERLTLYCSHVGIVFFAALVLCLISMYCSTCSEKCKKCPICRDSIAERLPVYDV

SEQ ID NO: 207796 - protein, 629 aa, Glycine max
  Coding DNA Sequence Number=SeqID_91018
  Gene Ontology: Mol. function=protein binding
  Homolog annotation: Hit_ID=Q10NT2; Match level="QueryCoverage=92%, HitCoverage=86%, E-value=0.0, Identity=57%"; Hit description =Expressed protein
  Pfam annotation: Domain name=DENN; Domain location=153-336; Score= -77.8; E_value=0.018; Accession=PF02141.11; Description=DENN (AEX-3) domain
  Pfam annotation: Domain name=DUF1630; Domain location=14-625; Score =941.3; E_value=4e-280; Accession=PF07792.3; Description=Protein of unknown function (DUF1630)
  Pfam module annotation: Pfam domain module=DENN::DUF1630; Domain location=153-336::14-625
MSQSPSFKVKEELSPSLDPESLQRWIVALCAIRFDLEQGQLVEVCYPPGCLTHDEELEIAYSSFPDSISQQQNRSTIHDCIFFFRFRRHLKCQTSNATHSKITEVDKEFSLKSIDKNSVSKRLSSTSSGNVSKYMYGFVFNRQRHDERLKRGGEQKSVVILSHSPYSSVFRPLLQIVGPLYFDIGKIALEHIAAYVSTWPAPVPGKLMDLPIGNTMLKVNLPPAHSLPMENGVSLDESAAPVAPFLPNNQYIPQGLFHDSDLFGAFRGLLLQLWLLWELLLVGEPILIIAPTPPQCCEAVASLVSLVAPLLCSVDFRPYFTIHDPEFACLNSIREGETFPPMVLGVTNIFFLKALRKIPHIVSVGSPPPSSNRVPLSTRSSTGKVSNRPESLGLQQLSLQKFSPSSLLNAIKLRREGPLCLMTQHKEAIWTTYSATTKPDTSILNRLIDAGMSPRVEESMSVVNNEILRRHFLELTINFLAPFGLYFRTTAPLEGSSPYVDPPSLPPFNADEFLASLSARGPGKFILKRMKSNWLDFYRRFLNGPNFMPWFQRRHAVAEQEQDRLWRHARMKTDIQHLISKMSELEVVDSFCVIERLLLRELLSSRRMLACVTHPVMGGGQCVNKEQLA

SEQ ID NO: 207797 - protein, 126 aa, Glycine max
  Coding DNA Sequence Number=SeqID_91019
  Gene Ontology: Mol. function=metal ion binding
  Homolog annotation: Hit_ID=UPI00001632AD; Match level="QueryCoverage =91%, HitCoverage=24%, E-value=7e-46, Identity=72%"; Hit description =protein binding / ubiquitin-protein ligase/ zinc ion binding
  Subcellular localization annotation: CTP_CleavageSite=19; ConfidenceScore=5.14e-01
MYGKVWVIFSPLWMFHGVVARGRFSLPAPSAPRNRNWAPCHAVIATPLLIAFELLLCIYLESLYDLGYAAVDLKIVFLPLLTFEIIILIDNFRMCKALMPGDEENMSDEAIWETLPVSYFWHYKIA

SEQ ID NO: 207798 - protein, 60 aa, Glycine max
  Coding DNA Sequence Number=SeqID_91020
MSIGFDHEILQFQLGLAHHWAKRSFTTLSATEESGSASISRLCTKCEGGAKRNVADSEPI

SEQ ID NO: 207799 - protein, 45 aa, Glycine max
  Coding DNA Sequence Number=SeqID_91021
MAPKKLSAKKSRRDTAAEGTSAAPKFDSHRFRSTEHQQRFEAIKG

SEQ ID NO: 207800 - protein, 220 aa, Glycine max
  Coding DNA Sequence Number=SeqID_91022
  Gene Ontology: Mol. function=helicase activity; Biological process =proteolysis
  Homolog annotation: Hit_ID=Q9LTU4; Match level="QueryCoverage=89%, HitCoverage=14%, E-value=4e-47, Identity=48%"; Hit description =Helicase-like protein
MPNTAEVVALIIGDEHIDCNQGTMKLKQYYIQGDCFNNGLLMASELRVDKYMNLSAYNNDPETLGNQKGMRVILPSSFVSGKRYMEQLYFDGMTICGHIGFPDLFLTLTCNPTWQKIQRKVRKSNLTPHDCPDVVSRVFKMKLNQLMNDLKRGHVFGAILGFVYTIEWKKRGLPHAYILIFLQPSNKYPNPKDIDNLISEEIPIKDTYPELYVLDQVASK

SEQ ID NO: 207801 - protein, 119 aa, Glycine max
  Coding DNA Sequence Number=SeqID_91023
  Gene Ontology: Mol. function=mismatched DNA binding; Cellular component=MutSalpha complex; Biological process=mismatch repair
  Homolog annotation: Hit_ID=Q6DQL7; Match level="QueryCoverage=92%, HitCoverage=11%, E-value=6e-48, Identity=89%"; Hit description=DNA mismatch repair protein
  Pfam annotation: Domain name=MutS_V; Domain location=1-119; Score =23.9; E_value=1.1e-16; Accession=PF00488.12; Description=MutS domain V
MIKIVKVAVRLRGVSTFMQEMLETASILKGATDKSLIIIDELGRGTSTYDGFGLAWAICEHIVEVIKAPTLFATHFHELTALALENVSNDSQKQIVGVANYHVSAHIDSSTRKLTMLYK

SEQ ID NO: 207802 - protein, 592 aa, Glycine max
  Coding DNA Sequence Number=SeqID_91024
  Gene Ontology: Mol. function=mismatched DNA binding; Cellular component=MutSalpha complex; Biological process=mismatch repair
  Homolog annotation: Hit_ID=Q6DQL7; Match level="QueryCoverage=100%, HitCoverage=62%, E-value=0.0, Identity=78%"; Hit description=DNA mismatch repair protein
  Pfam annotation: Domain name=MutS_II; Domain location=56-198; Score =61.4; E_value=3e-15; Accession=PF05188.8; Description=MutS domain II
  Pfam annotation: Domain name=MutS_III; Domain location=205-525; Score= 277.0; E_value=3.8e-80; Accession=PF05192.9; Description=MutS domain III
  Pfam annotation: Domain name=MutS_IV; Domain location=382-480; Score =97.9; E_value=3e-26; Accession=PF05190.8; Description=MutS family domain IV
  Pfam annotation: Domain name=MutS_V; Domain location=530-592; Score= -134.6; E_value=3e-05; Accession=PF00488.12; Description=MutS domain V
  Pfam module annotation: Pfam domain module=MutS_II::MutS_III::MutS _IV::MutS_V; Domain location=56-198::205-525::382-480::530-592
MFETIARDLLLERTDHTLELYEGSGSNWRLVKSGTPGNIGSFEDVLFANSEMQDSPVVVALSLNYRENGCTIGLGFVDLTKRVLGMAEFLDDSHFTNVESAFVALGCKECILPIESGKSTENRMLCDVLTKCGVMLTEKKKSEFKTRDLVQDLGRLVKGPIEPVRDLVSGFEFAPGALGALLSYAELLADESNYENYTLRSYNLDSYMRLDSAAMRALNVLESKTDANKNFSLFGLMNRTCTAGMGKRLLHVWLKQPLVDVKEINSRLDIVQAFVEDTALRQDLRQHLKRISDIERLMHNIQKRRAGLQHIVKLYQSSIRLPYIKSALERYDGQFSTMMRSRYLEPIELWTDDEHLNKFIGLVEASVDLDQLENREYMISPSYDSILANLKDQQELLESQIQNLHRQTADDLDLPMDKALKLDKGTQFGHVFRITKKEEPKIRKKLNTQFIILETRKDGVKFTNTKLKKLGDQYQQILEEYKSCQKKLVDRVVQTAATFSEVFESLAEIISELDVLLSFADLASSCPTPYTRPDITSSDEGDITLEGCRHPCVEAQDWVNFIPNDCKLVRGKTWFQIITGPNMGGKSTFIRQ

SEQ ID NO: 207803 - protein, 130 aa, Glycine max
  Coding DNA Sequence Number=SeqID_91025
  Subcellular localization annotation: CTP_CleavageSite=52; ConfidenceScore=5.28e-01
AKRARARLTDLPSTSVAPTPTSTSATPLVPRVAWPGAQPSLHREDEGEEQVRPETATTPERSLEGTSEPPAPVVDLSSPQPVADPSTPVVDTPEDQTTLVLTLNTSPPATSILHLTDEEDVRTQDTQDLP

SEQ ID NO: 207804 - protein, 285 aa, Glycine max
  Coding DNA Sequence Number=SeqID_91026
  Gene Ontology: Mol. function=phosphatidate cytidylyltransferase activity; Cellular component=integral to membrane; Biological process=phospholipid biosynthetic process
  Homolog annotation: Hit_ID=Q5QMR4; Match level="QueryCoverage=85%, HitCoverage=83%, E-value=7e-84, Identity=62%"; Hit description =Integral membrane protein-like
  Pfam annotation: Domain name=DUF92; Domain location=1-253; Score =44.3; E_value=9.7e-11; Accession=PF01940.7; Description=Integral membrane protein DUF92
  Subcellular localization annotation: CTP_CleavageSite=44; ConfidenceScore=5.33e-01
MAISNSMDFLQLFIAVFIAFSIAFRAHRKKSLSTSGAIAGFFVMALHIFVGYRFGAMLLAFFYSSSTLTKVGEDIKRIVDPEFKEGGQRNWIQVLANSGIASVLVVAIWVLTEGKDKCLNSEESPLITALIGAVIGHYSCCNGDTWSSELGILSDEKPRLITNFKFVKKGTNGGVTKRGLLAAAAAGSVIGLSFVLLGISATRCEGKGSTVLKQLLVIPIATLAGLCGSVIDSLLGATLQFTGFCSIRGKMVGKPGPTVRRISGANILDNNAGLCSQKDPEFETL

SEQ ID NO: 207805 - protein, 338 aa, Glycine max
  Coding DNA Sequence Number=SeqID_91027
MLVERKVEIYQTELDEFKAELERRNFHKRLTNLADNSINLALVKEFYANLYSPEGPSPKQVKIRGHLIKIDANNLNTFLETPVVLAEGESLPTYSRYCRMPTDIREIEAALCIPGRGFVLNVEGHPGKILKKDLTTLAQVWSVLSYSNLAPTSHTLDLTLDRARLIFGLVSQLDMNVGALISGQITSMAQSNSCRLGFPALITALCRSRGVASDSLVFKCLSPVINLAYIRKNCWNPADLTVTIRGARRARARPAKAPSTSAAPPPARTLATPSTPSFVDFQHLEAMLRSIHQGQIVLLQILQLVAPSDSIPSAEQFNEWVVWPGTHPLLHRDSASPL

SEQ ID NO: 207806 - protein, 68 aa, Glycine max
  Coding DNA Sequence Number=SeqID_91028
MNAKRREDMTCVLPKRRILMRHGVARKPGHNRVYHHTRPQHSTVQDMAQALRANEHLHRVIDSDAARV

SEQ ID NO: 207807 - protein, 824 aa, Glycine max
  Coding DNA Sequence Number=SeqID_91029
  Gene Ontology: Mol. function=translation elongation factor activity; Biological process=transcription
  Homolog annotation: Hit_ID=Q1RY74; Match level="QueryCoverage=91%, HitCoverage=57%, E-value=0.0, Identity=68%"; Hit description=Bromo adjacent region; Transcription elongation factor S-II, central region
MQHYVKWNWVCLSMFLDSSMGQELELDLDDKSSVGLSPNTVLPPHQYCVNVKKRSKKGKPTGKDDSFTLKEGFAEIKFARFRSSSCKSHLSRPHGLEGNIETRRSSMYQSSEEVKSINKMGTMVEGRKKIEISRRSDTSFAGSIVDSLCGSDDEASGLRSSEITRSRTCKVPDSPNSFIEICINSDVKKKKNSTTVQGRDSINLKPRSDKVSDSVINGNCRVEKDTVHSLLKSLSAKARVSHVPSPLGSDCSSRVSPKVQVTHCRKRLNHFTKSKSLRSPVSKILENSEIKSNETANIARHRTYQKSLLNDLSNTRKHSDIISEFISREIQYSGIGSSPVHLHGNLKLENKNGVPFFEFKVKCPKDVFVAKTWRTGNAFNWVYTFHSIDNRKKSNVNGLGSHDFDKDPSIVAQMLVSCNLCSELEDKEFDNSMVTEFVLYDFTQSRQSVSCEKKSLSELDGSKTPKAFHVGSKEETLGLHENRAVKNKLQDKPLSSNVEFDDLNFYPYLSTECYSNLENAVIVLQIPFSKRESLKYKRGDRISAKEYSNRSDLSAVKDRKSLHRHQIQEQVKVVIPTGNHGLPNAESHGPSSLLDRLRHGGGCDCGGWDMACPLILLGNPTIQFAEDCPLMEEHQPLELFVQMYAALSPSPGAKGSSPTFSMTRIEEGHYAVDFHAQLSTLQTFSICVAILHGTSAFSSASHEKNQQLSQCSSLKMLLEEDVDFFFKSVTTEKKTVCKNQKGIPRSYVLNPPFSPIARGVWLDVVDVVSDVSTVIPNTRLVSYLYTTFMPLLVGEVWSWRWPVKIGNKCVEDLSEGGDCNFAST

SEQ ID NO: 207808 - protein, 539 aa, Glycine max
  Coding DNA Sequence Number=SeqID_91030
  Gene Ontology: Mol. function=translation elongation factor activity; Biological process=transcription
  Homolog annotation: Hit_ID=Q1RY74; Match level="QueryCoverage=73%, HitCoverage=29%, E-value=1e-151, Identity=66%"; Hit description =Bromo adjacent region; Transcription elongation factor S-II, central region
  Pfam annotation: Domain name=BAH; Domain location=119-254; Score =65.8; E_value=1.4e-16; Accession=PF01426.8; Description=BAH domain
  Pfam annotation: Domain name=TFIIS_M; Domain location=403-495; Score=- 21.2; E_value=0.049; Accession=PF07500.4; Description=Transcription factor S-II (TFIIS), ce
  Pfam module annotation: Pfam domain module=BAH::TFIIS_M; Domain location=119-254::403-495
MGNRRFTQVATSEDEDEAPPPPPPPKQQSSVSAPEENRSKQQQRKRKRMKLQEEEEEEEEKEEEKKKKKRKIKDKQEERSNEEEEPPQEDAKPIGEPVRLSGKGRGRKKHYESFEYDGNQYMLEDPILLTPEDKDQKPYVAIIKRMLLSSLSCIDVILGLDITQSLNGSMMVTGQWFYRPEEAERKGGGSWQSRDTRELFYSFHRDDVPAESVMHKCVVHFVPIHKQLPNRKQHPGFIVQKVYDTVERKLWKLTDKDYEDNKQQEIDELVQKTLKRLGELLDIEPEEPVADQEDLMKNKRILRKKSISPLDVSKEEETTRKGDQPLKPETPWSCINNASEHYRILVDFNVLTGDTHRDKCLEKLLQSVEFMFNSDDSIKREEKGNDNSDATNNGSNNKSLESVNECKDKVQKSSKPFVWPDDAVPAVVALEKASHDTLSSDYQKYNQKLRQLVFNLKNNAILARRLLNGELEPSKILNMTPNELKVDLGLYGVTSASTLRSDTNTFWWTLVKTKVRRTVTEESVTTRRWIVEVEEEPDG

SEQ ID NO: 207809 - protein, 641 aa, Glycine max
  Coding DNA Sequence Number=SeqID_91031
  Gene Ontology: Mol. function=binding; Cellular component=integral to membrane; Biological process=transport
  Homolog annotation: Hit_ID=Q6ESH9; Match level="QueryCoverage=96%, HitCoverage=97%, E-value=3e-87, Identity=35%"; Hit description =Mitochondrial substrate carrier protein-like
  Pfam annotation: Domain name=Mito_carr; Domain location=362-446; Score=62.5; E_value=1.4e-15; Accession=PF00153.17; Description =Mitochondrial carrier protein
  Pfam annotation: Domain name=Mito_carr; Domain location=452-529; Score=21.3; E_value=3.9e-05; Accession=PF00153.17; Description =Mitochondrial carrier protein
  Pfam annotation: Domain name=Mito_carr; Domain location=532-624; Score=121.2; E_value=2.9e-33; Accession=PF00153.17; Description =Mitochondrial carrier protein
  Pfam module annotation: Pfam domain module=Mito_carr::Mito_carr::Mito_ carr; Domain location=362-446::452-529::532-624
MSGCKKSPKNDQQSIKYWRIQHGGASSEADLSCVDYSQSLSTNENKQCHGSSQPKSPQILSTAQLISAIGQIWDSASRPLSVLLPKDNVNQDDKGFQKEKILDSVDEKKNDLVYASSDIKYYPVTKGGGAKIVQGKLDFPKVMQKISVLDSSNDSQDYIHSLFQRCLQASDKNTNQDWKEMELRREEMSCISGNVFWWVGRNITKALNCQVNATRPENLETNAPVAGGNISVDTSTPTLANESDVCSPNSITHETQSLSNAAILNSRIVSPLCSDYFLQAVPDTKADAGACQILYSSICADYHIYSLASYNSASDQCQHEIDDNESQEIQRKHFLDITDDKPKVQIAATHLKPCNSQAKQEHAFSGALAGVCVSLCLHPVDTIKTVIQACRAEHRSIFYIGKSIVSDRGLLGLYRGITTNIACSAPISAVYTFSYESVKAALLPHLPKEYCSFAHCVGGGCASIATSFIFTPSERIKQQMQVGSHYRNCWYATVFGIISWRAVLFRNVPHSIIKFYTYESLKQVMPSSIQPNSFKTVVCGGLAGSTAALFTTPFDVIKTRLQTQIPGSANQYDSVLHALYKISKSEGLKGLYRGLIPRLIMYMSQGSLFFASYEFFKRTFSLEAPYPTDLCIQDNDGNAEE

SEQ ID NO: 207810 - protein, 44 aa, Glycine max
  Coding DNA Sequence Number=SeqID_91032
NKVADAIANRGIGTEEEFLLYEQQPDFLDLLLLRMFWDFNLPEL

SEQ ID NO: 207811 - protein, 361 aa, Glycine max
  Coding DNA Sequence Number=SeqID_91033
  Gene Ontology: Mol. function=3-dehydroquinate dehydratase activity; Cellular component=integral to membrane; Biological process=aromatic amino acid family biosynthetic process
  Homolog annotation: Hit_ID=Q2XPY5; Match level="QueryCoverage=92%, HitCoverage=51%, E-value=1e-127, Identity=61%"; Hit description=YSL transporter 1
  Pfam annotation: Domain name=OPT; Domain location=1-361; Score=75.4; E_value=1.8e-19; Accession=PF03169.6; Description=OPT oligopeptide transporter protein
  Subcellular localization annotation: CTP_CleavageSite=47; ConfidenceScore=5.04e-01
MFGFLFFVSFVGLFPIVPLRKVMILKYKLSYPSGTATALLINSLHTKRSKASKWFFTAGDDCGFITFPTFGLQAYSKRFYFDFSSTYVGVGMICPYLINASLLLGAIFSWGILWPLIEHKKGIWYSADLPSGSLSGIQGYRVFIAIAMMLGDGLYHWIIMLIRVAYSLTTQYLKKRGSSTVDPEDADQNSSEGFDAQRCTEYFLKDEIPSWVAIIGYSVLAVISIITVSRIFPQQKWYHVLITYLIAPILAFCNAYGCGLTDGSLASNYGKLAIIIFSSWVGLEHGGIIAGLASCGVMMGIVSTASDLMQDFKTGYLTLGSPRSMFVSQVLGTATGCLVSPLMFWFFHKAYTLGDPNIVLN

SEQ ID NO: 207812 - protein, 90 aa, Glycine max
  Coding DNA Sequence Number=SeqID_91034
  Gene Ontology: Mol. function=nucleotidyltransferase activity; Biological process=aromatic amino acid family biosynthetic process
  Homolog annotation: Hit_ID=Q6H7J6; Match level="QueryCoverage=96%, HitCoverage=12%, E-value=7e-30, Identity=67%"; Hit description =Oligopeptide transporter OPT-like
MALTIPFYLGGYFSIDMCIGSLILFLWEKKNKQKAKDYGPALASGLICGDSLWSVPAAILSLAGPNPPICMKFLSRAMNKKVDTFLSGGH

SEQ ID NO: 207813 - protein, 378 aa, Glycine max
  Coding DNA Sequence Number=SeqID_91035
  Gene Ontology: Mol. function=microtubule motor activity; Cellular component=microtubule associated complex; Biological process =microtubule-based movement
  Homolog annotation: Hit_ID=Q5JKW1; Match level="QueryCoverage=97%, HitCoverage=42%, E-value=1e-111, Identity=52%"; Hit description =Putative kinesin heavy chain
  Pfam annotation: Domain name=Kinesin; Domain location=1-274; Score =348.7; E_value=9.6e-102; Accession=PF00225.13; Description=Kinesin motor domain
PFLPGQSQSHTTIEFVGDDGELIVGNPLKQGKENRKLFKFNKVFGQATSQEEIFKDTQPLIRSVLDGYNVCIFAYGQTGSGKTYTMEKHTKYCFLDLHTLGIWNTAQPNGLAVPDASMHSVNSMADVLELMNIGLTNRATSATALNERSSRSHSVLSVHVRGTDLKTNTLLRGCLHLVDLAGSERVDRSEATGDRLKEAQHINKSLSALGDVIFALSQKSSHVPYRNSKLTQLLQSSLGGQAKTLMFVQLNPDVASYSETVSTLKFAERVSGVELGAARSNKEGRDVRELMEQLASLKDVIARKDEEIERLQSLKANHNGAKLGMISARHGSSSPRRHSIGTPRNSMRLAGARSFGVNGKAASEMDNCSEYSDKHSEA

SEQ ID NO: 207814 - protein, 135 aa, Glycine max
  Coding DNA Sequence Number=SeqID_91036
  Gene Ontology: Mol. function=zinc ion binding
  Homolog annotation: Hit_ID=Q1T1K4; Match level="QueryCoverage=80%, HitCoverage=29%, E-value=3e-38, Identity=59%"; Hit description=Zinc finger, DHHC-type
  Pfam annotation: Domain name=zf-DHHC; Domain location=68-119; Score =19.2; E_value=2.5e-06; Accession=PF01529.11; Description=DHHC zinc finger domain
MFLYIRWFSFGGVWTVYPVVFSISILCGVFHSIVTAILSIATISFFSFAAFRCAGTPPNILWGSYPAVGKDDLENYTYCHYCSKPKSPRAHHCRSCRKCVLDMDHHCPFYESQFCEEYLGGGNQERGHEKSIEVE

SEQ ID NO: 207815 - protein, 439 aa, Glycine max
  Coding DNA Sequence Number=SeqID_91037
  Gene Ontology: Mol. function=microtubule motor activity; Cellular component=microtubule associated complex; Biological process =microtubule-based movement
  Homolog annotation: Hit_ID=Q5JKW1; Match level="QueryCoverage=92%, HitCoverage=43%, E-value=1e-57, Identity=32%"; Hit description =Putative kinesin heavy chain
MNMQWEQEGRGRGGTDNGNGFPRAGSQQLVSLVKWINAVLPNFNLPLDTSEEELRAWLRDGSVLCSILDNLVPGSVKGSGSLNELIGVKRFLGSMVPVLQCLETLKTHFAYNAARENIQSCSRKRWDQSNLTSFEESDSCLKDASKLQHAVDGSVVSDEITSVDHTGIKSNELFQLKQGLLADFSDAKLNEVLKSNNLDSVSTQLLFNIGNRILSDIFERKNGDVPQAHRAACLLRKILQVIQLRFSNQAESMKNQNHLFKAREGKYQTRINALETLAVGTTEENEVVTSWVQQLKVEQTKFEEKKKLEEQDFSRLKKEKVHSEIKISELKQDLEIAKRTYEEHVSELELQATESKAEYEKRIEGLKLHLADARMQVKELEAFSESRFLKWKNKEDTYQTIVNFQVGAFQELRAAMKSVKDDVIKTKRNYLEEFKYFGR

SEQ ID NO: 207816 - protein, 42 aa, Glycine max
  Coding DNA Sequence Number=SeqID_91038
  Homolog annotation: Hit_ID=Q9LIH7; Match level="QueryCoverage=62%, HitCoverage=7%, E-value=3e-07, Identity=92%"; Hit description =Arabidopsis thaliana genomic DNA, chromosome 3, TAC clone:K24M9
MATVEILPWAHKRDRFEHSFMAAALLYIPGENLFESLEFTNR

SEQ ID NO: 207817 - protein, 65 aa, Glycine max
  Coding DNA Sequence Number=SeqID_91039
MVIFHHEDAAEDKGEEPWMSLMIKFLYNWREAVAVLVYATALWYLFERVSYNFLSFVTKVFANKL

SEQ ID NO: 207818 - protein, 81 aa, Glycine max
  Coding DNA Sequence Number=SeqID_91040
MWEKGEGDEAPLCKTEIKSNVLEECNVDETATRERLRIDENRGEMILKKWAWAFLCFQMTVSGPAGILEKLGKAELDYKPI

SEQ ID NO: 207819 - protein, 63 aa, Glycine max
  Coding DNA Sequence Number=SeqID_91041
MEFPVEATMVPLGKNHDKEQKSLWKITWFAVIHMVVVAASKRNCLQENETIGGMIDLWHQCCV

SEQ ID NO: 207820 - protein, 99 aa, Glycine max
  Coding DNA Sequence Number=SeqID_91042
MDFELDLNRDPPLVREEEEEEEEGGPSRHQQHHHHQQEPQTPIVDVDAIDDDVVESSPRSFAQAKSNADERRRVRRRTTIVDLDSDCPDLGVLPHQGSN

SEQ ID NO: 207821 - protein, 570 aa, Glycine max
  Coding DNA Sequence Number=SeqID_91043
  Gene Ontology: Mol. function=tRNA (5-methylaminomethyl-2 -thiouridylate)-methyltransferase activity; Cellular component =cytoplasm; Biological process=purine nucleotide biosynthetic process
  Homolog annotation: Hit_ID=Q9CAD1; Match level="QueryCoverage=93%, HitCoverage=100%, E-value=0.0, Identity=81%"; Hit description=GMP synthase; 61700-64653
  Pfam annotation: Domain name=ExsB; Domain location=265-436; Score= -102.9; E_value=0.051; Accession=PF06508.3; Description=ExsB
  Pfam annotation: Domain name=GATase; Domain location=48-236; Score =114.6; E_value=2.9e-31; Accession=PF00117.18; Description=Glutamine amidotransferase class-I
  Pfam annotation: Domain name=GMP_synt_C; Domain location=477-569; Score=168.0; E_value=2.4e-47; Accession=PF00958.12; Description=GMP synthase C terminal domain
  Pfam annotation: Domain name=Peptidase_C26; Domain location=45-218; Score=-60.4; E_value=9.8e-06; Accession=PF07722.3; Description =Peptidase C26
  Pfam module annotation: Pfam domain module=ExsB::GATase::GMP_synt _C::Peptidase_C26; Domain location=265-436::48-236::477-569::45-218
MFRLEEIGKVEGLPPKLKTPKSHTVNTINPSTWHSLMDPKNVKSDLVLILDYGSQYTHLITRRIRSLSVFSLCISGTSSLSTITDLNPSVVILSGGPHSVHTPDSPSFPDGFLQWAHSNGVTVLGICYGLQLLVQRLGGDVRVGDKQEYGRMEICADKPSALFGPEKVGKRQVVWMSHGDEAVTLPDGFHVVARSDQGAVAAIENPSAKLYGLQYHPEVTHSEEGMETLQRFLFDVCGVGAGWKMEDVMEEEIKVIKETVGPDEHVICALSGGVDSTVAATLVHKAIGDRLHCVFVDNGLLRYKERERVMETFEKDLHLPVVCVDAVGQFLTKLKGVVDPETKRKIIGKEFICIFDAFAQELEGKLGKKPSYLVQGTLYPDVIESCPPPGTGRTHSHTIKSHHNVGGLPKDMKLKLIEPLKLLFKDEVRQLGRILDVPVAFLKRHPFPGPGLAVRVLGDVTEGNALDILRLVDEIFIQSIKDAGLYDSIWQAFAVFLPVRSVGVQGDQRTHSHVVALRAVTSQDGMTADWYYFEHKFLDDVSRKICNGVRGVNRVVQDITSKPPSTIEWE

SEQ ID NO: 207822 - protein, 383 aa, Glycine max
  Coding DNA Sequence Number=SeqID_91044
  Homolog annotation: Hit_ID=Q9AVH2; Match level="QueryCoverage=46%, HitCoverage=75%, E-value=2e-63, Identity=61%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRWQNEREPTNGSLFWPNIVEEVRDTGLIARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGRAPLPIHGI

SEQ ID NO: 207823 - protein, 207 aa, Glycine max
  Coding DNA Sequence Number=SeqID_91045
  Subcellular localization annotation: CTP_CleavageSite=38; ConfidenceScore=5.55e-01
MEESSKKRKGVLTSSAATGTRSHGASRALTTPIPPSISSSTLFSLKEQRIRYTSFFSSRSILEPKFLDLKSFDDEMFDCFQAFQNFGLIQFMSMKLLFYPELVRAFYSNLEIQEGTLVFEVYGIKMVIDESLFFQLTQLSSDGVPFEGTIDEDWKFDFSNHDARRFLRKTWLSYGFYLSVVKSTGPTLSDIACKRHCDQMHPFLILI

SEQ ID NO: 207824 - protein, 793 aa, Glycine max
  Coding DNA Sequence Number=SeqID_91046
MARRSPPRVNQTYETGCTWRMLRIFNFREGHSDRRLVSNRRLNAHANGDGNSRTRSDVLGTVDEKRLQIGVSSRRRRDYSCKSIRGVENEQVADWREEVTKMIVDQRFVNKNYQGKDGTGCEPNQFLDALQILHSNKELFVKLLQDPNSWLVKQIHDLQSSQVKEPCQQARQKRMTRLNNPEDSNATQCVKPFESFDRSDLRSSYMPQSSNRIVVLKPGTVNVENFVETSFTSPPCSPDSSSSNAQNIRPSYFPFSCIKRKLKHVMRVRRQEQQWRTDDEMSCKFSCSSQGLEDGKKVKELEIAERNSPINAHPNTGNRLNSYPDTKKRNNIIKLKDSEFCMGLEAASFGESCSKNTYNTSVCHCEENILNIHIEGRKGPSQMLNCGSDECEQCTNSLARSIPLPDSLYLPSMHRYCEHSSITGRMRDYSNYQMVHRTRLGVPKEGEIKDSPLTIVNIHTDKLQLFGEDTGIRNSAPGDNLFAHYDIPRDGRYTDSPTQNIDMNDITGGSGSFLDLHPEIQTFPFSQYVISSGQRTDDSLNMGNKVALTRAESVVEQFIKDDVTYRQITTFQPDESPVQVKQDKFEENHFEDLIRFSLNPMNNLTSSKDILHYAREILHALNYKWDELTLKRSCDKLLDPSTFVELKELTSQLSGGRILHDCVIEISMQVHQNCGLPPHVSTKNPNFQAYVVKKHLAKEITELVKLHFHPRPSPLTLEQLVEKDLARRGSWLNIQVDTEDIAIEVERDVLEKLVLEIASEMEDVRNWTHCNEAMSTYSWDDKALWKDYQATIF

SEQ ID NO: 207825 - protein, 150 aa, Glycine max
  Coding DNA Sequence Number=SeqID_91047
  Gene Ontology: Mol. function=protein serine/threonine kinase activity; Biological process=protein amino acid phosphorylation
  Homolog annotation: Hit_ID=Q1T627; Match level="QueryCoverage=79%, HitCoverage=13%, E-value=1e-08, Identity=35%"; Hit description =Protein kinase
  Subcellular localization annotation: CTP_CleavageSite=47; ConfidenceScore=5.50e-01
MIQKSQSGAIPISSPRTGSGSSSPLTSGGGAIPFHQTNQPLFSHEVVGMIQKPPNVFYSNGNTAYQGSKHEQFGRNLQTTHPCWDVVSSDNDALPNHSRRAVQGDPIKFRDEKSCLADCVSQQLLRDYVRLNACLDNKLNTPNPDCINGL

SEQ ID NO: 207826 - protein, 760 aa, Glycine max
  Coding DNA Sequence Number=SeqID_91048
  Gene Ontology: Mol. function=protein serine/threonine kinase activity; Cellular component=Golgi apparatus; Biological process =protein amino acid phosphorylation
  Homolog annotation: Hit_ID=Q6UY78; Match level="QueryCoverage=93%, HitCoverage=80%, E-value=0.0, Identity=56%"; Hit description=YDA
  Pfam annotation: Domain name=Pkinase; Domain location=405-661; Score =287.3; E_value=2.9e-83; Accession=PF00069.15; Description=Protein kinase domain
  Pfam annotation: Domain name=Pkinase_Tyr; Domain location=405-661; Score=120.3; E_value=5.3e-33; Accession=PF07714.7; Description =Protein tyrosine kinase
  Pfam module annotation: Pfam domain module=Pkinase::Pkinase_Tyr; Domain location=405-661::405-661
MRLWWGKSSSKESKRKANKETIIDTIQRKLKNTSEEKCNNKSGRSRRHHDDAISKKGSRSLTPSTSASPSTHVSRVPSFTERPLSQPLPLPGSHLPAAIDVSSGVILTSKLERAIGSKLSLNFPLQKPGYVSNKEDPTDAAGDIASASVSSDSSIDSGNSFDSPHLVSPLASDCENGNPATINSSLRNQSLITIQRNSRASSKSSPQLCNNKTSSTSPRGAPLHLQNLKIAQPGGLCSAPDSSVSSPSRNQMGAFGPEQMLNSELHTGKPYPDIPSGRCYNPVSGRDSGHNSVGGDISGQMILPQNKRSPECSSIPSPRITSPGPSSRTQSGTVTPLHPKAGGAAAEAPTRRPDDVKQKNHQLAIPPITATKSCPFSPTYSALTTPSAPRSPGRSENSSSPGSRWKKGQLLGRGTFGHVYLGFNRECGEMCAMKEVTLFSDDAKSRESAQQLGQEIAMLSQLRHPNIVQYYGSETVDDRLYVYLEYVSGGSIYKLVKEYGQLGEIAIRNYTRQILLGLAYLHTKNTVHRDIKGANILVDPSGRIKLADFGMAKHISGSSCPFSFKGSPYWMAPEVIKNSNGCNLAVDIWSLGCTVLEMATTKPPWSQYEGVAALFKIGNSKELPTIPDHLSEDGKDFVRLCLQRNPLNRPSAAQLLDHPFVKNAMLERSILTAVPSEDPTAIINAVRSLAVGPVKHNLCLDSEVAGIYPLRSLRTGSGSRFLSNSNAHLNMRKIAMKKYNGLHVHMNIFSTDMYISHVNI

SEQ ID NO: 207827 - protein, 48 aa, Glycine max
  Coding DNA Sequence Number=SeqID_91049
MVKGVEYWWENTFQCLEENYFPEGVRNEKEMEFLKLKQGNMIVTKYVA

SEQ ID NO: 207828 - protein, 63 aa, Glycine max
  Coding DNA Sequence Number=SeqID_91050
MNMNMKDLQAMQRGADKEISIGTMLDIPRGGNRMVKELEIKWLKSFKHPWRERIGWLRIFNYA

SEQ ID NO: 207829 - protein, 227 aa, Glycine max
  Coding DNA Sequence Number=SeqID_91051
MDARARVMGEVDEVQEQIKADLEAMMSMKKVMEVNGAIVVATSVVAEVDLTPPSSLNQINHAILNIVGQRGKELGSTGGPYFVQVQNKHSFPLYDLAPNYAPSNMVHTLNKNVNNSTPILIKNQQPQFDHAFVPQLMGETHEIHHHNLANFEPRLEYATEGKAVGGVPLPNTLEGPQFLPQPQPLYFVAGRIPLAMVGKGKLDHIEERLTAVEGGGGYAFANTTDCA

SEQ ID NO: 207830 - protein, 435 aa, Glycine max
  Coding DNA Sequence Number=SeqID_91052
  Homolog annotation: Hit_ID=Q6K6Z8; Match level="QueryCoverage=96%, HitCoverage=97%, E-value=1e-46, Identity=32%"; Hit description =Hydroxyproline-rich glycoprotein-like
MRGTNVNDGRADNNNTLDTINAAAFAIASAQNRVSQPSTQKKRWGSWLGKIGCFGYQKSRKRIGHAVLVPEPTCNGADPAASSNQAPSITLPFVAPPSSPASFFQSEPPSTGVSPGGPASIFAIGPYAHETQLVSPPVFSASSTAPFTPPFTTPSSPEVPFAQLLDPNNKNAETFQRFQISHYDFQSYQFHPGSPVAQLISPRSTISSPLPDSEFNATFSHILDFPIADPPKLLNLDSKLSACENRKSNHGSGSLTPDAARSTTQSAFLSNHWVSEIKMSPHPSNNRLNEISINHRVSFELSAQKVLKSLENKPAASVWTNVVSKLKNDAPTTDKEEKSVEAVLDEKQVVKEAHNDQPLEEITLGGEKATTTVHEKDQSLTLSSAKEFNFDNADGGDSLAPNIVADWWANEKVAGKEREASKDWSFFPLIQPGVS

SEQ ID NO: 207831 - protein, 846 aa, Glycine max
  Coding DNA Sequence Number=SeqID_91053
  Gene Ontology: Mol. function=membrane alanyl aminopeptidase activity; Cellular component=membrane; Biological process=proteolysis
  Homolog annotation: Hit_ID=Q9CAE1; Match level="QueryCoverage=99%, HitCoverage=92%, E-value=0.0, Identity=73%"; Hit description =Putative aminopeptidase; 4537-10989
  Pfam annotation: Domain name=Peptidase_M1; Domain location=9-366; Score=63.9; E_value=5.8e-17; Accession=PF01433.10; Description =Peptidase family M1
METPREIFLKDYKMPDYYFDTVDLKFTLGEEKTIVSSKIAVYPRIEGSTPPLVLDGQDLSLVSIHLNGKALKEEDYHLDARHLTIQSPPSGKYDLEIVTDICPQKNTSLEGLYKSSGNFCTQCEAEGFRKITFFQDRPDIMAKYTVRIEADKSLYPVLLSNGNLAEQGDLEDGRHYAVWEDPFKKPSYLFALVAGQLQSRDDTFVTRSGRKVSLRIWTPADDVPKTAHAMYSLKAAMKWDEDVFGLEYDLDLFNVVAVPDFNMGAMENKSLNIFNSKLVLASPETATDADYAAILGVIGHESLFLVCYAVFPQLDWQQEFSSDMGSCTVKRIADVSKLRNYQFPQDAGPMAHPVRPHSYIKVYEKGAEVVRMYKTLLGSQGIQSYKLPGFQGMDLYFKRHDGQAVTCEDFFAAMRDANDADFANFLLCQDIPPTPGQSVKEPTFIPVAVGLLDSMGKDIPLSTVYHNGTMQSVSSNDQSVCTTVLRVTKKEEEFVFTDIFERPVPSLLRGYSAPIRLESDLTDSDLFFLLANDSDEFNRWEAGQVLARKLMLNLVDDLQRNKPLVLNSNFVQGFKRILCDSSLDKEFVAKAITLPGEGEIMDMMGVADPDAVHTVRTFIRKQLASELRSEFLSTVENNRSSEEYVFNHSNLARRALKNVALAYLGCLEEKEFTDLVLHEYKTATNMTEQFAALAAIAQNPGKTRDDVLDDFYGKWQHDFLVVNKWFALQAMSDIPGNVENVRKLLSHPAFDLRNPNKVYSLIGGFCGSPVNFHAKDGSGYKFLGEIVLQLDKLNPQVASRMVSAFSRWRRYDEDRQKLAKAQLERIMSTNGLSENVFEIASKSLAA

SEQ ID NO: 207832 - protein, 66 aa, Glycine max
  Coding DNA Sequence Number=SeqID_91054
MSKAGTEHEFLWQKIHFSQDFVLNPETCNAHGGMVVEQGRSNPEECSSKRSVSSMEERTEPFIANP

SEQ ID NO: 207833 - protein, 53 aa, Glycine max
  Coding DNA Sequence Number=SeqID_91055
  Subcellular localization annotation: CTP_CleavageSite=36; ConfidenceScore=5.15e-01
GHPAKHTASTHSVSEKSRAKPKFTNAHLAVQKWATRTSTNKVFASGKCTRSHK

SEQ ID NO: 207834 - protein, 64 aa, Glycine max
  Coding DNA Sequence Number=SeqID_91056
MEAKAQKWWPRGENLQNPWVLHFLNEGGEFWVERNSPSPRFCVSSCASHLSGARHGMMIHRSWA

SEQ ID NO: 207835 - protein, 358 aa, Glycine max
  Coding DNA Sequence Number=SeqID_91057
  Gene Ontology: Mol. function=nucleoside-triphosphatase activity; Cellular component=membrane; Biological process=defense response
  Homolog annotation: Hit_ID=Q2L3S2; Match level="QueryCoverage=49%, HitCoverage=15%, E-value=2e-24, Identity=38%"; Hit description =Putative ATPase
  Subcellular localization annotation: CTP_CleavageSite=61; ConfidenceScore=5.73e-01
MDIQEESSTTLGPLTAKSSRNMSSSSSAFFSANQSPFFSPRSSSCQLSESLRPDAPSDRIHSDAAAPSTISGIPEPKSIVNVGCSFSEVAASPAGCNAGDLQNLDRISSSVGISSSTVSGYCHPYDDGYSGLKEKRSKRGRNKRTSSTPDRAGCRNSCKLGIAEKAMDVASFGIVIITRKSFKNPYTIEELQFFSGKKNLVPIYFDLSPADCLVRDIFEKRGELWEKHGGELWLLYGGLEQEWKDAVHGLSRVEEWKLEAHDGNWRDCILRAVTLLAMKLGRRGAAEHLTKWREKVKEEELPFTRNENFIGRKKELSQLEFMLFGGVTGDSRQDYIDLKARPKLLAFVYWSGKEYWLR

SEQ ID NO: 207836 - protein, 326 aa, Glycine max
  Coding DNA Sequence Number=SeqID_91058
  Gene Ontology: Mol. function=DNA binding; Cellular component =intracellular
  Homolog annotation: Hit_ID=Q1PEA0; Match level="QueryCoverage=81%, HitCoverage=43%, E-value=5e-21, Identity=30%"; Hit description =ARID/BRIGHT DNA-binding domain-containing protein/ELM2 domain- containing ...
  Homolog annotation: Hit description=protein/Myb-like DNA-binding domain-containing protein
  Pfam annotation: Domain name=ARID; Domain location=45-152; Score =19.4; E_value=1.9e-06; Accession=PF01388.11; Description=ARIDBRIGHT DNA binding domain
MEEWSTFSNGSSLDCIGGVELETVGAFPGNGCGLGKHHVDNGADNGKLKQKYLFYQLFPAYLKDSCSKGGVRPLPVLVDGQWLDLYKLFFLVKERGGYARVSKKRLWGSVTKELGLNLVVCWSVKLVYDKYLNDFDRWLKKTFEEKNLKSGNHGCDWGLKWLPFDIEKEFRALLCPNLKDKDDHKLVKSKSINKKKNTDLVNHKNGNNLLDTKDQNNKSEDVQRIEGDNDEKSTNGVKDNPATLGAEGAKKEFNPHKRKRDALSGMLNWMKHVAKHALDPLTQPIPKPSKWKEYKGQDFFGQFLRAREVLSPRQHEEPSSELSSLQ

SEQ ID NO: 207837 - protein, 123 aa, Glycine max
  Coding DNA Sequence Number=SeqID_91059
  Gene Ontology: Mol. function=RNA-directed DNA polymerase activity; Biological process=RNA-dependent DNA replication
  Homolog annotation: Hit_ID=Q1SLU4; Match level="QueryCoverage=83%, HitCoverage=26%, E-value=1e-15, Identity=45%"; Hit description=RNA -directed DNA polymerase
MARVTTSGRTLEAEIKDFLIRMDSHHDSILSPYLFNLVLDVLARDTKDYLNACFLQMIVLIKESRKEVNSKHELWRQMLESLLNRSKLEYMHHNFSKKHEENNLEMNRWTFDHKPHKKGQDME

SEQ ID NO: 207838 - protein, 159 aa, Glycine max
  Coding DNA Sequence Number=SeqID_91060
  Gene Ontology: Mol. function=tRNA isopentenyltransferase activity; Biological process=tRNA processing
  Homolog annotation: Hit_ID=Q1W5W5; Match level="QueryCoverage=80%, HitCoverage=36%, E-value=2e-39, Identity=69%"; Hit description =Adenylate isopentenyltransferase
MVDELAQFFDPDAARRTGFGIRKAIGVPEFDRFFNKYPPSMGQGGDDPLRERAYEEAVKAIKDNTCELAERQIGKIERLKRAGWDLRRIDATEAFRMVLTSGSSNGSGVWERQVLEPSVKIVKRFLMEETEKCTKWGMEGSNLDHLTSLGEFEFVLSEE

SEQ ID NO: 207839 - protein, 389 aa, Glycine max
  Coding DNA Sequence Number=SeqID_91061
  Gene Ontology: Mol. function=ATP-dependent DNA helicase activity; Cellular component=nucleus; Biological process=regulation of transcription, DNA-dependent
  Homolog annotation: Hit_ID=Q38861; Match level="QueryCoverage=62%, HitCoverage=24%, E-value=5e-70, Identity=66%"; Hit description=DNA repair helicase XPB1
MSKNILVWHLDVHQYEHLNGVGDNSIDIPEANVIIQISSHAGSRRQEAQRLGRILRAKGKLEDRMAGGKEEYNAFFYSLVSIDTQEMYYSTKRQQFLIDQGYSFKVGKWDGMICCLTWNKWEHELNFLVIIREKNGREMRRNILVKVEKEVITSLPPPDEGPNLSYHRLEDQLALLGKVLSAGDDQVGLEQLDEDADEIALQSARRSQGSMSAMSGAKGMIFGHDCFLPRAVLCVKANKDRSRASRKIQRRDISCLKEDMGQPKCAVFVMKSFDASKSRHNGFSTVHFMEMWTNRCLTFSSSKNQLLKSENVHQTDKHRMLKEENYSVARQIDNRHMLKLVLRNRTCIEIKIRGWRRKGRCHRQNREKLKVRKRMVMKVVVGKGGKGSG

SEQ ID NO: 207840 - protein, 257 aa, Glycine max
  Coding DNA Sequence Number=SeqID_91062
  Gene Ontology: Mol. function=DNA binding; Biological process=DNA integration
  Homolog annotation: Hit_ID=Q1T192; Match level="QueryCoverage=52%, HitCoverage=25%, E-value=6e-13, Identity=31%"; Hit description =Polynucleotidyl transferase, Ribonuclease H fold
MKTEVGKTKQLSLELTKSMGTVKNLQEDLDKHVAYLSSKVEENKALSVQVADPEQQMNDIGKKMKDLTSEKKTTKAELGTVRDEMAEMKEALAKMEIELREKEEVESTLKAELNEAKRDDLSCDVFKPIHPILQGLDDVEWAFPVWCKFSFQVVLPGISSEPPNQFVGLEAMSNSTTKDYELLAMLTMLLRSEVVPPKHARELIHPQSLGDFGQSFAQHDKDDLVCDFLLPIGQGMLNQGCEMLDTKLLKELFIALF

SEQ ID NO: 207841 - protein, 64 aa, Glycine max
  Coding DNA Sequence Number=SeqID_91063
MAGPNTWTTTRQLHWRVHQVSSRVQLAIFIDESPPETDPPGKNFLTEEREIKIVIDMIVLQRLE

SEQ ID NO: 207842 - protein, 304 aa, Glycine max
  Coding DNA Sequence Number=SeqID_91064
  Homolog annotation: Hit_ID=Q5QMF4; Match level="QueryCoverage=42%, HitCoverage=44%, E-value=3e-21, Identity=44%"; Hit description=Zinc finger CONSTANS-like protein
  Pfam annotation: Domain name=CCT; Domain location=212-250; Score =80.8; E_value=4.3e-21; Accession=PF06203.4; Description=CCT motif
MSSDLYAFDTTLYSHSNSDLVSSDGVRDLPLISESFPFFANSQENCNNNALSNALDPFSPSFFSFSPPSSHLESLSLYHANRLQSLSNGQNLANEFGSFSAFDGSEMKTEECQMGGDYAYSQQLLPHSYSGAENFSKYMQRSFSSNSYEGKPAYSDPREDSPKFQRHEMSSPEDNTVFGGQMRRVCSTGDLQESNFKVGRYSAEERKERISKYRAKRNQRNFNKTIKYACRKTLADNRPRIRGRFARNDESSETLKVSCSTRDEDDVDFWIEELRLHEEQDDVTVGAEQYLRNYGASQFQYGGF

SEQ ID NO: 207843 - protein, 119 aa, Glycine max
  Coding DNA Sequence Number=SeqID_91065
MAPKTCLQSASVLDHTIQQLSPVLSRTLESDQFPLLNDPNKACIYVIKSESLLYNTEKNKMKDCKNTSGEDVSSTSRISQSLTNSSQALRMASASSSHLCRSSHRKISQNSLELGPFSL

SEQ ID NO: 207844 - protein, 125 aa, Glycine max
  Coding DNA Sequence Number=SeqID_91066
MGSDMGGETAKEDLNERYENLERDTLLQKFSESAEKLLMVSIHKENALKDLNTEVLRRKNIEGEVISRLLQLSLIVRNHSFPSILILRPKLRIGMFESSVAHQPRTDIIAHLQQRFPFIFCKRYR

SEQ ID NO: 207845 - protein, 345 aa, Glycine max
  Coding DNA Sequence Number=SeqID_91067
  Homolog annotation: Hit_ID=Q67YE3; Match level="QueryCoverage=49%, HitCoverage=64%, E-value=5e-50, Identity=59%"; Hit description=MRNA, , clone: RAFL25-03-N20
  Pfam annotation: Domain name=PLAC8; Domain location=94-241; Score= -14.3; E_value=0.081; Accession=PF04749.7; Description=PLAC8 family
MASQESIEKMQARQNYRNLWHTDLMRSIQADTPCNDTLSHTFSIFAFYFYTDIVSDFAQIVASRCGDLMIVLFSLKFCSFGRGIESFIFSFDVYRFRVIDLGLTKSEEEKVKNMHIHIVVYRQVMLIPGGLSAPCVSYLLRKRALYDDMSRYTCCAGYMPCSGRCGESKCPEFCLCTEEIAFEQIINCYLFSSALEIQSPQLAFYCKMNLTFKLRNGFMFCLQQIACIFSIVAMIVGSDEIQEASQLLSCLADFVYCTVCACMQTQHKIEMDKRDGKFGPQPAMAVPPMQQMSRIDQQVPPSVGYAPQPAYGQPAQGYPAPGYPPTGYPPAAYPPPGYPPSGYPK

SEQ ID NO: 207846 - protein, 286 aa, Glycine max
  Coding DNA Sequence Number=SeqID_91068
  Gene Ontology: Mol. function=hydrolase activity; Biological process =aromatic compound metabolic process
  Homolog annotation: Hit_ID=Q1SUN0; Match level="QueryCoverage=97%, HitCoverage=73%, E-value=1e-109, Identity=66%"; Hit description =Alpha/beta hydrolase
  Subcellular localization annotation: CTP_CleavageSite=54; ConfidenceScore=5.66e-01
MEASATLRFVTHTLSLFPHTPISSISVSPKFSSNTTLSVAKKKSSIEGVSEELNAMTSQNLDFAPSRRRVRAAFTEVHQQLDHFLFKTAPAGIRTEEWYERNSRGLEIFCKNWMPEPGVPLKAALCFCHGYGSTCTFFFDGIAKRIDASGYGVYAMDYPGFGLSEGLHGYIPKFDDLVDDVIEHYTKIKARPEVRGLPRFILGQSMGRAIALKFHLKEPNTWDGVILVAPMCKVAEGMLPPMAVLKVLNLLSKVMPKAKLFPHRDLSALTFREPGKRKVVGNFVNP

SEQ ID NO: 207847 - protein, 69 aa, Glycine max
  Coding DNA Sequence Number=SeqID_91069
  Homolog annotation: Hit_ID=Q1SVV0; Match level="QueryCoverage=100%, HitCoverage=7%, E-value=1e-16, Identity=60%"; Hit description=Heavy metal transport/detoxification protein
MPKYPKGVTEEEGSSNISSKALFSVVGMTCSACAASVEKAVKRLPGIRQAVVDVLNNRAQVLFYPSFVN

SEQ ID NO: 207848 - protein, 648 aa, Glycine max
  Coding DNA Sequence Number=SeqID_91070
  Gene Ontology: Mol. function=sequence-specific DNA binding; Cellular component=nucleus; Biological process=regulation of transcription, DNA-dependent
  Homolog annotation: Hit_ID=Q8LLE1; Match level="QueryCoverage=84%, HitCoverage=98%, E-value=1e-141, Identity=53%"; Hit description=BEL1- related homeotic protein 14
  Pfam annotation: Domain name=Homeobox; Domain location=423-483; Score= -7.2; E_value=0.028; Accession=PF00046.19; Description=Homeobox domain
  Pfam annotation: Domain name=POX; Domain location=245-370; Score =216.5; E_value=5.9e-62; Accession=PF07526.2; Description=Associated with HOX
  Pfam module annotation: Pfam domain module=Homeobox::POX; Domain location=423-483::245-370
MARQLCEDKSKDMASSTHHGLFYSDVSSHNQTIQSHLMNHIQGFVTETDPEMFNLTTGMEMIGFSKNLEQNSESNGVMWKSFFCKPGQHAGPSSSKTMNESCSNFYNHQHDHKYNKQDFTSGINSETSTDNLVVGGAHDSAPWQENRLMVDDSSLRCVFPCEGNERPSQGLSLSLSSTNPSGIGLQSFELRQTTSHHHHQQHLSDFVSREGFFGKPVNAQQQQEMLQDGYLSPNKAANIYQQGHFLIKNSKFLVPSQVLLNEFCSLGTKENDVPKQKNKQWEEGNNNGGGSSKNHSLSSLEFVELQKRKTRLLAMLEEVDRRYKHYRDQMKAVMSSFEAVAGNGAATVYSALALKAMSRHFRCLKDGIMDQIRATRKGMGEKELAAVPGTTRGETPRLKIIDQSLRQQRAFQQISIMETHPWRPQRGLPERSVSVLRAWLFEHFLHPYPSDVDKHILARQTGLSKSQARVSNWFINARVRLWKPMVEEMYLEEEKEHQNDVASSEGGGINILGDQKPTQARLVRIDSECMSSIVNNPDDKNDTKSGKTIQNDNQMDAFGSVELDFWSYTHQYSSGHSGGVSLTLGLQQHGESGVSLAFPPAATQSSMFYPRDQIEDCQTVQYSLVDGKGQNMPYRNLMGTHLLHDHLV

SEQ ID NO: 207849 - protein, 49 aa, Glycine max
  Coding DNA Sequence Number=SeqID_91071
MTVDGSCPLETSGQICFLEFLDRERASAMSMNCSCKDDRTKNKRLCTCN

SEQ ID NO: 207850 - protein, 499 aa, Glycine max
  Coding DNA Sequence Number=SeqID_91072
  Gene Ontology: Mol. function=transferase activity, transferring glycosyl groups; Cellular component=membrane
  Homolog annotation: Hit_ID=Q9FN55; Match level="QueryCoverage=91%, HitCoverage=90%, E-value=0.0, Identity=69%"; Hit description =Arabidopsis thaliana genomic DNA, chromosome 5, P1 clone:MYC6
  Pfam annotation: Domain name=DUF604; Domain location=224-478; Score =643.3; E_value=1.9e-190; Accession=PF04646.3; Description=Protein of unknown function, DUF604
MGEKESEKLLFWEHMRTPIAPQHPTLPKLLVLLILFVSLTYLVYTLKLVSTSRACKDAPFSKTIIAVNATASAAAVLRRGSRETNPEDRTDLRHLVFGIAASAKLWDQRKSYIKLWYRARDMRGVVWLDEKVKSEENNSDTLPPVRISGDTARFKYTNRQGHRSAIRISRIVSETLRLGMKDVRWFVMGDDDTVFVTENLIRVLRKYDHNELYYIGSLSESHLQNIFFSYNMAYGGGGFAISYPLAKALQKMQDRCIQRYPALYGSDDRMQACMAELGVPLTKEIGFHQYDVYGNLFGLLASHPVTPLVSLHHLDVVEPIFPNVTQVEALQRLTIPMKLDSAGLMQQSICYDKSKSWTVSVSWGFAVEIFRGVFSPREMEMPSRTFLNWYRRADYTAYAFNTRPVSRNPCQKPFVFYFSKAKYNSTMQQIVSEYERHRVPHPDCRWKMANPAAFDKVEVYKKPDPHLWDRAPRRNCCRVRKSKEKGTMVIDVDMCRDGE

SEQ ID NO: 207851 - protein, 117 aa, Glycine max
  Coding DNA Sequence Number=SeqID_91073
MNSTMSESGAGGFKTLSSPIPYLFGGLAIMLAVIAVALLILAWSYRKQYYTSSNSASDEEKPPPIKMVEKEENVSEPKIVVIMAGESNPTYLAKPVPSTSHNEQPLFKVAVCRSESE

SEQ ID NO: 207852 - protein, 112 aa, Glycine max
  Coding DNA Sequence Number=SeqID_91074
  Homolog annotation: Hit_ID=Q69L77; Match level="QueryCoverage=87%, HitCoverage=29%, E-value=2e-33, Identity=68%"; Hit description =Putative brix domain-containing protein
MPTEQCYISIPLQISAHHNESDKLPRGGLDKMTLIEVGPRFCLNPIKIFGGSFGGPTLYENPLYVSPNQIRALEKKKKSGKFAKKVKAKTRRKMHEMSNPLEPDEFADMWKD

SEQ ID NO: 207853 - protein, 46 aa, Glycine max
  Coding DNA Sequence Number=SeqID_91075
MPSVTRNPLVVGRVIGVESSISGSPIAIEKWAMVVSLTLLKFPTNL

SEQ ID NO: 207854 - protein, 298 aa, Glycine max
  Coding DNA Sequence Number=SeqID_91076
  Gene Ontology: Mol. function=homoserine dehydrogenase activity; Cellular component=chloroplast; Biological process=aspartate family amino acid biosynthetic process
  Homolog annotation: Hit_ID=O63067; Match level="QueryCoverage=88%, HitCoverage=29%, E-value=1e-127, Identity=84%"; Hit description =Aspartokinase-homoserine dehydrogenase
  Pfam annotation: Domain name=Homoserine_dh; Domain location=90-288; Score=350.3; E_value=3.3e-102; Accession=PF00742.9; Description =Homoserine dehydrogenase
  Pfam annotation: Domain name=NAD_binding_3; Domain location=5-82; Score=-1.5; E_value=0.0056; Accession=PF03447.6; Description =Homoserine dehydrogenase, NAD binding domain
  Pfam module annotation: Pfam domain module=Homoserine_dh::NAD_binding_ 3; Domain location=90-288::5-82
MAIIGPSLIGSTLLDQLCHQFLIIKYFHMLLTDSIIASNYEDWLRKGIHVITPNKKANSGPLYEYLRLRALQRQSYTHYFYEATVGAGLPIISTLRGLLETGDRILEIEGIFSGTLSYIFNNFKDGRAFSEVVAEARDEGYTEPDPRDNLSGIDVARKVIILARESGLKLELSDIPVENLVPEPLRGSSSAEEFMQQLPKFDEELTEILKDAESSGEVLRYLGVVDVSNEKGVVELRRYKKDHPFAQLSGSDNIIAFTTRRYRNQPLIVRGPGAGAQVTAGGKFNDILRLASYLGAPS

SEQ ID NO: 207855 - protein, 102 aa, Glycine max
  Coding DNA Sequence Number=SeqID_91077
MYLNQPSKSKVMRRALSITYYISEQLKLNDLVLLTTTIFQRHNYYQNHSNILQLFGAINGKQWCSAHWSVAVAVAFTVKEELSTRFAQIETIYPKPPNAYPA

SEQ ID NO: 207856 - protein, 262 aa, Glycine max
  Coding DNA Sequence Number=SeqID_91078
  Gene Ontology: Mol. function=oxidoreductase activity; Cellular component=integral to membrane; Biological process=electron transport
  Homolog annotation: Hit_ID=Q84LG7; Match level="QueryCoverage=97%, HitCoverage=63%, E-value=4e-49, Identity=35%"; Hit description =Putative taxane 10-beta-hydroxylase
  Pfam annotation: Domain name=p450; Domain location=1-257; Score= -171.4; E_value=0.0036; Accession=PF00067.12; Description=Cytochrome P450
MVFVKKLSYEIACNVLYDIKDEHTREAMFVDFTLAFKAIHSLPINLPGTTFWRGQRARARIVDRMIPIMNKRREELHGTSATLMSLMIWKLSRDKEVHNKVLEAKGRNRRVTWAEIQKMKYTWRVAQELMRMIPPLFGSFRKALKETNYEGYDIPKGWQVYWATYGTHMNDDIFENPHKFDPSCFENPPKIIPPYSYLPFGTGLHYYVGNEFASIETLTIIHNFVKMYEWSQVNPEEVITRQPMPYPSMGLPIKMKPRCIIP

SEQ ID NO: 207857 - protein, 109 aa, Glycine max
  Coding DNA Sequence Number=SeqID_91079
ELVCGSRGSSKELVCRRCPGLFGVLTLHSVWGAHSCSQGVIFSEGLYFLEGFIGFMYGVVGVVCPVEPGTASNLVSNSYEICCCSSLNVVALLWPAKENKDLSTLQQDK

SEQ ID NO: 207858 - protein, 116 aa, Glycine max
  Coding DNA Sequence Number=SeqID_91080
KRHIPSYYERELMDKLQRLRQGSMSVKEYRQQMELLLLRAGLREEERTSIVRFLNELNMEVRDKVELLPHRDLDDLVQLCIRLLAKPICRLSEPSAERTTLAAERNTPAAEREEES

SEQ ID NO: 207859 - protein, 306 aa, Glycine max
  Coding DNA Sequence Number=SeqID_91081
  Gene Ontology: Mol. function=protein serine/threonine kinase activity; Biological process=protein amino acid phosphorylation
  Homolog annotation: Hit_ID=Q2R4L1; Match level="QueryCoverage=79%, HitCoverage=37%, E-value=3e-52, Identity=49%"; Hit description =Protein kinase domain containing protein, expressed
  Pfam annotation: Domain name=DUF26; Domain location=198-251; Score =48.2; E_value=2.7e-11; Accession=PF01657.8; Description=Domain of unknown function DUF26
  Pfam annotation: Domain name=DUF26; Domain location=86-140; Score =61.1; E_value=3.6e-15; Accession=PF01657.8; Description=Domain of unknown function DUF26
  Pfam module annotation: Pfam domain module=DUF26::DUF26; Domain location=198-251::86-140
MVVQVQHNLLLVITFLMLLWSWWSLLGALGDPQTHLINKGCSQYNATDLSNFNQNLNATLDDLRAQVSNQSKHFATAQEARGADPVYAMFQCRNYLSTADCAACFVVATAQIRNCSAGANGARVIYDGCFLRYESNGFFDQTTLAGNSMICGNQTAVGATTSFNTTAQQVLMELQIATPKITGFFAATKTQLAGGGAIYAIAQCAETATESACLDCLTVGYNNIHICLPNTDGRAFDAGCFMRYSETAFFADNQTIDITPFLKQGGSSNKKGAIIGGVVGGVGLVVILLALFGLLRRYKKPKRVPR

SEQ ID NO: 207860 - protein, 219 aa, Glycine max
  Coding DNA Sequence Number=SeqID_91082
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=87%, HitCoverage=12%, E-value=4e-42, Identity=48%"; Hit description=Chromo
METEGWVRQLTMDIQGQKLSIPIYLLPVSRAYLILGSPWLATLGPHIVDYVALTLKFFHHRKFLTLQGEGSSTPTQARLHRLQRLHATSAIFSNFVVHLMQHDGPDDNLIEFPVDIAPEIATLLHTYSVVFQSPTSLPLLGIKTMSFPSTPMQSLLKSSHIDTHIVKMSTLKKWYMRCYTKASFSLVKYLGHKVSRAGVTMDVGKVQVVLDWPKPANVK

SEQ ID NO: 207861 - protein, 68 aa, Glycine max
  Coding DNA Sequence Number=SeqID_91083
  Gene Ontology: Mol. function=hydrolase activity
  Homolog annotation: Hit_ID=Q1S1X8; Match level="QueryCoverage=72%, HitCoverage=19%, E-value=2e-10, Identity=62%"; Hit description=NUDIX hydrolase
MEKEASSTDDTSSFTLLVSCTSGLSLSQVSVACSEAYDRIPHSEIWEQRSQKNNSFFNGKKFRVCAPC

SEQ ID NO: 207862 - protein, 168 aa, Glycine max
  Coding DNA Sequence Number=SeqID_91084
  Gene Ontology: Mol. function=hydrolase activity
  Homolog annotation: Hit_ID=Q1S1X8; Match level="QueryCoverage=96%, HitCoverage=65%, E-value=9e-72, Identity=83%"; Hit description=NUDIX hydrolase
MTVWRDFCGDKFKSYVGKVPVSIRSNNVGEFPGHFVFPGGHPEPQEIGITSHQYDKELTESVNIKVSQEIFDSIVHEVVEEIGVPASSLSIPAFIGISRRNLNVRPAAFFSIKCNLDSKEVQQFYSSTQDGYESTQLYDVPMIEVENMTSRMPGFALYKLMVDTRKIT

SEQ ID NO: 207863 - protein, 73 aa, Glycine max
  Coding DNA Sequence Number=SeqID_91085
MIEMLDASTEDALDRGSWSDSLSLLPSSFTPQDASKMLSLCQSVQNALKSNKAHIFGDFYVLSSSFIKLWHLM

SEQ ID NO: 207864 - protein, 78 aa, Glycine max
  Coding DNA Sequence Number=SeqID_91086
MMENILYLANTPVTNSVRRYQPISYLVHDGAQGGIVDPFQGEEDSSSDQKPSHHQKKHYHNKEINIESIRTMNMTRFC

SEQ ID NO: 207865 - protein, 128 aa, Glycine max
  Coding DNA Sequence Number=SeqID_91087
  Gene Ontology: Mol. function=protein histidine kinase activity; Cellular component=integral to membrane; Biological process=two -component signal transduction system (phosphorelay)
  Homolog annotation: Hit_ID=Q9X6X6; Match level="QueryCoverage=99%, HitCoverage=14%, E-value=2e-49, Identity=83%"; Hit description =Putative regulator YojN
MAAKLTRQLIAQPEGQGIGLTVAIALGIVQEREVQIINLTGCDAFTGIEDTERQTILRGLVGIDLKRDFANLRGGDGVLNNHQQNSTQRLTIAVTFVVGRQMVVDQQLQTFALNHPAELSGTTSSIRS

SEQ ID NO: 207866 - protein, 95 aa, Glycine max
  Coding DNA Sequence Number=SeqID_91088
MATKKNDKKKKGIALKASSSIHEENDKEDLKENNLEEDDDFSLFVKRFNKFLRNKGNQRRSNFHPKRKGEDSSLVPKYYERDQPGYLRVDCPIYK

SEQ ID NO: 207867 - protein, 88 aa, Glycine max
  Coding DNA Sequence Number=SeqID_91089
MIYRSWPEHEMTTEGRDMAEDVADMTDDVPEQPTEAPEMRADAQGADSGEGSDGDDAAEGFPGGPRDPSVLTSFAEHVAHAVWSGHVF

SEQ ID NO: 207868 - protein, 34 aa, Glycine max
  Coding DNA Sequence Number=SeqID_91090
MEIPFSCLGLPINVNPRVETTWRPIIDKLKREVL

SEQ ID NO: 207869 - protein, 56 aa, Glycine max
  Coding DNA Sequence Number=SeqID_91091
MARIGCGKLPVGMVLIFKAYRCRLVLQRMLCLVDGGPLKPLGSVFNIVCINLRVRV

SEQ ID NO: 207870 - protein, 622 aa, Glycine max
  Coding DNA Sequence Number=SeqID_91092
  Gene Ontology: Mol. function=protein serine/threonine kinase activity; Cellular component=membrane; Biological process=protein amino acid phosphorylation
  Homolog annotation: Hit_ID=Q1SHR4; Match level="QueryCoverage=99%, HitCoverage=74%, E-value=0.0, Identity=73%"; Hit description=Protein kinase
  Pfam annotation: Domain name=Pkinase; Domain location=282-552; Score =129.3; E_value=1.1e-35; Accession=PF00069.15; Description=Protein kinase domain
  Pfam annotation: Domain name=Pkinase_Tyr; Domain location=282-552; Score=127.3; E_value=4.3e-35; Accession=PF07714.7; Description =Protein tyrosine kinase
  Pfam module annotation: Pfam domain module=Pkinase::Pkinase_Tyr; Domain location=282-552::282-552
  Subcellular localization annotation: CTP_CleavageSite=47; ConfidenceScore=5.04e-01
MGGPTVSSGSDTLQRTWLPDKKFLIQPNLARNFTNIGAVKYVDGGPTANTAPPIVYGTLTQMNSADDPRSNFNVTWQFDVEPQFQYLVRLHFCDIISKSLNELYFNVYINSWFVAKDLDLSTRNNILGAPFFKDMITAPSASTKILVSIGPSTVSNDYPNAILNGLEIMKMNNSVSSLSSSTAVPLSSTSGSGSKKVGLIVGVSVGAFLAVFIVGVFFFLLCRKRKRSGKEGHSKTWIPLSINDGTSHTMGSKYSNATTGSAASNLGYRFPFVTVQEATNNFDESWVIGIGGFGKVYKGELNDGTKVAVKRGNPRSQQGLAEFRTEIEMLSQFRHRHLVSLIGYCDEKNEMILIYEYMEKGTLKSHLYGSGFPSLSWKERLEICIGAARGLHYLHTGYAKAVIHRDVKSANILLDENLMAKVADFGLSKTGPEIDQTHVSTAVKGSFGYLDPEYFRRQQLTEKSDVYSFGVVLFEALCARPVIDPTLPREMVNLAEWSMKWQKRGQLEQIIDPTLAGKIRPDSLRKFGETAEKCLADFGVDRPSMGDVLWNLEYALQLQEAVVQGDPEENSTNMIGELSPQVNNFDHEVSVSAAQFEATSLDDLSGVSMSRVFSQLVKSEGR

SEQ ID NO: 207871 - protein, 313 aa, Glycine max
  Coding DNA Sequence Number=SeqID_91093
  Homolog annotation: Hit_ID=Q2HU26; Match level="QueryCoverage=92%, HitCoverage=100%, E-value=7e-43, Identity=38%"; Hit description=CCT
  Pfam annotation: Domain name=CCT; Domain location=207-261; Score =58.3; E_value=2.5e-14; Accession=PF06203.4; Description=CCT motif
  Subcellular localization annotation: CTP_CleavageSite=23; ConfidenceScore=5.48e-01
MHSFFLFLNLSTKLTSSRSTFPRAMYTHRNASLSRAAADSLGHFLSPPDASTASPMQYSAAAHHQLGLGEFDNSVHELNYSEMSSSNTYNSCSSGCTSYMGSPSSLASNYESRRVVQRSVSSHSLQKNGRAHHQPFSEFSPLFVEFIDSENGPVRRACSTGDLQRFNGMQHFQHSDSSLSSESSLIIEEMSRTSPYSPEEKKVRIERYRNKRNQRNFGKKIKLASTLITVTSRRGKKQYACRKTLADSRPRIRGRFARNDETAKNPPAQWSHMGNGEEEDEEEENWADFFDSLVPANIAQEPQGSSSSFGVFY

SEQ ID NO: 207872 - protein, 321 aa, Glycine max
  Coding DNA Sequence Number=SeqID_91094
  Gene Ontology: Mol. function=microtubule motor activity; Cellular component=microtubule associated complex; Biological process =microtubule-based movement
  Homolog annotation: Hit_ID=Q2HU33; Match level="QueryCoverage=96%, HitCoverage=29%, E-value=1e-160, Identity=90%"; Hit description =Kinesin, motor region
  Pfam annotation: Domain name=Kinesin; Domain location=55-321; Score =257.9; E_value=2.1e-74; Accession=PF00225.13; Description=Kinesin motor domain
MEAQQRRGGLVPLSPSQTPRSGDKLARDLRSADSNSSGHSKFDKDKGVNVQVLVRCRPLSEDEARLNTPIVISCNEGRREVSAVQNIANKQIDRTFAFDKVFGPNSKQKELFEQAMSPIVNEVLEGYNCTIFAYGQTGTGKTYTMEGGARKKNGEFPSDAGVIPRAVKQIFDILEAQNAEYSMKVTFLELYNEEITDLLAPEETLKFVDDKSKKPIALMEDGKGGVFVRGLEEEVVCTANEIYKILEKGSAKRRTAETLLNKQSSRSHSIFSITIHIKECTPEGEEMIKCGKLNLVDLAGSENISRSGAREVSNDFGVYFG

SEQ ID NO: 207873 - protein, 341 aa, Glycine max
  Coding DNA Sequence Number=SeqID_91095
  Gene Ontology: Mol. function=hydrolase activity, hydrolyzing O -glycosyl compounds; Biological process=carbohydrate metabolic process
  Homolog annotation: Hit_ID=Q2HU31; Match level="QueryCoverage=80%, HitCoverage=90%, E-value=1e-118, Identity=75%"; Hit description =Glycoside hydrolase, family 18
  Pfam annotation: Domain name=Glyco_hydro_18; Domain location=78-323; Score=23.4; E_value=2.6e-08; Accession=PF00704.18; Description =Glycosyl hydrolases family 18
MVGKIKYWEAIGREWRGLPLAKATKQASEFQPTKLWQMRMEFPTLKLFFFIFLLLTSTHARSAPPTTNLFREYIGAEFNNVKFSDVPINPSVQFHFILSFAIDYDTSSSSSPTNGNFNIFWDTGNLSPTQVSAIKTKHPNVKVALSLGGDSVANGYAYFNPSSIDSWVSNAVSSLTSIIKQYNLDGIDIDYEHFKTDPETFSECVGRLIKTLKSNGVIKFASIAPFDDEQVQSHYLALWKSYGNLIDYVNFQFYAYDKGTSVAQFIDYFNTQSSKYNGGKVLVSFISDGSGGLAPNDGFFTACHTLKSEQKLHGIFVWSADDSMKSGFPYEKQSQALLAIP

SEQ ID NO: 207874 - protein, 502 aa, Glycine max
  Coding DNA Sequence Number=SeqID_91096
  Gene Ontology: Mol. function=binding; Cellular component =intracellular; Biological process=protein amino acid phosphorylation
  Homolog annotation: Hit_ID=Q7XBT9; Match level="QueryCoverage=92%, HitCoverage=72%, E-value=2e-75, Identity=36%"; Hit description =Pentatricopeptide, putative, expressed
  Pfam annotation: Domain name=PPR; Domain location=137-171; Score=1.0; E_value=5.7; Accession=PF01535.11; Description=PPR repeat
  Pfam annotation: Domain name=PPR; Domain location=213-247; Score =10.7; E_value=0.4; Accession=PF01535.11; Description=PPR repeat
  Pfam annotation: Domain name=PPR; Domain location=248-282; Score =33.8; E_value=6.1e-07; Accession=PF01535.11; Description=PPR repeat
  Pfam annotation: Domain name=PPR; Domain location=283-317; Score =30.2; E_value=7.5e-06; Accession=PF01535.11; Description=PPR repeat
  Pfam annotation: Domain name=PPR; Domain location=318-352; Score =33.6; E_value=7e-07; Accession=PF01535.11; Description=PPR repeat
  Pfam annotation: Domain name=PPR; Domain location=386-420; Score =28.1; E_value=3.1e-05; Accession=PF01535.11; Description=PPR repeat
  Pfam annotation: Domain name=PPR; Domain location=421-455; Score =12.9; E_value=0.22; Accession=PF01535.11; Description=PPR repeat
  Pfam annotation: Domain name=PPR; Domain location=456-490; Score =10.6; E_value=0.42; Accession=PF01535.11; Description=PPR repeat
  Pfam module annotation: Pfam domain module=PPR::PPR::PPR::PPR::PPR::PP R::PPR::PPR; Domain location=137-171::213-247::248-282::283-317::318 -352::386-420::421-455::456-490
MRYRRTHRIAVEGCLCLCRSWHSSSKWRRRNTVNSETLSRCPSDLIAFSLFLWSAQRRRHDSFAFDRIVTVLRRLTHRYDTVPAILSHLETIGCASLTNPVSQLVLLRIYSRAGMYAMLLEAYHHLQASYAFVPDTFARNLVMDALFRVGHSHLALTLTLSLFNHTHPPNFFTFHILLLHLSKLNNNNLNLNLPHIARMLRLMLWAGYSPSPLTFQMLLNSLCKINAFPQAYQLLALMTVLGINFSVNIWTILIHNYCKFGRLRLANNLFHNMLQTGCSPNVVTYTILFKAFMQSNMPSPAFRLFNVMLSSGQSPDLILCNVLIDCLSKAGRCQDAIQVFLSLSERNLKPDSYTFASLLSTICRSKMFYLLPKLVLVSRHVDADLVFCNALLSSLTKADLPSLAVGFYDHMIDEGFVPDKYTFAGLLSALCCAGRVDKAVNVYHGVVMSYHDIDAHIHTVIIVGLLKTGKFHKAVSVLRFAVMNKYPLDTVAYTVGICALLR

SEQ ID NO: 207875 - protein, 308 aa, Glycine max
  Coding DNA Sequence Number=SeqID_91097
  Gene Ontology: Mol. function=two-component sensor activity; Cellular component=membrane; Biological process=two-component signal transduction system (phosphorelay)
  Homolog annotation: Hit_ID=Q2KWN7; Match level="QueryCoverage=83%, HitCoverage=82%, E-value=1e-88, Identity=62%"; Hit description =Chemotaxis sensory transducer
  Pfam annotation: Domain name=MCPsignal; Domain location=67-292; Score= 144.6; E_value=2.6e-40; Accession=PF00015.11; Description=Methyl -accepting chemotaxis protein (MCP) signaling domain
  Pfam annotation: Domain name=PAS_3; Domain location=1-83; Score=42.7; E_value=1.2e-09; Accession=PF08447.1; Description=PAS fold
  Pfam module annotation: Pfam domain module=MCPsignal::PAS_3; Domain location=67-292::1-83
MGYREDELRGRHHSMLVLPEEVRSPAYKEFWRKLRGGEYDTGQYLRIGKNGRRVWIEASYNPIFDAEGRPFKVVKFATDITRRFTAAQTLRVAVQGLTENAERASQANTLARDACQVAEEGGKTVAGVVATMGTITESSRRISEIIGVMDGIAFQTNILALNAAVEAARAGPHGKGFAVVAAEVRSLAQNSASAAKEIKDLITTSVQQIGSGAEQVQSAGATMENIVTSSRRVTEIMGEVVEVSLAQSAKLGEVTEDITQMTAEAAHELQSAYEAQDRPEAAREAASARAVAPRAPASSQSGLEYVRY

SEQ ID NO: 207876 - protein, 658 aa, Glycine max
  Coding DNA Sequence Number=SeqID_91098
  Gene Ontology: Mol. function=microtubule motor activity; Cellular component=microtubule associated complex; Biological process =microtubule-based movement
  Homolog annotation: Hit_ID=Q2HU33; Match level="QueryCoverage=99%, HitCoverage=60%, E-value=0.0, Identity=74%"; Hit description=Kinesin, motor region
  Pfam annotation: Domain name=DUF1474; Domain location=69-162; Score= -5.2; E_value=0.028; Accession=PF07342.2; Description=Protein of unknown function (DUF1474)
MSHYIRDSKLTRLLRDSLGGKTKTCIVATISPSIHCLEETLSTLDYAHRAKNIKNKPEINQKMVKSALIKDLYSEIDRLKQEVYAAREKNGIYIPRDRYLHEEAEKKAMVEKIERMELEAESKDKQLMELQELYKCQQLLIVELSDKLEKTEKSLEETEQSLFDLEEKHTQANATIKEKEFLISNLLKSEKALVEHAIELRADLENAASDVSKLFSKIERKDKIEEGNRILVQKFQSQLAQQLEDLHKTVAASVIQQEQQLKEMENDMDSFVSTKAEAIENLRARVGKFKNMYGSGIKALGNLAEEFKGNSELTFEELNSEVAKHSSALENLFQGIALEADSLLNDLQSSLKKQEAKLTAYARQQEEAHARAEENTRAVSKITVNFFETLHMHASNMIQIVEESQFTNDQKLYELQKKFEECTAHEEKQLLEKVAEMLASSSSRKKKLVAVSFRHAKLTYSSFRYYLSVQMAVNDLRESANTKISRLRQETLTMQDSTSSVKSEWKLHMEKTESNYHEDTSAVESGKNDLVEVIRHCRKKAEVGAQQWRNAQESILSLEKINAASVNAIIRGGMEANHLLRDRFSSAVSTTLEDAEIANKDINSSIEHSLQLDHDACGNLNSMIIPCCGDLRELKGGHYHRIVEITENAGKCLLSEYT

SEQ ID NO: 207877 - protein, 176 aa, Glycine max
  Coding DNA Sequence Number=SeqID_91099
  Homolog annotation: Hit_ID=UPI00001628CF; Match level="QueryCoverage =94%, HitCoverage=8%, E-value=3e-20, Identity=34%"; Hit description =NRPC1; DNA binding / DNA-directed RNA polymerase
MNRARTEGITFTKEPFMEDTGPRKIKNMKFSTLSESEISKIAEVQVWKGSYYDSFKKPIHGGLLDPRMMQYFNIRFWKVACGVIILVTGYTIWMKKLPIQFAILIDWNYQGCCLDLESTLFVKEKGPANKSLVCATCDGNFHDCPGHYGYLNLALPVFNVGYLSTIVEILKCICKV

SEQ ID NO: 207878 - protein, 150 aa, Glycine max
  Coding DNA Sequence Number=SeqID_91100
  Homolog annotation: Hit_ID=UPI00001628CF; Match level="QueryCoverage =68%, HitCoverage=7%, E-value=3e-18, Identity=48%"; Hit description =NRPC1; DNA binding / DNA-directed RNA polymerase
MWKIWITIVLVFTLYELCANTGSRFGSVKKLPASLTIIHDCSKCRNYIVEELDSALSRMKDSRATTNVSNRILNPFQVLSLFKRMLDEDCELLYVAERPEKLIMTNVVVPPIAIRPSVVMDESLSYSSNRQQGIGVVGNRDMNYFRFVNV

SEQ ID NO: 207879 - protein, 267 aa, Glycine max
  Coding DNA Sequence Number=SeqID_91101
  Homolog annotation: Hit_ID=Q9LVH0; Match level="QueryCoverage=43%, HitCoverage=8%, E-value=9e-20, Identity=48%"; Hit description=DNA -directed RNA polymerase II largest chain
MMQLPEIATEKGDQCVATHRKSFWHCQCCLARLGNARESASDVKWGCCRQGWADQGEMAAAGTVAAMFGKVGKEERVIEKQKHATRISVTLFPVGDAFCYSLNLELVAKSIKVVMTSRSASVVITLDMKRIQDAHLNIDANIVKESILRTKKTKLKPEHIKILDIKKLEVVPQDVDRSKIHFQLHYLKNLLPTVVVKGIKTVDRVVISKDTKAEKFRLLVEGLVHPIFHYDLCSFNPVQYLLAWMHIIWLFEVGDFDTYCIRGKLRN

SEQ ID NO: 207880 - protein, 96 aa, Glycine max
  Coding DNA Sequence Number=SeqID_91102
MDFVVPFLQRLLSVFGSHSNQLIAKVEMCFTVQGTPPAMCLEPAQISMEENKCHGGGHMGISSFNQNKAQKGKCILGEKKLVRGETVSEGSVIWGG

SEQ ID NO: 207881 - protein, 450 aa, Glycine max
  Coding DNA Sequence Number=SeqID_91103
  Gene Ontology: Mol. function=DNA-directed RNA polymerase activity; Cellular component=nucleus; Biological process=transcription
  Homolog annotation: Hit_ID=Q2TUN3; Match level="QueryCoverage=90%, HitCoverage=66%, E-value=1e-127, Identity=59%"; Hit description=RNA polymerase III large subunit
  Pfam annotation: Domain name=RNA_pol_Rpb1_4; Domain location=144-250; Score=151.9; E_value=1.7e-42; Accession=PF05000.7; Description=RNA polymerase Rpb1, domain 4
  Pfam annotation: Domain name=RNA_pol_Rpb1_5; Domain location=257-450; Score=-16.7; E_value=2.1e-09; Accession=PF04998.8; Description=RNA polymerase Rpb1, domain 5
  Pfam module annotation: Pfam domain module=RNA_pol_Rpb1_4::RNA_pol _Rpb1_5; Domain location=144-250::257-450
MTTVYVCDTTIGEELREPLVHEGNQGSSGNGNKDGLFSVLLRDYRAHAAASCMNRLAKLRDGSMQARALLSVCLCKIKLMLQGKVKCCKSKNAKNMIILLGCSARWIGNHGFSIGIDDVQPKEILINKKDETISEGYRECDKHIEAFNKGKLELLAGCDAAQTLETRITGVLNGLRDTAGKVCMQTLHWRNSPLIMSQCGSKGSSINISQMVACVGQQSVGGRRTPNGFIDRSLPHFPRKSKTPAAKGFVANSFYSGLSATEFFFHTMGGREGLVDTAVKTADTGYMSRQLMKSLEDLFLHYDYTVRNAGGSIVQFCYGDDGMDPAGMEGKNGKPLNFERLFLKSKAICPNDEDDEILSSSDVSKVVHEKLSEFDMSRLAEKGVFEVGFSADFVESLQSFIKDNAKLTEEGFTDEHSQNLKKFGQRISGITRKQLDSIQRDLREKTGLSF

SEQ ID NO: 207882 - protein, 163 aa, Glycine max
  Coding DNA Sequence Number=SeqID_91104
  Gene Ontology: Mol. function=RNA-directed DNA polymerase activity; Biological process=RNA-dependent DNA replication
MFVMHLGRGVGSGLQGQYRIENWMWSKEKYPRIYNISQQQQNSIQHMGIATAGGWEWCLQWRRLFREVEVDTVAKFMEDIQAVTVQVNQQDSWGWRLEPCGVYTVTLGSAYKVLASQLSEDKFDEVFKQVWKLKIPSKRLPTKVNLRRRTVELNDPEPFLQIE

SEQ ID NO: 207883 - protein, 212 aa, Glycine max
  Coding DNA Sequence Number=SeqID_91105
  Gene Ontology: Mol. function=DNA-directed RNA polymerase activity; Cellular component=nucleus; Biological process=transcription
  Homolog annotation: Hit_ID=Q9LVH0; Match level="QueryCoverage=94%, HitCoverage=14%, E-value=3e-94, Identity=83%"; Hit description=DNA -directed RNA polymerase II largest chain
  Pfam annotation: Domain name=RNA_pol_Rpb1_2; Domain location=1-139; Score=257.1; E_value=3.5e-74; Accession=PF00623.11; Description=RNA polymerase Rpb1, domain 2
MARILTYPERVTHHNIEKLRQCVRNGPDKYPGARMLRRDGGHSWSLKVLCRKRAADELRIGDIVDRHLEDGDIVLFNRQPSLHRMSIMCHRARIMPWRTLRFNESVCNPYNADFDGDEMNLHVPQTEEARTEAILLMGVENNLCTPKNGEILVASTQDFLTSSFLITRKDTFYDRSTFSLICSYIGDGMDPIDLPTPAIVKVRVGAYKCDIH

SEQ ID NO: 207884 - protein, 154 aa, Glycine max
  Coding DNA Sequence Number=SeqID_91106
MQQRSSSSSLRCSGDEHRAINVGAEMQQQQHTKRRRNLDEDSLPIYHRSLTGRRDTFRSRSPATEKGIHAIPALVLLCLFTLWWFSFPVDVEIKDGRITAIRQIHTSVPHNTRIDLTILAVAASSPIPANNPQNLSGEDGTYLQPKFTQDPLNV

SEQ ID NO: 207885 - protein, 494 aa, Glycine max
  Coding DNA Sequence Number=SeqID_91107
  Gene Ontology: Mol. function=protein binding
  Homolog annotation: Hit_ID=Q75KA7; Match level="QueryCoverage=79%, HitCoverage=75%, E-value=2e-85, Identity=40%"; Hit description =Expressed protein
  Subcellular localization annotation: CTP_CleavageSite=60; ConfidenceScore=5.79e-01
MGGDSALKSGQVSAMIKQGFIPAPNLSFSPSRTFSPPPSSTRPSQTQSHPHTQTLFNMMSEEHKFSDEKRRNTHDRVSRLLDEPALRSASGDVRLTVVGRDGFRVSMEVRKTVLADKSRFFADKLRCCGGGLSHSVEISDCDDVEVYVEAVVLMHCDDLKPRLRSMAEGVPKILSLLKVSSAIMFDLGVVSCLEYLESIPWTEDEQEEVISQLEHLQIDDSATEVLLRVSSDPSTADRADDIFLNLLSGVLQAKDDKARREMKALLSRLLKENVSNDSSRLDVSKDTLYHLCHKCISSLLLCLSEATSSDEKLDRGAIISDITREADNIQWIVDILIGKKMSDEFVKIWAEQKELATLHSKISTVYRHEISRITAQLCIGIGRGHILVPKEIRFSLLSTWLEALYEDFGWMRRASRAVDRKLIEDGLSQTILTLPLLQQQSVLLNWFDRFLNKGDDCPNIQKAFEIWWRRAFIKQYSAEPENSQLQITLSDYPS

SEQ ID NO: 207886 - protein, 412 aa, Glycine max
  Coding DNA Sequence Number=SeqID_91108
  Gene Ontology: Mol. function=protein serine/threonine kinase activity; Cellular component=membrane; Biological process=protein amino acid phosphorylation
  Homolog annotation: Hit_ID=Q1SQN8; Match level="QueryCoverage=99%, HitCoverage=99%, E-value=1e-173, Identity=75%"; Hit description =Protein kinase
  Pfam annotation: Domain name=Pkinase; Domain location=95-365; Score =136.3; E_value=8.2e-38; Accession=PF00069.15; Description=Protein kinase domain
  Pfam annotation: Domain name=Pkinase_Tyr; Domain location=95-365; Score=116.3; E_value=8.7e-32; Accession=PF07714.7; Description =Protein tyrosine kinase
  Pfam module annotation: Pfam domain module=Pkinase::Pkinase_Tyr; Domain location=95-365::95-365
MGWFCCQGKSSKKSVAEEDYRDSLDQKPTNFTATDSVKVDFKVNGNKEDGSKGDQLALDVKSLNLKEEVSQDRKDNGNRAQTFSFNELEAATGNFRVDCFLGEGGFGKVYKGHLERINQVVAIKQLDPNGLQGIREFVVEVLTLSLADHTNLVKLIGFCAEGEQRLLVYEYMPLGSLEDHLLGRKPLDWNTRMKIAAGAARGLEYLHDKMKPPVIYRDLKCSNILLGEGYHPKLSDFGLAKVGPSGDKTHVSTRVMGTYGYCAPDYAMTGQLTFKSDIYSFGVVLLELITGRKAIDHTKPAKEQNLIAWARPLFRDRRKFSRMVDPLLEGQYPVRGLYQALAIAAMCVQEQPNMRPVIVDVVTALNYLASQKYDPQLHPAQTSRRSPPSQIMKRDDDAHRHILSMEHETDRS

SEQ ID NO: 207887 - protein, 189 aa, Glycine max
  Coding DNA Sequence Number=SeqID_91109
  Homolog annotation: Hit_ID=Q2QPA8; Match level="QueryCoverage=30%, HitCoverage=9%, E-value=9e-10, Identity=42%"; Hit description=HAT family dimerisation domain containing protein
  Pfam annotation: Domain name=hATC; Domain location=67-150; Score= -2.4; E_value=0.058; Accession=PF05699.5; Description=hAT family dimerisation domain
MLEEKRPTKTIHRRVSLVGFIYSHSSTLSLLRHFTNKRELVRHTITRFWRLIKGCMLASRGWCQLPSKEVQQKILIELPIYQSAAQWWKMYGQETLNLQKLAVKILSLTCSTSGCEHNWNVFEQGGKLAAKKESSHQVVVLLLELPKLPIKNLRAESEAIEESGEEEEGYAPLDMNEIDYDGIEEEPED

SEQ ID NO: 207888 - protein, 122 aa, Glycine max
  Coding DNA Sequence Number=SeqID_91110
MASRKRKSIGTRPKSQYDTRRFASLDAWTRYTDNVLGRNILPERKVELYHTELDDFKAELERCNFHKCLTLLANGSIDLALVKECYANLYNSEDCPPKQSRVKGHLVKIDANSLNTFLETPV

SEQ ID NO: 207889 - protein, 447 aa, Glycine max
  Coding DNA Sequence Number=SeqID_91111
FTSPEAWERYTDIVVPRKLLPERNVVIYHSEFDEFKEELERRKWDKELTSFDEGSIDVAIVKEFYASLYDPEDKSPKQVRVRGHLVKFDEDTLNTFLKTLVIIKDRDTLLAYSRFALLRPDPQELAAMLCIPGRGFELNVDGLPLKILRKNMTTLVQTWSFLSYSNLVPTSHTSDITLDRAKFGFPALITALCKARGVTSNSRSLESLSPAINLAYIKKNCWNLDDPTVTFRGPRKARGKRYEASPTLATPDTFAPSSSTLPDSLAPSTSTPHLPQLPASAPTPLLAPSVPAPPIEPSSFTSETLLFMLQSLHRDQIIIIQRLQSSGQQPAMSVEEFLAQVAWPRVQPSPSGGGEASAAQELVPAEEPMPDAEDEPVPLEPFIFETDLVAQEEAVAQELTSPVLISPAPISKDTMPSAPTMEQEQPILQDAPAAPVLDLNEHAEDQQ

SEQ ID NO: 207890 - protein, 214 aa, Glycine max
  Coding DNA Sequence Number=SeqID_91112
  Gene Ontology: Mol. function=transferase activity, transferring glycosyl groups; Biological process=metabolic process
  Homolog annotation: Hit_ID=Q9FUJ6; Match level="QueryCoverage=75%, HitCoverage=35%, E-value=1e-49, Identity=60%"; Hit description=UDP -glucosyltransferase HRA25
VPTVLVLPFPGQGHVNPIMSLSQKLIEHGCRVIFVNTDFNHKRVVSSIMVDEQQQYKLDDDESLMKLVSVPDGLGPDDDRKEPGKQYDAVVRTMPRMLEKLIQDTHHGDGDNRIGFIVADLEVGSKFGIKGAAFCPIAATMFALLCNSPKLIDDGIINSDENATRSGELPSLQVATMTGELGQTFGAGCKRGVAIATCELSASCNSHWQLSLYN

SEQ ID NO: 207891 - protein, 100 aa, Glycine max
  Coding DNA Sequence Number=SeqID_91113
MYCFSLKEFRYTDFKRDELVRLYGWMKRDAVEQILVPHFSGRNRPALPALCLAEALDIGATIRFSISEICYKARKRITLGDIKKSELGREEEWRRDRLQK

SEQ ID NO: 207892 - protein, 146 aa, Glycine max
  Coding DNA Sequence Number=SeqID_91114
  Gene Ontology: Cellular component=chloroplast outer membrane; Biological process=chloroplast fission
MKWDMQMEEIEAIMEKIWDLHDKLSDAIHSVSRSHFLTSVKTLKLNNSPPHLPNAAVAAADDRSSGFVFVKDFRPLAVADNDNDDDDSAVREAKSLNAIRTALENLEDQLEFFHKPIFGVQLVQVKMVMELSSLISCFLLFDVKGT

SEQ ID NO: 207893 - protein, 84 aa, Glycine max
  Coding DNA Sequence Number=SeqID_91115
MSWEENLQEYGRILGEEEEQTAIGNGEFAVQRPRGRETAIRVGELMTCRREADLYGAAKVQQALTGLEIATITGVLLVQKIFGL

SEQ ID NO: 207894 - protein, 217 aa, Glycine max
  Coding DNA Sequence Number=SeqID_91116
  Gene Ontology: Cellular component=chloroplast outer membrane; Biological process=chloroplast fission
MERQTIQTQQRVERDAAIARLEQSRIVLAMRLAEHRGKKYKVIEEALAFIGDVHDAGSLVAPDVFYGQPNCCSAENLATEKVKRSNILINIFVSSFNFVKRSLGLDHMGGIVGNAALVAPFGQENTVHRNSTVRRTRLVGSSSEAHSSNLDVLLAREIVTMDEVHVEEIQSISIVQGGLQQCCWQDDITTVPFHSRGVTGEACLTSLVMQDVTKNIL

SEQ ID NO: 207895 - protein, 527 aa, Glycine max
  Coding DNA Sequence Number=SeqID_91117
  Gene Ontology: Mol. function=binding; Cellular component=cellular _component; Biological process=response to unfolded protein
  Homolog annotation: Hit_ID=Q43468; Match level="QueryCoverage=95%, HitCoverage=97%, E-value=0.0, Identity=60%"; Hit description=Heat shock protein STI
  Pfam annotation: Domain name=TPR_1; Domain location=2-35; Score=25.5; E_value=0.0002; Accession=PF00515.18; Description=Tetratricopeptide repeat
  Pfam annotation: Domain name=TPR_1; Domain location=244-277; Score =22.9; E_value=0.0011; Accession=PF00515.18; Description =Tetratricopeptide repeat
  Pfam annotation: Domain name=TPR_1; Domain location=332-369; Score =16.8; E_value=0.054; Accession=PF00515.18; Description =Tetratricopeptide repeat
  Pfam annotation: Domain name=TPR_1; Domain location=36-69; Score =12.2; E_value=0.19; Accession=PF00515.18; Description=Tetratricopepti de repeat
  Pfam annotation: Domain name=TPR_1; Domain location=396-429; Score =31.9; E_value=2.2e-06; Accession=PF00515.18; Description =Tetratricopeptide repeat
  Pfam annotation: Domain name=TPR_1; Domain location=430-463; Score =37.2; E_value=5.8e-08; Accession=PF00515.18; Description =Tetratricopeptide repeat
  Pfam annotation: Domain name=TPR_1; Domain location=464-497; Score =40.9; E_value=4.3e-09; Accession=PF00515.18; Description =Tetratricopeptide repeat
  Pfam annotation: Domain name=TPR_1; Domain location=70-103; Score =33.4; E_value=8.2e-07; Accession=PF00515.18; Description =Tetratricopeptide repeat
  Pfam annotation: Domain name=TPR_2; Domain location=2-35; Score=26.2; E_value=0.00012; Accession=PF07719.7; Description=Tetratricopeptide repeat
  Pfam annotation: Domain name=TPR_2; Domain location=244-277; Score =22.3; E_value=0.0017; Accession=PF07719.7; Description =Tetratricopeptide repeat
  Pfam annotation: Domain name=TPR_2; Domain location=332-369; Score =7.2; E_value=4.8; Accession=PF07719.7; Description=Tetratricopeptide repeat
  Pfam annotation: Domain name=TPR_2; Domain location=36-69; Score =21.4; E_value=0.0032; Accession=PF07719.7; Description =Tetratricopeptide repeat
  Pfam annotation: Domain name=TPR_2; Domain location=396-429; Score =28.9; E_value=1.9e-05; Accession=PF07719.7; Description =Tetratricopeptide repeat
  Pfam annotation: Domain name=TPR_2; Domain location=430-463; Score =24.6; E_value=0.00036; Accession=PF07719.7; Description =Tetratricopeptide repeat
  Pfam annotation: Domain name=TPR_2; Domain location=464-497; Score =29.0; E_value=1.7e-05; Accession=PF07719.7; Description =Tetratricopeptide repeat
  Pfam annotation: Domain name=TPR_2; Domain location=70-103; Score =29.0; E_value=1.7e-05; Accession=PF07719.7; Description =Tetratricopeptide repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2; Domain location=2-35::244-277::332-369::36 -69::396-429::430-463::...
  Pfam module annotation: Domain location=464-497::70-103::2-35::244 -277::332-369::36-69::396-429::430-463::464-497::70-103
MAEEAKAKGNAAFSAGDFAAAVRHFSDAIALSPSNHVLYSNRSAAHASLQNYAEALADAQKTVDLKPDWPKAYSRLGAAHLGLRRHRDAFSAYKTGLQLDPDNAALKSGLADAQAAASRPPPTSPFATAFSGPDMWARLTADPTARANLQDPEFVKIMQDIQKDPNKFNLHLSDQRVMHAIGVLLNVKIQTPNHDENDHDADDDVSEDEVVSQPEPEHEPEAAVEVAEEEEEEEKETRDRKGQAQKEKEAGNAAYKKKDFETAIGHYSKALELDDEDISYLTNRAAVYLEMGKDTLCSLIMKMIFKFEDCIKDCEKAVERGKELRSDYKMIARALTRKGTALAKMAKCSKDFEPAIEIFQKALTENRNPDTLKKLNEAEKAKKELEQQEYFDPKLADEAREKGNELFKQQKYPEATKHYTEAIKRNPKDAKAYSNRAACYTKLGAMPEGLKDAEKCIELDPTFSKGYTRKGAVQFSMKEYDKALETYREGLKHDPNNQELLDGIRRYGIVLHSCYFWVEYCHFPYAP

SEQ ID NO: 207896 - protein, 106 aa, Glycine max
  Coding DNA Sequence Number=SeqID_91118
MRHDHAQHLVGHMKLFGTVKKDIDAVRFATRITHAIHQGLCVNAAGIKAIDDIPLILILYPSFVEIAHQVIDDGRVLQQALRGQLWKRGGNIKMQIAITEVAPCNQ

SEQ ID NO: 207897 - protein, 85 aa, Glycine max
  Coding DNA Sequence Number=SeqID_91119
  Subcellular localization annotation: CTP_CleavageSite=26; ConfidenceScore=5.22e-01
MLRSQTVAIVAAAAAAIAVAVRLSCACAGAGCRRHWYVVLVLSSCWSLPSSSSCWSSHGTANRAGVRVLPFVLALLIPFCMRKSG

SEQ ID NO: 207898 - protein, 62 aa, Glycine max
  Coding DNA Sequence Number=SeqID_91120
MRSDCLVQSSILQCVLHRQVRTLLTGKCEKRSRDESRYRLITERARQTKSVSYLCFPLISDK

SEQ ID NO: 207899 - protein, 63 aa, Glycine max
  Coding DNA Sequence Number=SeqID_91121
MTHLLADSITSISPDQTSPLQPLGCCMASSDISRMHQVEDSDMKTKAVPKLVVKITIRRGHSY

SEQ ID NO: 207900 - protein, 263 aa, Glycine max
  Coding DNA Sequence Number=SeqID_91122
  Homolog annotation: Hit_ID=Q1S5N2; Match level="QueryCoverage=27%, HitCoverage=14%, E-value=5e-17, Identity=52%"; Hit description=Viral capsid/hemagglutinin protein
  Pfam annotation: Domain name=DUF659; Domain location=168-263; Score= -0.4; E_value=2.5e-07; Accession=PF04937.6; Description=Protein of unknown function (DUF 659)
MSKILESLFPYPCLCIYLIVYIDDIVITSDDSAKIHNQFQTKDLVCLIVALTTLQWILLPSFFWVKEATRRHKCGNVKSCFKCTTEVKEELLNLALEKEKRENSEMPNVAYDLSSDDEIQIPAAASNVKGKKNVAKKGPMDMFCRNPPSEISKRQKDKLRQANIKELCDKTLKADVHQYIARFCGADTAVLLSDAWTDWKQRSIINILVNSPAGTMFVKSIDGSKFVKTGEKLFELLYSLVEEIGEHDVVQVITDNGSNCLSW

SEQ ID NO: 207901 - protein, 83 aa, Glycine max
  Coding DNA Sequence Number=SeqID_91123
  Gene Ontology: Mol. function=DNA binding; Biological process=DNA integration
MATTAYTPDTKLICGNQVVLHIASNSVFQEQTNHIEIDCDYAREKVHSGEITTDFVSSKDQLADMFTKSFKVSHVDYICNKLG

SEQ ID NO: 207902 - protein, 126 aa, Glycine max
  Coding DNA Sequence Number=SeqID_91124
MERQPVPASKNPQSLCLSTRNSEAKGESGREDIIVEMLTCIKRRREWLGAPRGTLGPRDVARSRRVDLQTWTKSNAARLCTPFRIQYDLPDLDPTTWLTHLSYKGSPFKPTSPQNALVLVRDDRVY

SEQ ID NO: 207903 - protein, 170 aa, Glycine max
  Coding DNA Sequence Number=SeqID_91125
MSSSSDDETKLEIKVEAGVTFFIRKLNQECIGVVATWSGGVVREVPFSSSPLPFPATKDTNSVTDLTTLLTTKIVTRPLFGGSVCLLLDRVAVRSILETDGVRGIAKNETHGEPTAQDSDPVAIADDGVVVIHTIEDKDHSGEGDLANRFREGFHVTGCFWLAVVTIGYK

SEQ ID NO: 207904 - protein, 343 aa, Glycine max
  Coding DNA Sequence Number=SeqID_91126
  Gene Ontology: Mol. function=protein serine/threonine kinase activity; Cellular component=nucleus; Biological process=protein amino acid phosphorylation
  Homolog annotation: Hit_ID=Q1SDM8; Match level="QueryCoverage=99%, HitCoverage=84%, E-value=1e-146, Identity=75%"; Hit description =Serine/threonine protein kinase, active site
  Pfam annotation: Domain name=Pkinase; Domain location=38-343; Score =202.3; E_value=1.1e-57; Accession=PF00069.15; Description=Protein kinase domain
  Pfam annotation: Domain name=Pkinase_Tyr; Domain location=41-279; Score=-34.8; E_value=2.5e-10; Accession=PF07714.7; Description =Protein tyrosine kinase
  Pfam module annotation: Pfam domain module=Pkinase::Pkinase_Tyr; Domain location=38-343::41-279
MENNGAESENPKGIPIHGGKYVRYNILGSHFQVYSKYAPPLQPVGRGAYGITKEGVAIKKIGNAFDNRIDAKRTLREIKLLCHMEHDNIIKIKDIIRPAERENFNDVYIVYELMDTDLHQIIQSNQSLTDEHCQFVIVSVGVSAKEKNVIEWMGVKPGCRGDGLKYIHSANVLHRDLKPSNLLLNANCDLKICDFGLARTTSETDFMTEYVVTRWYRAPELLLNCSEYTAAIDIWSVGCILMEIVRREPLFPGKDYVQQLALITELKQASKEQIPHNHLSKQLLGSPNDSDLGFLRSDNAKKYVKQLPHVEKQSFAERFPEMSPLAIDLAEKMLVFDPSKRIT

SEQ ID NO: 207905 - protein, 100 aa, Glycine max
  Coding DNA Sequence Number=SeqID_91127
MRIHRNGEAIHLPQSAEKRLAQQGQNETHPRQILQKVKLAAEDKIEEGVLANNNRGGYRGQGNQSHGNNVGGFAGGGSTKSAWKSHLRAIKSVNHFSTVS

SEQ ID NO: 207906 - protein, 80 aa, Glycine max
  Coding DNA Sequence Number=SeqID_91128
  Subcellular localization annotation: CTP_CleavageSite=42; ConfidenceScore=5.64e-01
MPHLERTVTRTNSRAKTPPRKLPPPRGLVKIRVFKTLFKSARAFASLTTSTTTGDATSHTTTRTSPSSTSPIPSGYNSDD

SEQ ID NO: 207907 - protein, 193 aa, Glycine max
  Coding DNA Sequence Number=SeqID_91129
  Gene Ontology: Mol. function=DNA binding; Cellular component=nucleus; Biological process=regulation of transcription
  Homolog annotation: Hit_ID=Q6H666; Match level="QueryCoverage=74%, HitCoverage=39%, E-value=8e-76, Identity=89%"; Hit description =Putative OsNAC7 protein
  Pfam annotation: Domain name=NAM; Domain location=7-136; Score=314.4; E_value=2e-91; Accession=PF02365.6; Description=No apical meristem (NAM) protein
MNTFSHVPPGFRFHPTDEELVGYYLRKKVASKRIDLDVIKDVDLYKIEPWDLQELCKIGTDEQSDWYFFSHKDKKYPTGTRTNRATKAGFWKATGRDKAIYSKHCLIGMRKTLVFYKGRAPNGQKSDWIMHEYRLETNENGTTSQSAKSILTFHTNIAEEYHRIMHYATILSTGLMHSTNMRITSVALALDEK

SEQ ID NO: 207908 - protein, 489 aa, Glycine max
  Coding DNA Sequence Number=SeqID_91130
  Gene Ontology: Mol. function=amino acid binding; Biological process =metabolic process
  Homolog annotation: Hit_ID=Q1RVD0; Match level="QueryCoverage=83%, HitCoverage=93%, E-value=0.0, Identity=83%"; Hit description=Amino acid-binding ACT
  Pfam annotation: Domain name=ACT; Domain location=114-186; Score =38.7; E_value=1.9e-08; Accession=PF01842.15; Description=ACT domain
  Pfam annotation: Domain name=ACT; Domain location=245-316; Score =17.5; E_value=0.021; Accession=PF01842.15; Description=ACT domain
  Pfam annotation: Domain name=ACT; Domain location=323-389; Score =34.8; E_value=3e-07; Accession=PF01842.15; Description=ACT domain
  Pfam annotation: Domain name=ACT; Domain location=33-96; Score=18.8; E_value=0.014; Accession=PF01842.15; Description=ACT domain
  Pfam module annotation: Pfam domain module=ACT::ACT::ACT::ACT; Domain location=114-186::245-316::323-389::33-96
MEWPACTDEYEKLVIRMSTPRVVIDNAVCSTATIVKVDSARKHGILIDAVQVLSDLNLSIKKAYISSDGRWFMDVFHVTDQNGNKLTDESVLSYIEQSLGSIHNGKTSHSNGLTILELTGTDRVGLLSEVFAVLAEQQCDVVDAKVWTHNGRIASLIYVKDSNSETPIEDSQRISTIEARLRNVLKGDNDIRNAKTSVTNAVLHAERRLHQMMYTDRDYQRNPIFKFSSDTPIVTVQNWAERGYSVVNVQCKDRVKLLFDVVCNLTEMEYVVFHATIKTTIDQAYLEFYIRHKDGTPISSEPERHRVIQCLQAAVERRAFEGVRLELCTEDRQGLLAEVMRTFRENGLNVTRAEISTIGDMASNVFYVTDAIGYPADPKIVESVRQKVGLSNLKVKELPLVCHEKAEREDQPVGVGGAVLLCLGSLKGAEFSSVGRYLPLSEHKYSLLEVKTDSYTAGGDCVPTLLNALREEGEVFKRVWSCKRGCRPW

SEQ ID NO: 207909 - protein, 176 aa, Glycine max
  Coding DNA Sequence Number=SeqID_91131
  Gene Ontology: Mol. function=nucleic acid binding; Cellular component= intracellular
  Homolog annotation: Hit_ID=Q2A962; Match level="QueryCoverage=96%, HitCoverage=84%, E-value=5e-17, Identity=37%"; Hit description=Zinc finger (C2H2 type) containing protein
  Pfam annotation: Domain name=zf-C2H2; Domain location=10-32; Score =21.6; E_value=0.0028; Accession=PF00096.16; Description=Zinc finger, C2H2 type
MGTTWPPRSYTCTFCRREFRSAQALGGHMNVHRRDRARLHQAPPSSCSNPMSSSLPTSSFINIPPQELVGNAGLCLLYHLPTSPSSAPPFPSPTSNGASPSTLLSISSYPTNNFLMQTSFNFPGAPPTGINTTTVSSLCYNSSKVEQSATSSSIDNGHLEELDLELRLGHKPTPTS

SEQ ID NO: 207910 - protein, 69 aa, Glycine max
  Coding DNA Sequence Number=SeqID_91132
MVAPCLFRNAKWKVQEAIKGVQEASCRRLIPCYWRRGWPGEFPRSAALATTTTCSEIVVGSSVKMKRSD

SEQ ID NO: 207911 - protein, 105 aa, Glycine max
  Coding DNA Sequence Number=SeqID_91133
MNSKAEAENEILFYENSAREQPLDPTVTSDDSEHLRANVFQEEGNDKNPETAEIQGPMITSRIKQSVDTLQQMVADIFNKVQVEKDEGPEAEALLSILIVTKGLD

SEQ ID NO: 207912 - protein, 125 aa, Glycine max
  Coding DNA Sequence Number=SeqID_91134
  Gene Ontology: Mol. function=RNA-directed DNA polymerase activity; Cellular component=intracellular; Biological process=RNA-dependent DNA replication
MWVSRERFPADFRWEEKEKSYFRQEEKEKSECKVDPAKIAVISQLPYPSCVREQSGPSTIQSAAKEVEFDFDDQCKEAFDCLKRAMTTTPIIQAPDWKTPFELMCDASNYALGAVLAQKIDKLPR

SEQ ID NO: 207913 - protein, 647 aa, Glycine max
  Coding DNA Sequence Number=SeqID_91135
MGNLILIVWRGSCGSLLIGVVTMSWGAQLQGHIVYAPVRGLTWRGLNQLAGERDYPVSKEIVLRQGRLSDVGGSNFDNGILERCENAAFSSLSSPRAWTSFVWPTFVELFGVDMLLVLQARSDVSEDTRHGASENESSSYERLRISCRTGERISRIRRRAQPPTASLAEEPISVTVIHPPSISGGARRSGRDVRDDVLKYRSFTTSTASIVALQRQVKLASPEDSYKIVVQACGSDDFPFLRCLFEVLDLVFPLTAFQCALLEHLNIAPSQLHRNSWAMGKIGWVSLNNMSKKLFEFDLNVFRHFKDHFFKVLAIDVVVVGLPLMVDKAILEQLSAALYAQSILSLPLASDPLTALDDIKGDFAWRGQLTIEVGLIMGVVEVSPNVFSSFLVKKKWEDSVGTSASFVVPVAIDVPSPPSLLCVSVQKVAPIAEVVTLPVSANHVVVPPSTVTTPLFSANVTTMSAPEMPPPLSSTPRVPPSIVLTSASPSTSSHPHVSLDHIYTSNNADSLWGVSYKLEQKTLVTKWRASAHIVWRVKHPKVVSAIVAFREVVKLNHQLFSKVCSVLAKVVVDLVARVAKEREVNKELEKELIMYKKKDVEQHEMLLDVMEYATGSRWELGKRALSTHGSLSARPLTRAKNVYALNA

SEQ ID NO: 207914 - protein, 70 aa, Glycine max
  Coding DNA Sequence Number=SeqID_91136
MVYRQVMVVVVVGVAINDGVQNDKEEEGWRRMTYGGDDGEVDIDDKAFTGDANEGTNDSLLTTRQSKMQK

SEQ ID NO: 207915 - protein, 249 aa, Glycine max
  Coding DNA Sequence Number=SeqID_91137
  Homolog annotation: Hit_ID=Q47522; Match level="QueryCoverage=17%, HitCoverage=54%, E-value=2e-19, Identity=100%"; Hit description=LacZ protein
MTVKTSDTCSSRRRSQLVCKRMPGADKPVRARQRMRKEKIPHQAPFAIQAAQLLGRAIGAGLFAITPAGERGMCCKAIKLGNARVFPEELRKLKANMNNWRLISDSHRAKSTLLIHCLSALKGNHTPDAQSTLKIIQVFPTNTVQSSILLVNTLLSIENLYTNDNAILCRVFPMSLKGMTLTWYGGCPQAKPISQKKRKMGEERRKVVREEVDKLLKANFICEVKTCPKDTYPLPSIDMLVDEASGFKN

SEQ ID NO: 207916 - protein, 74 aa, Glycine max
  Coding DNA Sequence Number=SeqID_91138
MESGDDSSCNSGGRGNGSKVAVVVVVVGFGVVVLQYWWFPLPIAKTNSNPLPSFCSIGGIGVTMHCGGGDKDFI

SEQ ID NO: 207917 - protein, 157 aa, Glycine max
  Coding DNA Sequence Number=SeqID_91139
  Gene Ontology: Mol. function=prephenate dehydratase activity; Biological process=L-phenylalanine biosynthetic process
  Homolog annotation: Hit_ID=Q1RXT6; Match level="QueryCoverage=85%, HitCoverage=49%, E-value=1e-19, Identity=64%"; Hit description =Prephenate dehydratase with ACT region
  Pfam annotation: Domain name=PDT; Domain location=8-80; Score=-94.6; E_value=0.038; Accession=PF00800.9; Description=Prephenate dehydratase
MALSPLLTSQLANTGTSRGIYIHRNYDLLLRHRLHIVGEVKLRVNHYLLGWPNVRMEKTIEVVDDDVNVTRFLVLARVSIISGTDRPHKLVFSLGEGPGVMFKALSAFPMREICQSCVILIDIRLLKLKHTFITVIPSYDSDEGSAMYFDYLFYVDI

SEQ ID NO: 207918 - protein, 69 aa, Glycine max
  Coding DNA Sequence Number=SeqID_91140
MELYQIRCSSEENNVGDDMEGGIGVVCALDAPWLRVPGITRCTSSTPNIEFGFSSPMGIFPFPDLKLNG

SEQ ID NO: 207919 - protein, 127 aa, Glycine max
  Coding DNA Sequence Number=SeqID_91141
MAPMLFFLKISFLKNGVSIKGTVVGTQVVISPTIIDVVSRCALDGLIMSKDWEKKITQKFVDKLLYGKALSRRGDKTALNTFLRTTNLTNSYRMIHSVSFNIVMPKVGSRDYVSDRYCFGIYKTQPI

SEQ ID NO: 207920 - protein, 57 aa, Glycine max
  Coding DNA Sequence Number=SeqID_91142
MARIAVHLLAKPICRLGEPSAERTTLAAERTTLAAEPEEESGRRMSWTHVLSEGSSR

SEQ ID NO: 207921 - protein, 79 aa, Glycine max
  Coding DNA Sequence Number=SeqID_91143
MAPMLFSGERLGNMDYCWDLGASSGLVGQIILGLSQASGRACNLMAAEWTWKKDDWRRHFKEKMSQEEAHHHRKPWIRA

SEQ ID NO: 207922 - protein, 68 aa, Glycine max
  Coding DNA Sequence Number=SeqID_91144
MHDAIKEQAKVTLLCAPPMMQSYPARALDRRLQEDWARDAREGPKVLMSLRPLYFRAPRLDFVLEVVL

SEQ ID NO: 207923 - protein, 41 aa, Glycine max
  Coding DNA Sequence Number=SeqID_91145
MNKVAARDCQSSSSLLKDHNKEKFIRWQQHPDSGDPSCRDN

SEQ ID NO: 207924 - protein, 250 aa, Glycine max
  Coding DNA Sequence Number=SeqID_91146
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SS89; Match level="QueryCoverage=36%, HitCoverage=10%, E-value=4e-31, Identity=75%"; Hit description =Integrase, catalytic region
MYISGKDKLGYINGDLPEFLQIDPAFKKWRTENAMVKGWFINSMDLKLVSNFIRFPTAKVVWDSIATTYFDGADTSQVYDLKRRVTRLKQGSGSIETYYNNLQGLWREINFHRPNHMEYGADIQQYNLILQEDKVYTFLDRLDDCLDKIRVDYQQWKVTALIIYVDDMIITGNVEKEISTLQEQLATKFEMKNLGGLKYFLGIEVVRSKQGIFPSQRKYVLDLLSETRMLDCRHVDTPVTQNHGLGEFPN

SEQ ID NO: 207925 - protein, 441 aa, Glycine max
  Coding DNA Sequence Number=SeqID_91147
  Gene Ontology: Mol. function=drug transporter activity; Cellular component=membrane; Biological process=multidrug transport
  Homolog annotation: Hit_ID=Q84M81; Match level="QueryCoverage=86%, HitCoverage=94%, E-value=1e-65, Identity=37%"; Hit description =Putative MatE efflux family protein
  Pfam annotation: Domain name=MatE; Domain location=220-368; Score =58.6; E_value=2e-14; Accession=PF01554.9; Description=MatE
  Pfam annotation: Domain name=MatE; Domain location=54-214; Score =102.3; E_value=1.5e-27; Accession=PF01554.9; Description=MatE
  Pfam module annotation: Pfam domain module=MatE::MatE; Domain location=220-368::54-214
  Subcellular localization annotation: CTP_CleavageSite=42; ConfidenceScore=5.47e-01
MSATSKGESITANDWSNRQPSFPSSHTQKCPSNANNFVKMVVEELRVQRGIALPLVPMNLAWFAKLAITTAFLGHLGELNLAGGALGFSFANVTGFSVLNGLSGAMEPICGQAHGAKNARLLHKTLLMTTLLLLLVTLPLSFLWLNLGKILILFGQQQEISTVAKTYVSNLIPDLFIKALLCPLKAYLSSHCVTLPTMFSSAVALAFHIPVNIVLSKTMGLRGVAIAVWITDLMVMVMLAIYVVVLERRMMISLATSVSTRVSNELGANRAGQACESARVSLALSVVSGCIGGSTMVAARGVWGDLFSHDKGVVKGVKKAMLLMALVEVFNFPVTVCGGIVRGTGRPRLGMYASLGGFYFLTLPLGVVFAFKLRLGLAGFTIGLLIGIVACLILLLTFIVRINWVQEATKAQTFVCIAQVQEQVPRYEVNELVENHENDQV

SEQ ID NO: 207926 - protein, 287 aa, Glycine max
  Coding DNA Sequence Number=SeqID_91148
  Gene Ontology: Mol. function=DNA binding; Cellular component =chromatin; Biological process=chromosome organization and biogenesis (sensu Eukaryota)
  Homolog annotation: Hit_ID=Q6EQU6; Match level="QueryCoverage=95%, HitCoverage=94%, E-value=2e-57, Identity=46%"; Hit description =Putative DNA-binding protein AT-hook 2
  Pfam annotation: Domain name=DUF296; Domain location=100-217; Score =212.1; E_value=1.2e-60; Accession=PF03479.5; Description=Domain of unknown function (DUF296)
MDPISAHGHSLPPPFHTRDLHLHHQQQQQQHQFQSLNQATEDENSGSSGAQKREREENSNGNNEGAGEAEITRRPRGRPAGSKNKPKPPIIITRDSANAMRTHMMEVADGYDIVESVSEFARKRQRGICIMSGTGTVTNVTLRQPASSGSVVTLHGRFEILSLSGSFLPPPAPPAASGLTIYLAGGQGQVVGGSVVGTLVASGPVVIMAASFSNAAYERLPLEDEDPNSLQMQGGSIGSPGASGVGQSQLLGGDATAPLFHGLPPNLLNSVQMPSEPFWAASTRPPF

SEQ ID NO: 207927 - protein, 238 aa, Glycine max
  Coding DNA Sequence Number=SeqID_91149
  Gene Ontology: Mol. function=microtubule motor activity; Cellular component=microtubule associated complex; Biological process =microtubule-based movement
  Homolog annotation: Hit_ID=Q5VQ09; Match level="QueryCoverage=91%, HitCoverage=26%, E-value=8e-88, Identity=72%"; Hit description =Putative kinesin
  Pfam annotation: Domain name=Arm; Domain location=111-151; Score =18.5; E_value=0.023; Accession=PF00514.13; Description=Armadillobeta- catenin-like repeat
  Pfam annotation: Domain name=Arm; Domain location=161-201; Score=9.1; E_value=0.9; Accession=PF00514.13; Description=Armadillobeta-catenin -like repeat
  Pfam annotation: Domain name=Arm; Domain location=31-72; Score=22.0; E_value=0.0021; Accession=PF00514.13; Description=Armadillobeta -catenin-like repeat
  Pfam annotation: Domain name=Arm; Domain location=73-110; Score=6.7; E_value=1.8; Accession=PF00514.13; Description=Armadillobeta-catenin- like repeat
  Pfam module annotation: Pfam domain module=Arm::Arm::Arm::Arm; Domain location=111-151::161-201::31-72::73-110
MERRPQLPSSLNKAKILSLLEAEVTDARIHAVKIVANLSSEGGLTSLLILLKNSQDETTQTVAASAIANLAMNDLIVAQGGIHLLSMTAANAEDPQTLRMVAGAIANLCGNDKLQIKLTEEGGIKALLGMFRCMHPDVNTQIARGIANFAKCESKASTQGTKVGRSLLIEDGVLPWIVQNANNEVSLVRRHIELALCHLAQHEANAREMISGGAIQELVRISRDCSREDIRILGRIEL

SEQ ID NO: 207928 - protein, 531 aa, Glycine max
  Coding DNA Sequence Number=SeqID_91150
  Gene Ontology: Mol. function=drug transporter activity; Cellular component=membrane; Biological process=multidrug transport
  Homolog annotation: Hit_ID=Q84M81; Match level="QueryCoverage=87%, HitCoverage=94%, E-value=1e-121, Identity=48%"; Hit description =Putative MatE efflux family protein
  Pfam annotation: Domain name=MatE; Domain location=277-440; Score =122.1; E_value=1.5e-33; Accession=PF01554.9; Description=MatE
  Pfam annotation: Domain name=MatE; Domain location=54-214; Score =123.2; E_value=7.2e-34; Accession=PF01554.9; Description=MatE
  Pfam module annotation: Pfam domain module=MatE::MatE; Domain location=277-440::54-214
  Subcellular localization annotation: CTP_CleavageSite=56; ConfidenceScore=5.34e-01
MSATSKQVENLSTNDKANHRPSSPSSHTKKCPFNANFIKMVLEELRVQRGIALPLVAMNLAWFAKTAITTAFLGHLGELNLAGGALGFSFANITGFSVLNGLSGAMEPICGQAHGAKNVRLLHKTLLMTTLLLLLASLPISFMWLNVDKILICFGQQQEISTVAKTYVSYLIPDLLVTSLLCPLKTYLSSQCMTLPTMFSSAVALAFHIPVNIVLSKTMGLRGVSIAVWITDLMVMVMLAVYVVVLERRNEGMLWKEGGWWDQNVMDWIRLMKLSGSCCLNTCLEWWCYEILVLLTGHLANAKQALGVLAIVLNFDYLLYSVMLSLATCVSTRVSNELGANSAGQAYKSARVSLAVGVISGCIGGSMMVASRGVWGNLFSHDKGVVKGVKKTMFLMALVEVFNFPVTVCGGIVRGTARPWLGMYANIGGFYFLALPLGVVFAFKLRLGLAGLIIGFLIGVVACLILLLTFIVRINWVQEATKAQMLVCIPAQVQEQVPRNQVEQDVGLRTNVIIVSNDHNAIKAKLFYSYI

SEQ ID NO: 207929 - protein, 60 aa, Glycine max
  Coding DNA Sequence Number=SeqID_91151
MASSLEKETKRLSMVKEDDGFVFNGGEAHNQILNLEREVRVQIMKARMVEIWRPKKGVTI

SEQ ID NO: 207930 - protein, 70 aa, Glycine max
  Coding DNA Sequence Number=SeqID_91152
MVETTTQGRVKCNIDAAIFESEKCFGAGFCLRDDLGQFLIAKTAYQHGVPKPAVAAMSFIKFLLVLPLLF

SEQ ID NO: 207931 - protein, 129 aa, Glycine max
  Coding DNA Sequence Number=SeqID_91153
  Gene Ontology: Mol. function=metal ion binding; Cellular component =cellular_component; Biological process=biological_process
  Homolog annotation: Hit_ID=Q6NNI8; Match level="QueryCoverage=96%, HitCoverage=91%, E-value=3e-35, Identity=48%"; Hit description=Zinc finger A20 and AN1 domains-containing protein At1g12440
  Pfam annotation: Domain name=zf-A20; Domain location=6-30; Score =25.5; E_value=0.00018; Accession=PF01754.7; Description=A20-like zinc finger
  Pfam annotation: Domain name=zf-AN1; Domain location=70-110; Score =69.5; E_value=1.1e-17; Accession=PF01428.7; Description=AN1-like Zinc finger
  Pfam module annotation: Pfam domain module=zf-A20::zf-AN1; Domain location=6-30::70-110
MGSSERKPCANNCGFFGTSEKLNLCSKCYKDLCLEEELASMKSVLCSAKPPSPAEPSQGTEGPSKPANRCGTCNKKVGLTGFVCKCGSTFCGVHRYPEKHKCTYDFKGEAREAIAKANPVVKGDKIDRF

SEQ ID NO: 207932 - protein, 203 aa, Glycine max
  Coding DNA Sequence Number=SeqID_91154
  Gene Ontology: Mol. function=protein serine/threonine kinase activity; Biological process=protein amino acid phosphorylation
  Homolog annotation: Hit_ID=Q9LSF1; Match level="QueryCoverage=48%, HitCoverage=23%, E-value=5e-28, Identity=62%"; Hit description =Serine/threonine-protein kinase OXI1
MLYGTTPFKGSNRKETFYRILMKEPELTGEKTALRDLIGKLLEKNPDRRIQVNEIKGHNFFKGVKWDTVLHIARPPYIPENEVENKVGFSKSDVEVFVDNCCCRCITSTTPWHSRSNKMYRNGFSGSTVGSGAGADAGTGGFWIRIPTGLGMAQPGSGSKLVAAIKVLGDGFVRTKQKEMAREIETMQMEVEMKRTEIILELQ

SEQ ID NO: 207933 - protein, 109 aa, Glycine max
  Coding DNA Sequence Number=SeqID_91155
  Homolog annotation: Hit_ID=Q153F6; Match level="QueryCoverage=67%, HitCoverage=34%, E-value=3e-21, Identity=62%"; Hit description =Pectin acetylesterase
MHGHWYCCKLNPATCIPDQINTSQGFRLDMLAALRSFYMNSSTGWVFINSCFAHCQSEPQETWFGDYSPRINNKFKKEEAIALGVQALDLRLPFGEIEVLKENLDLIKR

SEQ ID NO: 207934 - protein, 112 aa, Glycine max
  Coding DNA Sequence Number=SeqID_91156
MPDCIPTETLNCNWGFKESKCKCSIDYLILTSQIPKALTNEGCSTGRIGLKKCGILIRTLADASYEKHSLSAPQIILNVAGFCITVATTIFFTAYARRRLDELQREEDPLLQ

SEQ ID NO: 207935 - protein, 117 aa, Glycine max
  Coding DNA Sequence Number=SeqID_91157
  Gene Ontology: Mol. function=transition metal ion binding; Biological process=DNA integration
MDTLNIFANQIGSNSWMSPIWNYTVNDLLLEDENEAKKDLSRLLEYSKKCKEHPRVCQSSPSAPKKLHNIYSPWSFACWGTDILGHFPIAKGQLKFLLVAIDYFTKRKLAKVIAQKV

SEQ ID NO: 207936 - protein, 166 aa, Glycine max
  Coding DNA Sequence Number=SeqID_91158
MTPYGLDAILSRKGPVTRAMSKRLQEDWARATKEGPRVLMNLSDAILPRKGLVTRAMSKRLQEDWAIAAEEGPRVLMSLRGLLFAGMQPSLDRLEVLNTHRWVIRKVPQHSGRRRETRGMRVPRKEYARSRHQRLFEENVGKTGKDAIYELLSERFGSCIYAQGRY

SEQ ID NO: 207937 - protein, 172 aa, Glycine max
  Coding DNA Sequence Number=SeqID_91159
  Homolog annotation: Hit_ID=Q9SZ63; Match level="QueryCoverage=36%, HitCoverage=21%, E-value=8e-17, Identity=66%"; Hit description=Nudix hydrolase 14, mitochondrial precursor
METLVETNMRSLDRNWMSIWKMNALPKVKLIFGAFAKISFLIGSEVKVEEEIGLKLNVEDIVDLTAFLDSTTGCSVFPSGGGCDEELSIFLYRGRVDKEIITQPQAGDTIGDAAAATESESLINRDVEALKQAGAEEDVAEAIQLVFHGLFERVTARAWWGGCPIQKVHTWN

SEQ ID NO: 207938 - protein, 533 aa, Glycine max
  Coding DNA Sequence Number=SeqID_91160
MSMTMVMEEDEEDAEIEHVFIAHEIDLDYEFDAARFFDFTRPETPAEAHEAQHWFQNAASYPPSPFVRRLLVVREDLFLEDVGDSPKSEHVECASNVDDEKSTVPLGIGFSDTAFENCGPKTLGENISGLLAGILQNDGARSLQVPTGLTFGSKTISNNLNSKAKSAVPKSSTLMKPTASQLAKQNHPAKNIGSRFQKLRTQNEQNLSISSGVENQAAKRQKLESGLLCKFLVSDVKQQTNFFHKAPMMKEAVTVEQNSACSKLRLTIPREPDLRTARRAHRIRPKNVGEAEHVTVAAPKFKARPLNRKILEAPSMLPPKRSTPRLPEFQEFHLKTFERAMQHTSAMSSSFHYDDSDKGWDKHTSVSALENRIKDLRRPAAAAAPTNDGLGFTHIFKAQPLNKKILPSKGNGGVFHNSKQETTVPMEFDLQTEKEVQHDPPVELFSKLSLTSEGQPNNGSHFKLPQHSGMCRKLTHDAGEGFYVKGKPNVSREWQLHQSDGCKEELRNSMTKNEGKCATCLVMDIRLEVLLLT

SEQ ID NO: 207939 - protein, 51 aa, Glycine max
  Coding DNA Sequence Number=SeqID_91161
MRQVNVHSHLEVTKEEQAESHSPGFLSSSYFGYLCCLIRKVVLYPSEPLLC

SEQ ID NO: 207940 - protein, 61 aa, Glycine max
  Coding DNA Sequence Number=SeqID_91162
VTANDFVLASETFGSINVQDKGTYLEPEDVKVGRLDVVGDVQQHSVLTIERCKRETDSIAR

SEQ ID NO: 207941 - protein, 158 aa, Glycine max
  Coding DNA Sequence Number=SeqID_91163
  Gene Ontology: Mol. function=DNA-directed RNA polymerase activity; Cellular component=DNA-directed RNA polymerase II, core complex; Biological process=transcription
  Homolog annotation: Hit_ID=O48890; Match level="QueryCoverage=99%, HitCoverage=100%, E-value=9e-64, Identity=79%"; Hit description=15.9 kDa subunit of RNA polymerase II
  Pfam annotation: Domain name=RNA_pol_Rpb4; Domain location=39-157; Score=167.6; E_value=3.2e-47; Accession=PF03874.6; Description=RNA polymerase Rpb4
MSGEEEENAAELKIGDASMANMLTCWCMWCQNGRLNEFLKAKCLMNCEVSLILEHKYEQLQQTSDDPMNQVSQVFEKSLQYVKRFSRYKNPDAVRQVREILARYQLAEFELCVLGNLCPETVEEAIAMVPSIKSRGRAQDDEAIEKMLNDLSLIKKFE

SEQ ID NO: 207942 - protein, 149 aa, Glycine max
  Coding DNA Sequence Number=SeqID_91164
  Gene Ontology: Mol. function=chromatin binding; Cellular component =chromatin; Biological process=chromatin assembly or disassembly
  Pfam annotation: Domain name=zf-H2C2; Domain location=20-61; Score =16.3; E_value=0.0024; Accession=PF09337.1; Description=His(2)-Cys(2) zinc finger
MTHLTKQSNSIVPLLLKEYHKSPLGGHMGLAKTLSHLHQNFLWTGMKQDIRQYIIQCSDCQQTKYIPQRPAGLLQPSSSPWEDMALDFITGLPNYQGAIVILAIVDRFSRGAHFGMLSTHFTAHKVVKLFIKIVCNHLQVPWISQEFDL

SEQ ID NO: 207943 - protein, 455 aa, Glycine max
  Coding DNA Sequence Number=SeqID_91165
  Gene Ontology: Mol. function=RNA-directed DNA polymerase activity; Cellular component=chromatin; Biological process=chromatin assembly or disassembly
  Pfam annotation: Domain name=RVP; Domain location=34-138; Score=-8.5; E_value=0.026; Accession=PF00077.10; Description=Retroviral aspartyl protease
  Pfam annotation: Domain name=RVP_2; Domain location=19-162; Score= -53.1; E_value=0.014; Accession=PF08284.2; Description=Retroviral aspartyl protease
  Pfam module annotation: Pfam domain module=RVP::RVP_2::RVT_1; Domain location=34-138::19-162::267-443
MASRCKKGLCYNYVERYGPNHKCRANLHALSGHPASATLRITGTVNGHEVVILVDGGSTHNFVQDRMVRFLNLAAQSTPRLTFMVGNGSEIRCDQVCKNVPVLIQGHQFHLDLYVMALGGAGMVFGVAWLKLLGLVTTDYSHLTMSLVWKDQPITLQGCSGPGSTETRLGWQPFSTFSSTTPPAQSPLTPLLFHLNFITSFTDILPFSGNPPSYLRLDQPTTPFTSHPTPNSQPVNIRPYRYPYFKQEIEKQVEDMLHCHLICSSRSPYSLPVLLVKKKDSLWRFCVNYRALNAVTIKDRFPLPTINKLLDGLGHATWFSKMDLAQGFHQIRMAESDIRKTAFHTYQGHYEYVAMLDWPAPTSPKSLHEFLGKTGFYRRFIKNYAQLTFPLTQLLCKDQFSWSPNAQTAFDNLKRAMTQTPVLSLPDFNIPFFLETDASGMGMGALLMQMGHLIA

SEQ ID NO: 207944 - protein, 86 aa, Glycine max
  Coding DNA Sequence Number=SeqID_91166
MALIISMHTIAINLQEIQSKSTVNDIRVSLNIYLYHYKEHSLIDMNGSGMEKEEREEMPLQVEDESRRSSPPYEALDKSLKEEGDE

SEQ ID NO: 207945 - protein, 208 aa, Glycine max
  Coding DNA Sequence Number=SeqID_91167
MARIQRESLNLSSCNLAKAATYTKDNVRRYGWPRLETQKGRHQLSPPERVSKERRGDRHRRKVEEGDLESLVIGGAMVVKKLANLDYPRHSISPVEARNLKGVKERDNLVQFEVEGALCGGECALVLGQEGHDLLEARQGIRTSIIDHGEGSMKAPNDGSHWKLASCIRGQEIPPEKKDEDNNNIIIKNETSITEWLSTRGTATKRYH

SEQ ID NO: 207946 - protein, 113 aa, Glycine max
  Coding DNA Sequence Number=SeqID_91168
MASESLFDACEMYKALLRSYTFHGYSDYTQISVFIKGTTDEFRTMINVSTGGYYVNGTTTKVKKIIEDVATSERGCDCNCTSPKDVPKEDIEDESIKQQTQMKAIMENVTKSK

SEQ ID NO: 207947 - protein, 93 aa, Glycine max
  Coding DNA Sequence Number=SeqID_91169
  Gene Ontology: Mol. function=ubiquitin-protein ligase activity; Cellular component=ubiquitin ligase complex; Biological process =response to abscisic acid stimulus
  Homolog annotation: Hit_ID=A0BJ69; Match level="QueryCoverage=76%, HitCoverage=13%, E-value=5e-10, Identity=41%"; Hit description =Chromosome undetermined scaffold_11, whole genome shotgun sequence
  Pfam annotation: Domain name=TPR_1; Domain location=11-44; Score =23.0; E_value=0.0011; Accession=PF00515.18; Description =Tetratricopeptide repeat
  Pfam annotation: Domain name=TPR_1; Domain location=45-78; Score =24.8; E_value=0.0003; Accession=PF00515.18; Description =Tetratricopeptide repeat
  Pfam annotation: Domain name=TPR_2; Domain location=11-44; Score =19.1; E_value=0.016; Accession=PF07719.7; Description=Tetratricopepti de repeat
  Pfam annotation: Domain name=TPR_2; Domain location=45-78; Score =16.6; E_value=0.091; Accession=PF07719.7; Description=Tetratricopepti de repeat
  Pfam module annotation: Pfam domain module=TPR_1::TPR_1::TPR_2::TPR _2; Domain location=11-44::45-78::11-44::45-78
MGPNAAAAKQAEKLRIDGNTYFKKDRFGAAIDAYTEAITLCPNVPVYWTNRALCHLKRNDWERVEEDSRKAIQLDSNSVKARSGFERPEPSLR

SEQ ID NO: 207948 - protein, 87 aa, Glycine max
  Coding DNA Sequence Number=SeqID_91170
MVRLLKTLRCLWMGSVKVCDEEPLKGEEISMKDLSLGGVMIRARLKKLQEEFNKKMTSLMNRGGNRSDRPTGAYDMAYIKSDLNWPI

SEQ ID NO: 207949 - protein, 66 aa, Glycine max
  Coding DNA Sequence Number=SeqID_91171
MEKFDKRNFKEKKEKKAYITWEDNDIYSSSDSENEIINLGLMAKDYESGEEMHSMTCIKNLSNLPN

SEQ ID NO: 207950 - protein, 97 aa, Glycine max
  Coding DNA Sequence Number=SeqID_91172
MDHFIGYLHFTATSLDRSGDTPKFIEYFILWTQPTPPYYCHATLVEIVELSSSSSSSFSSDMPMYAPPLTYDIEISKHILTTPLSLDPYSCFDLSWG

SEQ ID NO: 207951 - protein, 389 aa, Glycine max
  Coding DNA Sequence Number=SeqID_91173
  Gene Ontology: Mol. function=sequence-specific DNA binding; Cellular component=intracellular; Biological process=regulation of transcription, DNA-dependent
  Homolog annotation: Hit_ID=Q4KCA5; Match level="QueryCoverage=49%, HitCoverage=95%, E-value=6e-55, Identity=61%"; Hit description =Transporter, LysE family
  Pfam annotation: Domain name=HTH_AraC; Domain location=114-160; Score= 42.0; E_value=2.1e-09; Accession=PF00165.13; Description=Bacterial regulatory helix-turn-helix proteins, araC family
  Pfam annotation: Domain name=HTH_AraC; Domain location=166-209; Score= 16.4; E_value=0.033; Accession=PF00165.13; Description=Bacterial regulatory helix-turn-helix proteins, araC family
  Pfam annotation: Domain name=LysE; Domain location=204-378; Score =10.0; E_value=0.00039; Accession=PF01810.9; Description=LysE type translocator
  Pfam module annotation: Pfam domain module=HTH_AraC::HTH_AraC::LysE; Domain location=114-160::166-209::204-378
MVFIPAGAVHSCNPLPHKHWSYQMLHMDAAWLNALLAEMDDVSGGFISQGEVRVTNNQERYHRFCELNNLLFSTASTEDKNTALIEFIGDSKYGTGPVKAFPVMASDISRALHNVIEVLQQAERQPWALSELASLSGMSRYQLIRAFRAATGMTPHAYQLNLRINKARHWLQSGCDITDIAYRLGFADQSHFQRQFLIVAAAHFLALLSPGPDFFLVARTSIRAGWRRAANVCLGIAIANGVFILAAFSGITLFHPESISFIVIQLAGCAYLLNVGLLFIRFAGMSSLSACSVKTAESVTQPAGASNHYRELGMGFLSGILNPKNALFYVSLATLIGGGDAMCRAAMGFTGRRFHWQSSGTPALFPVITLAGTYLRNDVDWPGIECHRG

SEQ ID NO: 207952 - protein, 105 aa, Glycine max
  Coding DNA Sequence Number=SeqID_91174
MARATEKRLKHAVVSCFQEWKRHGNGRNLGCVSVQKSEGSTCKSTSNQVIADTWSRGVFGLGVLGVPLASVEKKDFMMYQNNYHYSPDGYTPLLPRSNYYVVDIK

SEQ ID NO: 207953 - protein, 90 aa, Glycine max
  Coding DNA Sequence Number=SeqID_91175
MEMHALNGEALVRYQDTEIDKPRSALANANKEIEGANAGRSGSNKRPLIMCAIHMRPNSTIAFEEKVVPSPLRSETPTEEPKVEGAKDGE

SEQ ID NO: 207954 - protein, 157 aa, Glycine max
  Coding DNA Sequence Number=SeqID_91176
MTDKEMIIIIVDTLPVFYYEKMVGYAPSSFTDLVFAGKRIEAGLKKCKFDHPAWMNEKTGANEEDENEEGTHVEAAIPTWPNFPPAQQHHYSVNISPSHYPPPKSTTRPTCLPHTQCPNTTFSVNQKGIFQQKACRIHPKFRCHMLTCSHIYLIMQW

SEQ ID NO: 207955 - protein, 138 aa, Glycine max
  Coding DNA Sequence Number=SeqID_91177
MQKLLHLSSSHFYLLLYLKVTLLSLVAYVFFLRASLTAMEWEILGGSQDSISPFSLSKLSLGKKLESFGESLDKVGLSSIKLEGYFEPARIVFWLGQSLTERRILSRGVMAAYGCRNLISQGELDASLGEWTSKILEK

SEQ ID NO: 207956 - protein, 96 aa, Glycine max
  Coding DNA Sequence Number=SeqID_91178
MVYKAEMHNMRVPIATNNCAINMVMDSLAASPYMSPLVLPDPIIAYRKGSMQLVWHGQLALGTMPMLDREVAMQHKKKLWRKTLHMMVVEMRAIEL

SEQ ID NO: 207957 - protein, 122 aa, Glycine max
  Coding DNA Sequence Number=SeqID_91179
MDPSKENPTPQPLWSKELQIWTSHTRFTPYHPSSLRPSKQELDVIGGILKQMYVSNQATTYPPRLHINRYVEAKLHDDDKGDDKKLKDQSKNNSSESRAIQEFKTRIEIKIQDSRFKNQEKA

SEQ ID NO: 207958 - protein, 134 aa, Glycine max
  Coding DNA Sequence Number=SeqID_91180
MSNSRENIASATTIITTDTTSIHPDGEPTIHNSRLFQQPSDDIPKAYHSVLEECLDEGLEDHYVQGSWKRDPHPKGIYGKNFKEADGKKKAHYPIDQDNIQQRRQKKLARTMADEDKALETFGLAKKVQSILRE

SEQ ID NO: 207959 - protein, 64 aa, Glycine max
  Coding DNA Sequence Number=SeqID_91181
MRQRSVNMRRNVPAEITDGEVALVPHATAWEPRGGVEDSATRTWENGKLVSIMQLTLQAYGFLI

SEQ ID NO: 207960 - protein, 153 aa, Glycine max
  Coding DNA Sequence Number=SeqID_91182
MVPYKVCPRLPNYDERKKKGFKLYFNEDIKLDTDDDRTSWNQTMWYDTKGASPSNSVHVPASQQRDSIQELCQTKVYLFDDANAYFTKNREDGFLKCLLLLQTIFCHCIFDIRKTTIEMLENEAKQKDDAIARCTTAIKRKANVEANRLDPAR

SEQ ID NO: 207961 - protein, 182 aa, Glycine max
  Coding DNA Sequence Number=SeqID_91183
MDPSKNHFSKKEVGQLTEQATKAQKLRDISEIEDEGPLIFPRERKEEPVVQKKPNQPMIPSFFPKKRKTRVGRKSFTPKEPIKIPSSNGSSLSNNEATPTPTPQPSSPPPLQSREPISPITTSSFSVIGLTWRRNWTPWVQQTREENACRKLAIAFLTRNQQNCYSEEDIIHQPHMEPIHRQ

SEQ ID NO: 207962 - protein, 42 aa, Glycine max
  Coding DNA Sequence Number=SeqID_91184
GEKKELHEDSKNGGFNPFSVSLTFGNSIEAVGGKTGEISGNR

SEQ ID NO: 207963 - protein, 192 aa, Glycine max
  Coding DNA Sequence Number=SeqID_91185
  Gene Ontology: Mol. function=electron carrier activity; Biological process=electron transport
  Homolog annotation: Hit_ID=Q0K023; Match level="QueryCoverage=79%, HitCoverage=47%, E-value=1e-16, Identity=33%"; Hit description =Cytochrome c, mono-and diheme variants
MPFRFCVPVILCLRAGSMHKPTLDEPHGLGVHACNQRAQAVGQGASANAGGGLGRRVRAADQLLRAAEQGHGLPGARVVDGAVQGAGGAVAAIGRQLQADQARVFLHRAAACHHPQPLLAALPGAQAACGLACALHGHVGKAHGIGPAAGDLQHLACGAGLHEVDQGPGVVAGQPVGLAVCPCAIARLHGAA

SEQ ID NO: 207964 - protein, 79 aa, Glycine max
  Coding DNA Sequence Number=SeqID_91186
MYTYVLETSSKIFESIQRLTNWNEGNVTGSMMIGCGITWMLWKLGRIDGDPTLRGTRIRATWEYMSSVGGGQQGMVGYT

SEQ ID NO: 207965 - protein, 275 aa, Glycine max
  Coding DNA Sequence Number=SeqID_91187
MARARALLRTAQPESYAVARGYLADWGALDAEVWSHWAGVADGPQPRRLHGERPLHIRFGREQHRAQQADEPSWRKRIWRLHPTWNGGQVQYAGQMGGPLESLCGSCHAPLQRLLRTDAAALQPGAAGEITLGLCLDCCGWEDPPVRFYRHDAAGLPSCHPSQHREVPATPTDSGDLMQAEVGLVAMDTRRWEQQDWGQSNHRQNLSRVGGAPSWVQSAWYPACIDCGEEMPFVMQLDSTLPTTGGGTLLWGSGGMLYTFWCAKCRVSGHFWQCT

SEQ ID NO: 207966 - protein, 44 aa, Glycine max
  Coding DNA Sequence Number=SeqID_91188
MVSLVNNAHGAVNGFPGISQTLIIDTDPGIDSALNPFRYLLPFP

SEQ ID NO: 207967 - protein, 88 aa, Glycine max
  Coding DNA Sequence Number=SeqID_91189
MQRCLFFLLECCGTLRIVQKCFLSTSRTLQNFTDYLTMGVEYLEAVKRRLHATKQWSPDEIRVRMTMQYPRMSSDLLSLDDERYRRRR

SEQ ID NO: 207968 - protein, 159 aa, Glycine max
  Coding DNA Sequence Number=SeqID_91190
MTCGVPYGYSHLSSSRGGKPNDMWGYHLVIGTFRHPEAASLMRCGETYIVFCTFCHPEATSPMTCGGTVWLSAPWSFRGGKPDDMRGYRVNESVDAQRLTSSPASFVNKGQTSPLTCRDLHHLLHLLSSRGDEPDDMRGYRMVIRTFCHPEMASPMTCG

SEQ ID NO: 207969 - protein, 80 aa, Glycine max
  Coding DNA Sequence Number=SeqID_91191
ASVLNFEHLDILRDTIRHSSKKLLSLDFGQSFRSEFRASDTQRERIGKPSKKLLSIDFAQSFCSEFGASRYTTGHNRTFE

SEQ ID NO: 207970 - protein, 234 aa, Glycine max
  Coding DNA Sequence Number=SeqID_91192
  Homolog annotation: Hit_ID=Q8H6Q8; Match level="QueryCoverage=77%, HitCoverage=6%, E-value=2e-32, Identity=39%"; Hit description=CTV.20
MASESHDDSKVDLQKQIQKTKQTKTVCNQKEKRMLAQQDPTPQPTNNYISKNKFFNVLQMEPEYWDKNPFKATAKVFPQGFHYRPTALNKTRKFYEFILVDTNSVSIKHFKDSKDPSLNTHSKIQILKVMQPRHYGTNLNQPKKFSAPFDLAGYTYWDYIDAWTNVFWHQNNKFKHPSLIYFKNSIVYHFPNWFLQWWNYFGPIPQIFPEEVQQGFQQFNKLFNSQELRILADL

SEQ ID NO: 207971 - protein, 320 aa, Glycine max
  Coding DNA Sequence Number=SeqID_91193
  Homolog annotation: Hit_ID=Q47522; Match level="QueryCoverage=19%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSILFQQIVAQLKLRKPLIDNSPSSPYDRHRMLHGTPIFFDHKAVCTDTSPFYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 207972 - protein, 107 aa, Glycine max
  Coding DNA Sequence Number=SeqID_91194
  Subcellular localization annotation: CTP_CleavageSite=39; ConfidenceScore=5.40e-01
IAPTKTPSGPEKVKQGPGVSSSGYGPLSVLQGARTPPARSRHHSSTEYLSPPARASGPLLIELSSRSTAPPGRRRAKHHSSIGMAGSGQIDIPPPPLEFTSAHPQKA

SEQ ID NO: 207973 - protein, 81 aa, Glycine max
  Coding DNA Sequence Number=SeqID_91195
VNEANWQQCYFHLLAKPWLSTRKNPEEDELSGSLSAPLQVIKRTASAHPLSKRSALRHNPPMHAKRSRFALSAQARTNPPI

SEQ ID NO: 207974 - protein, 241 aa, Glycine max
  Coding DNA Sequence Number=SeqID_91196
  Gene Ontology: Mol. function=kinase activity
  Homolog annotation: Hit_ID=P28306; Match level="QueryCoverage=61%, HitCoverage=43%, E-value=2e-68, Identity=83%"; Hit description =Hypothetical protein yceG
  Pfam annotation: Domain name=ADC_lyase; Domain location=1-154; Score =150.0; E_value=6.1e-42; Accession=PF02618.6; Description =Aminodeoxychorismate lyase
  Pfam annotation: Domain name=Thymidylate_kin; Domain location=154 -240; Score=-23.2; E_value=0.0011; Accession=PF02223.8; Description =Thymidylate kinase
  Pfam module annotation: Pfam domain module=ADC_lyase::Thymidylate _kin; Domain location=1-154::154-240
MYTANTSDIAILKRAHQKMVAAVAKAWEGRADNLPYKDQNQLLTMASIVEKETAVPAERDRVASVFINRLRIGMRLQTDPTVIYGMGERYNGKLSRKDLETPTAYNTYVISGMPPGPIAVPGEASLNAASHPAKTPYLYFVADGKGGHTNYIVIEGLEGAGKTTARNLVVEALEQLGIRDMVFTREPGGTILAEKLRSLVLDIQSTGDEVINDKAEVLMFYAARVQLVETVIKPALARGQW

SEQ ID NO: 207975 - protein, 143 aa, Glycine max
  Coding DNA Sequence Number=SeqID_91197
MEIMVRTRGLGHALARVIGRGRQDEHDAVDAPQRRRPTASARRRRVYITVDEGIPQVTEDVPHMAEDVPQVTEDVPHMADDVAQRSEDVPQMTADVDATVAEDLSRDGAEGSYTDEGFPGGPRDPSVLTSFAKHVTHAIWTGQ

SEQ ID NO: 207976 - protein, 227 aa, Glycine max
  Coding DNA Sequence Number=SeqID_91198
  Pfam annotation: Domain name=Transposase_23; Domain location=155-213; Score=-1.0; E_value=0.0015; Accession=PF03017.5; Description =TNP1ENSPM transposase
MTSAAAQEIADKIDELQEQAKQGAFVPHGRQDILNTAIGRPEHPERVRVDGHGVTITSYFGHASCGSHSSSPVITAERLVEIIQTIKQEVKKEVEDENKDRMDKMKMELDAIKSELSQIHTQQSAPPRPSNPDVFVARVSTKESCVEVANNVVGNERSTFDTWGKVFGVGGTIHTVAYGDDVVRVCVETVYDAEAIVPLPTSEIQYVRDAMNSFIGWPIHLVKPLSY

SEQ ID NO: 207977 - protein, 35 aa, Glycine max
  Coding DNA Sequence Number=SeqID_91199
MPFLTSGMLRNFTDCATMLPFDFQNVAKLHGLPND

SEQ ID NO: 207978 - protein, 173 aa, Glycine max
  Coding DNA Sequence Number=SeqID_91200
MWEATTCYLKISYGVAHVSLKSDNTTHTSQEMSNIWDEVEPEIASRSIVLMRIRDTLTLHRFPRMICDDDGPYDSGHRSGVHPRGALDSIILSQIEKELKADPEEEPIEGSEAKGDFVATEVAEARVGEIEILKWYTKNLHCPEASVVERYVAEEAIAKPVGFPSLNMMKEWK

SEQ ID NO: 207979 - protein, 101 aa, Glycine max
  Coding DNA Sequence Number=SeqID_91201
  Subcellular localization annotation: CTP_CleavageSite=68; ConfidenceScore=5.19e-01
MMLSLEGKSAKLDVSLSELNALSKCHPLSKASTRLADRRNLEGNLSRRHALNASSARSASRLSPSRLSASLALSETSLTRAKFENGTKHDDEVNEPFLSLE

SEQ ID NO: 207980 - protein, 76 aa, Glycine max
  Coding DNA Sequence Number=SeqID_91202
MPRCAHVQFLVPQNALSMHVCEFSQGDVCDVSNKYTLEVRVNNLGMAPRKLASKRSRKDKAAEGTSFRPGVRQSPL

SEQ ID NO: 207981 - protein, 155 aa, Glycine max
  Coding DNA Sequence Number=SeqID_91203
MNLRFYHYTIEDFTIKQRGRTHSFGAATPNECALPFCSQLKRLENDRNGISPKKAHDVEARYFDVLMMPKDQVLLKFYSRQESKNPRKSRYMTKLISRILGRSFQIEKAKGIKRPRVSCSKGFLNTREGFSLCGSDFVKGVLQREWKIASGLLED

SEQ ID NO: 207982 - protein, 121 aa, Glycine max
  Coding DNA Sequence Number=SeqID_91204
  Gene Ontology: Mol. function=RNA-directed DNA polymerase activity; Biological process=RNA-dependent DNA replication
MGEKREQEKENSEAPQRNMKKKSDTPEEKSDTHERKFNYFAEASEEFKNVFPKEIPHGLPPSRGIEHQVDLLPGASLPNRPTYKSNPQETQRKDAHAKVEYVKRLYDQVKVQIAKKNENYA

SEQ ID NO: 207983 - protein, 93 aa, Glycine max
  Coding DNA Sequence Number=SeqID_91205
MTPPKEIVTIIYHNGHIVDDPTRVISAQLFDNDDLRGAMETILQNPQLNSTEFYVVTELIPQPQSSSPQPSCPQLQLSPPQQLPYNNIDLNNP

SEQ ID NO: 207984 - protein, 255 aa, Glycine max
  Coding DNA Sequence Number=SeqID_91206
  Subcellular localization annotation: CTP_CleavageSite=41; ConfidenceScore=5.12e-01
MADRGRGGGRRTFNRGRRCGFSLGAPITTNPSSSSIHISTSESMIHVVAQTPNTLPTSQDQPNPTFVRESIPTTPVRDASPSAPDDSLTPEYPLDPNCEHIVDQRPFIRAYKGEFQPTYGCSNFISNIIREKFDELAASWLKVSVDLRDRWFGEFKKEYRWHPQEKRAIRAVFETKALDEHWGSTDFLNKSSTAKVNRSVDRGASTYYGGSVSIETHFEKLSKEFQRPPTTWKVMEKTKKLKSGEWVNDKSREFA

SEQ ID NO: 207985 - protein, 122 aa, Glycine max
  Coding DNA Sequence Number=SeqID_91207
MYPVEQYMKILKGYTKDLHYPKAFIVERYIAEGAIEFCSEYIEKAKPVGLLESRHDEKVGGCQKRLNCEVSNFSALSMTKESGRAQESRPRAKCESNSLSAMFVSYQAQHNNGAKLKITNSC

SEQ ID NO: 207986 - protein, 79 aa, Glycine max
  Coding DNA Sequence Number=SeqID_91208
MSLQSQKRSPVCDKDELRQKEKEEERPRSLKANHNGLPKSIPTLSGTLSFPSFLRPAKSQKRKPICDKDELRQKEKEEE

SEQ ID NO: 207987 - protein, 58 aa, Glycine max
  Coding DNA Sequence Number=SeqID_91209
  Gene Ontology: Cellular component=membrane
MKDVCNVITFAGVNVFYKLAVNDGMSLRVVVAYRFVFATVFIAPLALIVERFINSLAG

SEQ ID NO: 207988 - protein, 228 aa, Glycine max
  Coding DNA Sequence Number=SeqID_91210
  Gene Ontology: Mol. function=protein translocase activity; Cellular component=type II protein secretion system complex; Biological process=protein secretion by the type II secretion system
  Homolog annotation: Hit_ID=Q9WZW4; Match level="QueryCoverage=97%, HitCoverage=46%, E-value=4e-56, Identity=54%"; Hit description =Protein-export membrane protein SecD, putative
  Pfam annotation: Domain name=Sec_GG; Domain location=34-62; Score =22.1; E_value=0.0021; Accession=PF07549.4; Description=SecDSecF GG Motif
MRSDRVRLIISLALLVAAVVALLLPGGRQATGIAKLFSRIKLGLDLSGGVRLEYRVDIEKGVENPSAVVDDVWTVLRNRLDSAGYTEAVVKKSFRENNSFIIVEIPDATDTSFAEKLVGSTGLLWFGQAIDERDYDPTTNPDDVNLATREGAQWYSDKDGKKWYLIKKEINNRKDLVLSGPRISEAVPTVDQKGVANYVVSFTLAREYVEVFKNITKELYVPEQVLNS

SEQ ID NO: 207989 - protein, 182 aa, Glycine max
  Coding DNA Sequence Number=SeqID_91211
  Homolog annotation: Hit_ID=Q8H6Q8; Match level="QueryCoverage=89%, HitCoverage=4%, E-value=3e-18, Identity=32%"; Hit description=CTV.20
MTKSRSNPQLILLWNLMMLSENFSIDKETLRKDFYSLENELQRRWFFQHYKGANRRQIQDTFYEFVERVKINVLFFDWFHAYTIRKDIDYPWKQDIIGDPTTNVITNWKMKDGELIQSELPPVTQYQPPNVKDSNNKPVMAVPFKTKDVNEEVTSKDIKSLMEQANYTNKYLQVLGETIKTK

SEQ ID NO: 207990 - protein, 358 aa, Glycine max
  Coding DNA Sequence Number=SeqID_91212
  Gene Ontology: Mol. function=RNA-directed DNA polymerase activity; Biological process=RNA-dependent DNA replication
  Homolog annotation: Hit_ID=Q8H6Q8; Match level="QueryCoverage=78%, HitCoverage=10%, E-value=2e-33, Identity=31%"; Hit description=CTV.20
MASESDDDSETDLFKQIQKAKQTKTVVNLKEKLVQKDPIPKSTNSYIPKNKFFNVLQMEPEYWDKNPFKATAIAFSSGFHYKPTSLNKTRTFYEFILVDTYSVSIKHFKDPKDQSLNTHSTIQLLKVMQPRHYRSNLNQPKKFSAPFDPTGYTYWDYIDAWTNVFWHQNNKYKHSWLIYFKNYIVYNFPNWFTQWWTYFSPIPQIFPEEVQQGFQQFCKLFNSQESRIPYGKTENNKQYPPLQRHAFVKWWTQFDTSKAAPDQVKNWFQSHPELLKPADPKTSLFLNQKSQLAAFLASSKSKESLAKNLKEVFQILQQEEEEESSKIEAESSEDFDDQDDDPFYQNEDDCFGISLEED

SEQ ID NO: 207991 - protein, 136 aa, Glycine max
  Coding DNA Sequence Number=SeqID_91213
  Gene Ontology: Mol. function=RNA polymerase II transcription factor activity; Biological process=regulation of transcription, DNA -dependent
  Homolog annotation: Hit_ID=Q9LU97; Match level="QueryCoverage=54%, HitCoverage=64%, E-value=1e-10, Identity=45%"; Hit description =Similarity to transcription-associated zinc ribbon protein
  Pfam annotation: Domain name=TFIIS_C; Domain location=96-134; Score =30.1; E_value=7.8e-06; Accession=PF01096.9; Description =Transcription factor S-II (TFIIS)
MSAEVVKNSWKKIAKESVVISKGEGSDFVAKAVDLAARELITSASLGQVTQVQLDRAKVSTKSAVLMNLESIDIRRELGMEIIEEHTVMEYSKVSKKCEKCGHGEATYYTIQMRSADKGQTTFYTCTSYGHPSQEN

SEQ ID NO: 207992 - protein, 77 aa, Glycine max
  Coding DNA Sequence Number=SeqID_91214
MALNEKLEEHLGARGNEKEQLTSDDGVGVILRRKATRELRLGFRGSGGGAQKDKRARGSKGLQARLGLERVQRERGK

SEQ ID NO: 207993 - protein, 153 aa, Glycine max
  Coding DNA Sequence Number=SeqID_91215
MVRIRGLRRALGRLLGRALGRHVSCDAEEAPKLRRPTTSACRQQATVAIAEDVNHVDHVVDEVHEQPQEPVTNHVGVDIEGFPGGPHDTSMLTSYVDHECTELKLVSHGRKVEKFEWHEPEIEGIVAATRLSSLITCSLNIGDKGLLSAFAER

SEQ ID NO: 207994 - protein, 675 aa, Glycine max
  Coding DNA Sequence Number=SeqID_91216
  Gene Ontology: Mol. function=RNA-directed DNA polymerase activity; Cellular component=chromatin; Biological process=chromatin assembly or disassembly
MECIEEAIAKLASNQLHITTNLDEIIQCITVLETSQQQSPSPSSSSTNPHPISPSSHLPRMMLKAPRFDGSDPSGWIFKINQFFKYHTTPEPECLVIASFSMKGLALAWFLLVLNICCEVQALQPLTLVQAAGLARLQEEKIAEHRHSFHGRMHSGPEPSSSFTAIFNSITFIDETASPTCQALISRGDGDLMVVVGNGNEVSCHHLYVGVAINIQGQLYTFNLHDLPLCGADLVLRFSALNAITVKDQFPIPTIDELLDELGGVCWFLKLDLLQGYHQILMKEEDMSKMNFRTHHNHYEFCVMPFGLCNALSSFQATMNSIFGPYLRKFIIIIFFDDILIYNQSFTEHLAHLEKAFEVLVVGQFFLKLSKCMFAQKQVEYQGFYRRFIKGYASIVAPLTRLLVKDQFYWLLEAHQAFDNLKSAICQAPILGLLDFSLPFVVEIDALGVGHTVILVVVDRFSKGIHLGILHPPSLYSLYGGTSLYGYCWQNSWNVAQLGVESRLVIHNCETIFAELKKKLVKAQQTMKYFADNYRREVQFHKGDWVFVKLWPCCQMSIIGATHSKLAKRYHDPFKVLQKIGSVAYQLKLPPDSRIHPVFTAPFSNLTISPPIWHVDVMKQPRSTQQSNNTKTEKLQIDTGETSTNQRPKRKINKPHHLKDFIELSMKKNDELAKD

SEQ ID NO: 207995 - protein, 57 aa, Glycine max
  Coding DNA Sequence Number=SeqID_91217
MKAPRCYDQNYEKDDPSIQCLGPSREKMNGGMKERRLAVQTKGLGEGKHEREGRGWV

SEQ ID NO: 207996 - protein, 101 aa, Glycine max
  Coding DNA Sequence Number=SeqID_91218
  Homolog annotation: Hit_ID=Q1RWU1; Match level="QueryCoverage=73%, HitCoverage=21%, E-value=5e-07, Identity=41%"; Hit description =Resistance-like protein HAAS-2-related
MRITMRGNHMLIAESLGRHYQWGSSIVRHQPERIVRQFGYVQTIPPLPVAPSLSIEEIDDRWLQFLEYLAPVGQICSAPGQCAADYMEWFYRISHPFMSLT

SEQ ID NO: 207997 - protein, 636 aa, Glycine max
  Coding DNA Sequence Number=SeqID_91219
  Gene Ontology: Mol. function=ubiquitin thiolesterase activity; Cellular component=nucleus; Biological process=ubiquitin-dependent protein catabolic process
  Homolog annotation: Hit_ID=Q1SM56; Match level="QueryCoverage=99%, HitCoverage=60%, E-value=0.0, Identity=69%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=UCH; Domain location=105-431; Score =149.6; E_value=8.2e-42; Accession=PF00443.19; Description=Ubiquitin carboxyl-terminal hydrolase
MTRLATRRKNKRQRQGDDGGGGTSDIWRKIHNTGAVTEDDINQLYMIWKPVCSGCRVNTKDNPNCFCALVPPTNGTRKTGLWQKVSDFVESLGPDPNMDLRASDSSPAGLTNLGATCYANSILQCLFMNKSFREGIFSVEPDVLQQQPVLDQLTRLFVQLHASKMAFIDSSPFVKTLELDNAVQQDSHEFLTLLLSLLEHCLSHSIIAKARTIVQDLFRGSVSHVTTCSQCGRDSEASSKMEDFYGLELNIKGLKGLDESLDDYLAIEELHGDNQYFCESCKTRVDATRSIKLRTLPDNTMKKKVTSAFSFPAELHMHHRLSEPSQFELMYDLSAVLIHKGTAVNSGHYIAHIKDVNTGQWWEFDDENVTNLGCHPVGEGSSSTSKSVKTDVLHSNCSGAMLADSNGLDATHSRSSPLETFSSSDAYMLMYHLKHSKNVGEKGGIVYGANLEEVAGNAVTAQDSACLPSHLCEEIQSFNASYLDSCEQYKHRKVLELSRINERRQEVRSILAEAPTQSLQQPYFWICSDWLRQWADNLIPIALDNTSIQCSHGKVPVSKVTSMKRLSSKAWDKLLSKYGGGPTLSHEDCCWDCLIDGAQNVVSADTYRDQRESLKRLARDILDGNCEDGMYYVSRP

SEQ ID NO: 207998 - protein, 362 aa, Glycine max
  Coding DNA Sequence Number=SeqID_91220
  Gene Ontology: Mol. function=ubiquitin thiolesterase activity; Biological process=ubiquitin-dependent protein catabolic process
  Homolog annotation: Hit_ID=Q1SM56; Match level="QueryCoverage=99%, HitCoverage=36%, E-value=1e-150, Identity=68%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=ubiquitin; Domain location=253-314; Score=5.7; E_value=0.069; Accession=PF00240.13; Description =Ubiquitin family
MPEQAVGAKRLLVPEDSGFSYIKMPFLLVKQMQRQNHEKLFVGKSMPLTLNCKYFLVPSSWISKWRNYINLAVKTSDKPETLDGVIDSLICEKHSGLIERLPELVITRGAIIPRESSVSGLTIISESDWKCFCEEWSGIETKGVSARIENVNDSENAFTGSCREMPICEDQLNTWDKVNNESRNGQIVIKTCPEVCESCIGEKESCELMQKLSYCNQDISVILVRGREVPRSILQASKGFVETDRRVSKRSRKTKNESSISLKVSASTSIYQLKMMIWESFGVVKENQILQKGDRTIDLDNEYATLVDVNIFAGDQIIVRDSEIHENRDIADELCDEEMETQRIEAGFRGTLLTSNGLSQVV

SEQ ID NO: 207999 - protein, 76 aa, Glycine max
  Coding DNA Sequence Number=SeqID_91221
  Gene Ontology: Mol. function=binding; Cellular component =intracellular; Biological process=RNA processing
  Homolog annotation: Hit_ID=Q1SXC6; Match level="QueryCoverage=64%, HitCoverage=13%, E-value=1e-09, Identity=56%"; Hit description =Tetratricopeptide-like helical
MADPNDGGILMQYAKLVWENHHDKDRKMVYFECAVQPTPQDSLPECPHVSVSQFFERAKVHSLGFGRCCGMPHCLP

SEQ ID NO: 208000 - protein, 60 aa, Glycine max
  Coding DNA Sequence Number=SeqID_91222
MKVAMSNDGSNEGCDRFQGRHRWVECVEMTLSTLRKKKKLIKLRQVKQIFVFTFYVLKKT

SEQ ID NO: 208001 - protein, 73 aa, Glycine max
  Coding DNA Sequence Number=SeqID_91223
MLRVTLKLNHIVTTIVTKRRVCILYSIARGSKVIESMATNNMSQKPILLSNLASSVKQVPSNFIKPFDDRSTL

SEQ ID NO: 208002 - protein, 88 aa, Glycine max
  Coding DNA Sequence Number=SeqID_91224
MAPRKLSTKRSRKDAAAEGTSAAPEFDSHRFRSTEHQQPFEAIKGWSFHRERRVQLRDDYSRVLCQCLAHGGGRVGPAVMGKGSVDSF

SEQ ID NO: 208003 - protein, 73 aa, Glycine max
  Coding DNA Sequence Number=SeqID_91225
MSNEELKLKDPRCRIQCPDILLENTGSAVQCKIKIFRKKIDLLQHQELAAQNRTRLYNHGGCTSSAPSPGLKS

SEQ ID NO: 208004 - protein, 86 aa, Glycine max
  Coding DNA Sequence Number=SeqID_91226
MTVADSIKTTLPKIESDKKFMGLVGEYSQTADKFVVGTLMSTLTTMKFDGSPTKGIKELKKKFMKKHDKDKWSLKNNDNSLQIQKK

SEQ ID NO: 208005 - protein, 159 aa, Glycine max
  Coding DNA Sequence Number=SeqID_91227
  Gene Ontology: Mol. function=transporter activity; Biological process= transport
  Homolog annotation: Hit_ID=Q4KCI2; Match level="QueryCoverage=99%, HitCoverage=32%, E-value=7e-45, Identity=58%"; Hit description=Outer membrane efflux protein family
MGGASQGRTRRSSRADAVSDRHWDGYVGVQVQIPIGDLSARQAEVHAKADADNQALLLEDAEQQLALDVNNAVRELASRWRQYEIAGRVRDLSRKKLEIEHQKLQAGRSSNFQVLAFETDLRGAENARLNALIGYLDAQAQLDLKLGMTLQSWGISLND

SEQ ID NO: 208006 - protein, 94 aa, Glycine max
  Coding DNA Sequence Number=SeqID_91228
MAKSDPEVVLEFYANAWPTEEGVRDMRSWVRGQWIPFDADALSQFLGDPLVLEEGQECEFSQRRNMADEFDEEAIAQLLCTPGQDFTRTAAGRR

SEQ ID NO: 208007 - protein, 85 aa, Glycine max
  Coding DNA Sequence Number=SeqID_91229
MSGKGLQHVRKSLSQYQRLRACLEIKWDTNWERGTQKLRHPYLQEHLKGGNATQKGTTSATWRWWEQQVHFGFKYFTAGNKTSGW

SEQ ID NO: 208008 - protein, 115 aa, Glycine max
  Coding DNA Sequence Number=SeqID_91230
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=72%, HitCoverage=15%, E-value=1e-40, Identity=96%"; Hit description=NADH -plastoquinone oxidoreductase subunit 2
MYGLIEATTKYLLMGGASSSILVHGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 208009 - protein, 199 aa, Glycine max
  Coding DNA Sequence Number=SeqID_91231
  Gene Ontology: Mol. function=transporter activity; Cellular component= membrane; Biological process=sodium ion transport
  Homolog annotation: Hit_ID=Q87M64; Match level="QueryCoverage=83%, HitCoverage=35%, E-value=1e-46, Identity=55%"; Hit description =Sodium:galactoside symporter family protein
MAIGVMGIVAAVLCLVAPMLTRRMQKRKLFMILCGLDVAVRVVMWFVGYQQVTMLFILLGLSTLFVMMTNILTSSMIADTIEYAEYHTHKRCAAITFSGQTFTGKMSVAVGGGLIGVFLTMIGYVPQAQIQSEGVLSGLFFGICLLPAMGSLIRMGFMSRFTFTEEKHAEICRLLAERRHHLKNSRAENERLERPAPAN

SEQ ID NO: 208010 - protein, 157 aa, Glycine max
  Coding DNA Sequence Number=SeqID_91232
  Homolog annotation: Hit_ID=UPI00005FA44B; Match level="QueryCoverage =97%, HitCoverage=40%, E-value=2e-59, Identity=70%"; Hit description =COG4268: McrBC 5-methylcytosine restriction system component
MAGFYHVHLPKKDWTVAAGKELKWRLTSQSAGSESIFPTMNSDIILEHRQPAQRIIIDTKFNNILIKGWYRDRSLRSGYIYQMYTYLRTQENRTDPLSLRSAGLLLHPAVNVMLSEFVEVQGHKIHFATVDLAADAVTMTQQLLKLAHDCCGIADVN

SEQ ID NO: 208011 - protein, 152 aa, Glycine max
  Coding DNA Sequence Number=SeqID_91233
  Homolog annotation: Hit_ID=Q1SPB9; Match level="QueryCoverage=98%, HitCoverage=27%, E-value=3e-17, Identity=34%"; Hit description =Transposase
METISKRFEKLDVCGKVHLKTKLREIAYPDLNSMCAPPEKVKTTGAPKKPLTKQQKSRKCDPSYWEYVDALNSVQNSNSLVKRSASSSEEPIQRQNIPMLDQFHQCIHDSIENIIDIKADGNYSYRAIAALLGMGEELWSLVRNHLHKELTS

SEQ ID NO: 208012 - protein, 157 aa, Glycine max
  Coding DNA Sequence Number=SeqID_91234
MVILRLFSSRGGGPEDMRRQIMRLTLSSAPLSSRGGEPNDMRRQIMRLTSSSAPLSSKGGRPDDMQEPFGPAPFHLLSSRGGGLDDMQEPFGPAPFHLLSSRGGRPDDMREPFGPGAFHLLSSRGGGLDDMREPFGPAPFHLLSSRGGRPDGMRGTI

SEQ ID NO: 208013 - protein, 112 aa, Glycine max
  Coding DNA Sequence Number=SeqID_91235
MSLQVLYLRAFSRSPPGDFRSVVSLVTIFQRNEHRFEAFSPHGQDHLGLPSGVKTKHEWQKPVKVLKDERKRGWGHDRPIVALLCAKQTGNVAARQLRILCILQLSFTICLF

SEQ ID NO: 208014 - protein, 49 aa, Glycine max
  Coding DNA Sequence Number=SeqID_91236
MRQWIHAHGDSSVAVDLMTGRMSPCKDDHEACPVVERQCKVLGLADSNG

SEQ ID NO: 208015 - protein, 32 aa, Glycine max
  Coding DNA Sequence Number=SeqID_91237
MVLVIAGPPSSSLPRWSSLALQALLHVTMLRC

SEQ ID NO: 208016 - protein, 184 aa, Glycine max
  Coding DNA Sequence Number=SeqID_91238
  Homolog annotation: Hit_ID=Q1SHM2; Match level="QueryCoverage=47%, HitCoverage=18%, E-value=1e-25, Identity=65%"; Hit description =Leucine-rich repeat
MGRLNTNKVCMVGLKPRQDNSANLHLSIRVEENLDDLASKRCDNWGTTKEGGAPSSRCHWLAIRESHRGSDDAMVAEVLLEEWWRTRNKKKRRNIGEGPSVCFTVPEDFCMKGMALCVVHVSTPEIVATKCLTSVVIVNCTKCTIQIYKRDTVISFNDEDWRDIISHLGAGDKVEIVVTFEHRL

SEQ ID NO: 208017 - protein, 48 aa, Glycine max
  Coding DNA Sequence Number=SeqID_91239
MKFLSDGDVILPRRGPITRAMARRLQEDWVRGVGESPRVLMSLRGSIV

SEQ ID NO: 208018 - protein, 134 aa, Glycine max
  Coding DNA Sequence Number=SeqID_91240
  Gene Ontology: Mol. function=ATP binding; Biological process=defense response
MEGNLKLSKLDGGNKEDHTSFEIVVGNLRNINKQVIVTLSTCEVEYIVATSCICLRRLKEFNMDQEKSIKIHIDNKSAQVLANNLMFYEQSKHIGTIYHFIRECVARKEVELVHVRTQDQVADISRNSSNLKIL

SEQ ID NO: 208019 - protein, 58 aa, Glycine max
  Coding DNA Sequence Number=SeqID_91241
MSNERWKDTKEGLLLKAISNNMELIMMKCLHWLLGKREGIEIEKGIVWPAKASTKGME

SEQ ID NO: 208020 - protein, 56 aa, Glycine max
  Coding DNA Sequence Number=SeqID_91242
MGPGHNHGCLGATRRWGGEVDSHHRSQMLVKADEPKTKTILNKFQIKFQTKILNKK

SEQ ID NO: 208021 - protein, 38 aa, Glycine max
  Coding DNA Sequence Number=SeqID_91243
MTVKKRLSHEVLKVTVELSSSVGLSVHPSLSAASARLA

SEQ ID NO: 208022 - protein, 57 aa, Glycine max
  Coding DNA Sequence Number=SeqID_91244
MSLGLLRLKRGLPMAPSLTILAHIALSMPRLSELVFITHPLSSSCSCVEVHLSEACH

SEQ ID NO: 208023 - protein, 205 aa, Glycine max
  Coding DNA Sequence Number=SeqID_91245
  Homolog annotation: Hit_ID=Q1SMF0; Match level="QueryCoverage=83%, HitCoverage=32%, E-value=3e-19, Identity=34%"; Hit description =Tetratricopeptide-like helical
MDEEQWMYDSIIYEEVDMNVENEEDAGMKLFASCDEVLHWTRPMTHDIGFVVVIMTSDTNTGVRGRALFLLIACERSGEYRPKKNDLVRTCTDSGKCGCPFKLRVKPVLGGEGCMVKLICGVHNHEMPKLLVGHPYAGRLTKDKKIVVVDMMKSMVKPRNILLTLKEHNANSYATIKQIYNARHAYRSSIRRSNTEMQQLMILLD

SEQ ID NO: 208024 - protein, 99 aa, Glycine max
  Coding DNA Sequence Number=SeqID_91246
  Gene Ontology: Mol. function=transition metal ion binding; Cellular component=cytoplasm; Biological process=fucose metabolic process
MGRVTKASLHCFRWCRICFQRKTRCQKYQAKKILCPMGMEYKKIHACLNDCILYIHEFEEMQKFPRCGVSRYKVKDDDKCSCDEGTKKGDAILPPKGIG

SEQ ID NO: 208025 - protein, 150 aa, Glycine max
  Coding DNA Sequence Number=SeqID_91247
GSLTTRVYCRCLLADAVGLRRWRHHYHRHSPFSSPREQRITYLEEDHATKNKKKNCDPGTTTNHQQQQQAERSNVHEKQRNKKQRSRGRRRSREAKDEEEADAALEEVTCEGHFSPFTYVAGCPNKNAGCPKQHPLVIYFLVFGHFVNVF

SEQ ID NO: 208026 - protein, 98 aa, Glycine max
  Coding DNA Sequence Number=SeqID_91248
MHSLNDKLSPHALRNYTIPTMDGTSGNAILATIINIRNRDAIMATTNSQNRDAITVAGNATIWATITNIQSPHQGLYINIYKQTTRDSKGCANTNNES

SEQ ID NO: 208027 - protein, 108 aa, Glycine max
  Coding DNA Sequence Number=SeqID_91249
  Gene Ontology: Mol. function=zinc ion binding
  Homolog annotation: Hit_ID=Q1SXA1; Match level="QueryCoverage=94%, HitCoverage=27%, E-value=2e-15, Identity=39%"; Hit description=Zinc finger, SWIM-type
  Pfam annotation: Domain name=SWIM; Domain location=55-87; Score=15.6; E_value=0.0092; Accession=PF04434.8; Description=SWIM zinc finger
MITFGQVSTLVLNKAMEDAWRKKNSHIVLEFNRCDTQFLVQETINPREVWPVGNFTVRLDEKWCDYGKFQKVNMPCSHVVVACKHVHHEYENYKYHVYTLESISNMYK

SEQ ID NO: 208028 - protein, 120 aa, Glycine max
  Coding DNA Sequence Number=SeqID_91250
MGETCEIPHHNLADFESCLGYATEGQAVGGIPLQNTLEGPQYHPQPHPLHSTVGKNPHAMAEIGKLDHLEERLRAIEGGEDYAFANLEELFLVPNIITPPKFNVSDFDKYKGTTCNQEPG

SEQ ID NO: 208029 - protein, 121 aa, Glycine max
  Coding DNA Sequence Number=SeqID_91251
MWTTTGEELATQLAQATKVASSRSNSLLEEGYGRPKWARLLFATPLLTKCTPFYSPAFEEVTKTHGLRKNTSFRLPPHYGISRIAQACFLLISETSQDFIYCATKDTKYLKAANQRFHVIK

SEQ ID NO: 208030 - protein, 91 aa, Glycine max
  Coding DNA Sequence Number=SeqID_91252
MVGYTPSSFANLVFASERIKVGLKRGKFDHLALMNEKIGANEEDENEGETLAVTAIPTRPNFPSAKQCHYSASISPSHYPPPNHPQRLSLN

SEQ ID NO: 208031 - protein, 93 aa, Glycine max
  Coding DNA Sequence Number=SeqID_91253
  Gene Ontology: Mol. function=DNA binding; Biological process=DNA integration
MSTSCYLNPDEKGKHVDESKYRGMIDSLLYLTTSHPDIMHSVCVCARFQANPKESHLVAIKRILKYIKGCKVHRKSSSGTCHLLGSALVSWHS

SEQ ID NO: 208032 - protein, 110 aa, Glycine max
  Coding DNA Sequence Number=SeqID_91254
MVTITMEEAMKWCEIVITTTTTRWRQQNSGDGGTRGNGEGRAGKVVVVMVIMMVKMLSMMDSNSPFLPHCNSDTKNAFRKPSGDAANRNYRRRSPVEGSPSPDGWDLLSC

SEQ ID NO: 208033 - protein, 322 aa, Glycine max
  Coding DNA Sequence Number=SeqID_91255
  Gene Ontology: Mol. function=sequence-specific DNA binding; Cellular component=intracellular; Biological process=regulation of transcription, DNA-dependent
  Homolog annotation: Hit_ID=Q13NX6; Match level="QueryCoverage=95%, HitCoverage=95%, E-value=2e-89, Identity=57%"; Hit description =Transcriptional regulator, AraC family
  Pfam annotation: Domain name=AraC_N; Domain location=31-184; Score =216.9; E_value=4.5e-62; Accession=PF06719.3; Description=AraC-type transcriptional regulator N
  Pfam annotation: Domain name=AraC_binding; Domain location=30-178; Score=-5.4; E_value=0.1; Accession=PF02311.9; Description=AraC-like ligand binding domain
  Pfam annotation: Domain name=HTH_AraC; Domain location=199-245; Score= 32.3; E_value=1.7e-06; Accession=PF00165.13; Description=Bacterial regulatory helix-turn-helix proteins, araC family
  Pfam annotation: Domain name=HTH_AraC; Domain location=251-295; Score= 19.6; E_value=0.011; Accession=PF00165.13; Description=Bacterial regulatory helix-turn-helix proteins, araC family
  Pfam module annotation: Pfam domain module=AraC_N::AraC_binding::HTH _AraC::HTH_AraC; Domain location=31-184::30-178::199-245::251-295
MNSGECWHAHDRDRTITLLSALTPTEGFTLTALDGVKLMRWNRAIPRSPVFYEPSIVFVCQGRKIGYLGGEVYQYNPQQFLILSVPLPFESETIASAEEPLLAISIRINLSMVSELLLSLTHDAPVNINGKSGISSTPLDMRLSNAVVRLLECLQSRTEAAVLGQSIIREIHYRILQSPQASAILAAHSTHNNMGKISKALRLIHAEYANELNVDKLAAESAMSVPSFHAAFRDVTATSPIQYLKKTRLHKARLLMVQDGINATLAATKVGYESASQFSREFKRMFGKSPMEEVSAVRSALITSPGEFVANQGVDQYVTVQQ

SEQ ID NO: 208034 - protein, 131 aa, Glycine max
  Coding DNA Sequence Number=SeqID_91256
MFPVAFAVVEIEIQQKGLSRTVAKSFSYARQRSLVVKYAGNDKFQLKVEYINTMVKLNDKMFGFNQWNLTRFPGKHIIHPMPKIDANSNSGDYPDIGPPNLTKLAMKGHVGSMLFPSIKTLTELMGQGKHV

SEQ ID NO: 208035 - protein, 207 aa, Glycine max
  Coding DNA Sequence Number=SeqID_91257
MIMRGQDIYSSQDEATTLPSSSESEEAKGEESSEEIYPQEEGQPLMVKEECKEASVFSKRLATKERHFEIKTNIKVISPLRQPPHFLLCEKTLVSIATPLRLEVYSSSIIRHQIPEIGGMMNVLSGATLFCKITRAPNIFMICVHRNSLGSDQGVPMNPKRIKVIPEWPTPPSVEKKSPEFQKPQDLRSNPFQGGGNDAILPHKGIG

SEQ ID NO: 208036 - protein, 121 aa, Glycine max
  Coding DNA Sequence Number=SeqID_91258
MGIVVWVYFHRRGIREQGYLVVMGLRKGKVMGCLGNSGLGCKEMERCYGVRVGGDKGFGRKPQRGTCGQRPVQRRWFPSPTVTKNWEIRAIKSYRWEASRGCIILWELLVVWLGILNLNLN

SEQ ID NO: 208037 - protein, 111 aa, Glycine max
  Coding DNA Sequence Number=SeqID_91259
MEPEETTTTLHIPSCIVNPTKLPQATIMNPPKTIVTPNQQKLECIQENSWVIELDTVVFTTRDSIVAIVANVSGGSEVEAYLMMGILARVSNRASNKVISVVSIETCALIG

SEQ ID NO: 208038 - protein, 126 aa, Glycine max
  Coding DNA Sequence Number=SeqID_91260
MSQISNPRENSGGNVVDLDLISQFQEVLMDIEIEGYEFTWTNKRKGADLIEEKLNKAFVNNMQRDQYPIILNMLVSQQQRLQKRLGEVQKMTQNDVVMEMEANIERDMDECLKMDEVYWSQRSRAE

SEQ ID NO: 208039 - protein, 274 aa, Glycine max
  Coding DNA Sequence Number=SeqID_91261
  Gene Ontology: Mol. function=isomerase activity; Cellular component =membrane; Biological process=protein folding
  Homolog annotation: Hit_ID=Q1H039; Match level="QueryCoverage=70%, HitCoverage=70%, E-value=1e-66, Identity=64%"; Hit description=PpiC -type peptidyl-prolyl cis-trans isomerase
  Pfam annotation: Domain name=Rotamase; Domain location=192-274; Score= 121.1; E_value=3.1e-33; Accession=PF00639.11; Description=PPIC-type PPIASE domain
MMTRSYMLAFMGRSWSNHLEKPCHKCYAQKLNNVYRHWPLKLWKFKMTVSFTADTQETQAAGTTPSSALPHVYAADADAVATVNGKPIKKSWVDFILKDAEARTGQKANDGMKAAVVNELVGSELAYQEAQKAGIDKQPDFIASEELARRKLLVNAFLADFIRKNPVTDAEKKEGYEQYKKELGDKEYNARHILVKTEAEAKAIIADLKKGTDFAKIAKEKSQDPGSKDKGGDLGWFSPAGMVKPFAEALVGLKKGETTPEPVQSQFGWHVIKL

SEQ ID NO: 208040 - protein, 98 aa, Glycine max
  Coding DNA Sequence Number=SeqID_91262
MEELINKTQLFPKIITTSSRRLGGSTKESHFSYSIVVILLPQTKVHDYHSLCLKGVPNRVTCPQVQAFLLMRNYKYLLTMFILFPCHMKYETWAPSMH

SEQ ID NO: 208041 - protein, 120 aa, Glycine max
  Coding DNA Sequence Number=SeqID_91263
  Gene Ontology: Mol. function=nucleic acid binding; Biological process= DNA integration
  Homolog annotation: Hit_ID=Q1S9I4; Match level="QueryCoverage=82%, HitCoverage=12%, E-value=1e-09, Identity=34%"; Hit description =Integrase, catalytic region; Zinc finger, CCHC-type
MVAGSTTIEKPREQWDVEEKKMNPNETIQDMQKRFTHIVNHLASLGKIFPNEDLINKVLRCLSREWQPKEHEMELMRLNQHEENDKKKKGIALKASSSIQEGSDKEDSNEIDDDLSLFVK

SEQ ID NO: 208042 - protein, 87 aa, Glycine max
  Coding DNA Sequence Number=SeqID_91264
MARRDKLWSFCTLLSSRGGEPDDMQRQIMVIARTFSPSGDDRVRWHAETNYGHSAPFRHPETIVSDGTQRQIMVILRLVSTERNEFG

SEQ ID NO: 208043 - protein, 74 aa, Glycine max
  Coding DNA Sequence Number=SeqID_91265
MHTSEPYTGAMKGTMHKPQANLGQIRSSHLIGSLLQGFDGLIVEASFMMMNLAILTMPKDQVIDSRLQDQASRI

SEQ ID NO: 208044 - protein, 102 aa, Glycine max
  Coding DNA Sequence Number=SeqID_91266
  Homolog annotation: Hit_ID=Q9LL84; Match level="QueryCoverage=75%, HitCoverage=6%, E-value=4e-35, Identity=88%"; Hit description=DNA ligase 4
MVYHNLLNILNFSASFSLRKYEYPKKRPPSFYQVTNHSKERPDVWVDSPEKSIILSITSDIRTIESEVFSAPYSLRFPRIDRVRYDKAWYECLDVQCKGFAK

SEQ ID NO: 208045 - protein, 436 aa, Glycine max
  Coding DNA Sequence Number=SeqID_91267
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=94%, HitCoverage=92%, E-value=0.0, Identity=91%"; Hit description =Ribulose bisphosphate carboxylase large chain precursor
  Pfam annotation: Domain name=RuBisCO_large; Domain location=139-423; Score=703.2; E_value=1.8e-208; Accession=PF00016.10; Description =Ribulose bisphosphate carboxylase large chain, catalytic domain
  Pfam annotation: Domain name=RuBisCO_large_N; Domain location=7-131; Score=239.8; E_value=5.8e-69; Accession=PF02788.6; Description =Ribulose bisphosphate carboxylase large chain, N-terminal domain
  Pfam module annotation: Pfam domain module=RuBisCO_large::RuBisCO _large_N; Domain location=139-423::7-131
  Subcellular localization annotation: CTP_CleavageSite=23; ConfidenceScore=5.22e-01
MITPSLKLTLTKGNKSWYRAPPRAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 208046 - protein, 255 aa, Glycine max
  Coding DNA Sequence Number=SeqID_91268
EFDISPKKLPETDERGTNDFDHDPLRQLIKSLYFMYGTPVELKWDGSKFGLSNVDASFFLTFSDVNEIVAGYKCLNISILQLWMLFLDEWSSTLGHASVYGFLEPQSIHHAKDRRAECEHYLQAWLKESQREVYLGAYLNQQGSLATGSTVSCDQCCCMVLFVTAMKSANTTADGTNNPATPKWIEVKSHVQSGGYECGYYVMHWMWNIVSGGLKNYWSMWFLDGTALDNETITTIRQKWAAYFLKVQSNQCTKS

SEQ ID NO: 208047 - protein, 651 aa, Glycine max
  Coding DNA Sequence Number=SeqID_91269
MAKVPHIQEFPYLETDTRKKLDGFTVFSNGKTEDMSEENIGKRDLKSLESEQKYDFRKSLAWDSAFSTSSGILEVEDLFDSSNSWHIQNGCDMLGPEQDQHLSVNYLKPEIKTVTDEFNLRKSLAWDSAFFTSEGILNHEELSLLNKGPKKSEIDMFPRIEELWISSDSNCTIDSDGSSLASLEVSMHQSRVAPSTVALSSRNIQKVYSTKRMNGDGVSKLKVKSRPTSTMQTIKNNQPERTTKEQSVPPSSMFSAASGIPNLASHLKPPKISRRVRRSVPIAPTKRVPLFSNEVNGESKTFKPSGKCLTEKPNLFKTCSSDNNSSCTSLSWEFSSLSSQSCMNGSNGLCSPYRKLSTRQSSPEFSIVKNDTPNSNSSKHRTTNKITPEDCCHQTCSSVKKNCCCISPLVSIEGFSPASSMSESNSFHDDKGIMCSNPCSEVKGTHSVSFDASRNLKPSGLRMPSPKIGFFDVDNLLMSIENGGNKSHSKAFSKLQSGQKLKDVGITRTCAWKTRNSTISKTIKFSRGAVSKAEEGKDCLRNDEKIVNVMRAHEPELERQTCAKIDKRGVGSKILREREEQSCLKGKKLLLKEQTRANTIHTGNDQHPHTLHESEKENLIGFENELEQVRKHDVRGDVVIEFVDKNCQSEK

SEQ ID NO: 208048 - protein, 267 aa, Glycine max
  Coding DNA Sequence Number=SeqID_91270
  Gene Ontology: Mol. function=DNA binding
  Homolog annotation: Hit_ID=Q1RTB4; Match level="QueryCoverage=65%, HitCoverage=49%, E-value=2e-20, Identity=28%"; Hit description=IMP dehydrogenase/GMP reductase
VEVSMEPIASLAQYYGQPLRCFIFGDFQLSPMVEEFEEILGCPLGGRKPYLFSGQVENGVVGIPRKYLEGVLFPNVDGLVDLAAIDVFLAYHNHKESPVVAMLADLYDTFDRRCEESNARIVCCTPALYVGLEGRIKILSSCKGCPNVPLMGTRGCINYNPVLAIRQLGYPMRGAPLDESITPFIARGFSDHNARDRELRGSSNGIIGGYHKWLRVRTQGLDWLPNLKTVRDDEVKASEESDEVQALKAKLERARVVEEKFKSIAIK

SEQ ID NO: 208049 - protein, 122 aa, Glycine max; identical to SEQ ID NO: 178306
  Coding DNA Sequence Number=SeqID_91271

SEQ ID NO: 208050 - protein, 71 aa, Glycine max
  Coding DNA Sequence Number=SeqID_91272
MEIDSQTDEITLVTIKNKVSHAVTKDDLQKTVMQSYPARALDRKLQVDWVRDAREGPSVLMSLRVDFGPMG

SEQ ID NO: 208051 - protein, 101 aa, Glycine max
  Coding DNA Sequence Number=SeqID_91273
  Gene Ontology: Mol. function=DNA binding; Biological process=DNA integration
MRIVETGNARFIENGEINKSTIPQDVEIKKVKVKVPLTCVSSKLPKGCNRVGCKWIFKTKCDSHGNLERYKVRLVAKGFTQKDDIERRFYRFYKRILSGLS

SEQ ID NO: 208052 - protein, 154 aa, Glycine max
  Coding DNA Sequence Number=SeqID_91274
MASRKCKSIGSRPTTQYDTRRFSSLDAWTRYTDNILGRNILLERKVELYHTELDDFKAELERHNFHKRLTNLVDGSIDLALVKEFYANLYSSEDRPPKQSRVRGHLVKIDADSLNTFLEIPVVLAEGETLPAYSRYCRLPTDFREIEAALCIPG

SEQ ID NO: 208053 - protein, 68 aa, Glycine max
  Coding DNA Sequence Number=SeqID_91275
MAALEFCALAILCKCVEAVIKALVSRLAWLKAPVALSLMLMLCQILLCAKCAEVALSGGYALSRTATF

SEQ ID NO: 208054 - protein, 74 aa, Glycine max; identical to SEQ ID NO: 185508
  Coding DNA Sequence Number=SeqID_91276

SEQ ID NO: 208055 - protein, 154 aa, Glycine max
  Coding DNA Sequence Number=SeqID_91277
MACGDHRNHPLSLFSRLLQSPSHLETIKSDGMRRASWSPAFIVFETIKVSFAFQRQSSLLAHGDKTCSFAPFPSRDNQVSWHVETIMRQSSPLACRDKLWSYAPFRRLQCLSTETINDQILPRKGPVTRAMSKRLQEDLARDAEEGPRVLMNLR

SEQ ID NO: 208056 - protein, 215 aa, Glycine max
  Coding DNA Sequence Number=SeqID_91278
  Subcellular localization annotation: CTP_CleavageSite=31; ConfidenceScore=5.43e-01
MLSFKKKLSGGNGPSWASAASSASCCAFRVRIMHTSMTTLTQIWMTLLLSNILPSDHNSNLPLPKCQLVYAIMTQVSVHVTQLISDAIYQFAGITPSRHPVDPKKSNRALGFPALITGLCQFYGVFVAPAKLTRPPIRRAFFEKYCIPRHAQGQAPQQPVVDAPPLPLEESQDPCPFPWPTPEQFRATVAWPGDETNFEGAQGDDDMADVLDLFT

SEQ ID NO: 208057 - protein, 334 aa, Glycine max
  Coding DNA Sequence Number=SeqID_91279
  Gene Ontology: Mol. function=RNA-directed DNA polymerase activity; Biological process=RNA-dependent DNA replication
  Pfam annotation: Domain name=RnaseH; Domain location=171-312; Score= -14.7; E_value=0.0014; Accession=PF00075.14; Description=RNase H
MCLNPKKYTFKVSRGNFLGFMITHRGIETNLDKCTTILEMHKLTNVREVQKLNGRLTFMSRFLLKLAEKARPFYKSLRKTRPFLWGEAYKQAFLAFKKMIASLLVLSQPKLRKLPDGKEGGISAHNLGPMPQAIFSEPPSHCQDRSSHQTCVAKAWTCWKDDFVGNAQATPEWWNLYVNGASNVKGSRAGIILEGSDNVTLEQALKFNFKASNNHAEYEALIAGLKLAKSWSQEAKVRPLQEISASEVEKFTWKHIICKYNLLYAIVTNNGTQFKPQAYEEFLRRLSVKHLVTFFKHPHTNAQAEAATKVILKALHTRLDKSKGLWKEELPSIL

SEQ ID NO: 208058 - protein, 68 aa, Glycine max
  Coding DNA Sequence Number=SeqID_91280
MFRCYKDLLRVKNDLADNVENTTVEKEELTVIVAKSTKDVKDTELLDKEEITATEEDVGEERDDRTSV

SEQ ID NO: 208059 - protein, 79 aa, Glycine max
  Coding DNA Sequence Number=SeqID_91281
MGVSLVDSPKARQTQGPSLVSLAKTQDGIGASLVDSPKARQTQGLPLGSLAKIQDEHAPCRISKRLDKPKVALSEPPYC

SEQ ID NO: 208060 - protein, 161 aa, Glycine max
  Coding DNA Sequence Number=SeqID_91282
  Homolog annotation: Hit_ID=Q9Z621; Match level="QueryCoverage=46%, HitCoverage=47%, E-value=3e-29, Identity=80%"; Hit description=CigR
  Pfam annotation: Domain name=DUF1236; Domain location=96-157; Score= -8.1; E_value=0.085; Accession=PF06823.3; Description=Protein of unknown function (DUF1236)
MNKRRTTLTVLALIASLGLSSAPALADKGGNGNGNGNGHGNSGNHGNSGNHGNNGNKGNKDKGGYRNDDNLVSVSLSRDRARSLARNYGLTGYSSLPPGIAKNLARGKPLPPGIAKKVVPYSMLRDLPQYPGYEWRIAGDDLVLVALSTAIVASVINGVFD

SEQ ID NO: 208061 - protein, 131 aa, Glycine max
  Coding DNA Sequence Number=SeqID_91283
YHKERDGSWVKKDAPVQAVEDRSPSPPPQRNDSSSLMHNILDRLDGLHTFVGERFDSLDSRIDAMDARFAGIDTCITKLKEDDCHHQKEGDCGSNAFQDYFDDAKRIKSQASFKNQDQDSRFKNQEKSQSR

SEQ ID NO: 208062 - protein, 551 aa, Glycine max
  Coding DNA Sequence Number=SeqID_91284
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=96%, HitCoverage=39%, E-value=0.0, Identity=56%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam module annotation: Pfam domain module=RVT_1::RVT_2; Domain location=80-287::56-313
MRSQRVMQPSQMLKDYEVMKDSQITYEGDIVHFALYADDEPMSFEEALKNDKWVNAMKEELKLIETNHTWQLMELPKLKRPIAVKWVFKVKRNPAGEVVKHKARLVAKGFLQKKGVDYGEIFAPVARIETVRLVVAIASMKGWSMYQLDVKSAFLNGPLEEEVLVKQTPGFEVVGHEGKVYKLKKALYGLKQAPRAWNKKIDSVLIQIGFSKCISEHGVYVKGEYESDLVILCLYVDDLLITGNNKIEIDKIKQLLKNQFEMTDLGSLSYFLGIEFKETEAGIVMHQSKYATDLLKKFRMTNCNATATPTETGLALSLRDEGEPVDETQYRQIVGSLRYLCNTRPDLAFSVGLISRFMQAPKTPHMMAAKRILRYIRGTINYGILLPNTITNSNMELVGYTDSDWRRDNDDRKSTAGYIFLLGDALVSWSSKKQDPVALSTYEVEYIAASMCSCQGLWLRKLLKEMKIQKTEAINILVDNKSAISFAKNPIDHGGSKHIETRYHFIRDKVSKGKVKLLYCKLEDNLADLLTKPLKKNKFEDLRNKMMIMIE

SEQ ID NO: 208063 - protein, 63 aa, Glycine max
  Coding DNA Sequence Number=SeqID_91285
MHSRQQNQNISWNPTTGNQTKWYQELGERQQSKGLRETVVQKYGVATPSDDVALIEAQQKEYE

SEQ ID NO: 208064 - protein, 163 aa, Glycine max
  Coding DNA Sequence Number=SeqID_91286
  Pfam annotation: Domain name=zf-CCHC; Domain location=123-140; Score =24.7; E_value=8.4e-05; Accession=PF00098.13; Description=Zinc knuckle
MKKKYQGSSRVKRAQLQALRRDFEVLQMKKESNDINDLSLDELQSSLLVHEQKINKKSTMEKHALKASTNSTHSNNSRGRGRGRGRGRGSGERGNRDFNNNFKDNNDQSQGNGRGRDHYKSKVQCYRCHKFGHYASNCYTRLPNLKEKGKAQILSRRKKWKPY

SEQ ID NO: 208065 - protein, 38 aa, Glycine max
  Coding DNA Sequence Number=SeqID_91287
MRNLPITSAKSRDTCTKECPKYAAWRVKKGFPVEPTTK

SEQ ID NO: 208066 - protein, 195 aa, Glycine max
  Coding DNA Sequence Number=SeqID_91288
  Gene Ontology: Mol. function=DNA binding; Cellular component=proton -transporting two-sector ATPase complex; Biological process=DNA integration
  Homolog annotation: Hit_ID=Q1T2W1; Match level="QueryCoverage=95%, HitCoverage=25%, E-value=5e-62, Identity=58%"; Hit description =Integrase, catalytic region; Asp/Glu racemase
MENPTKMHLLVAKRILRYLQGTREFELFYKRGEKFNLLGFTDSDYAEDSDDRKSTFGYVFMMASTTICLSSRKQPIITLSTTEAEFVATSTCACQEIWLRNILEEVHFKQQGPTLIYWDNSSTIKLSKNPIMHGRSKHIDVRFHFLRDLSNEGIIDLIYCKSEEQIVDIMTKPLKLSAFQKLRNLLGVCMLNESH

SEQ ID NO: 208067 - protein, 120 aa, Glycine max
  Coding DNA Sequence Number=SeqID_91289
MKLAYEINLLVKHWREAHCEVPGISGGVVLNSIVEEEIRKDFEVLLIHWKEALHKAASILSLPKWPSGNNLNVNNPPSTLNPVQDPMSLFYANPNENPTTSIVSSPLIGTNHHKWAQAMQ

SEQ ID NO: 208068 - protein, 99 aa, Glycine max
  Coding DNA Sequence Number=SeqID_91290
  Gene Ontology: Mol. function=protein binding
  Homolog annotation: Hit_ID=Q1T2X1; Match level="QueryCoverage=81%, HitCoverage=12%, E-value=1e-20, Identity=62%"; Hit description =Leucine-rich repeat
MEIVVPRYVNNRQCSNVEDLMWKCSSQPAIIKTKDGEIFVMGKCFGHWDDNLFQSRTMIDILSTLFKEGSKGHERPHHDMLNSYRGTPGGGQRQRLRHK

SEQ ID NO: 208069 - protein, 73 aa, Glycine max
  Coding DNA Sequence Number=SeqID_91291
MKTSWRPLGLKKIGTHRTKGCQWARRSILADPFYISGIRTELAFENVAYFLCWVVWGFLEYASANESNLSRLV

SEQ ID NO: 208070 - protein, 375 aa, Glycine max
  Coding DNA Sequence Number=SeqID_91292
  Gene Ontology: Mol. function=transferase activity, transferring nitrogenous groups; Biological process=biosynthetic process
  Homolog annotation: Hit_ID=Q93AP5; Match level="QueryCoverage=73%, HitCoverage=77%, E-value=3e-96, Identity=57%"; Hit description =Putative aminotransferase
RLLKPTPILRQVVEQLIKPGSAPLIGRGRRRHRQRVEYIQPVGVQPIDKRLPKPGIGDQEIRNAQRGKAERFAGGRRRNHPIAIFLAQMQHRRKRLAGQQQVGPNFIGDHRDVMGVAERHEPLQFIAAPATAGWIVRVAQQQQRRFTLRQAGGQLVEIDPLDQHRQPRHHPFNRREPLAPQRQAVPLGKPVDCRLVVGVVAFAVAKDAVVHPLMQRLLHLWRARKVEIGHPHRQQFAAVQLQIAVDEVPLHGAGVVAIDDGVEMTRHVRLPYAASRSEIEGADPQRGGHVNAGGRPRDQRFDDGARIFDGARQIFVVQPHAPIGPFEQLRRDQQRQLAVAGRAGHQDSGGNGGGDQLAGGVHHVQQPADDHRQRA

SEQ ID NO: 208071 - protein, 100 aa, Glycine max
  Coding DNA Sequence Number=SeqID_91293
HRCWICINTTLKKSWPCTKRVHNYEKLIDPGDLETKRSLEQRTHYFSMPTTKTMIMRGQDKATTSPFSSENEEAKGEESSEEIYPQEEGQPLVVKEECNE

SEQ ID NO: 208072 - protein, 257 aa, Glycine max
  Coding DNA Sequence Number=SeqID_91294
  Subcellular localization annotation: CTP_CleavageSite=37; ConfidenceScore=5.27e-01
MCKLIWVWVGLEASGGSVSGSMLGSDSRKPSSSSKPRSRHKVNSSWDKRLMDTEGVGFEGVGTKGEGGDRRGVECLGTFIPEVRPDQFLAPTLMDEEPVPHDKFLRTNGIFVLRRGEASLRGLKETRPRGELPIAGHPLEPSKGTTIHIKRRNGETLMFRGGFVPSNLKTSSFIWCDEDRDTGEGMAEEEEGHVLDCFTEGNLVCSELGNGFLKPVGIGFGPSGFIHGNRTTRAPNLLRVEKIELASRANDLLEEKE

SEQ ID NO: 208073 - protein, 259 aa, Glycine max
  Coding DNA Sequence Number=SeqID_91295
  Homolog annotation: Hit_ID=Q0KIN0; Match level="QueryCoverage=53%, HitCoverage=8%, E-value=8e-18, Identity=34%"; Hit description =Integrase core domain containing protein
  Subcellular localization annotation: CTP_CleavageSite=60; ConfidenceScore=5.42e-01
METGNNKPEKGSLLVSFNLASEQVAAVRRRAARRRQLRRFSPARPGFGSPRKARSTPGTRAAVGRRTRPHAPPFLRAISGACCSRAAVPASGAVPSGPGSLAVTSWTCFRLQIPLPASRLLWFLGQGHHDHLEKTSDFVSDDKRAEWEKLDYQLCVVLWQSVEPDILEILRSFKSCRSFWKKAQEIFANDIQSLFDATMKVTALKQTGHDMIAHVGKARAAVEELRKFLVADSLEEVNRKLDKFYMVLILRSLHSDFDH

SEQ ID NO: 208074 - protein, 185 aa, Glycine max
  Coding DNA Sequence Number=SeqID_91296
MVEWYSSLVYVEGRDELYEICGYMAKRVLDFIGYIASGVSHLDRILIPYIGPPSPFLASTKKKAFTLCARAVRIFFSDGSLSGESVDNESEVHGYNNEVFEVLFDSYSLGSNFSSSIDHLAIEGSSDFLAFLSLLLEKVSENIVAPMLVPAVEKGTSMKVAPWPKKCPMLKDKCSPPPITLLKYN

SEQ ID NO: 208075 - protein, 649 aa, Glycine max
  Coding DNA Sequence Number=SeqID_91297
  Gene Ontology: Mol. function=protein transporter activity; Cellular component=nuclear pore; Biological process=protein import into nucleus, docking
  Homolog annotation: Hit_ID=Q84NP8; Match level="QueryCoverage=99%, HitCoverage=63%, E-value=0.0, Identity=57%"; Hit description =Putative Ran binding protein 11-like
  Pfam annotation: Domain name=IBN_N; Domain location=29-104; Score =69.2; E_value=1.3e-17; Accession=PF03810.9; Description=Importin -beta N-terminal domain
MALSASDVAAMYSLLSNSMSTDHRLRGPAEDALAQSESRPGFCSCLLEVITAKDLGSQTDVRMMATVYFKNSVNRYWRHRRNSSGISNEEKMHLRQKLLMYLREENDQIALMLAVLISRIARSDYPKEWPDIFLVLSQQLQSADVLASHRIFLILFRTLKELSTKRLTSDQRNFAEGSKEVLSVSCWKLGCSWRLWQSDMQTILHGFSSLSQSCNLNAEDQPHELYLTCERWLLCSKIVRQLIISGFQSDSKCFQEVRPVKEVSPVLLSAIQSLLPYYSSFQKQYPKFWDFVKRACTKLMKILVAFQGRHPYSFGDKFVLSSVLDFCLNRITDPDPYLLSFEQFLIQCMVMIKNILECKEYKPSLTGRVMDENGVTLELMKKNISSAVGGVLTSLLPTERIVHLCNVLISRYFVLTASDLEEWYRNPESFHHEQDMVQWTEKLRPCAEALYIVLFETNSQLLGPVVVSLLQESMNNCPTSVAEITPALLLKDAAYGATAYVYYELSNYLSFKDWFNGALSLELSNEHPNLRIIHRKVAIILGQWVSEIKDDTKRPVYCALIRLLQDKDLSVRLAACRSLCLHIEDANFSEREFVDLLPICWDSCFKLFEDVREFDSKVQILNLISILIGHVSEVIPFANKLVQFFQKVQ

SEQ ID NO: 208076 - protein, 130 aa, Glycine max
  Coding DNA Sequence Number=SeqID_91298
MWCLLLTKIPRRSNNTKKGVTANTKAIWEHRDSNSCDKILKQQMLKFHRTSAGTLANLSALTNQANMKLAGNNKNLEDQVLVLTIEANGLEKLSVNAEALVRSWDSEIAKLRSALAIAKKEKMRLLLIKR

SEQ ID NO: 208077 - protein, 58 aa, Glycine max
  Coding DNA Sequence Number=SeqID_91299
MEWIRREKVTSLWRVDWKGFVSKSEYVWMENEDDNDDVQVGLKNEVTTEIHPHTLEDD

SEQ ID NO: 208078 - protein, 266 aa, Glycine max
  Coding DNA Sequence Number=SeqID_91300
  Pfam annotation: Domain name=Pox_A_type_inc; Domain location=136-158; Score=15.3; E_value=0.22; Accession=PF04508.3; Description=Viral A -type inclusion protein repeat
  Pfam annotation: Domain name=Pox_A_type_inc; Domain location=191-213; Score=13.3; E_value=0.9; Accession=PF04508.3; Description=Viral A -type inclusion protein repeat
  Pfam module annotation: Pfam domain module=Pox_A_type_inc::Pox_A_type_ inc; Domain location=136-158::191-213
MDGASLHTGGSIPHRLHWKRMKEEKGTDPSLAEFYFRTHRRKKDQSWVGPHAESAYDKFEQRKTELSSKSSKFTSGEGGTDSQADSQPSMNHMPSDFDIWADSVGKKKGRIFGLGSIAKTLFTSSSQPTKLSANSEEVDALRNQIQELNESLQRQEQEQQKTRQELTQTKNQGSTSIASSSQPMKLSANPEEIDALRNQINALNESLQRHVQEKLEMKQELTQTKEQVIALMQHFGFVGSLRPSSSPQHNSVNDDDYSDTISDHID

SEQ ID NO: 208079 - protein, 234 aa, Glycine max
  Coding DNA Sequence Number=SeqID_91301
MEKPTHRTWMYNRLLPGQKGYTTEFLKGVKDFIDFACQQPKYLNEGVIRCPCKLCKNAKHLTPEEVNVHIIKKGFTPRYWFWTSHGEKLPHINNDVEVHSVSPRLASMTDLEPDLKLDLELNSLNLNLHLNSLNLNLKPALEPDLDLLNLHLNFNLIPPNPLNLNLDLLNLHLNLNLIPPNLLNLNLDLLLYLNHNLIPPNLNISPLKSYVWKNIQWPIKPHLLHLVMLVKAIT

SEQ ID NO: 208080 - protein, 61 aa, Glycine max
  Coding DNA Sequence Number=SeqID_91302
MKNGGKPLRNHPRKRLGKRGRWLPPSSPRRAGLLPPQGTAFCCNILEGLSGLDFYLHTPVY

SEQ ID NO: 208081 - protein, 65 aa, Glycine max
  Coding DNA Sequence Number=SeqID_91303
MDNGGVVWGHKEGEGEEGGAWFELRAHTNLTDDPTKELKETKTHLLKRSEPLDYTLLLRRVSNRK

SEQ ID NO: 208082 - protein, 81 aa, Glycine max
  Coding DNA Sequence Number=SeqID_91304
MTIYPTPLTDSLAAVAHRSSLGDGVWFMAVVFASIGDKIGDVDVGGMIVVVVGWHAHNDVVLAVTRQRQGDMKWRNATLAW

SEQ ID NO: 208083 - protein, 75 aa, Glycine max
  Coding DNA Sequence Number=SeqID_91305
MAVIKRIWPLVIDYILCIVLNLILKSPFASIATHHHDHHQNIKGNCIYIECEDALSASHALNVSLPPYSLSAKVA

SEQ ID NO: 208084 - protein, 102 aa, Glycine max
  Coding DNA Sequence Number=SeqID_91306
  Gene Ontology: Mol. function=transporter activity; Cellular component= integral to membrane; Biological process=cell division
  Homolog annotation: Hit_ID=Q9M0R2; Match level="QueryCoverage=72%, HitCoverage=11%, E-value=1e-18, Identity=57%"; Hit description =Patellin-5
  Subcellular localization annotation: CTP_CleavageSite=96; ConfidenceScore=5.08e-01
MDTMVCVEKKNGMRKAHSLARTSTSTPFWMKIWAMTWRRWCSCTDMTERAILFVTTSTASSRTRISITSPCPLRIIETSFSNGVFSCWSAVFGTLRIMKKKL

SEQ ID NO: 208085 - protein, 443 aa, Glycine max
  Coding DNA Sequence Number=SeqID_91307
  Gene Ontology: Mol. function=RNA-directed DNA polymerase activity; Cellular component=chromatin; Biological process=chromatin assembly or disassembly
  Pfam annotation: Domain name=zf-H2C2; Domain location=151-189; Score =12.7; E_value=0.0074; Accession=PF09337.1; Description=His(2)-Cys(2) zinc finger
MEDRQPIAYFNKALSARTLSKFVYEKEIMALALSIQHWQHYLLGRSFKVYTDHRSSKHLLQQRLTTTDQQCWLAKLMGFQYEVVYKPGTENKVVDALSRQLPSTEFNTISISPYWVDFPAIKNEVQNDLELVKLSSQLQSDSDSLPHYTLHDGGHSGFTKTYKRLSSSFFWKRMKAIIMEYIRQCDVYQHNKYQVLSPAGLLQPIPILEVHPYTAHTVAEVFINEVAKLHDFPKSIISDREPLFLSKFWSELFRLQGTVLRMSTNYHPQTNDQTEVSRVLIQYFIPFCNSLTSIEVPPALCSVNDEVRDAHCRHVTYEVGDWVLFHVSEVAYMLQLPDAASIHPIFHVSQLKRSAKSEWLILGKSEPVEEATWEKAASIKDRFSNFCLEDKAAVLEGCIDRKLASQWDKPFKVRNISVIIGIVVLVVGYDGFGIESGAQRTFL

SEQ ID NO: 208086 - protein, 68 aa, Glycine max
  Coding DNA Sequence Number=SeqID_91308
MDCRPVMYKTYYEESNKVTSKDKHCFKINTRLLQQTKPCFKINSRSSLASKQSVSKTSKALAIDYQAM

SEQ ID NO: 208087 - protein, 85 aa, Glycine max
  Coding DNA Sequence Number=SeqID_91309
  Subcellular localization annotation: CTP_CleavageSite=62; ConfidenceScore=5.25e-01
MGVPVRDNNRQDSKAVWRFFTFLYGVFGWKAVWRFGRSDSNRQNRFKAVWRFFTFLFSGSPYATVLKCMGHAVHVLRVPSAEIVY

SEQ ID NO: 208088 - protein, 254 aa, Glycine max
  Coding DNA Sequence Number=SeqID_91310
  Gene Ontology: Mol. function=protein serine/threonine kinase activity; Cellular component=cell surface; Biological process =protein amino acid phosphorylation
  Homolog annotation: Hit_ID=O64477; Match level="QueryCoverage=100%, HitCoverage=31%, E-value=3e-81, Identity=59%"; Hit description =Putative receptor-like protein kinase
  Pfam annotation: Domain name=Pkinase; Domain location=80-254; Score =26.4; E_value=3.9e-10; Accession=PF00069.15; Description=Protein kinase domain
  Pfam annotation: Domain name=Pkinase_Tyr; Domain location=81-252; Score=-13.6; E_value=1.2e-11; Accession=PF07714.7; Description =Protein tyrosine kinase
  Pfam module annotation: Pfam domain module=Pkinase::Pkinase_Tyr; Domain location=80-254::81-252
LSQDDSSGQTLYVKLAASEFHDDNSRIGMIVSVVVGVIVGIGVLLALLLYVKIRKRKRMVRAVEGSLVAFRYRDLQNATKNFSEKLGEGGFGSVFKGTLGDTGVVAVKKLESTSHVEKHFQTEITTIGKVQHVNLVRLRGFCSEGSKKLLVYDYMPNGSLDFHLFQNKNSKVLDWKTRYQIALGTARGLAYLHEKCRECIIHCDVKPGNILLDADFCPKLADFGLAKLVGRDLSRVVTAARGTTNYIAPEWISG

SEQ ID NO: 208089 - protein, 47 aa, Glycine max
  Coding DNA Sequence Number=SeqID_91311
MSLKNLIGRLRVHDKTNHTLGDQSGSRYFVRMFQPRGINTGLKEHLN

SEQ ID NO: 208090 - protein, 47 aa, Glycine max
  Coding DNA Sequence Number=SeqID_91312
MNPLSLSVRLLNKAKQCCCAKPLLCVKEVELSAPYCAKLNSLTVLSF

SEQ ID NO: 208091 - protein, 70 aa, Glycine max
  Coding DNA Sequence Number=SeqID_91313
MTCQSTLGSRIGLGPSIAAPNQTFKSWIHHAILPRKGPVTRTMSKRLQEDWARAAEEGPRVLMNLRGSIL

SEQ ID NO: 208092 - protein, 119 aa, Glycine max
  Coding DNA Sequence Number=SeqID_91314
MITIENENAWDEQCTSHKSAKPFRFKVLQNWDDIVDLCAKDRAIGHGAEMAMDADEAMSRETNKKKWMDEDIREVLRETTLIHGLNRQQWAKAIKWLADDPKSLATVKVLPIHQKDIMF

SEQ ID NO: 208093 - protein, 106 aa, Glycine max
  Coding DNA Sequence Number=SeqID_91315
  Homolog annotation: Hit_ID=Q84P23; Match level="QueryCoverage=45%, HitCoverage=8%, E-value=1e-09, Identity=59%"; Hit description=4 -coumarate-CoA ligase-like protein
MGLLEEDGPSGVVTLAKRDQNSDEEGLATVARHHEWRQQQHVGDSILLYGLEHPFEVEPLQEDERLPDGNGSNQHEEPEHCRGEAVGEDIEGVAKFWGVRILGKEI

SEQ ID NO: 208094 - protein, 453 aa, Glycine max
  Coding DNA Sequence Number=SeqID_91316
  Gene Ontology: Mol. function=nucleic acid binding; Cellular component= beta-galactosidase complex; Biological process=DNA integration
  Homolog annotation: Hit_ID=Q0KIN0; Match level="QueryCoverage=97%, HitCoverage=70%, E-value=4e-42, Identity=41%"; Hit description =Integrase core domain containing protein
MDMQIYLGKLESVIADYNTLMPFMSDVEMFYKQRNQFFMVLALVGLTIELEAVRNQILSGSVVLSYDTVNEQLLRLSTPHAFGSSSTPTGDFFALVSHSSNHDIPLDVHTGIPPIVPTPIVASTTPPLMVYLRCLQPPPMVPSPNPPTSSPTPTLHPPTLLVPNLPIALRKGIQSSRNPNAMLEEMAALDANNTWELVPLPTGKTILGYTQISSLDYKDTFSPVAKIAFMHLFLAMVAIQHWPLHQLDIKNAFLHGEFFALLQFGMTHYEADHSVFFIHSPSGRCIYLVIYVDDIFITGNDSNGILHLRSHLHKKYALDILTKIGMLDCRSSDTSMNPNVKLLQRSPSDKRFTSRYYVLNEGNLTSWRSKKQKTIARSSVEAKYRAMAAAAFEITWLKQLLQQIKFGGEITIEFVSSKDQLVDLLTKSLKGFPIDDICNKLDSNDICSNLTGV

SEQ ID NO: 208095 - protein, 407 aa, Glycine max
  Coding DNA Sequence Number=SeqID_91317
  Gene Ontology: Cellular component=integral to membrane
  Homolog annotation: Hit_ID=Q1SAP1; Match level="QueryCoverage=69%, HitCoverage=92%, E-value=1e-113, Identity=63%"; Hit description =Amino acid/polyamine transporter II
  Pfam annotation: Domain name=Aa_trans; Domain location=192-407; Score= -145.6; E_value=0.023; Accession=PF01490.8; Description=Transmembrane amino acid transporter protein
MVRNESSNKEKDKDLDQFLFDRNDDDLVDEEQQEIEGVKYESESSSDGDDANRRAQPDSFSSQQWPQSYKVSPGTPLKPWRPVGHGLASLHMQGYKVEYNDSPQYLCIARSLLTREGRETTDSYTIAAAPNFESVLRGPSFIYSSFDNRSKSNLDIDGKTPFLSAAEGIRQSTWWEKASVQRLVSGELPIGYGCSFTQTIFNGINVMAGVGLLSTPYTVNQAGWMSMAVMLLFAVMCCYTATLLRYCFENREEIITYPDIGEAAFGRYGRIAVSSYCVEFITLEGDNLTSLFPGTSLDLGGFQLDSMHLFGVLTALIILPTVWLKDLRIISYLSAGGVIATVLIIICVFCVGTIDGVGFHHTGTAIMGYLMFGDGTLSQITLNMPPGTFASKVALWTTVSFEIFWVS

SEQ ID NO: 208096 - protein, 218 aa, Glycine max
  Coding DNA Sequence Number=SeqID_91318
MLEEELLEATDEPLDLIMEDGATVVMIVSGELPQGGVGWLVKECSKEDPKEDSNEDRWGPPSCPPNKGTSQTIRLGLSMDNSCTVCNNAVETLFHTFRDCKDVLLVCSWCLMELPHWRNHELYLVEEESYSFSARELVSYAGFEHSIKLATAYTMSWEIVSIVMGVFAMLEAMRLAVEFLETILAELRVILLGPKLAWSRGYRRISVDSGSLNMLKML

SEQ ID NO: 208097 - protein, 63 aa, Glycine max
  Coding DNA Sequence Number=SeqID_91319
MREAKRASTAKCSFSVLSVTEESDRASISRSRAKCEISVLSATVVLSQAQRMNGAKLKSTYSR

SEQ ID NO: 208098 - protein, 65 aa, Glycine max
  Coding DNA Sequence Number=SeqID_91320
MASKKRKAPSTPTQARYDRSRFALLRPDPQELATKICIPRRGFELNADEQPLKILRKNMTTLAQT

SEQ ID NO: 208099 - protein, 190 aa, Glycine max
  Coding DNA Sequence Number=SeqID_91321
  Gene Ontology: Mol. function=RNA-directed DNA polymerase activity; Biological process=RNA-dependent DNA replication
MGFKSGFKPHSYMHERHGLSKENAGATYQQAIDAIFHEWVGKSMKVYIDDVVVKSTDFEEHLGDLPLKLYISTAEESIGCLLAQDVDDDTERPWVLMFDGSKTKEGASVGVKVINPKGNSVDYHGSSICTHTGDSQLVIKQLKGIYKCQHDQNEEANELAQGASGYKSLDVDIQLEEYPLVGCLVLNVEN

SEQ ID NO: 208100 - protein, 80 aa, Glycine max
  Coding DNA Sequence Number=SeqID_91322
MLNEEKAERPHEIEVEVEVEHEAVTVVVAMALSMRVRVKYERRRLLVAFSSIKSSLSCLDALCMCMSTQSDGQLVNIVFQ

SEQ ID NO: 208101 - protein, 345 aa, Glycine max
  Coding DNA Sequence Number=SeqID_91323
  Subcellular localization annotation: CTP_CleavageSite=41; ConfidenceScore=5.40e-01
MAESSKKQKGYSSTTTATGHRRHGTSRDPPDPVPPSLSSLRSSTLFSSNDQHQRYYSQFWNRVILEPKYLDLEFFDGEIFDCYQVFQNSTLVDFMSLKLPYFPKLVKSLFYSLTKLPSQGVPFEGTLVDDWKFDYSSHDACRMVCHDQADMIGRLLARSFTFDCCIMHYIIVCILLPRSSNLAQASEEDLILLWAIQIGRQIDWAHLIWYRMHTTLRANAPLSYPHLATLFLHHFNVLLDDEPYVKVKRSFSIGAGVVTSFGYRKDVDGQWVSKQDLPPPIPDERTPSPPPQRDASSSLLTEVLTELHDLRAFVDERFDAMDTRITRLEDDIRFIRRCFDPPADS

SEQ ID NO: 208102 - protein, 138 aa, Glycine max
  Coding DNA Sequence Number=SeqID_91324
  Homolog annotation: Hit_ID=Q5YJM7; Match level="QueryCoverage=28%, HitCoverage=19%, E-value=3e-10, Identity=79%"; Hit description =Ribonucleoside-diphosphate reductase R2
MADSTCSKSNMDHIEEAITKLTSNQLNLIATQNTIQLSKVTYGFCNDNDTDGATQHINHALDVSREEVGGKTHSNEVTTAIGAGDSDGGDGVDGVEEVVLLVGVLDVGFEEEAVHLEVDVLDGDLDRRCGPRGDGSPV

SEQ ID NO: 208103 - protein, 136 aa, Glycine max
  Coding DNA Sequence Number=SeqID_91325
MRQQLDPSAHTIKSYGSTLARKHIRDWLILLLLIVIEIVLFVIHPFKRFVGRDMMEDIRIFVKKQCNKYDAVVGDVTIVAKCSEYVDFTMPFLESERGVPVSSSMRFFIVIHLFICSPEHKVQDHHRIQTQTANRE

SEQ ID NO: 208104 - protein, 185 aa, Glycine max
  Coding DNA Sequence Number=SeqID_91326
  Gene Ontology: Cellular component=extracellular region
  Subcellular localization annotation: CTP_CleavageSite=38; ConfidenceScore=5.38e-01
MVQLNLTVGGPSMGNQTSPIQALASSLGKGGPIQALLVAMAQKNPFIGQVNLVRRPPSAIGHIGMLPLGKPSVPAVNMLTNGDATRNHLLPGSPYRGVHTSSQLIGGPQLIDLEVIAETMRKYFGIHLKPMEGPRYRKPYPEWVDKMVHFPKGYKMLDFTTFSGENGKSTLEHVAQFMNLHGEGS

SEQ ID NO: 208105 - protein, 155 aa, Glycine max
  Coding DNA Sequence Number=SeqID_91327
MRRHTKAFNPGARMLIIDDKPNPDRGKLMAKFKVENNMRTLKITMENNDNPSGRIIKLCASVKKGEWTVNQQKERLIPLKMFAKTHKRRFQRKKVISKMKQAFSLTAKVKDKGSNEVSSYEVMEALQKAFISEEGSLVASVIEEQQTWEKLSKMY

SEQ ID NO: 208106 - protein, 103 aa, Glycine max
  Coding DNA Sequence Number=SeqID_91328
  Homolog annotation: Hit_ID=O81078; Match level="QueryCoverage=34%, HitCoverage=3%, E-value=1e-07, Identity=61%"; Hit description =Glutamate receptor 2.9 precursor
MPIWFFGVTLNSEFMRCSKNQTMKPVKMKATPVVNQSPPNLSQKNDDLGLIHRWIIVKFEYHVRNPISNILTVGNFRDNIRGGRKRNHMKTVQVEVSISSPSL

SEQ ID NO: 208107 - protein, 102 aa, Glycine max
  Coding DNA Sequence Number=SeqID_91329
MVLRNYVGGKTFLMGKCDPNDWSLQEVTFDLKQHDYKGSVQIFYRQLGIRLDKDLIKVLNDDGTRKIVKTAMDLIQKHVEVYINHTSHMTEGSIVYGGYLVM

SEQ ID NO: 208108 - protein, 157 aa, Glycine max
  Coding DNA Sequence Number=SeqID_91330
MKKIQGLQALHGATSGKAMVEGDLGNDVIDGIDSDAEVDMVDLDDRDKETDDDKGDNDNYEENDSDDRDDLDAEYDIDKLEYDIASEEDDDCYALSMAQINGEDISIEPVSKRFQPHEMGRDFNFEVGMEFDSISQFKEAIKEYANLHGFGGEIQEK

SEQ ID NO: 208109 - protein, 138 aa, Glycine max
  Coding DNA Sequence Number=SeqID_91331
  Homolog annotation: Hit_ID=Q00M75; Match level="QueryCoverage=23%, HitCoverage=5%, E-value=4e-10, Identity=93%"; Hit description=PPR -repeat containing protein
MHDTSKDVFQNLVLGSYFYLLNSALSTFFHCKAGDNRLCQNLRASPGAAVKLCLGDLLVMGSNPETASLHMQGYWFSPSDQNRVRRGSIVTGNEKSSVTSIPHLKLHCDMEAQIHLLEQEAYSAVLRAFKAQSDALTW

SEQ ID NO: 208110 - protein, 158 aa, Glycine max
  Coding DNA Sequence Number=SeqID_91332
DVPHGRSHLRAWRSGFLLPRCLPASSSSASAENACRKSTPNKSPVLELGHDIAVKGSLWAMKNELVFPQHHRTIAGLQKYQCDDPEKDIDTSGSDTQQMFVACNTFHGHAPPFVGNILPLQQCPFFCLSPEFQYLTEACETVVQEIDALMRDHVTLAQ

SEQ ID NO: 208111 - protein, 188 aa, Glycine max
  Coding DNA Sequence Number=SeqID_91333
  Gene Ontology: Mol. function=nucleic acid binding; Biological process= DNA integration
MGNARFIENGEISGSTIPQDVEIKEVKVGCSKNNEEEQHNNEPMIHNERIVEEPQEVGLRRFERERRPTISNDSVVYLREIETKTNLSINENDPVSFSQVVNCELPKGCNKRVGCKWVFKTKHNSHGNLERYKENTVDRCINLKVSGSMVIFLILYVDDILLATNDLGLLHETKKFLSSNFEMKDMGE

SEQ ID NO: 208112 - protein, 86 aa, Glycine max
  Coding DNA Sequence Number=SeqID_91334
MSRVEPNWLQNGAGFFQPTSSVQLVCFRVVKKVVKRQKDLLWECKKAALRRWVGGWKMSGEGKISMGERPSATIGYIIEGSYSYEG

SEQ ID NO: 208113 - protein, 48 aa, Glycine max
  Coding DNA Sequence Number=SeqID_91335
HVVRLTVNGSSFLGDPIVPSSKGKDGNSHPGSRDKGMSHIISMKHMQQ

SEQ ID NO: 208114 - protein, 305 aa, Glycine max
  Coding DNA Sequence Number=SeqID_91336
  Homolog annotation: Hit_ID=Q47522; Match level="QueryCoverage=14%, HitCoverage=54%, E-value=2e-14, Identity=84%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYLRPLTDRGEQVRVRGDGGLRANDDRPEGSVRRDGLPLIQAQHAGEDSQDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 208115 - protein, 80 aa, Glycine max
  Coding DNA Sequence Number=SeqID_91337
  Subcellular localization annotation: CTP_CleavageSite=37; ConfidenceScore=5.03e-01
MAPKQIFAKRSRKDAAAEGTSAAPEFDSHHFSAPSTNSASRPSKDGRSTERDASSSGTMSTPIFREDSSQTLDAAGYSHG

SEQ ID NO: 208116 - protein, 101 aa, Glycine max
  Coding DNA Sequence Number=SeqID_91338
MRSLLATRSSTICPCSPERDMAKASGIHEAKGFHVWLQKVLVIQEPLCHMSLGHWMPSQPILKMILLTNLIKKALDKFEFPDFDGNDLIGLLARAEKLFEI

SEQ ID NO: 208117 - protein, 72 aa, Glycine max
  Coding DNA Sequence Number=SeqID_91339
  Gene Ontology: Mol. function=DNA binding
  Homolog annotation: Hit_ID=Q9LTA2; Match level="QueryCoverage=94%, HitCoverage=27%, E-value=3e-11, Identity=53%"; Hit description =Similarity to AT-hook DNA-binding protein
MVFVIVALFNNPSYHWLLLSEDMQNNFANEEDAQSPPVSGGGTESGYVPAESCMYSYHLPSDVIWAPTPKDI

SEQ ID NO: 208118 - protein, 64 aa, Glycine max
  Coding DNA Sequence Number=SeqID_91340
MEEEEWVKIARGMEVIDVWSLSSMLSALLVFHDPMAAIAELAFWCVAMDKDNQPNVREVVEELK

SEQ ID NO: 208119 - protein, 284 aa, Glycine max
  Coding DNA Sequence Number=SeqID_91341
  Gene Ontology: Mol. function=transmembrane receptor activity; Cellular component=membrane; Biological process=defense response
  Homolog annotation: Hit_ID=Q1SI46; Match level="QueryCoverage=99%, HitCoverage=25%, E-value=4e-84, Identity=58%"; Hit description =Leucine Rich Repeat, putative
  Pfam annotation: Domain name=NB-ARC; Domain location=1-172; Score= -117.3; E_value=0.0083; Accession=PF00931.13; Description=NB-ARC domain
MMGQKKVLIVLDDVNDSEQLEELFGTPDWYGSGSRIIITTRDIKVLIANKVPEIYHVGGLSSCEAFQLFKLNAFNQGDLEMEFYELSKRVVDYAKGIPLVLKILAHLLCGKDKEVWKSQLEKLKGIKSNNVHDFVKLSFDDLHHEEQEILLDLACFCRRANMIENFNMKVDSINILLGDCGSHNAVVVGLERLKEKSLITISEDNVVSMLDTIQEMAWEIVCQESNDLGNRSRLWDPIEIYDVLKNDKGTKAIRSITTPLSTLKNLKLRPDAFVRMSNLQFLDF

SEQ ID NO: 208120 - protein, 37 aa, Glycine max
  Coding DNA Sequence Number=SeqID_91342
MFTKPKTSYQDTANETTVWQDHSNTNYSFNIPIILQS

SEQ ID NO: 208121 - protein, 433 aa, Glycine max
  Coding DNA Sequence Number=SeqID_91343
  Gene Ontology: Mol. function=nucleic acid binding; Biological process= RNA-dependent DNA replication
  Homolog annotation: Hit_ID=Q2HRL0; Match level="QueryCoverage=31%, HitCoverage=27%, E-value=9e-32, Identity=40%"; Hit description=RNA -processing protein, HAT helix
MAKRGRGRPPNTVPPPPVNHPQPATNLVVETENHELQKHEETIEKFEATTKSPETLIEEPKEVTDRKLWVDVLNNNRNLSNGVTMEFVAPKLINGEVEVEIEAEDIASELQFWENAMILYVLGGSLSMTMLKNYMVKMWNFVTLPDMLYHDDGYFLLRFKNREDRETVMMRGPYTIRNMPIILKEWTPDFNLSKDLERTMPIWVKLSQLPLCLWGLKSLNKIGSAISNPLMTDECTAQKLRVSYARILVEVDITQKLVEEITISDRTGGKIKQIVEYEWKPEFCEKCQKAGHQCGKKKVVKKWIPRNKQADEVKADPLPKTPVQNTETEGEVKPEGWITVGKAARHTGKAIEGEFKFWLTVVYALNQLDRRKVLWKDLEAIHKHQQGPWCVIGDFNNVTKAQDRIGGKAVTESEYIDLLNMMETTGLAEMDTT

SEQ ID NO: 208122 - protein, 108 aa, Glycine max
  Coding DNA Sequence Number=SeqID_91344
MAKGCADDHNLSLPVIGLAASASQKVHKDHNLSLRDIGLDCLWMAKRCADDNNLSPHVIGLAASGLQKVQSDHNWSLRGTGLERLRMAKRFADDNNLSPHVIGLAAFG

SEQ ID NO: 208123 - protein, 113 aa, Glycine max
  Coding DNA Sequence Number=SeqID_91345
MAKRFADDNNLSLHVIGLAASALQKVQNDHNLSLRATGLDRLWMTKDSIVSGWQKGVRMTKICLCVSSGSPPLDDKRLDRLCLAKRLDRHWMAKRYVDYHNLSPHVIGLAASG

SEQ ID NO: 208124 - protein, 77 aa, Glycine max
  Coding DNA Sequence Number=SeqID_91346
MVQQQHQFAAQEFHILPSSVETQGIGTQWNVPGAIPNMDDLLGVDLHHQFSAEADQVEAVRNRGRKNPNRAAQRTTM

SEQ ID NO: 208125 - protein, 328 aa, Glycine max
  Coding DNA Sequence Number=SeqID_91347
  Gene Ontology: Mol. function=aspartic-type endopeptidase activity; Biological process=proteolysis
  Homolog annotation: Hit_ID=Q8H6Q8; Match level="QueryCoverage=99%, HitCoverage=8%, E-value=1e-15, Identity=24%"; Hit description=CTV.20
ETIKTKVVPKQKSVEEASPSIAIEKPLFKPFKVSEKAKRKIRDLRKTKSLVEGVETIKTKVVSKQKSVEEASPSIPIEKPLFKPFKVSEKAKRKIRDLRKTKSLVEGVGDNHSEILNKIGSLLKVIPETPQTSENTSKMVTRSTSKLINVINEDSDQNLNNTNETGSVSEKNINPINSKHWKTPSKLYYQRPTAPDLLLEERGENNFKSFSANNIYEWNIDAQTEYNIMNTLQHMTMVAKAYQTSHEYSEETIIDILVAGFSGQLKGWWDNDDDKEIPDAINTLILTIAQHFIGDPSLWKDRSAELLSNLKCRTLADFRWYRDTFLTR

SEQ ID NO: 208126 - protein, 76 aa, Glycine max
  Coding DNA Sequence Number=SeqID_91348
MASFSSCSSNIQIKSDQLMVTFYGCKISMFQNIFEMGKKTENYTLDELSPRIKIKKKYQRKFLYFDNLVSVWMGHH

SEQ ID NO: 208127 - protein, 142 aa, Glycine max
  Coding DNA Sequence Number=SeqID_91349
  Gene Ontology: Cellular component=mitochondrion
MQSDLGQKDRGKFSMKTLYLKMRCEGSNEVVWNRLFCGNPARPRALMTLWQACHGRLPTKDRLLRFGMLGDKICCFCEGPKSHDHLFFGCSVFGDVWKQVLEWIQVKHHPQEWNEELKWIIRHDKGKGHKASILKLAVTETV

SEQ ID NO: 208128 - protein, 154 aa, Glycine max
  Coding DNA Sequence Number=SeqID_91350
MVTPEKHVPLKKHLHLCALLCKPAPLHLRSITSNSPVKLAKNIAPKSPALVSIYFMHGWVLRKKETPVVICFKTDLVWELVCKTNLIRHNFQKKGGVWESCIYYLDFRSCHRQKGRDCRSKTTRDFDDANNQVFFMDNSTDLQAIQEIQVTSTS

SEQ ID NO: 208129 - protein, 121 aa, Glycine max
  Coding DNA Sequence Number=SeqID_91351
  Gene Ontology: Mol. function=oxidoreductase activity; Cellular component=membrane; Biological process=electron transport
  Homolog annotation: Hit_ID=Q9FF18; Match level="QueryCoverage=59%, HitCoverage=14%, E-value=7e-22, Identity=70%"; Hit description =Cytochrome P450-like protein
MGLCRKEVPIVEWYRTKVVPDTEMIKEFLSKYSTTSGKLWQQQQGTKHFIGRGLLMANGEDWRHQRHMVAPAFMGDRLKLKLLGISILKFQQLVQLSVFEIKWNIVTISLEVVIIFKRNIP

SEQ ID NO: 208130 - protein, 70 aa, Glycine max
  Coding DNA Sequence Number=SeqID_91352
MVVSPSSGSLYHPRVWSPAVLALPASHSGHLRYLYTRLSQSPTSTIDSDTNCWGDSRGTPVDHEPPHKEV

SEQ ID NO: 208131 - protein, 56 aa, Glycine max
  Coding DNA Sequence Number=SeqID_91353
MENNDGLWWLMVDVGDGERCYTQAIRRESKYFISSHSYRVELLKQLAIFSFLEAGM

SEQ ID NO: 208132 - protein, 62 aa, Glycine max
  Coding DNA Sequence Number=SeqID_91354
MEVEILLMEIIESRKYCVEMGRSNFYGNDLLGILLDEIKKEGAMLLASNPHWQDKVRAEVKE

SEQ ID NO: 208133 - protein, 48 aa, Glycine max
  Coding DNA Sequence Number=SeqID_91355
MPRIYDAIREYEGIKENNRNELERLDKERRDDLLNMLKVFLVNQWSNY

SEQ ID NO: 208134 - protein, 130 aa, Glycine max
  Coding DNA Sequence Number=SeqID_91356
  Subcellular localization annotation: CTP_CleavageSite=74; ConfidenceScore=5.24e-01
MARLFFSVLKNKNYFSLFVQHQWLPHVVAIPRPKCASSRFSAAIPYPPNNNNNKNPFQPKGVGIDLNLRFFFVTETEESESSRSDYDNASATTQTNNNKGFLENIVEVLEKLDNNNNINNHVTWRNSVAS

SEQ ID NO: 208135 - protein, 138 aa, Glycine max
  Coding DNA Sequence Number=SeqID_91357
  Gene Ontology: Mol. function=aldehyde dehydrogenase (NAD) activity; Cellular component=mitochondrion; Biological process=metabolic process
  Homolog annotation: Hit_ID=Q84V96; Match level="QueryCoverage=56%, HitCoverage=18%, E-value=7e-25, Identity=61%"; Hit description =Aldehyde dehydrogenase 1 precursor
MRHRDSIENVVLWEQGRWACRGCDGCVVLLRSRAFTGSTDTGKIVPELATRSNLKRVTLERGRRLPVIGQCCCSRSPTFLHERVYDEFLEKSKKQALRHVVGDPFKKGVEQGHLACWMRSASNLFGFNGLASLKYDMI

SEQ ID NO: 208136 - protein, 48 aa, Glycine max
  Coding DNA Sequence Number=SeqID_91358
MELGQNSCKGVGSVSKGEGERGRDGWQLLYAIIYNQLTQEWVMDSHTM

SEQ ID NO: 208137 - protein, 73 aa, Glycine max
  Coding DNA Sequence Number=SeqID_91359
MLSEHYRGQTTSHDTCNVHHECEKLFGIILRLKANLMKAKGKEKHEKASDGLNPPIAEELGVNHAGFDDAKKN

SEQ ID NO: 208138 - protein, 189 aa, Glycine max
  Coding DNA Sequence Number=SeqID_91360
MAGDASKFIHISPKNSEHVTYEDNNKGFDDAKRIYLIMVVIIKKGESVNHAEIGSLLENLEHKGEGSQGTNRVVYLSELSQEKREWHGRKYGAVVIVWVPRIGRSIEKGVATSLGEEEAMQEKKVGRIQDKEHKGKKIGLHGRLNNFAQLMEANRSKRDSSNARLVLVSTTKVARTSEVMSPTEVEEEQ

SEQ ID NO: 208139 - protein, 84 aa, Glycine max
  Coding DNA Sequence Number=SeqID_91361
MVSDACKRAQILRSEEHGAWHARSGVTVRSNRHILGSNKGAVWRKTEDRFPGLGLGLWAQLKKLEEPKKSDQCDKANGFSLFWV

SEQ ID NO: 208140 - protein, 104 aa, Glycine max
  Coding DNA Sequence Number=SeqID_91362
  Gene Ontology: Mol. function=DNA binding; Biological process=DNA integration
  Homolog annotation: Hit_ID=Q1SX87; Match level="QueryCoverage=48%, HitCoverage=3%, E-value=3e-10, Identity=64%"; Hit description =Polynucleotidyl transferase, Ribonuclease H fold
MSHLNSIFHTALVVSNIKNHVPIILEMENVQYVTWAELFKPSYLVIQLVSGLTSAYRGVGTLIQQSDHQPSFYQARSMLTLEEAGLTMLATSQSIYDSNFSHSY

SEQ ID NO: 208141 - protein, 62 aa, Glycine max
  Coding DNA Sequence Number=SeqID_91363
MGNRQNESTNHRKVRKKDNEKWKPWRGNPNGREFRGHNGNENQKNAKASTLQSQAQLEKTKQ

SEQ ID NO: 208142 - protein, 269 aa, Glycine max
  Coding DNA Sequence Number=SeqID_91364
  Homolog annotation: Hit_ID=Q1SWC8; Match level="QueryCoverage=27%, HitCoverage=5%, E-value=2e-08, Identity=45%"; Hit description=RNA -directed DNA polymerase
MMSSSSKATLTKPSSWQSFDIHDAPCNAGRVDDARKKEFMMLSVSSIWVLWRSRGSELNTELVFILLNLPINGLCKISLRNLICMSLVTRTFYGASKFSFRPNFLLGVLVGTIFPPASNSTPKVKPGITSWLYGGFKGLLFPMDCKIVVDKLRENVLKLKEWGPKDANARGSTRLTNNLVDIPNKGRRLSMDARIENFHVGSSTVATNKIRMRERQILGKSHKEIEEIWLEVLERIQVTSLKEFMFKEDKLISVSFREGECQICIMLIQ

SEQ ID NO: 208143 - protein, 105 aa, Glycine max
  Coding DNA Sequence Number=SeqID_91365
  Gene Ontology: Mol. function=racemase and epimerase activity, acting on carbohydrates and derivatives; Biological process=carbohydrate metabolic process
  Homolog annotation: Hit_ID=Q9M0B6; Match level="QueryCoverage=83%, HitCoverage=18%, E-value=3e-16, Identity=54%"; Hit description =Nucleotide sugar epimerase-like protein
MGNNNPLKPPYSQEGYVGADEANCADDENGHVALTVDMGGGVDLLLPLDPALGGGEVEAAEINEPLEVEIKAEELEGEDFGGDSEAKEGGEGLEEVRVTVRVTER

SEQ ID NO: 208144 - protein, 41 aa, Glycine max
  Coding DNA Sequence Number=SeqID_91366
GDLNINHSDKLEVVKNEFRYTMEQDPFVIDIGLSLAFSTAN

SEQ ID NO: 208145 - protein, 58 aa, Glycine max
  Coding DNA Sequence Number=SeqID_91367
MASESASRLTSMADSYIGSLISLTSKSEIKYKGSGESLMAKAVMMGGVLFGKSTVVGA

SEQ ID NO: 208146 - protein, 93 aa, Glycine max
  Coding DNA Sequence Number=SeqID_91368
MMIYAIKNVRIPKYFDLEWFSQQGFNFPNLLKAQRLSKLKVVGLDMGGVHKFDETPDGYSKMQTYRGMLLDPTRNLRNHLRVGGKITEDRMLV

SEQ ID NO: 208147 - protein, 153 aa, Glycine max
  Coding DNA Sequence Number=SeqID_91369
  Gene Ontology: Mol. function=transferase activity; Biological process= DNA integration
  Homolog annotation: Hit_ID=Q1SXA8; Match level="QueryCoverage=92%, HitCoverage=11%, E-value=2e-20, Identity=35%"; Hit description=Zinc finger, CCHC-type; Polynucleotidyl transferase, Ribonuclease H fold
MVLIRHILKKIPYELYKGRKPNISHLRVFGCKCFVLNNENYLEDKDAGFLDKDTTLEDETKVEEIEQSKEITVIPPKDLPREWITQKDLSLDNIIGEISKGVSTRFRLRILCNNMTFVSQFEPRNIDEALYDEHWLLAMHEELISLKGMKCET

SEQ ID NO: 208148 - protein, 198 aa, Glycine max
  Coding DNA Sequence Number=SeqID_91370
  Gene Ontology: Mol. function=protein dimerization activity; Biological process=regulation of transcription, DNA-dependent
  Homolog annotation: Hit_ID=Q1S5E6; Match level="QueryCoverage=97%, HitCoverage=26%, E-value=2e-39, Identity=46%"; Hit description=HAT family dimerisation domain, putative
  Pfam annotation: Domain name=hATC; Domain location=94-176; Score =128.3; E_value=2.1e-35; Accession=PF05699.5; Description=hAT family dimerisation domain
MFDPDFKHEILMWSFVTLFKYNNIFTEKLCTSIRKNCKKAYKEQTKSEQSSHGLGNFASAAKTSVCAETSSYLARTNAFKRHLAEKDSIDIQNEFERYLAEKCVDVDDSFDVLVWWKQNASRFPTLSRMVKDILATPISIVASESDFSIGGRVIDCFRSSLNPQMEEALIFAQNWLRPILAQLKGLKIIEDIEISEAQ

SEQ ID NO: 208149 - protein, 203 aa, Glycine max
  Coding DNA Sequence Number=SeqID_91371
MMTCSIFEAYFLSKGEVEVKVKKTGTKELERVKDEGLAEVVRIQESHKQILVAWEARIKNTSRFKRKVEFKNQDSRDQGSRLKIQESRKGYSRIKKKLNQDKYKKYIYLGLTENKRGYISCGSVLVEGTSTRFKENKGGFGERRFGIRHIFFLGFLDRTKGLGSEGGEGGYFLLFVEMMLQIQDQGVDLELPSSDPPQTMVPS

SEQ ID NO: 208150 - protein, 65 aa, Glycine max
  Coding DNA Sequence Number=SeqID_91372
MARGGHRWSWVVEEEVLGLGWAFGEKKISLCKNPLLVLSAIICVERNSNCALSVTISAQRNSLSS

SEQ ID NO: 208151 - protein, 103 aa, Glycine max
  Coding DNA Sequence Number=SeqID_91373
MVMPILGSIDYVSGRDKFCMYKVIVGEKINLPKVIFYYWLQAFKDRFNPKVKKNHVPYGILFNQIMRDVGVDVFGMAPSGGATQHKEITFVKMEITDNFQEYA

SEQ ID NO: 208152 - protein, 129 aa, Glycine max
  Coding DNA Sequence Number=SeqID_91374
MGESVGQIKNMKINRENKFTNHHQYILYEPAGNYSRWKWKRNRRLSYIRIARRRLLSFGETAYSVLSFASLTPLRKVEKGPQLIVVSVVVIVVAAVAVAVVALEEERMACLDQKHFGRKEQVAVVVVEG

SEQ ID NO: 208153 - protein, 84 aa, Glycine max
  Coding DNA Sequence Number=SeqID_91375
MVVFLVAIANDTSGGVGVDSYNAVLLIMVVIDIIAVMLVVGVNNNGDSVDNNSDCVNDYDDDHNDDIDGGPGVSRGNEKCHYQM

SEQ ID NO: 208154 - protein, 74 aa, Glycine max
  Coding DNA Sequence Number=SeqID_91376
MPPSAVITEEEGQSKDVFTDIELAEVELPDLGALCAPGKEVPVVILVHDFTYQRELLLEVIIPNFLDLNRIAFW

SEQ ID NO: 208155 - protein, 72 aa, Glycine max
  Coding DNA Sequence Number=SeqID_91377
MTPAEARNLIEKMASNSKQFSARNDAIVIRGVHEVATNSSTSSETKKLEAIEQPEAYAANIYNRPPQAQQQN

SEQ ID NO: 208156 - protein, 175 aa, Glycine max
  Coding DNA Sequence Number=SeqID_91378
  Homolog annotation: Hit_ID=Q2QP91; Match level="QueryCoverage=52%, HitCoverage=15%, E-value=3e-31, Identity=66%"; Hit description=Dor1 -like family protein, expressed
METFLVDGSCVSAAMNDLRPCAPISLKHVLAQELIKGLWAVSDSLLLYNTTRVLRSNESGLFRSLCRAFIEVAYPHCATCFGRCYPGGATLVMDAKNVYDGISRLLETSSSRELPKPVNNEESKSVAENGELPKMENGETPDAKESEAVIGKDVNEEGPTLQIDQEDTNLEKSVE

SEQ ID NO: 208157 - protein, 212 aa, Glycine max
  Coding DNA Sequence Number=SeqID_91379
FNGCYKQATALKKSGYTENDVMEQCKEVPSKRTKLNENWNYSLSSNMETPIDVSESDIPTPLARPMGQKATKRKVKVIGASSSTLLVNLFSIEKEMKERNVVQKQITKVVELDNVVKMYDILTKEKSNMIEDQHKHHKMARNSGFDRVWQQIVDEALEDNIVEEIMRYLCQLQQQANSSSRPKRTRRNINQNREDGHSLLMNDYFSENCIYA

SEQ ID NO: 208158 - protein, 374 aa, Glycine max
  Coding DNA Sequence Number=SeqID_91380
  Gene Ontology: Mol. function=protein binding; Cellular component =membrane; Biological process=protein transport
  Homolog annotation: Hit_ID=Q2QP91; Match level="QueryCoverage=82%, HitCoverage=50%, E-value=1e-131, Identity=75%"; Hit description=Dor1- like family protein, expressed
  Pfam annotation: Domain name=Dor1; Domain location=4-334; Score =406.8; E_value=3.2e-119; Accession=PF04124.3; Description=Dor1-like family
MYPSLGERHEILDGCDTVGVGVGVIVADKKHCQSSPKNVFLVRDNGGVNTFVGISNICKWSAGDKINEIPKLTSGCTEFIESAEQILEKRKMNQTMLTNHSTLLDLLEIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPGVGFSAHTVGDENHEDVTPPSNLME

SEQ ID NO: 208159 - protein, 204 aa, Glycine max
  Coding DNA Sequence Number=SeqID_91381
  Homolog annotation: Hit_ID=Q9SJI9; Match level="QueryCoverage=64%, HitCoverage=54%, E-value=4e-50, Identity=70%"; Hit description =Expressed protein
  Pfam annotation: Domain name=DUF1637; Domain location=4-175; Score =157.3; E_value=4e-44; Accession=PF07847.3; Description=Protein of unknown function (DUF1637)
MPYYIQRLYRLCNASFSPNGPASEEAIEKVREKLERIKPSDVGLEQEAQVVRNWSGSMLEHNGSHQSLPPIKYLHLHECDSFSIGIFCMPPSSIIPLHNHPGMTVLSKLLYGSMYVKSYDWIDAPGSNDPSEGTSDLFCVRTSIQCQNVNVIRKCLFSSRTTARVVLLVKDNQEISIAQLGRYKEFNIVLCALIKRCIFDRMLT

SEQ ID NO: 208160 - protein, 135 aa, Glycine max
  Coding DNA Sequence Number=SeqID_91382
HIVHCVKAQLVKSDSRELQLLIRDEEVHTGLAVEIIFENGVWAKEGQNEDLIDWTVVGNVEFDGGYDDDRATYPFGVCGPRSKEPVPRHPLELEEGGSFHVKQRNGEPLRVGNILIGGGEGGGFGEGRAEVREAR

SEQ ID NO: 208161 - protein, 133 aa, Glycine max
  Coding DNA Sequence Number=SeqID_91383
  Gene Ontology: Mol. function=nucleic acid binding; Biological process= DNA integration
MDSDNVGDLDEVYNKSIIQSLVTISTIQAKYMTVAKASKEPVWLARVVKELGIGQGGVQLYCDSQSAIDLTKNQVCNAKTKHTDVRFHKIMEFMTSGQILLRRVLTLENAANMLTKAVTTDKFKHYLDLLNVA

SEQ ID NO: 208162 - protein, 88 aa, Glycine max
  Coding DNA Sequence Number=SeqID_91384
MEQVDYTGKHAGPGRLPWEIHRPSLITLETLWGQVLVYGGGGSGSGANIFGVGSNAGDGSDSISGGGGGDNGNGIVKCRKSAFVLKLN

SEQ ID NO: 208163 - protein, 149 aa, Glycine max
  Coding DNA Sequence Number=SeqID_91385
MPSVTIFKIPRLVRKMLRSDQFPSCHKAKDELMVLSGNAFLPEQCKAISKPTAPLQEPKEARLEVPTPHSPNASKIEDHIYREGNTCADLLASQGEIGGLMTRSKTKRMEQTLQGLILKIKEKENQWELRAAPNWVILLQIDEDALKST

SEQ ID NO: 208164 - protein, 76 aa, Glycine max
  Coding DNA Sequence Number=SeqID_91386
MAHQSSAPFLQSRDNQVRWHPEINMVICTVFAIQRQSKTNMAIRTIFAIQRQSSSMTRGDKTWSLFASDKCTRLQK

SEQ ID NO: 208165 - protein, 209 aa, Glycine max
  Coding DNA Sequence Number=SeqID_91387
  Homolog annotation: Hit_ID=Q1T493; Match level="QueryCoverage=88%, HitCoverage=38%, E-value=8e-27, Identity=33%"; Hit description =Nucleic acid-binding, OB-fold, subgroup
  Pfam annotation: Domain name=DUF223; Domain location=40-135; Score= -7.4; E_value=0.014; Accession=PF02721.5; Description=Domain of unknown function DUF223
MARIPDKIRSIDGSKETLKLAVRITDLWFVGTPNKSEQAEMVFVDSEGDQIHAICKSDHLKSWKVDLKENCTYVMHNFKVVKNDGQFRVCEHEYKLFFIGVTVVREANLHELPFKEFRFVEFANVVAGNFVSGLLIDIIGVVDMVVFRGEILSCTLWENYCTQFLSYLNERGDDGPMVIILTHARIKDAQGKKLSSFSEQFLQGVKTID

SEQ ID NO: 208166 - protein, 103 aa, Glycine max
  Coding DNA Sequence Number=SeqID_91388
  Gene Ontology: Mol. function=nutrient reservoir activity; Cellular component=apoplast; Biological process=auxin mediated signaling pathway
  Homolog annotation: Hit_ID=Q9AR81; Match level="QueryCoverage=68%, HitCoverage=43%, E-value=3e-15, Identity=50%"; Hit description =Germin-like protein precursor
MVCTAENRKSQGLFVTNSNFKVQQPLYESSKDLTLKHNEYLIGTGMSVVWDNTTRTKVQPYCIYFKAIETWIMQLSSLGLGEGVGNGFQCSFSAMVLSYVYSF

SEQ ID NO: 208167 - protein, 92 aa, Glycine max
  Coding DNA Sequence Number=SeqID_91389
  Homolog annotation: Hit_ID=Q1SCX4; Match level="QueryCoverage=67%, HitCoverage=7%, E-value=2e-09, Identity=47%"; Hit description =Probable Na/H antiporter [imported]-Arabidopsis thaliana
MATLANFRPPYSIPNPPPDAIPELACYNSTMDLSNNIWRGGNVIGERVPLLSIQIAYSVLLSSIFHRIFKSFHLPLMVSQILESSSATFLFN

SEQ ID NO: 208168 - protein, 112 aa, Glycine max
  Coding DNA Sequence Number=SeqID_91390
  Gene Ontology: Mol. function=transcription factor activity; Cellular component=nucleus; Biological process=regulation of transcription, DNA-dependent
  Homolog annotation: Hit_ID=O23112; Match level="QueryCoverage=66%, HitCoverage=29%, E-value=9e-12, Identity=49%"; Hit description=AP2 domain containing protein RAP2.11
  Pfam annotation: Domain name=AP2; Domain location=47-112; Score=90.3; E_value=5.9e-24; Accession=PF00847.10; Description=AP2 domain
MSTTNSITKPHKGYRVNIYVILSSLAEYQNQRAKEGRFCEKLKIKNKPKFVGVRQRASGKWAADIKHTSKKIRLWLGTYQTAEEAARAYDEDACPLQGSNTATKGFVLFLVI

SEQ ID NO: 208169 - protein, 238 aa, Glycine max
  Coding DNA Sequence Number=SeqID_91391
  Homolog annotation: Hit_ID=Q1S022; Match level="QueryCoverage=99%, HitCoverage=40%, E-value=1e-10, Identity=27%"; Hit description =Cyclin-like F-box
MDGKVDWSELPIELWPKIGKYLQNHVDGKVDCVCGSCRSSIPPSLPNSPSFPMQIPHPSNHSIETLLNQATVYVIEPTDANGASNLEPLAISTKWRLIKVEESKNHNHNHNHPLTLLSPISDRKILYPHGSNSPMLWNLLDFRVTELCKSYTPNISSATVSKVVFFPNSPWIGAEDSVACCIFLEGKLGFMKHGDEKWNLVDNENFFYDDVIVFKGQFYVTDKWGTISWIDTSSLKLV

SEQ ID NO: 208170 - protein, 127 aa, Glycine max
  Coding DNA Sequence Number=SeqID_91392
MRDEIGLCHTLISSGDLCSMTCDHSLVLVRCLAPIIRQFVKFQDMPKNQKNIDAQSHPGPLGPSGIFLQKAVASGGSNPARLGELGGNLLPYFAINRGGRQEGRGSAPLALLSLSNLLRKIVSVKKI

SEQ ID NO: 208171 - protein, 295 aa, Glycine max
  Coding DNA Sequence Number=SeqID_91393
MPYGMLLDRQTYLQTHYEEKDGGDFNRVLNGGPWSFKNNMIALSSIKESEIPKEMPLNFILIWVQIHNLLAGFMSAMVDQHIGNFIGAFMKYDNKNNSNYEGLWNLFLLCGHIGHIENFCGKLFMKEKVEDAGSLLEKLLRRRRGEKRCHPLENKPWKEKLHHQESALDKKLREETSKNEENEREHPSIFPLDATSMKGVTLAHGSFLEKQGRLATHTPPIAKFTPMPKWAWLLSPILLEPLAPGFGDWSLPREDCIRGGKGVRIEANRKSGEIEGSKWLQEKRVNRGRTESENR

SEQ ID NO: 208172 - protein, 59 aa, Glycine max
  Coding DNA Sequence Number=SeqID_91394
  Homolog annotation: Hit_ID=Q1SRR6; Match level="QueryCoverage=89%, HitCoverage=3%, E-value=2e-09, Identity=54%"; Hit description =Integrase, catalytic region; Zinc finger, CCHC-type
MAAVDITGSNSNDLNKPFRFKGYHFKRWQQKMMFSLTMRKAAYVLNTDIRVVPEDVEKE

SEQ ID NO: 208173 - protein, 515 aa, Glycine max
  Coding DNA Sequence Number=SeqID_91395
  Gene Ontology: Mol. function=RNA-directed DNA polymerase activity; Biological process=RNA-dependent DNA replication
MELDGGWIRATTSFGEVVLKIASGTRSMLILGSCPNENDNKKATLNGQRISAKGTDKEDLLVETQLSSKIYNIWGGGSLIGLERPTLKVNIREVGEEAKGVFKEKLGGPTNVRCKDQEVDRLEGVLVRTNKSNDEEVDNTTIKFEPYNENKETYVAHVHDKEEKKSTRVNMDINVGVLVSNEWVGNWDACSQLVFDRSVKNHFPLVSRNKDLDWGLKPFRMLNYWFLNPKSKGFVEDSRKGLPSGRESHFCDKGKLNMEVVNELNEVDKKDEESGLSEEEIVLRRKLLEEFWKVSTKYEFLMHQKSKKKWIKEGDDNTKFFHSIINGRKDVSCIKGRFSQTTWRRPTLDRIPFKLISGEDNNMLCAKFEKMVINEVVRDYDMGKCLRPNKFNFNFLKEFWHLLKEDFLRVLSEFYEREVLPKGTNSPFISLIPKKEDLLHLGEFRPISLIGCIFNVISKLLARRIRRVLDNDERQCAFVGGNMLDGILVASEVVDEARKEKWLLTGSTGTFYISC

SEQ ID NO: 208174 - protein, 141 aa, Glycine max
  Coding DNA Sequence Number=SeqID_91396
  Homolog annotation: Hit_ID=Q9M3A6; Match level="QueryCoverage=36%, HitCoverage=9%, E-value=4e-11, Identity=61%"; Hit description=SF16 -like protein
  Pfam annotation: Domain name=IQ; Domain location=61-81; Score=36.6; E_ value=8.3e-08; Accession=PF00612.17; Description=IQ calmodulin -binding motif
  Pfam annotation: Domain name=IQ; Domain location=83-103; Score=16.5; E_value=0.096; Accession=PF00612.17; Description=IQ calmodulin -binding motif
  Pfam module annotation: Pfam domain module=IQ::IQ; Domain location=61- 81::83-103
MGVPQKWFRNIVRGRFLRSSNKDIVLVLPRTSICTNECEEAMLRNEEFSFPTPISSITKEDASAIKIQAYFRGHLARRAYKALKSLVKLQALVRGVWVRKQSRIAMQCMHALVRLQVRVRARQLLGSFDKERPTNLQSQNV

SEQ ID NO: 208175 - protein, 246 aa, Glycine max
  Coding DNA Sequence Number=SeqID_91397
  Gene Ontology: Mol. function=nucleic acid binding
  Homolog annotation: Hit_ID=Q10SY5; Match level="QueryCoverage=65%, HitCoverage=65%, E-value=6e-46, Identity=53%"; Hit description =Expressed protein
MLFLSWGRPSPQDQKTCINKSGTFNYDDKYKGATAKSVASLKADEGLSKDGFLLNEARVLVGSGIETFEKGKSALRSWRHFGLNWAFVDPKTPVQQGVKFCVCVKEFFPWLMMPLQVVYVNETGTAKYRTASFGFGSGTLHGHLLAGEERFSIEIDENNQVWYEVLSFSKPASILSLVGNFPVATYANHNGWRWDILRLLLPPTLCDRIAPIPPPKDTVDDVPLWKGLNDGSFSLKGSLHLSHKLV

SEQ ID NO: 208176 - protein, 242 aa, Glycine max
  Coding DNA Sequence Number=SeqID_91398
  Homolog annotation: Hit_ID=Q1SP02; Match level="QueryCoverage=50%, HitCoverage=26%, E-value=1e-14, Identity=37%"; Hit description=IMP dehydrogenase/GMP reductase
  Pfam annotation: Domain name=DUF1723; Domain location=58-107; Score =48.5; E_value=2.2e-11; Accession=PF08330.1; Description=Protein of unknown function (DUF1723)
MITSDNNSWQSQSYNQGQGQLLLVSHGAQVLAPATHPQVKTYVEKSRLSALATMWYPVTNKDLMNFIFERWHQETSSFHLPVGEMSITLDDMSCLLHLPLIGRSIDHVSLHFDKKVVRILLMTYLGILTETEATIATNAGAKVSHPYVIPSEEGHPPHGPVYLPPIRVQPQPRKPLVDYVPGGDYSCQLIGPQSYAKGRESSSGHTTSFATIVGGVTVGCSSDTQSLLDIVNSLASAPNCLK

SEQ ID NO: 208177 - protein, 120 aa, Glycine max
  Coding DNA Sequence Number=SeqID_91399
MEREAEGYMWSKPFIKILEYAFSLRPELFLDEAPFNFYPFKLTKFSNFEMQFTLLSAPFPMDPQSFNPSDMVLKEHFEPRAIAGTSLGHCQSLDQQSSDRYLNGSIFSMKPCTIIIRIIF

SEQ ID NO: 208178 - protein, 142 aa, Glycine max
  Coding DNA Sequence Number=SeqID_91400
  Homolog annotation: Hit_ID=Q1S365; Match level="QueryCoverage=32%, HitCoverage=4%, E-value=3e-16, Identity=75%"; Hit description =Lissencephaly type-1-like homology motif; CTLH, C-terminal to LisH motif; WD40-like; ...
  Homolog annotation: Hit description=Quinonprotein alcohol dehydrogenase-like
MSRSGDETAVTEEAQPKESLPNLFSLFPKINFQLPFLPPKPQEPNPEAQAQQELPKPSRVQFPKTQVAMVASLPLLAEPNADHSPAAKTTNPLILWQDEVHNGNWDEVEKYLSGFTKVDDNRYSMKIFFEIRQQRHDWSKAI

SEQ ID NO: 208179 - protein, 119 aa, Glycine max
  Coding DNA Sequence Number=SeqID_91401
MEKDISLPMEKSLGNPLRFYMMWMEEEEGWIMEEKRRMDRDGGFPLFEKLRLWMYSIENSESREYDGDHVLSMIFTLSMPLGFFMGLLHAKLELAAKRENTLGLSCVLSELSQSSTFSR

SEQ ID NO: 208180 - protein, 298 aa, Glycine max
  Coding DNA Sequence Number=SeqID_91402
  Gene Ontology: Mol. function=protein kinase activity; Biological process=protein amino acid phosphorylation
  Homolog annotation: Hit_ID=Q69S79; Match level="QueryCoverage=40%, HitCoverage=19%, E-value=4e-43, Identity=60%"; Hit description =Putative ABC transporter
MWYGGGSRAVAFCTQTYCVELHRAAALKHIVGRRLLRRVVPMSPIVFSSHRQPVKGIRCRFYQMLVEFVPFWGDSPVEIFEAVLRANLRFPTRVFCSVSPAAKDLLRRMLCKELSRRHGLALLNRVSDLMCVEVAVAPGGRWSRFKTYSMIQRTLEIWGFVITFIFKSWWNNHKFSYKGGMTEEKKTSRRNALAMWLKESIMRLGPTFIKDQLPPFPSETAIAIFEEELGSLLAGVFDHFEYEPIAATSLVNVQSEKGTQLNVLRSMIQMGVLVPTGDMTAVKRIAQFFLNMYFIKPI

SEQ ID NO: 208181 - protein, 540 aa, Glycine max
  Coding DNA Sequence Number=SeqID_91403
MYKKVGKQVCIVFSGCVEGLMESGVVIAFADNYRLVDNSRLSDVSGSSLDNKRLGSLALGTLMLRRLTYQCWAEVSAHSSFVVGHFDHDNVDKPGTDGELVADNVGVDSRHNISDAPALRAGEVPIELRTLPRFGFELQLDELFDGLWASVRSVVAQIYIKFFVNACLVDVQGSDWRPFVHAHDLSTFSWCMMRLGRLLGGRIRVGNLIFRCNVETMALSSLSVFLEIKARYNDVSGATLVDEYLGYHEVCNDDGDNHGVILVDGVNTLEVSICEIDVDVPNGVKMAFTRLVVVCTFVAGVSVCLDLLFFLFFCLHRDSYVAPLGVLQVLLLLGVPSSPLCYDRYRDGSLMGTSKLKASSRIIVRLAIKGIKSHAIRPIGCILHTEVFDEGVEAIYGSWWESTVPAFSTPPHGFAPSPQCGFGVAKEYLYLSWLLVEAHGGRQIYLPKSGVGTRQGGRVVITFADNYRLIDNSRAERLYFYDRAGIERRQVSRNAMWAPGLHTSALRVIFVKRTRGETCKTKYSNVEGSTEPDIYRSEVE

SEQ ID NO: 208182 - protein, 381 aa, Glycine max
  Coding DNA Sequence Number=SeqID_91404
  Homolog annotation: Hit_ID=Q6AVF2; Match level="QueryCoverage=73%, HitCoverage=99%, E-value=1e-71, Identity=52%"; Hit description =Expressed protein
MERSNPVRKPHTSTADLLTWPETPISDSPAPPSSAVRSHQPSDGIRKVVFGGQVTDEEVESLNKRKPCSDYKMKEITGSGIFVANGEDDASEAGSDNPNKTGVRMYQQAISGISHISFGEEESVSPKKPTTLPEVAKQRELSGTLESEDSILKKQLSDAKCKELSGHDIFAPPPEIKPRPITPRILELKGSIDIADGDQGDTNSAGKTAKKIYDKKFAELSGNDIFKGDAPPSSAEKSLSGAKLREMSGSNIFADGKVEARDYLGGVRKPPGGESSIALCNNKDYNPDTLHVPLIKLPRALCHERLGRNRVRKPLDQGLMLSMSQAVEIAIVVGWSRGGAIDQIGIIMYKGEFQQGLQKSEAKIEGVSGILGGVILDTDSE

SEQ ID NO: 208183 - protein, 645 aa, Glycine max
  Coding DNA Sequence Number=SeqID_91405
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=99%, HitCoverage=80%, E-value=0.0, Identity=61%"; Hit description =Probable Na/H antiporter [imported]-Arabidopsis thaliana
  Pfam annotation: Domain name=Na_H_Exchanger; Domain location=5-314; Score=0.3; E_value=0.00053; Accession=PF00999.11; Description =Sodiumhydrogen exchanger family
MNCDTIIRSSKKAITIALVCILIPMLGGAGFLALEHRVSGGSAKPTVSTKGYFFCCAILAVTGFPVVARLLSGLKILYTRLGKDALTAAMLIDAYGWIVFTILIPYSHDRGGKPLLSAICTFLFIVFCFYVVRPILTRIINRKIRLETWDSSGLLDVMVGLFICSSITDFLGAHHVVGAFVYGLILPSGKFADLMMEILDDVVTALIVPIYFASFGFRLHLEALWAVHNSVLFPVLMVLLLTIPKVLGSMLATFYFGMSARDGLGLGLLLNTKGIMAVIMLSVAWDKNLLDPYAFTIMMLAILFMTVLVSPLINVIYKPKLRFMQTQQRTVQKLRNDAELRVAVCVHNAHQATGMIHVLEATNATRISPLQVSVLHLVELTRHGTGLLVAQMDNPSSVQGESHYGSQEEFESISKAFEEFSEEYNAVRFETSSIVSTYESIHEDIYTVTQEKRANLVLLPFHKQLSSEGVLDTTNNAFSGINQNVMQQPPCSVGIFVNRGLDSLLKTKMSIIMIFIGGPDDREALSIAWRMAGHSCTMLHVVRLLLSGTEVAEEEKAFHSDSNGLLSTVMDSVMQKELDDEQILHFRHKGVHNNDSISYSEKEVKIETGEEIPLILNEIDKPGYDLYILGQGSGKNYTALQKLLE

SEQ ID NO: 208184 - protein, 226 aa, Glycine max
  Coding DNA Sequence Number=SeqID_91406
  Homolog annotation: Hit_ID=Q8S1S0; Match level="QueryCoverage=47%, HitCoverage=24%, E-value=3e-37, Identity=68%"; Hit description =Putative lung seven transmembrane receptor 1
  Pfam annotation: Domain name=Lung_7-TM_R; Domain location=2-203; Score=-154.2; E_value=0.082; Accession=PF06814.3; Description=Lung seven transmembrane receptor
MDNFDDNYFVEIVLESNINDGFVALERVAGAKDGGFDERSVLLRVLEAKDGVVVDIDEVGDEGGVVGEEDLLVRIHGRDDDIKAGVQGVGGRGEVQVREFQGRDDEGGVVGAIGVPIVWSIRSLRETSKIDRKAGRNLAKLTLFMQFYIIVTGYLYFTHIVVFALKTIATYKYQWVSNLTEEVASLAFYVVMFYMFRHVEKNGYFVLDEKEEEVVEIAVRDEEFEL

SEQ ID NO: 208185 - protein, 169 aa, Glycine max
  Coding DNA Sequence Number=SeqID_91407
MTEVEELAPHGGALERGLHRGRPIKKGQNAIPGPISWEAMKDRWRKKVWGGWVVVMVAGYNLLEAIGGHLMSVVVKHYGGKSDQVDKKCYYTTTMVIDPYKSARPDVVPCFDIVGLEVEGEKSIPRPTFLIPSLKSTLMGASIWRIIETLGARIWAHVCLGARLSICGM

SEQ ID NO: 208186 - protein, 183 aa, Glycine max
  Coding DNA Sequence Number=SeqID_91408
  Gene Ontology: Mol. function=RNA-directed DNA polymerase activity; Cellular component=chromatin; Biological process=chromatin assembly or disassembly
  Subcellular localization annotation: CTP_CleavageSite=48; ConfidenceScore=5.39e-01
MAVLEASDLMVNGRLKFNGANTRASVITCFKSSKTCWASTNKKNRFFCSNELGGPFTHSTNLGWIRSYVGRRNNMIETLQAIDKDVIEKHRHIFSKKWFEDDFVNIFLGHADLVEPLSEIKFREPGSIAQVVNWARDECGGSWNMGEVTLSVPRKDGCNRQLAGRFTCWVDTGAGRTGTSARS

SEQ ID NO: 208187 - protein, 478 aa, Glycine max
  Coding DNA Sequence Number=SeqID_91409
  Gene Ontology: Mol. function=mismatched DNA binding; Cellular component=intracellular; Biological process=mismatch repair
  Homolog annotation: Hit_ID=Q1XBQ8; Match level="QueryCoverage=99%, HitCoverage=37%, E-value=0.0, Identity=85%"; Hit description=DNA mismatch repair protein
  Pfam annotation: Domain name=GIY-YIG; Domain location=392-465; Score =28.2; E_value=2.9e-05; Accession=PF01541.14; Description=GIY-YIG catalytic domain
  Pfam annotation: Domain name=MutS_V; Domain location=11-300; Score= -16.2; E_value=8.8e-14; Accession=PF00488.12; Description=MutS domain V
  Pfam module annotation: Pfam domain module=GIY-YIG::MutS_V; Domain location=392-465::11-300
MSCSEGRRRRWVFPTLVESHGFEVDVKSLDKTHGMKISGLLPYWFHIAEGVVRNDVDMQSLFLLTGPNGGGKSSFLRSICAAALLGICGLMVPAESALIPYFDSITLHMKSYDSPADKKSSFQRLFKIGTKGKNEIIENNSNSIKYTKVLKKLHYLSFILDKKYPCHMRAIINVEMSELRSIIGGTTNRSLVLVDEICRGTETAKGTCIAGSIIETLDGIGCLGIVSTHLHGIFTLPLNKKNTVHKAMGTTSIDGQIMPTWKLTDGVCKESLAFETAKREGIPEHIVRRAEYLYQLVYAKEMLFAENFPNEEKFSTCINVNNLNGTHLHSKRFLSGANQMEVLREEVERAVTVICQDHIKDLKCKKIALELTEIKCLIIGTRELPPPSVVGSSSVYVMFRPDKKLYVGETDDLEGRVRRHRLKEGMHDASFLYFLVPGKSLACQFESLLINQLSGQGFQLSNIADGKHRNFGTSNLYT

SEQ ID NO: 208188 - protein, 135 aa, Glycine max
  Coding DNA Sequence Number=SeqID_91410
  Homolog annotation: Hit_ID=Q8LLX2; Match level="QueryCoverage=57%, HitCoverage=9%, E-value=1e-09, Identity=46%"; Hit description =Putative retroelement
MVDVAAHSLPEEVLFKMSKGFGNAHRITPITMPEAFVSGKKGMVKSGVQFGEPRGSTKLIKELVNGGHGELVFNGDGIEKGLWLSLIRPKSSIMNVVGNQTFWGELGWFAEQVAKPRKEEGEFYGLGKVVGDEGR

SEQ ID NO: 208189 - protein, 166 aa, Glycine max
  Coding DNA Sequence Number=SeqID_91411
  Homolog annotation: Hit_ID=Q1SSZ2; Match level="QueryCoverage=53%, HitCoverage=21%, E-value=4e-12, Identity=43%"; Hit description=C2 calcium/lipid-binding region, CaLB
MVEACWAASNRACPLGGPRPIARVQHPTVSDDGGSNDIVSHQSRAQMRVRCASNAGHAAEVSLYGAPSPKRPSSRPKGILNIGAAIIDNSMQSKPLGYNHNNLIKPSHPAMLELHHTKSDSSSMLSSEAIAPKHQAKAKKGKTSSQITQSRSPLFCRDQDFSIEFG

SEQ ID NO: 208190 - protein, 69 aa, Glycine max
  Coding DNA Sequence Number=SeqID_91412
MDVAFKDANAKSPLWEQVSRFKLLHQEDIEFQRFGMRNNVDQLCVFERTSYSFICSVESQEVLDAELSA

SEQ ID NO: 208191 - protein, 121 aa, Glycine max
  Coding DNA Sequence Number=SeqID_91413
MLAAVAAPRKRRWGTVAKSLSAISGSSEVAISAAVAPPPTAEATRDSLAPARHNQAILFNLNNETIILNLESGGKEGCGDDVNALEKELATVARRCNEVKKKMERRRECARGEGKRVRGEY

SEQ ID NO: 208192 - protein, 317 aa, Glycine max
  Coding DNA Sequence Number=SeqID_91414
  Gene Ontology: Mol. function=protein kinase activity; Cellular component=integral to membrane; Biological process=protein amino acid phosphorylation
  Homolog annotation: Hit_ID=O04212; Match level="QueryCoverage=96%, HitCoverage=57%, E-value=1e-131, Identity=74%"; Hit description =Putative ABC1 protein At2g40090 precursor
MVDSSDNPPELDFLTEAKNSERCVENFHKLSPHIANYVYAPNVYWNLSTSKLLTMEFMDGAYVNDVKTIRKLGINLHELSTLVSQTFAEMMFKHGFVHCDPHAANLLVRPLPSSKASIWGRRKPQLILLDHGLYKELDFQTRTNYASLWKALVFADANAIKEYSTKLGAGEDLYALFAGVLTMRPWNRVVDPSMDHLVIQGNESDRLELQMYASQYFHQISELLRRLPRVILLMLKTNDCLRAVNNSLGSSLETFFVIGKVSSEAVIEAKMLQSKSLLTWLNIKLDKILLEVRLWGMQVALWLLQLRKSLSWYNQAL

SEQ ID NO: 208193 - protein, 360 aa, Glycine max
  Coding DNA Sequence Number=SeqID_91415
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=77%, HitCoverage=39%, E-value=1e-61, Identity=40%"; Hit description =Probable Na/H antiporter [imported]-Arabidopsis thaliana
MRAYTSALVTDLLGDTPCGWGSVLLLSFIPKILSTVIASQFYGMSVLDGVSIGLLMNTKGILPILMLNNAWDKQILSVESFSILTVAVVMMTMTVPLIINAIYKLRKLYKQSKLKTIQNLKAEIELRILACVHNPRQATGMINILDACHTTKLSPLRVFALQLVELSGNTTSLFNQQRSGGAQALTKAQEDLESITNIFQTYTGANENTSVETFAAASTYSNIHEDIYNVSQEKQASLMRDAPCSVGIIVDRGLGSLFKVNLRVLVLFIGGPDDREALAVAWRMSKHQGVQLSVMRILMYGDMVASNNFGSSSSVLVGQKYGYGGVVFDNSNAATQQQPREVMPADDDNDDSGALAVKIE

SEQ ID NO: 208194 - protein, 119 aa, Glycine max
  Coding DNA Sequence Number=SeqID_91416
DELNPESSHLWLQFSRFPSPRSGPRPCGKRMGTTDEVAKPSKKGTIFVEDLPEEEQVVVAVLTQASWLLNPKLYGGPGKPEASLGKPGGSKDKDTNLVQAILLFDRATGENQGSETKKT

SEQ ID NO: 208195 - protein, 116 aa, Glycine max
  Coding DNA Sequence Number=SeqID_91417
NKRGYISCGSVQVEGTSTWLFKENKGGYIPCGSLLVKDFTRLKEISRTGGCLGTGCHLIQQLERFRTLICNLSRHCNFVTAGISSSHSAATSLSPSLSSRYNLIFILAVLQLSAMK

SEQ ID NO: 208196 - protein, 631 aa, Glycine max
  Coding DNA Sequence Number=SeqID_91418
  Gene Ontology: Mol. function=RNA binding; Cellular component=cytosol; Biological process=mRNA catabolic process, deadenylation-dependent decay
  Homolog annotation: Hit_ID=Q9C9R6; Match level="QueryCoverage=41%, HitCoverage=45%, E-value=2e-74, Identity=52%"; Hit description =Putative RNA-binding protein; 42664-44784
  Pfam annotation: Domain name=PUF; Domain location=336-367; Score =17.4; E_value=0.034; Accession=PF00806.9; Description=Pumilio-family RNA binding repeat
  Pfam annotation: Domain name=PUF; Domain location=372-406; Score =44.9; E_value=2.8e-10; Accession=PF00806.9; Description=Pumilio -family RNA binding repeat
  Pfam annotation: Domain name=PUF; Domain location=414-446; Score =18.6; E_value=0.022; Accession=PF00806.9; Description=Pumilio-family RNA binding repeat
  Pfam annotation: Domain name=PUF; Domain location=448-482; Score =32.8; E_value=1.2e-06; Accession=PF00806.9; Description=Pumilio -family RNA binding repeat
  Pfam annotation: Domain name=PUF; Domain location=534-567; Score =20.5; E_value=0.006; Accession=PF00806.9; Description=Pumilio-family RNA binding repeat
  Pfam annotation: Domain name=PUF; Domain location=571-601; Score =11.7; E_value=0.2; Accession=PF00806.9; Description=Pumilio-family RNA binding repeat
  Pfam module annotation: Pfam domain module=PUF::PUF::PUF::PUF::PUF::PU F; Domain location=336-367::372-406::414-446::448-482::534-567::571 -601
MDSPMLKMSDDNNKRNAAEDAETRFVGIPTTPSPFLHPDHVAVGSPITRVPLAPSPAPPPPSPCRFWLDPAYPVWGHDFSRINFFDATQTDNMPFEPYASYFNETGTLPYVNNTQTNMGLDPYAFCFNETGTFPSLPYHQHVNNVPLFDKGYTLGTPDDHDNLVYHHLVDQRRRQLEGTSDNNYQILRDRYMAASQSLHDGGGVKSPIRFSQITPQHQYPPNANITPSHYYVAAKQKAELSPFLSPRRIGGDPATAFRYDNNDVFLQGRDAKHYFENGYGSYRRSPRDDDAAAIHDVGGSVVPKNFYSAAAPSGQRSGGGDFSSLPMLLDFYSVPDAQCYIYNLAKDQNGCRFLQRMVDEGTYQDICIVFEGIIGNVVELMIDSFGNYLVQKLLDVCTDDQLLQIVLLLTNHPTQLVRISLNTHGTRVVQKLIETLTSDEQVSLVKSAIQPGFLDLIKDLNGNHVIQRCLQCFSCQDNQLLIGMDVVYCNVAFITQQERIGISWSQKYANMDFSSLRMHLESDTPAVSVKLLSQFKGSFVILSTQKFSSHVVEKCLKHIGNSRPRIVGELTSVPRFEQLLQDPYANYVIRSALLFTKGPLHASLAEIVRAHKGLRTSPYCKRIFSGSLLKK

SEQ ID NO: 208197 - protein, 278 aa, Glycine max
  Coding DNA Sequence Number=SeqID_91419
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=99%, HitCoverage=32%, E-value=2e-69, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MQEEINLIERNQTWELVDLPQEKRPIALKWVYKVKVNPEGSSEGEIEEFKKKIMQEFEMSDLGLLSYFLGIEFKDSNHGVIMHQAKYARNILKKFNMIDDEEDCEEMANPTYFRQIIGSLRYMCNTRQDLSFSVGYISIFMKAPMRRHLLAAKRIMRYIKGTVDYGILFPKGGGESEIELLGYSNSDWCGDKSNRKRTVVYVFLSGGAPVSWCSKKEVVVALSPCEVEYVAASMSACQVVWLDTLMQELQLKQVGVVKLLVDNKFVIDLAKHPTANGR

SEQ ID NO: 208198 - protein, 52 aa, Glycine max
  Coding DNA Sequence Number=SeqID_91420
  Homolog annotation: Hit_ID=Q5K3W0; Match level="QueryCoverage=84%, HitCoverage=8%, E-value=1e-10, Identity=75%"; Hit description =Monosaccharide transporter
MAGGGLAVVDAPPCGFDGKITLSVVITCIVAASSGLIFGYDIGVSVISYLAG

SEQ ID NO: 208199 - protein, 55 aa, Glycine max
  Coding DNA Sequence Number=SeqID_91421
MLSFVQKRHYHTNIVIDSTTTGRGQHTRQHNLQHRSFTTGQTEHGTEELKLKAGG

SEQ ID NO: 208200 - protein, 129 aa, Glycine max
  Coding DNA Sequence Number=SeqID_91422
  Subcellular localization annotation: CTP_CleavageSite=46; ConfidenceScore=5.10e-01
MSQAEPVFSIYLGNSTKTYSNFVLGRSFAKVWILASRIELLNTICRAIRKTPGPTRKLRTGRAMLLLVGATARLGELLFNLLSSFPVNRHEGVEVMSSASYIESIIVKLVRRRRKKKKERGRGASESLP

SEQ ID NO: 208201 - protein, 117 aa, Glycine max
  Coding DNA Sequence Number=SeqID_91423
  Pfam annotation: Domain name=Tryp_alpha_amyl; Domain location=32-110; Score=0.8; E_value=0.07; Accession=PF00234.12; Description=Protease inhibitorseed storageLTP f
MGQKTFLALVMFVMAYGLAATTFTVSQIPPSCNGDESLLTFCGPYMGNIHPNPTSDCCKAATSVFDKAMATGQGIRDLCNCLRVAGPVLRFQKEKVLRLPDVCQIKLSFSMELCIEG

SEQ ID NO: 208202 - protein, 101 aa, Glycine max
  Coding DNA Sequence Number=SeqID_91424
MNLKEVVRWHDAEASAAEEKVVVHGVKVKPMRKVEGGLNEGEFIVGVPYSKEEWEDEGHKQKRYNGVEMEKAKGEWREGREARIADLKRKREMERKSRTRV

SEQ ID NO: 208203 - protein, 108 aa, Glycine max
  Coding DNA Sequence Number=SeqID_91425
MSASLRYLDPGQYSCGSPPPPLQQPPSLESIAAHMQHLADQQAANHRGHVQLNESFYQYTLHQQRQDPSPYPWPTPEQFKATVAWPGDRPRFQVGAGLTEAPGDEDEA

SEQ ID NO: 208204 - protein, 121 aa, Glycine max
  Coding DNA Sequence Number=SeqID_91426
  Gene Ontology: Mol. function=RNA-directed DNA polymerase activity
  Homolog annotation: Hit_ID=Q2HRM8; Match level="QueryCoverage=76%, HitCoverage=11%, E-value=4e-13, Identity=32%"; Hit description =Polynucleotidyl transferase, Ribonuclease H fold
MNVEIRALEANHTWKLTDPTPHKTPIGLRLLLALAAISKWNLRQLDVNNAFLHGDLNEEVYMVIPQGMNPEKPGLVCRLQRCFYRLKQVLNQYPLPLIRLPDCINILVLLSQLNMPLLTGD

SEQ ID NO: 208205 - protein, 140 aa, Glycine max
  Coding DNA Sequence Number=SeqID_91427
MVEKYGEDILNHPSVDFDVWLKICDENKKGRIHNINHSFDLAITKHDSSSIVVGLSSTNSNPTTPPTKGITRINNYTNDSNAREDANIVASIDIIWNAILNATTGTSATYVDTIKGAREHTNEGANAGFRRRHKQKCRHF

SEQ ID NO: 208206 - protein, 102 aa, Glycine max
  Coding DNA Sequence Number=SeqID_91428
MKMFQNKLKRNFIYLILYDILSQPTLRREGDASASPMGGKCTESPPTFIQGKRRKNRKRCGLRTLIVKGSGVVFTHGEGCFLCSYVFLNWDEEIRPMKFFEN

SEQ ID NO: 208207 - protein, 163 aa, Glycine max
  Coding DNA Sequence Number=SeqID_91429
  Homolog annotation: Hit_ID=Q1SWX1; Match level="QueryCoverage=85%, HitCoverage=27%, E-value=9e-11, Identity=27%"; Hit description=IMP dehydrogenase/GMP reductase
MGSSQAPSLKKRFYQVKIKGLGVASLKELGQLMGQLQRQAFRKAYGKIWDLTMAEVSTEAIASLAQYYDQPLRCFTFGDFQLTPTVEEFEEILGCPLGGRKPYLFSGFYPSLGRISKIVKISTQELDRGKQVENGVVGGTKEMFGSKARVLASQEEWAPFMTS

SEQ ID NO: 208208 - protein, 212 aa, Glycine max
  Coding DNA Sequence Number=SeqID_91430
  Gene Ontology: Mol. function=DNA binding; Cellular component=nucleus; Biological process=regulation of transcription, DNA-dependent
  Homolog annotation: Hit_ID=Q6QAD8; Match level="QueryCoverage=99%, HitCoverage=81%, E-value=1e-45, Identity=48%"; Hit description=MYB transcription factor
  Pfam annotation: Domain name=Myb_DNA-binding; Domain location=22-67; Score=50.9; E_value=4.2e-12; Accession=PF00249.21; Description=Myb -like DNA-binding domain
LKRNGKSCRLRWVNYLRPDLKRGQITPQEESIILELHARWGNRWSTIARSLPGRTDNEIKNYWRTHFKKKAKSPSDAAEKARNRLMRKQQFHQQQQQQQEQLQQQHQAQQQQMQFNFDMKGIMAMLEDNIHRTPYISQSRQEMINMHQNTTEEQGYLYSMLNDNSSASSAPETSAEEVLWDGLWNIDDVHGNFSVASAASKVGLYNLVAPFC

SEQ ID NO: 208209 - protein, 171 aa, Glycine max
  Coding DNA Sequence Number=SeqID_91431
  Gene Ontology: Mol. function=transcription factor activity; Cellular component=nucleus; Biological process=regulation of transcription, DNA-dependent
  Homolog annotation: Hit_ID=Q45EZ4; Match level="QueryCoverage=86%, HitCoverage=41%, E-value=1e-47, Identity=68%"; Hit description=RAV -like DNA-binding protein
MEKKFLCFVHLPLFLSLTYEDVARRNRFLKQLLMRFCIVDAARHGTITTMPTTVRAMLELVAVGVLVESIDDVKLGIRVEELGLSVIGGNCDGRRLKVCESVVATKALRDNVLGSGDFVFLIESVEPHTLVLLINLCSPATVWSRHNAFVFQRREFPGFGLAENVTTMGGR

SEQ ID NO: 208210 - protein, 216 aa, Glycine max
  Coding DNA Sequence Number=SeqID_91432
  Gene Ontology: Mol. function=nucleic acid binding; Cellular component= beta-galactosidase complex; Biological process=DNA integration
  Homolog annotation: Hit_ID=Q1S1X7; Match level="QueryCoverage=98%, HitCoverage=16%, E-value=7e-74, Identity=62%"; Hit description =Integrase, catalytic region; Zinc finger, CCHC-type; Peptidase aspartic, catalytic
GSLMYAMVCTRPDIAHAVSVVNRYMANPGKSHWQAVKWILRYLRGSTNLGLVFGKATNECNGHVIGYCDSDYAGDLDRRRSLSGYIFTLGSSAISWRATLQSTVALSTTEAEYMAATEAVKEALWLKGLVGDLGVSKKEVVVHCDSQSTIHLTKNQMYHERIKHIDIRMHFIRDVVTQGDVLIEKISTSDNPADMMTKALPTIKFKQCLDSVGIKN

SEQ ID NO: 208211 - protein, 116 aa, Glycine max
  Coding DNA Sequence Number=SeqID_91433
MGHSKDRKKEKKWSKEVKGGKLTQSMAYKEALRKKKKVTKDIEEDDEELEVVAHFASSNDDDKSLDEAVEDNDKDKHSPTRLDFTDYLELARRAGQMQHRLPHTFTTHLGITPIFQ

SEQ ID NO: 208212 - protein, 296 aa, Glycine max
  Coding DNA Sequence Number=SeqID_91434
  Gene Ontology: Mol. function=sequence-specific DNA binding; Cellular component=nucleus; Biological process=regulation of transcription, DNA-dependent
  Homolog annotation: Hit_ID=Q7X9H4; Match level="QueryCoverage=96%, HitCoverage=97%, E-value=4e-57, Identity=43%"; Hit description=MADS -box protein AGL66
  Pfam annotation: Domain name=SRF-TF; Domain location=9-59; Score =103.9; E_value=4.7e-28; Accession=PF00319.9; Description=SRF-type transcription factor (DNA-binding and dimerisation domain)
MGRVKLEIKRIENPTNRQVTFSKRRNGLIKKAYELSILCDIDIAVIMFSPSGRLNHFSGRRRIEDVFTRYINLPDQERDNAVSFPELPYRRSIQNKEELQQEVNRLQQQLQMAEEQIRLYEPDPLKMSSMADLENSEKHLVDVLTRVIQRKEYLLSNHLSSYDPSGIQGIPTSFENVGWLQDGSQNQAQIFDASAPLDPLRDLSSTMYGSFSQGRSSNADPRGMGECHVSNPSDGNLQAWPQGYTLYPHHIQHDMVGPDMPDMMPHAQVNLPITALEPPKNNEPVEYDQSKQPHHH

SEQ ID NO: 208213 - protein, 179 aa, Glycine max
  Coding DNA Sequence Number=SeqID_91435
  Homolog annotation: Hit_ID=Q5W7F2; Match level="QueryCoverage=18%, HitCoverage=4%, E-value=3e-11, Identity=94%"; Hit description=ARF-GAP
MAINGREEKRKGGGEIVNLKLKSFEKWNAPEENYREGHRGRLKFFSEKENQETQQPHPREGNAPEKNPHCVAVVLPGKDARCRSSEKMSRVYVGNLDSGVTERDLEDEFRVFGALFAFTFILSNEGLGEAYDGDIAFASALETFGGGHNDPIGVALGGMLPFYINIMMVDERFSVPPGS

SEQ ID NO: 208214 - protein, 129 aa, Glycine max
  Coding DNA Sequence Number=SeqID_91436
MTEPQPPREFRIFSTGKCFKALELDRVGWRTITPEQVFGSANSSLAIISKRVGLDRVLSRGGNFGFKRLVVRVELNLEKLEGNGSWLWFPFEVGGRVSEFHYWREPTWGESDPVAGGRFGQCCCGFKFG

SEQ ID NO: 208215 - protein, 109 aa, Glycine max
  Coding DNA Sequence Number=SeqID_91437
MDYHERKPRVCRWKSGKALLVVTYRKRLDRLTSDVVCWIPYDYMNKFYRISHRFTSLLQLVDPPRHPPMVHDDTFIVPDPPVLPIQSATMPQPLVLVAANADMPRHAVV

SEQ ID NO: 208216 - protein, 101 aa, Glycine max
  Coding DNA Sequence Number=SeqID_91438
MDHAAEEVHEQPQEPITDHVDVDTKEHTELKLAFHGSKVENFGRPAAEIEGIVVATRLSSLITCSFETDQVVDLLVELLDVSTQKAKDDTFQCKRAYVRLT

SEQ ID NO: 208217 - protein, 84 aa, Glycine max
  Coding DNA Sequence Number=SeqID_91439
MDCEIKARQRATLSTVVILPSVTVSREKRLCCMEENLLVLLKRISGKQRVAWEGLGEEMKRIIDIEWPMVVVTAASQANCGVIY

SEQ ID NO: 208218 - protein, 84 aa, Glycine max
  Coding DNA Sequence Number=SeqID_91440
MKNRRELVRLCKNHNTINMYEQKKKKKKKKKKKKKNKKKKKKKGKRGEEEKKKELVRTSEEQKGTREGTTKATILRRHDEGTKS

SEQ ID NO: 208219 - protein, 69 aa, Glycine max
  Coding DNA Sequence Number=SeqID_91441
MAKHYSISKKRIHQIFKTRNGTFVPNKEKVGTQEVAPRSMLQQPGGRNYFDPAEAKIPGLTNNSFIDRY

SEQ ID NO: 208220 - protein, 123 aa, Glycine max
  Coding DNA Sequence Number=SeqID_91442
MYVYEKEILVIRKQLSNFPIAVSAIANNNGGRSKNAKEKRTSKKKQKCEEVFLLITTTMAATKMKKQKREEEAFIWEEDAESRHEEEERRRCRILKQKNEEAEAKPSEEGRRSKHGREARVIF

SEQ ID NO: 208221 - protein, 193 aa, Glycine max
  Coding DNA Sequence Number=SeqID_91443
  Gene Ontology: Mol. function=structural constituent of ribosome; Cellular component=ribonucleoprotein complex; Biological process =regulation of transcription, DNA-dependent
  Homolog annotation: Hit_ID=O49937; Match level="QueryCoverage=67%, HitCoverage=47%, E-value=2e-30, Identity=54%"; Hit description=50S ribosomal protein L4, chloroplast precursor
LLGELRRKVLQHNGTGDDVGNSGGDGEALLLAVDLDAPVVGLRAEDDASAGPVGATGFFLQEGLPAAASDLAAGEGGGGAAALVLEVGDDGMVDDDTSGVGRGEAEVEEGLADLLAREVEDGKRRGGLAGNGEGMEDDVKEREVGVVGVERERESEAIVDWYDANPKGLDICIASFGASFLAIATSKGFMEAK

SEQ ID NO: 208222 - protein, 118 aa, Glycine max
  Coding DNA Sequence Number=SeqID_91444
  Subcellular localization annotation: CTP_CleavageSite=45; ConfidenceScore=5.27e-01
MVIIIVRNNPAGVAWLRGLPRRWWTPSIRQPFLSRTSRAKSLVVVAVESSEMIVAAIFRGHNRLKGMTQRKIPCGFKDEQSEDEQQLDEGEANNGYRLNDQSEDDGMLNGVGWDQWQW

SEQ ID NO: 208223 - protein, 107 aa, Glycine max
  Coding DNA Sequence Number=SeqID_91445
MQPLTETRSLPRQWKSKMELQVLNADEESPNARQTNLQGKQTTPGGEEEEARTAQPGKGKAKKLVRKKQFGKARTASTKRNTPRLSARKTLEEDELYRFAKRTTSSH

SEQ ID NO: 208224 - protein, 274 aa, Glycine max
  Coding DNA Sequence Number=SeqID_91446
  Gene Ontology: Mol. function=nucleic acid binding; Biological process= DNA integration
  Homolog annotation: Hit_ID=Q1S0A6; Match level="QueryCoverage=98%, HitCoverage=20%, E-value=3e-78, Identity=49%"; Hit description=Zinc finger, CCHC-type; Peptidase aspartic, catalytic; Polynucleotidyl transferase, Ribonuclease H fold
MKTSFRARRKWSFIDGTIKKPEEGSFVMENWWAVQAMLERFSIPNGPCIHQLKSNLAQCKQGGLSMVAYYEKLMASWDDLANYEQLSICTCKGCMCGVAAKLEKHREEEQGHILFMGLDDGLYGMICSNLLATNPMSYLNNMNSILVQEERLQTITRSKEERTKVMALTAQTSARMKGHENKNKYVCTNCNKSGHDEANCLLLIGYPKWWGDRPRNDDKAGGQGRGQNRTKGTGSNSEHAQKGPIHAHVVQNLGSNISGDMENFGMTGLSKEHM

SEQ ID NO: 208225 - protein, 197 aa, Glycine max
  Coding DNA Sequence Number=SeqID_91447
  Gene Ontology: Mol. function=zinc ion binding; Biological process =intracellular signaling cascade
  Homolog annotation: Hit_ID=Q1S0A6; Match level="QueryCoverage=66%, HitCoverage=8%, E-value=1e-29, Identity=51%"; Hit description=Zinc finger, CCHC-type; Peptidase aspartic, catalytic; Polynucleotidyl transferase, Ribonuclease H fold
MTPKYNQTRLLQETFKVKQIEIASRLIQGFDDAKKNSLDNDCHHQKEEECKCMNTDFDGAKATCPTEQWQTLVELLNNSKATPNESMACKTKLNLWILDSKASYHMTGTLQHLCDARKVLRCPVKLPNGHTTISTKEGTIRLVGGLRLENVLYVPQLNCNLISISQLSNESNSNVQFTANLCVIHDLTLKMLIGASE

SEQ ID NO: 208226 - protein, 356 aa, Glycine max
  Coding DNA Sequence Number=SeqID_91448
  Gene Ontology: Mol. function=nucleic acid binding; Cellular component= beta-galactosidase complex; Biological process=DNA integration
  Homolog annotation: Hit_ID=Q1S0A6; Match level="QueryCoverage=92%, HitCoverage=25%, E-value=1e-118, Identity=58%"; Hit description=Zinc finger, CCHC-type; Peptidase aspartic, catalytic; Polynucleotidyl transferase, Ribonuclease H fold
MQQLPPRKKALGCKWVYCVKYHSDASQPDMVCKLQKSLYRLKQAPRCWFAKLSIALKSYGFQQSYLHYSLFTLHREDTQLVVLVYVDDLVIAGNTPSAIKHFKLYLNTCFYMKDLGVLKYVLGIEVARNPTGIFLCQRKYALDIISEVGLLGAKLVATPLEQNHRLSLVVGHLISNLEQYRCLFGHLIYLCFARPELSYSVHLLFQFMQEPRTEHWEATLHMLGDSPISWKTKQQHTISRSSAEAEYRSVETPTCELKWLKGILSNLWVVHDKPMTIHYDSEVALHIAKNPVFHERTKHIEINCHFVWDEVLKDNIRPSYVPTSAQLADIFTKALGELEFEAFLGKLGIRNLHTPT

SEQ ID NO: 208227 - protein, 55 aa, Glycine max
  Coding DNA Sequence Number=SeqID_91449
  Subcellular localization annotation: CTP_CleavageSite=45; ConfidenceScore=5.27e-01
MAPSMVGMLASGPPNGCSMKVTSSPKVIASFQTPPPPEKQSETRSCGMRGHDPSK

SEQ ID NO: 208228 - protein, 82 aa, Glycine max
  Coding DNA Sequence Number=SeqID_91450
MSCEVREKQDDLKAALQRKANRISSFTEHNEVAGRLLNVCIQEAKLKLLIAMEHWLITNQEELFYSSFFACQCYCIDHLLPG

SEQ ID NO: 208229 - protein, 609 aa, Glycine max
  Coding DNA Sequence Number=SeqID_91451
  Gene Ontology: Mol. function=RNA-directed DNA polymerase activity; Cellular component=nucleus; Biological process=RNA-dependent DNA replication
  Homolog annotation: Hit_ID=Q1SFJ7; Match level="QueryCoverage=95%, HitCoverage=70%, E-value=1e-102, Identity=35%"; Hit description=RNA -directed DNA polymerase
AAVWECGSEKSPGPDGLNFKFIKQFWKLLKPDISRFLDEFHANGIFPKGSNASFIALIPKVKDPQSLNEYRPISLIGCIYKILAKVLANRLKKVMSEIIDVRQSTFIGGRQLLHSVLIANESVEEAKSGSNGLRAAFGQPRPYGFDEGRSGQEIVFELYGGKKNEPINILQYADDTILFGEATMLNVKTIKALLRSFKLVSGLKINFAKSCFGAIGKSELWQQEAAAYLNCKLLFMPFMYLGIPIGANPRRSEVWDPIVRKCERKLARWKQKHISFGGRVTLINAVLTSIPIYFLSFFRLPSKVAEKLVTIQRRFLWGGRLEQRKIAWVKWKTVCLPKDKGRLGIKDIKTFNTTLLGKWRWDLFQQPDEPWAKLLESKYGGWRSLEEGKTGKLNGGWDVVTSAGSGRIMGSNSGAVWDWQLNWRRPLFDSEIAMADDFIGKIAQKEILPHKTDSWWWKPDPGGKFSSKSAYRMLWGELTGTNQEAAFKDLWKLKIPPKAAVFAWRLIKDCLPTKLNLSKRQVVLSDTMCPFCCNHEEDAAHLFFNCSKTLPLWWESLSWIGVVTALPQNPRAHFLQHGHQLVGCYIAGCCGVGLGPISKHRNQLAPNIL

SEQ ID NO: 208230 - protein, 71 aa, Glycine max
  Coding DNA Sequence Number=SeqID_91452
MKKIWRFKDVGMEDVIKEKDEEGFYARREKSETFIDRDELNPQGLCSMVIDYQSIAESGNRLPDPKTWIFK

SEQ ID NO: 208231 - protein, 662 aa, Glycine max
  Coding DNA Sequence Number=SeqID_91453
MREREPGGGGVDHRNQSESRQREDVRMRVDPRQRYDDTRRGQLHKHQNANWRDRNDITTFYFTRFPEQTTEKELWIHFKQWGEGVQDERRLERNLDNIILGGLKMYVNAPKYGRGKERHIGHNIIQRTLAGEDINGSNAPGQVSQQYRANPMTYAKAVTSTIKAANAWVGRLKEPRFFKRIEEELPWEIGSNVVPKYIGDDMILLLGLSDAKAEELILEENKHGTSLFYSVERWSPTLRPRNRLIWVQCWGIPLEAWDIRHIRKIVAAVGDLIEVDDDVEELRRLDRARVLIRTPWIPLIHHTVTMHVQQETHNVTIVEESQNDAGQRFHQRRNVIGSSKEIDSDDSDVAEMSHATSDTHPPPTRFAVRHTGDGEDDQHEPSSKLSPAKDYHSADIDTQHGETTLNGPKPRRTGDVATQPAATLSNGSRHHLNPSGITRGQGAHFPIEEACTRLEDRKGNMHSAGVESTTLLEAHFGDHRLHAAPNWKEQGCRGMSPTTAGRLDREEGEISEDAANGQMEVDLNNANGSFVPITVARDISAGICGLSNLEAHDIVVGTTGPSIAEGCRKQVAQEEGKEDNMGAANMLANHQNSIGEVITDPTCSKNDTTTVHVEEATSQWEMAKALGVTAVADPDKIIKKIEEMEDRDRKEAEAMGTLNIHP

SEQ ID NO: 208232 - protein, 98 aa, Glycine max
  Coding DNA Sequence Number=SeqID_91454
  Homolog annotation: Hit_ID=UPI0000196C59; Match level="QueryCoverage =73%, HitCoverage=8%, E-value=1e-09, Identity=48%"; Hit description =triacylglycerol lipase
  Subcellular localization annotation: CTP_CleavageSite=37; ConfidenceScore=5.69e-01
MASLQFRYVLSLLSPSLIPLPPRFSGTFPPRFPGKLRAFSLARRRRVLSIRCCSSKTGSQLQRVPVPEDDDRHPFDINLAVILAGFAFEAYTTPPIVL

SEQ ID NO: 208233 - protein, 121 aa, Glycine max
  Coding DNA Sequence Number=SeqID_91455
  Gene Ontology: Mol. function=triacylglycerol lipase activity; Biological process=lipid metabolic process
  Homolog annotation: Hit_ID=UPI0000196C59; Match level="QueryCoverage =69%, HitCoverage=10%, E-value=3e-15, Identity=50%"; Hit description =triacylglycerol lipase
  Pfam annotation: Domain name=C2; Domain location=29-105; Score=58.9; E_value=1.7e-14; Accession=PF00168.20; Description=C2 domain
MGRHEVDAGGCKTVYLSEEFVREIYDGQLFIKLKKGFNFPAMDPWGTSDPYVVIQMDSQTAKSSIKWGTKEPTWNEEFIFNIKQPPSQTLQVNKHDLSRSLTSMCAYIFQWNAHSQGSLFS

SEQ ID NO: 208234 - protein, 79 aa, Glycine max
  Coding DNA Sequence Number=SeqID_91456
MWSSRRPLKVLTISLPIRLWRERGSVVASRTAEGGGGGAARRGRGGWWCRTPRQGRGWCTAQRWRVREGWRGKGRGLCG

SEQ ID NO: 208235 - protein, 207 aa, Glycine max
  Coding DNA Sequence Number=SeqID_91457
MNPPPNRAKVNEEEDEGEMSYNVFIDCGLDGHGSSNKGKKVKSPNRHAHFVQTLQYSSSFFLALLTHKIDPNSDFNRIWKEIVNETFKENIEEEIMRYLRKVSNVEAAIPLNCTLSNHDPFPNEIRCNRNEYLRSPKNNDINRLLQIGKAWGFQGQCPNNNFYEAIYTTCMYFVNGNTTRKNKDLNPFPTCTLPDTQVMKLKMNYWR

SEQ ID NO: 208236 - protein, 145 aa, Glycine max
  Coding DNA Sequence Number=SeqID_91458
MKDHLHLNISTPTLESSSSTRPNEPNFTTKPNLPNGELSPFSEDEDEVLHNQPQEKDDEEEAQSVSPITIVPPYYISPLMQNFEESYFQDFEYEHSLDCKEVQHPVGTLFKRMCFLKKQDVQNALLQYHVSKWTNYKTQLSNPKK

SEQ ID NO: 208237 - protein, 533 aa, Glycine max
  Coding DNA Sequence Number=SeqID_91459
  Homolog annotation: Hit_ID=Q7XZF5; Match level="QueryCoverage=98%, HitCoverage=31%, E-value=2e-73, Identity=33%"; Hit description=RST1
MESYGPLLEKTQVPQPALQKLAVDSIFSKLRSAPSHLDPESEPGRRAISQCLASPSPHVVDHSVRHLCRLAADSAVAVPRASLELLSALQGSDPKLVPIFVKGLGFLARHDFRHKNSASQQFTSSTLTHPFVRNKDVGMVRVCEFLRPLLNVSIIRLSVSESSLSSSFAMQLVSSMAAFCCSFPHETVPVFKLLIECLKFLPHESSEDYRKLVFVVEHMVEAYIVVLKSLAGKKSNDLGLPWLPGLASTIASLFTIIVQSELEHEQISILKLLLLILKWKYDNVTNADAAISEPKFSLFEETLFLLPVVSLMSSPSKSVKGLATDLLLLLEKLLVKMFVAPKDKPIVKGGDHYLSTPGVIVLRLLRHLWYQDGESSPRTSLLKLTLKGLNQSEIMHDRPISWVSHLRGFCLSIVDQRKSSLAISHSQEVFLNEMPLLLSAVLNVLLIHQSMAAAAVDCLSSIAIMDPKLGVPLLLTIMFYSNIFIRNDINHHDMLLNFFEMLPSLASHSAMIPLVVQTILPMLNKDAKVWVLL

SEQ ID NO: 208238 - protein, 236 aa, Glycine max
  Coding DNA Sequence Number=SeqID_91460
EEHGMQCYLGVKISDLDGSAPKSIHEFFEEPVVYLWQTGQGGRGHIVRPAGGVLRTKSFDEGVKAIYGPRWEFNVPGSPKSGRRPDARLDLLSHLYHSRLSGFHPKDFVKDILQDDGNLKWVAWGLDVGTGRGRTSHLSNKHEPPADHGQPLAFLVLPYGVAPSPQCGRDRVLTTDEKERVDEKPRGMFYYSPAALGLYMSALRMAFVERTRGGTCKTKDSDAQGLMEPGIYRSGA

SEQ ID NO: 208239 - protein, 166 aa, Glycine max
  Coding DNA Sequence Number=SeqID_91461
  Gene Ontology: Mol. function=zinc ion binding
  Homolog annotation: Hit_ID=Q1SXA1; Match level="QueryCoverage=78%, HitCoverage=35%, E-value=2e-26, Identity=42%"; Hit description=Zinc finger, SWIM-type
  Pfam annotation: Domain name=SWIM; Domain location=89-121; Score =29.2; E_value=1.5e-05; Accession=PF04434.8; Description=SWIM zinc finger
MDANVDRATNGLVRFYEKNRLLHGMVTDGREVTTILASGQVYKEVQNKIIEDALRKENTHNFIEFDLHNTRFLVQETTNLREVRLTGDFKVKLDERWCDCDKFQKLHMPCSHVVATCKHTHHGHNNYIHPMYRLESVCNIYKTLFGELRSETYWSSCHEPMISPNP

SEQ ID NO: 208240 - protein, 1229 aa, Glycine max
  Coding DNA Sequence Number=SeqID_91462
  Homolog annotation: Hit_ID=Q7XZF5; Match level="QueryCoverage=99%, HitCoverage=64%, E-value=0.0, Identity=47%"; Hit description=RST1
MVLCWNKQSCIESQDPVIKAIGLQSLAFLCEADVIDFYTAWDVIAKHVQGYQDDPILAHSLCLLLRWGAMDAEAYPEASKSVLQILWDVVTYGQGRQWGKARISALEALAQYEVPQLENSIPDFKKMNLELFFSETNPKVLKAMEEFHVKLITYEHINRRRVVKEKRVTGSKIEKLMDVFPQVIFSSGVINKARELPGASLLCFSFPPKDMNEHLASKRLRDVHAGYENALVEVAASLQLSRNILLALMALQSWKGFMRRWMKAYTLSYDAKAQSSVLDKTSKAASDILKVRLFCYMLFVQSMIAIADEAIPRAAENIALAIGALCVVLPPSVHMVKSAASKFLLEWLFQHEHEHRQWSAAISLGLISSCLHVTDHKERYHNITGLLEVLSDSKSSLVKGACGVGLGFSCQDLLTRVETSDTSTVMKETEYVPESVLLGRIIRALATMIQQRTRCSSDVLDSLCSCFPLGSYDMSAKGYEQLSENSEDLEEDIWGVAGLVLGLANSISAIYRAGELETVIKIKNLLMSWLPYLHSLVESSTFQWKESEHVLALGSCIALPTVVAFCQRMELINDVELDRIVVGFKELISELIAVKKSGILHHSLLMASCVGAGTVLSCILNEGVYSIEVERVKCLLELFRKCYLNPFPFLVHLGGMLGVVNAVGAGAGILVNMNFPNYSRQSGYQKESSSVMGPLLSSSDFEPYLTSLVQEMFLVAQNSDNHQLQQFASWVLAFLRHHLWSKELLGVDSDRSVAATNSKSVSQSFSEDNIVLKLSLWLTSFKYTESLLIVLIFGLFQVQPGTIVHISRVIAVLRCLSTAPRLPSLDWGSIIRRCMRYEAKVAELLPKDSASKNGTLREECIMFAMAHANQFDSLLTFLDELSDFSRFRTLEINLQSCLLNHLADLVKVYSNSRLEKLFGDVSNHLSSFTSYKESSTYPKSLLCISCWKGLYECLDEVSVDSSGYISHIERCMEVLFTLLPVVQSSGSVSSADVSSVEEWSEAVRCLGKAPQIWLLDFLKVSHEEFVQSAGKSIEVQKKVCAKIKLVKTGSLSLTELGKMKSYILNSKSQGLWDILFEVVAALYHAEGSVKKQWLIDAVEISCVSSFPSTALQFLGLLSAACCKYMPFMIVDQQMVLNDLPVTLVSLLADQNWNAVAETVVSHFFSSTERIYDWSVQIADGSYIPDSQPIDGSENHMAVFLLQVMHHTCVLLKSYLPLDKQLRLASMVIT

SEQ ID NO: 208241 - protein, 266 aa, Glycine max
  Coding DNA Sequence Number=SeqID_91463
  Gene Ontology: Mol. function=ribonuclease H activity; Biological process=DNA integration
  Homolog annotation: Hit_ID=Q53JA8; Match level="QueryCoverage=30%, HitCoverage=11%, E-value=8e-15, Identity=39%"; Hit description =Integrase core domain, putative
MALPFWQASGGTWTRMLAYHSASKLLGPEELASAYPESAFFGVAAHVIFTEFPKDFFQARHMVCVFGAHPVQINVVDAHFPFAVGLFDHDNIGEPGRKPDFSDEHVGDVPVLITGEVPTEPRALSGFRSELQLDKPFDGFRASFGSVISRIYVKSIAQACLVDGQGLDLRPFVHAYDLSAFSRCGVRHALTITISLIKVGNFIFKWAPGELALTEGGHQVHKPLDINGTVLVDKDPVHHEVCNNDGDDHEAVLVDGVDALEVPIRK

SEQ ID NO: 208242 - protein, 105 aa, Glycine max
  Coding DNA Sequence Number=SeqID_91464
MKRNKLVQHKWKKKLFALILVVFCLGSLLFMQTRYHHVAGLVSLQHRFVSEPEVQVVIDLYIFGISKVLNIGSSCVVVAFVDIAANCGQRWLIRSQLRSLALKKP

SEQ ID NO: 208243 - protein, 681 aa, Glycine max
  Coding DNA Sequence Number=SeqID_91465
  Gene Ontology: Mol. function=DNA photolyase activity; Cellular component=nucleus; Biological process=DNA repair
  Homolog annotation: Hit_ID=Q6EAN1; Match level="QueryCoverage=99%, HitCoverage=100%, E-value=0.0, Identity=82%"; Hit description=Mutant cryptochrome 1-1 protein
  Pfam annotation: Domain name=DNA_photolyase; Domain location=5-176; Score=281.1; E_value=2.1e-81; Accession=PF00875.8; Description=DNA photolyase
  Pfam annotation: Domain name=FAD_binding_7; Domain location=207-485; Score=525.3; E_value=6.6e-155; Accession=PF03441.4; Description=FAD binding domain of DNA photolyase
  Pfam module annotation: Pfam domain module=DNA_photolyase::FAD _binding_7; Domain location=5-176::207-485
MSGGGGSIVWFRRDLRIEDNPALTAGVRAGAVVAVFVWAPEEEGQYYPGRVSRWWLKNSLAHLHSSLRNLGTPLITKRSTDTLSSLLEVVKSTGATQLFFNHLYDPLSLVRDHRAKEVLTAQGITVRSFNADLLYEPWEVNDAHGRPFTTFAAFWERCLSMPYDPESPLLPPKRIIPGDASRCPSDTLLFEDELEKASNALLARAWSPGWSNANKALTTFINGPLIEYSKNRRKADSATTSLLSPHLHFGELSVKKVFHLVRIKQVLWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGSLPDGREIDRIDNPQFEGYKFDPNGEYVRRWLPELARLPTEWIHHPWNAPESVLQAAGIELGSNYPLPIVGIDAAKTRLLEALSEMWQQEAASRAAMENGTEEGLGDSSESVPAAFPQDMQMEETHEPVRNNPLPVARRYQDQMVPSITSSLLRVEEEETSSDLRHSAEESSRAEVPVTANAQQNVGVTLNERMLQTTNRNAQTQYNTTMELRNVAEDSAVESSSGTRRERDGGVVPVWSPPASSYSEQFVGEENGITNSSSFLQRHPQSHQMLNWRQLPQTG

SEQ ID NO: 208244 - protein, 156 aa, Glycine max
  Coding DNA Sequence Number=SeqID_91466
MHSTLTYLSLTEWAHTEVSVRASSSEGTRRDASNSESSFSERVRALHRVGRGTSHSHGRAQLFVAVGELVMVTVILPPYAFRGVRRGSGGGDVKASPRMRRSHSARSLSSTPAVIGYEGVAALQRQMKLTSLEDSCKLAIQACGSDDFSFLRTMPN

SEQ ID NO: 208245 - protein, 128 aa, Glycine max
  Coding DNA Sequence Number=SeqID_91467
MSFLFIPKQFFYEYRLGAEHGLSSVGFGLKKSNPQQPNPSYFDPSLTVYLIGLDERDDGHGGSRTETRGIESRTKTRNEKWEKRKTRQRGNQENQGYKKKAVLEYQRCKTILKKVLDWMSDREMTPMN

SEQ ID NO: 208246 - protein, 110 aa, Glycine max
  Coding DNA Sequence Number=SeqID_91468
MDDDPLRNKELSFGKEKSYRTPFLEKESLTFMEEGKRMRECKNEGVGQGRVVAGGRGVVNVGVSSKKGCRRCGCAVEEGMSSHVERKEKGGVRIERYEVKISIKVLLYFY

SEQ ID NO: 208247 - protein, 339 aa, Glycine max
  Coding DNA Sequence Number=SeqID_91469
  Gene Ontology: Mol. function=peptidyl-prolyl cis-trans isomerase activity; Biological process=protein folding
  Homolog annotation: Hit_ID=Q653M6; Match level="QueryCoverage=78%, HitCoverage=46%, E-value=1e-27, Identity=35%"; Hit description =Peptidylprolyl isomerase-like
  Pfam annotation: Domain name=zf-CCHC; Domain location=38-55; Score =29.7; E_value=1.1e-05; Accession=PF00098.13; Description=Zinc knuckle
MQMDNALIDDRRIHVDFSQSVSKLWSQYRRKDQKGKGGGCFKCGSTDHIAKDCTGDSTMKQPQAKYILKDDNAQRGGDNARYEMVFDGDNSQSPRRDIKHQWHDGDLVERKDHRSRREQDMVDSNNRDRYGDRSRGHGGNGDNKARSERGARDLGSHADTKDRDRHMGRHGDDDYKRKDECDSRKRDEDDGYKRKDEQDSRKRDEDDGYRERRTSRDDRRNMDSSHLERRNDRDYRKRPEDSGKQEMKMDSGRRKGSPVDEDYKNGRDDEDYKHRREERGHKRQDTKADDDYKRRREDVDYKRRREDGDYRHRRQERGHKRQDIVSDDYPHRRHHGDRR

SEQ ID NO: 208248 - protein, 178 aa, Glycine max
  Coding DNA Sequence Number=SeqID_91470
  Gene Ontology: Mol. function=protein serine/threonine kinase activity; Biological process=protein amino acid phosphorylation
  Subcellular localization annotation: CTP_CleavageSite=64; ConfidenceScore=5.06e-01
RVNFKFSHSDGVVDCVSVVKNQRGKICDLTHQAASTASCRTTAGFGRGPIQRSQIPANSLILINSTAQSTTDGGLKLTTIAFLPPLGIAEADEVDEAGAGDLGEDLDLIFGGAGAVAAVGAFGGVVFRGAGGDKFGRLDGGEELDGVQGGSIDSAVAALAQEGVGGEAIGGGDDVGNG

SEQ ID NO: 208249 - protein, 147 aa, Glycine max
  Coding DNA Sequence Number=SeqID_91471
  Gene Ontology: Mol. function=nucleic acid binding; Cellular component= nucleus; Biological process=protein folding
  Homolog annotation: Hit_ID=Q6Q151; Match level="QueryCoverage=89%, HitCoverage=25%, E-value=1e-47, Identity=71%"; Hit description =Multidomain cyclophilin type peptidyl-prolyl cis-trans isomerase
MEVTSLFYEICSLLQVFGEVAEGFETLTRINEAYVDEKGRPYKNISRIKHTYILEDPYEDPSQLSVFIPDASPEGKPKDEVDDEVRLEDDWVPMDEQLNPAELEEVIRSKEAHSRAVVLESIGDIPDAEIKPPDNVLFVCKLNPVTE

SEQ ID NO: 208250 - protein, 149 aa, Glycine max
  Coding DNA Sequence Number=SeqID_91472
MISGNEILYRAGNNFDTRKTFQSLCPNKPVREEIILFMALKVAYSQLYRTRIVWCMPPAFAVDVINGTPVETLIQHYGKDWMPPFSNLNLKLCFQHKNSLLALMEWIVGILWKPEESQIVDPARRKGRQNEGGNDRAVRDTQPVQGRVD

SEQ ID NO: 208251 - protein, 283 aa, Glycine max
  Coding DNA Sequence Number=SeqID_91473
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9ZPL8; Match level="QueryCoverage=94%, HitCoverage=95%, E-value=3e-85, Identity=60%"; Hit description =Protein phosphatase type 2C
  Pfam annotation: Domain name=PP2C; Domain location=33-275; Score =232.3; E_value=1e-66; Accession=PF00481.12; Description=Protein phosphatase 2C
MDKLCCFKDSYSQLVAARSSSSTGKGKNHEGSIKYGFSLVKGKANHPMEDYHVAKFAQIQDNELGLFAIYDGHVGDRVPAYLQKHLFTNILREEEFWEDPTLSISKAYESTDQEILSHSSDLGRGGSTAVTAILINGRRLWIANVGDSRAVLSRKGQAVQMTTDHEPNTERGSIETRGGFVSNLPGDVPRVNGKLAVSRAFGDKSLKSHLRSDPDVQNTDVDVDTEILILASDGIWKVMTNQEAVDIARRTTRDPQKAAKQLTAEALKRDSKDDISCVVVKFR

SEQ ID NO: 208252 - protein, 331 aa, Glycine max
  Coding DNA Sequence Number=SeqID_91474
  Gene Ontology: Mol. function=isomerase activity; Biological process =cell redox homeostasis
  Homolog annotation: Hit_ID=Q5EUC7; Match level="QueryCoverage=97%, HitCoverage=95%, E-value=8e-64, Identity=42%"; Hit description =Adenosine 5'-phosphosulfate reductase 3
  Pfam annotation: Domain name=Thioredoxin; Domain location=83-183; Score=-16.1; E_value=0.0034; Accession=PF00085.10; Description =Thioredoxin
MRMRVWGSEIVFALLLCGTLSCTAQAIHNRVSLSTTTTTTTICPARSLLDFILGFPDSTCPLPNSLGSIAVTELCIGDVQGDEVSLQKALNMVHKNNHEYVAVLFYASWCPFSRVFRSVFSVLSALHPSIPHFAIEESLVRPSILSKYGVHGFPTLFILNSTMRVRYHGSRTLGSLIGFYNDVTGIMIDSLDQLSLEKIGRSSADESHGNTEPESCPFSWARSPENLLRQETYLALATTFVVLRLLYLFFPTLLICIQYTWRRVIQNIRIWSLLEHPLVYLKRLTQSFNCLKEPCKRRNLQEGAMNARAWASKSLATVSIGEESSSRGMHL

SEQ ID NO: 208253 - protein, 45 aa, Glycine max
  Coding DNA Sequence Number=SeqID_91475
MEKSEPEEENVLANVTYGACCVDDLGTAALSTKILFMHMYYVLLY

SEQ ID NO: 208254 - protein, 863 aa, Glycine max
  Coding DNA Sequence Number=SeqID_91476
  Pfam annotation: Domain name=AT_hook; Domain location=168-180; Score =19.6; E_value=0.0095; Accession=PF02178.9; Description=AT hook motif
MATPEPQLEPTSDHRVDSLPLVDLRLLSQPELYTLSLSGATHCHRRNSDDDSVIPKIDRSNFNESAGSRKQTYSKLRLNKRKQNPAVPASSSFHIPLHISEPEEEENSRIVALLQQLFGVEPLRNAPRNDAAERRLVPVQVDFKQPPPMFAAFQNVPIDVVADSSQRKRKRGRPRKDENSVTVFVEEPKKVTKEENSVTVFVEEPKKVNGNGEVNAAVATTTTTVNETVGLDEDPFEVELKRRTQGLETEPQVVEFLETLNGEWASQRKKRRIVPASELGDLLPAGWKIVIITMRRAGRASAVCRRYVSPDGHQFESCKEASAYLLSVFGVQDRSHLKSSYSDGAQQLSSSMNRASESSVGHVPTGDMKTDASASYLPSAGAPIHSSHEKQPPISSSIGSENFNSDLALGCKLGDATGGAFRDFDFQTEDKKLSKADKDDGNSVQECFVEDRVCNVQSEKLVGAVESSDAACNLYIPLVFSTPFSNNNSDNGQFLDEINASRCMKGGISNFASHDIDTGCCETVSCGNEQAHVDNNGLGLSVKLVEENIQKLSFESSMLAPNSEGKIHAGKNLEDGHLISSLEDMEIRDGKAIMNDKQQIICSRDQTEIKDVSTDVKLHSSSEGCSLVSSHHELNTSTSNMDRTQTSELKDSAEENIFDSDLFSSSIDERTRVHSGYISNVSFSSCTQDASEYGGFDFASDLKLDKDVSDNHILSNEEAVTRSLRERSSLNDQNSMMDNLLHRSSESNLFALTGNQHSCAFHDNVNISDGTFDALKVVDAGCMEPQLGIVSCSNIAVDAYTTASIMQGKPQGCVSVPLGGSILNFEKPSDDGVNKANKSCLPETAQNEVEMFQTDSMGLPKFR

SEQ ID NO: 208255 - protein, 132 aa, Glycine max
  Coding DNA Sequence Number=SeqID_91477
  Homolog annotation: Hit_ID=Q6YXC5; Match level="QueryCoverage=30%, HitCoverage=10%, E-value=2e-13, Identity=65%"; Hit description =Putative zinc finger protein ID1
MTSIKPIIHQNPSTTSPIYIKPSTIKRSILRSSQREREREREIDVDILVWVGKGSGAKTREVRRRRRRKSLRRPLCSGTRRGSLSVCRLQTEQAPPAVSATEIGDLREEPLQAKPLPKDVHVRAELSRSEIG

SEQ ID NO: 208256 - protein, 174 aa, Glycine max
  Coding DNA Sequence Number=SeqID_91478
  Gene Ontology: Mol. function=isomerase activity; Biological process =cell redox homeostasis
  Homolog annotation: Hit_ID=Q84P95; Match level="QueryCoverage=94%, HitCoverage=50%, E-value=1e-35, Identity=47%"; Hit description =Disulfide isomerase-like protein
  Pfam annotation: Domain name=Thioredoxin; Domain location=73-173; Score=-8.1; E_value=0.00076; Accession=PF00085.10; Description =Thioredoxin
MRIMVWGSEIVFAILLCGTLSCTAQAHHNRVSLSSTTAICPARPLLDFILGFSDSTCSLPNSLGSIAVTEGDEFFLHKALNMVHKNNHEYVAVLFYASWCPFSRVFRPVFSILSALYPSITHLAIEESSVWPSILSKYGVHSVPTLFILNSTMRVRYHGSRRFGSLIGFYNDVT

SEQ ID NO: 208257 - protein, 428 aa, Glycine max
  Coding DNA Sequence Number=SeqID_91479
  Homolog annotation: Hit_ID=Q43462; Match level="QueryCoverage=38%, HitCoverage=83%, E-value=7e-88, Identity=98%"; Hit description=Rab7p protein
  Pfam annotation: Domain name=Arf; Domain location=242-426; Score= -43.5; E_value=2e-06; Accession=PF00025.11; Description=ADP -ribosylation factor family
  Pfam annotation: Domain name=DUF579; Domain location=42-292; Score =407.3; E_value=2.2e-119; Accession=PF04669.4; Description=Protein of unknown function (DUF579)
  Pfam annotation: Domain name=MMR_HSR1; Domain location=255-370; Score= 2.6; E_value=0.00058; Accession=PF01926.13; Description=GTPase of unknown function
  Pfam annotation: Domain name=Miro; Domain location=256-370; Score =71.8; E_value=2.2e-18; Accession=PF08477.3; Description=Miro-like protein
  Pfam annotation: Domain name=Ras; Domain location=256-417; Score =343.7; E_value=3.1e-100; Accession=PF00071.12; Description=Ras family
  Pfam module annotation: Pfam domain module=Arf::DUF579::MMR _HSR1::Miro::Ras; Domain location=242-426::42-292::255-370::256 -370::256-417
MRTKAHQPGLNLKLLIVAVLVAITLLFVLIRSSNTKGVKQQEALLVKSDGSCNKMKIPGSVSEALIHYSTSSITPQQTVKEISVTARVLEKKSPCNFLVFGLGHDSLMWNALNHGGRTIFLEEDESWIQQMRRRFPMLEAYQVNYESKVNEAESMMEVGRGGECRAVGDPRYSICPLALKGLPSVVYETKWDLIMVDAPTGYYENAPGRMTAIYTAGMMARNRESGETEVFVHDVNRVVEDQFSRAFLCQNDYLFKLLLIGDSSVGKSCLLLRFADDSYVDSYISTIGVDFKIRTVELEGKTVKLQIWDTAGQERFRTITSSYYRGAHGIIIVYDVTEMESFNNVKQWLNEIDRYANDSVCKLLVGNKSDLVDNKVVDSLTAKAFADELGIPFLETSAKDSINVEQAFLTMTAEIKKKYLILVSPVLI

SEQ ID NO: 208258 - protein, 256 aa, Glycine max
  Coding DNA Sequence Number=SeqID_91480
  Gene Ontology: Mol. function=nucleotide binding; Cellular component =membrane; Biological process=small GTPase mediated signal transduction
  Homolog annotation: Hit_ID=O04486; Match level="QueryCoverage=89%, HitCoverage=100%, E-value=9e-99, Identity=83%"; Hit description=Ras -related protein Rab11C
  Pfam annotation: Domain name=Arf; Domain location=23-213; Score= -72.7; E_value=0.00037; Accession=PF00025.11; Description=ADP -ribosylation factor family
  Pfam annotation: Domain name=MMR_HSR1; Domain location=39-168; Score =9.9; E_value=0.00012; Accession=PF01926.13; Description=GTPase of unknown function
  Pfam annotation: Domain name=Miro; Domain location=40-168; Score =67.0; E_value=6.1e-17; Accession=PF08477.3; Description=Miro-like protein
  Pfam annotation: Domain name=Ras; Domain location=40-215; Score =305.0; E_value=1.4e-88; Accession=PF00071.12; Description=Ras family
  Pfam module annotation: Pfam domain module=Arf::MMR_HSR1::Miro::Ras; Domain location=23-213::39-168::40-168::40-215
MVKFRCCVVCCNTIGGLRNLVCVGFVMARRAEEEYDYLFKVVLIGDSGVGKSNLLSRFTRNEFCLESKSTIGVEFATRTLQGGNGIAMPMALVVSVEGRTVKAQIWDTAGQERYRAITSAYYRGALGALLVYDVTKPTTFENVSRWLKELRDHADANIVIMLIGNKTDLKHLRAVATEDAQGYSEKEGLSFIETSALEATNVEKAFQTILAEIYRIISKKSLSSNEPASANIKEGMTITVGGPQSNASKPSCCTSS

SEQ ID NO: 208259 - protein, 130 aa, Glycine max
  Coding DNA Sequence Number=SeqID_91481
MLNSLFNLILDKNLGRATPQKLAVVVGEPLVNPTLKSHTSNAGLKSHTLQLHPNVPPCFPVPVPMQTGYALACFDQSQVAPYRLVLAAVLNRLAFWCLHGLEDLDAAACLYTTIRPSFLTLTPKQHNQSN

SEQ ID NO: 208260 - protein, 74 aa, Glycine max
  Coding DNA Sequence Number=SeqID_91482
MGFLLLVRLVLLRDEALRQWHSQWFRWCRVGDDINASNSVGDSIVYAVPATSRETKGRQWSKFQVEDDRVMKMI

SEQ ID NO: 208261 - protein, 240 aa, Glycine max
  Coding DNA Sequence Number=SeqID_91483
  Gene Ontology: Mol. function=nucleotide binding; Cellular component =intracellular; Biological process=translation
  Homolog annotation: Hit_ID=Q1SL19; Match level="QueryCoverage=92%, HitCoverage=41%, E-value=2e-56, Identity=55%"; Hit description =Nonsense-mediated decay UPF3
  Pfam annotation: Domain name=RRM_2; Domain location=7-106; Score =13.6; E_value=0.0033; Accession=PF04059.3; Description=RNA recognition motif 2
  Pfam annotation: Domain name=Smg4_UPF3; Domain location=1-186; Score =204.6; E_value=2.2e-58; Accession=PF03467.6; Description=Smg-4UPF3 family
  Pfam module annotation: Pfam domain module=RRM_2::Smg4_UPF3; Domain location=7-106::1-186
MKGALDRTKVVLRHLPPSISEAALLAQIDAAFAGRYNWLSFRPGKISQKHISYSRAYIDFKRPEDVILFAEFFNGHVFVNEKGSQFKVIVEYAPSQRVPRQWSKKDGRDGTIYKESFLLDKYKHLHGELLDSEYLEFLELLAKPVENLPSAEIQLEKREAERSGAAKDIPIITPLMDFVRQKRAAKGPRRLLSNGKVSQRAGTSSNGSPSSVTSRRGSGKKRVSATMVLCIFLKRKVKYG

SEQ ID NO: 208262 - protein, 236 aa, Glycine max
  Coding DNA Sequence Number=SeqID_91484
  Gene Ontology: Mol. function=RNA binding; Cellular component=nucleus; Biological process=nicotianamine biosynthetic process
  Homolog annotation: Hit_ID=Q1SL18; Match level="QueryCoverage=95%, HitCoverage=84%, E-value=5e-72, Identity=59%"; Hit description=KH
MAESFFQFPPDRHRYLAQLLAERQNLVPFLQVLPHCTKLLTQEIRRMSVAGFNHAFISMDGQLSSSPKDGIGTQGLPTTPVVKRVIRLDVPVDKFPNLLLSFNSQQFNFVGRILGPRGNSLKRVEAMTECRVYIRGCGSVKDSIKKNLKINPDMSTLKNHCMCEFPEDIINARLDHAVAILENLLKPVDESLDHYKKQQLRELAMLNGTLREESPSMSPSMSPFNSTGMKRAKTGR

SEQ ID NO: 208263 - protein, 184 aa, Glycine max
  Coding DNA Sequence Number=SeqID_91485
  Gene Ontology: Mol. function=nucleotide binding
  Homolog annotation: Hit_ID=Q1SL19; Match level="QueryCoverage=98%, HitCoverage=36%, E-value=3e-59, Identity=66%"; Hit description =Nonsense-mediated decay UPF3
MTGPYVARDPGKNSTIKDKSTLVPKQGDQHLSDKASNMASSDANLTLDENGVSGNHDAGKKKVLLLKGKEREIITVSDLDSMSQHHNVTSSAKMIVGSTVLKQSQRHEGSGRIIRSILSKKELRQSQYSRALSEQQIQTSNLEKEKQPPRPLHVQLILKGSNGTPENKIGVHDSHVSSERQERH

SEQ ID NO: 208264 - protein, 76 aa, Glycine max
  Coding DNA Sequence Number=SeqID_91486
  Homolog annotation: Hit_ID=Q1SL19; Match level="QueryCoverage=54%, HitCoverage=8%, E-value=5e-15, Identity=85%"; Hit description =Nonsense-mediated decay UPF3
MVGFYLNFTCVYLGFNKHFGRRGPSHGVKDVDGYSVSSEGKHPRRSSTSAYGSNEVPKFDFSMAVHGIFFSGSIID

SEQ ID NO: 208265 - protein, 94 aa, Glycine max
  Coding DNA Sequence Number=SeqID_91487
  Homolog annotation: Hit_ID=Q6R3K6; Match level="QueryCoverage=66%, HitCoverage=9%, E-value=4e-29, Identity=84%"; Hit description=Metal -nicotianamine transporter YSL6
MPSSLLCKFYLDFSPTYVGCGLICTHLVNCSVFLGAIISWGFLWPFVCEHAGNWYPVDLGSNDFKGLYGYKRDPKIGELEALSFDFNLCQAVAT

SEQ ID NO: 208266 - protein, 119 aa, Glycine max
  Coding DNA Sequence Number=SeqID_91488
  Gene Ontology: Mol. function=transporter activity; Cellular component= integral to membrane; Biological process=transport
  Homolog annotation: Hit_ID=Q652N5; Match level="QueryCoverage=40%, HitCoverage=8%, E-value=9e-12, Identity=70%"; Hit description =Putative sialin
MACLWLQHYKSSKKDVRKLYDSQVVVVEEENHKIKMCVIWNFLMLKSFSQVLKFNVTENFYDLVSNAFKLSHVKTLVVAVLCMVCSQGSDAFSQSGIYSNHQDIGPRYVIEAIPKSNKH

SEQ ID NO: 208267 - protein, 130 aa, Glycine max
  Coding DNA Sequence Number=SeqID_91489
  Subcellular localization annotation: CTP_CleavageSite=50; ConfidenceScore=5.28e-01
MNGYSRISGDDDSSSRRSMDHEGERFGVILGRSASVSSSSQFQRAFSMTRSSSVSERYRRIHDQEDTPITTSPSIASKKKQRGGANKILKASRSVVFKVSHDSYIHGITITIITGRDVHLWLDSGEITNE

SEQ ID NO: 208268 - protein, 689 aa, Glycine max
  Coding DNA Sequence Number=SeqID_91490
  Gene Ontology: Mol. function=unfolded protein binding; Cellular component=chloroplast; Biological process=protein folding
  Homolog annotation: Hit_ID=Q02028; Match level="QueryCoverage=99%, HitCoverage=99%, E-value=0.0, Identity=86%"; Hit description=Stromal 70 kDa heat shock-related protein, chloroplast precursor
  Pfam annotation: Domain name=HSP70; Domain location=54-649; Score =1345.5; E_value=0; Accession=PF00012.10; Description=Hsp70 protein
  Pfam annotation: Domain name=MreB_Mbl; Domain location=52-432; Score=- 197.9; E_value=6.6e-05; Accession=PF06723.3; Description=MreBMbl protein
  Pfam module annotation: Pfam domain module=HSP70::MreB_Mbl; Domain location=54-649::52-432
  Subcellular localization annotation: CTP_CleavageSite=66; ConfidenceScore=5.46e-01
MACSSAQIHGLGTPSFSRTLFLGQRLNTKAAFIKVKSAPTPRRLRPLRVVNEKVVGIDLGTTNSAVAAMEGGKPTIITNAEGQRTTPSVVAYTKNGDRLVGQIAKRQAVVNPENTFFSVKRFIGRKMSEVDEESKQVSYRVIRDDNGNVKLDCPAIGKQFAAEEISAQVLRKLVDDASKFLNDKVTKAVVTVPAYFNDSQRTATKDAGRIAGLEVLRIINEPTAASLAYGFEKKNNETILVFDLGGGTFDVSVLEVGDGVFEVLSTSGDTHLGGDDFDKRIVDWLASNFKRDEGIDLLKDKQALQRLTETAEKAKMELSTLTQTNISLPFITATADGPKHIETTITRAKFEELCSDLLDRLRTPVENSLRDAKLSFKDLDEVILVGGSTRIPAVQELVKKLTGKDPNVTVNPDEVVALGAAVQAGVLAGDVSDIVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPSDEVERMVNEAEKFSKEDKEKRDAIDTKNQADSVVYQTEKQLKELGDKVPGPVKEKVEAKLGELKDAISGGSTQAIKDAMAALNQEVMQLGQSLYNQPGAAGAGGPTPPGADSGPSESSGKGPDGDVIDADFTDSK

SEQ ID NO: 208269 - protein, 604 aa, Glycine max
  Coding DNA Sequence Number=SeqID_91491
  Homolog annotation: Hit_ID=Q1SKW8; Match level="QueryCoverage=98%, HitCoverage=98%, E-value=0.0, Identity=89%"; Hit description =Membrane attack complex component/perforin/complement C9
  Pfam annotation: Domain name=MACPF; Domain location=124-319; Score =72.8; E_value=1.1e-18; Accession=PF01823.10; Description=MACPerforin domain
MALKVPARKAAEIAIGSIGRGYDISLDIRLKYCKGDSINSRLIEIDENDVREVVLPGGVSIPNVSKSIKCDKGERTRFRSDVLSFQQMSEQFNQELSLTGKIPSGLFNTMFEFSGSWQRDAAHTKSLAFDGVLITLYTVALEKSQMVLSDHVKKAVPSSWDPPALARFIDTFGTHIIVGMKMGGKDVIYLKQQHSSTLQPADVQKKLKEIADRRFLDANGHYSIASDQVFPDDKFRIREQRLTFANISPSSSYSHKEDIVSICKRRGGREDRNISHNEWLQTVQSEPDVISMSFIPITSLLNGVPGSGFLSHAINLYLRYKPPIEELHQFLEFQLPRQWAPVFSDLPLGPQRKQRSSASLQFSFMGPKLYVNTTQVDVGKRPVTGLRLYLEGKKSNRLAVHLQHLSSLPKIFQLEDDPNENVRRKSYDRRFYEKVQWKNFSHVCTAPVESEEDLSIVTGAQLQVENYGIKNILFLRLRFSTVLGAKAVKHPEWEGSPKLGAKSGLISTLISQHFTTTFQKPPPRPADVNINSAVYPGGPPVPVQAPKLLKFVDTTEMTRGPQESPGYWVVSGAKLVVDKGKISLRVKYSLLTMVLPDEEMLDDQ

SEQ ID NO: 208270 - protein, 268 aa, Glycine max
  Coding DNA Sequence Number=SeqID_91492
  Gene Ontology: Mol. function=protein-tyrosine kinase activity; Biological process=protein amino acid phosphorylation
  Homolog annotation: Hit_ID=Q1SKX1; Match level="QueryCoverage=99%, HitCoverage=98%, E-value=6e-58, Identity=45%"; Hit description =Octicosapeptide/Phox/Bem1p
  Pfam annotation: Domain name=PB1; Domain location=24-110; Score=70.5; E_value=5.2e-18; Accession=PF00564.15; Description=PB1 domain
MGDESPRNKVKFLCSYGGKVLPRPSDGLLRYVGGETRVVSVPREITFPELMKKVSSMVEGVGDMVLKYQLIPEDLDALVSVRTEEDVKHMIEEHDRHHTGALLRAFLFPPSKQTGLVACEPYLLEQRYIDAINGIIRASPRKGSACSSPKSNSPDASPRFSNSNSLHRVQSSPTLTDLGVFLDHQHQGQQQQYHHPNFHFSRPPQDPQRLGAGRVPSFNYHYSNITRQLTHRGDRGGGYAYYDDSPPSYAHDRIHSVSRSPRRKSIWE

SEQ ID NO: 208271 - protein, 59 aa, Glycine max
  Coding DNA Sequence Number=SeqID_91493
MNARVWASKSLATVSIGEESSSSRGTHQIIFTPSGLVLSEEWKVFAVTCFRETRKTASN

SEQ ID NO: 208272 - protein, 471 aa, Glycine max
  Coding DNA Sequence Number=SeqID_91494
  Gene Ontology: Mol. function=zinc ion binding; Cellular component =cellulose and pectin-containing cell wall; Biological process =metabolic process
  Homolog annotation: Hit_ID=Q6Z692; Match level="QueryCoverage=99%, HitCoverage=68%, E-value=1e-177, Identity=62%"; Hit description =Putative early-responsive to dehydration stress protein
  Pfam annotation: Domain name=DUF248; Domain location=3-463; Score =322.5; E_value=7.3e-94; Accession=PF03141.7; Description=Putative methyltransferase
  Pfam annotation: Domain name=Methyltransf_11; Domain location=49-144; Score=10.4; E_value=0.0052; Accession=PF08241.2; Description =Methyltransferase domain
  Pfam annotation: Domain name=Methyltransf_12; Domain location=49-142; Score=9.3; E_value=0.064; Accession=PF08242.2; Description =Methyltransferase domain
  Pfam module annotation: Pfam domain module=DUF248::Methyltransf _11::Methyltransf_12; Domain location=3-463::49-144::49-142
MMMLDEEQISFRSASLMFDGVEDYSHQIAEMIGLRNESSFIQAGVRTILDIGCGYGSFGAHLFQSQLLTMCIASYEPSGSQVQLTLERGLPAMVASFTSKQLPYPSLSFDMLHCARCGIDWDRKDGILMIEADRLLRPGGYFVWTSPLTNARDKDSQKRWKFIQSFAENLCWDMLSQQDETVVWKKTSKRNCYSSRKNSSPPPLCGRGYDVESPYYRELQNCIGGTHSSRWISVQERETWPSRDHLNKKELAIFGLQSDEFAEDSESWKAAVRNYWSLLSPLIFSDHPKRPGDEDPPPPYNMLRNVLDMNAHVGGFNSAMLQAGKSIWVMNVVPLSGLNYLPLIQDRGYVGVLHDWCEAFPTYPRTYDLVHAAGLLSLEFAQQRSCTMLDMFIEIDRLLRPEIAVAELIFAVNIEILPKGWIIIRDTVPLIESARALTTRLKWDARVVEIESDSDQRLLICQKPFFKRQAN

SEQ ID NO: 208273 - protein, 226 aa, Glycine max
  Coding DNA Sequence Number=SeqID_91495
  Homolog annotation: Hit_ID=Q6Z692; Match level="QueryCoverage=55%, HitCoverage=20%, E-value=5e-23, Identity=44%"; Hit description =Putative early-responsive to dehydration stress protein
MSRPLHRGVSIRIPDSNNNDLWDSQSKDKTEKEGLDRRGSFGHPSPLRSPFKLLFSDNSNSKYGIGENGFSSDPFIIGTPRSRHKLVLLFLKFSLVFIVILALAGSFWWTISISTASRGHIYHGYRRLQENLVSDLLDIGEISYAPSRLKELEFCSEEFENYVPCFNVSDNLALGFSDGNEFDRQCHHELRPNCLVLSPPNYKIPLRWPTGRDIIWIANAKITAQE

SEQ ID NO: 208274 - protein, 109 aa, Glycine max
  Coding DNA Sequence Number=SeqID_91496
MLLLLVLPVLVSSSSSATPRAKLLLLLLRERAFEKTRVEDAGRNGEMGLMAAAFRRSVKGSSGTSGRSCSGKIPEEVFFRKKPKVFRKSSEKFPKEVVLPKEFWKKGSS

SEQ ID NO: 208275 - protein, 83 aa, Glycine max
  Coding DNA Sequence Number=SeqID_91497
MSSPPQRRNDYEKEHDSTCNHLGYKNKCPSQNGSRSSPPQNVDIGGSLGYRQDPAGKTGSKGLFIGGTYVHVGRNFTKSSTIG

SEQ ID NO: 208276 - protein, 168 aa, Glycine max
  Coding DNA Sequence Number=SeqID_91498
  Homolog annotation: Hit_ID=Q9ZPW2; Match level="QueryCoverage=30%, HitCoverage=27%, E-value=3e-14, Identity=75%"; Hit description =Anaphase-promoting complex subunit 10
  Pfam annotation: Domain name=APC10; Domain location=39-164; Score= -54.2; E_value=0.00015; Accession=PF03256.7; Description=Anaphase -promoting complex, subunit 10 (APC10)
MNTLGDDMRYSGDSENKRGSQSTQVTGIKSPPTLAGDMSYADSSKDKKGPKSSGNGTQTHEDVSMRDKLSHTDDSRKKNVDCAFSGFQACESYTPSKVSIRAVDGFHNLKEIKTVELVKAIGWVYLSLSGADPRPGFLLFVGKYSVLSVSSFFSSVVLFWLCALESVN

SEQ ID NO: 208277 - protein, 56 aa, Glycine max
  Coding DNA Sequence Number=SeqID_91499
MGLPEEPSFYTEHLLRQRPSSPTTTISCPLRLVPFEAAADKVGFMWGSLMKLTCGQ

SEQ ID NO: 208278 - protein, 242 aa, Glycine max
  Coding DNA Sequence Number=SeqID_91500
  Homolog annotation: Hit_ID=Q1T132; Match level="QueryCoverage=27%, HitCoverage=10%, E-value=2e-11, Identity=51%"; Hit description=IMP dehydrogenase/GMP reductase
GATNHEPVSTVEGASSASAVEVSTTVLSTIDVGVGKLGGAYGSGDLWVATKKTVKSIRTPSYGERLDRLRIPDVCWIPYGEHREVRDFHLRLCYSGLLRWGPVAVYYRPERVVRQFGYTQTISAPPVDSWVSYDDIHDRWMHYKDHIVPASEPRVVPQAPQTDIPHVPESGALSTSAEEPRHAVEVYDAIVERLERHLSLGVVTPGSSTHEVIKECLRLARSVTQDHLVYVRSRRRRRTDQT

SEQ ID NO: 208279 - protein, 73 aa, Glycine max
  Coding DNA Sequence Number=SeqID_91501
DSVVPCSVFEVLLVAVLPILSECCRKTHPEDLLPEVTEAYSGRSASGRHFRNHFFRNRPQKLPEDGLPEVLNY

SEQ ID NO: 208280 - protein, 191 aa, Glycine max
  Coding DNA Sequence Number=SeqID_91502
  Homolog annotation: Hit_ID=Q1SL15; Match level="QueryCoverage=28%, HitCoverage=5%, E-value=1e-09, Identity=57%"; Hit description =Ovarian tumour, otubain
MHLGNTTTNRVDSAHWTLKRLLQNSLGDLCSVWEAMNNMITLQHTAIKTSFETNQGLPEPEVSIIEKMETISKRFKELDVKTKSAQKKQMTKHQRSTKCDPSYYEYVDTLYFVQNNNSSMKRATSSCEQPKPQRNMPMLDQFHPCIHDFIENIVDVKPDDSCGYRAIDTLLGMCEGSWSLVRNHLLKELIK

SEQ ID NO: 208281 - protein, 123 aa, Glycine max
  Coding DNA Sequence Number=SeqID_91503
  Subcellular localization annotation: CTP_CleavageSite=24; ConfidenceScore=5.06e-01
MQPEETKQPEETKQKKAKGSKKKRRKRKRSRKKRLRFRKKVLPETSGRRFFRKLPDEGLPDEVCEYFRNSQILFPEEVFFRKLSGKTCSEKFTEILLPEEELLKGNFATSLFAGCTNNNAGCT

SEQ ID NO: 208282 - protein, 160 aa, Glycine max
  Coding DNA Sequence Number=SeqID_91504
  Gene Ontology: Mol. function=transferase activity, transferring glycosyl groups; Cellular component=cytoplasm; Biological process =metabolic process
  Homolog annotation: Hit_ID=Q8L5C7; Match level="QueryCoverage=87%, HitCoverage=49%, E-value=2e-43, Identity=52%"; Hit description=UDP -glucuronosyltransferase
MASDQLIEFARGLANSGKTFLWVIRPDLVDGENMVLPYELCQRLKIESLCNGVPMICWPFFAEQPTNCRFCCKEWGAGMQIEGDVTRDRVERFVRELMEGQKGEELTKKALEWKKLAEDATIHKDGSSFLNYHNMFRQVLLSDNNRNQLKTSSVWGLDFI

SEQ ID NO: 208283 - protein, 103 aa, Glycine max
  Coding DNA Sequence Number=SeqID_91505
MGGCCDVDEGDRKRGIYRSKEMCVFNCGERLKSDFCAWGVVSPSGIYEPRLADVGGVRGKAVERGLKKREGIMEISEEGFGVTKAIQLGPVVVVVVEIDPGNG

SEQ ID NO: 208284 - protein, 183 aa, Glycine max
  Coding DNA Sequence Number=SeqID_91506
MQEMIMKHKTKSNERFKSLESIVSNLITLMSQRALCTLPSQTEANPKKEGGECCEHQEWKVYGRTEEERESHFNTRKRLSIRRVMRQQKVGEKRYWRLLRALCDLGASIILMSYSVYKKLGLQEPQPINISIQLSKKNRDGITIQALGYGVNDCTRGSMQKGKITLFWDGRFSSLFHTSDSRC

SEQ ID NO: 208285 - protein, 114 aa, Glycine max
  Coding DNA Sequence Number=SeqID_91507
  Homolog annotation: Hit_ID=Q66MH7; Match level="QueryCoverage=45%, HitCoverage=14%, E-value=2e-18, Identity=88%"; Hit description=MAPKK
MKMKTKTPLKQLKLAVPAQETPITSFLTASGTFHDGDLLLNQKGLRLISEEKESRILGPGVFGASAFDILRALPNSLILVVTKLSSDKERVCFHWSWFVVWIDHVASDSSVGYE

SEQ ID NO: 208286 - protein, 56 aa, Glycine max
  Coding DNA Sequence Number=SeqID_91508
  Subcellular localization annotation: CTP_CleavageSite=31; ConfidenceScore=5.06e-01
MAKNVNGTWQEAIHLLTLILRGRRSNSLEPRASAASMASSSSSSSSWFTDFAALLL

SEQ ID NO: 208287 - protein, 47 aa, Glycine max
  Coding DNA Sequence Number=SeqID_91509
MVTEEPIIKDNVSDFSDDEQQHDFDEHGEPTNQRREYRSAKYAKGGS

SEQ ID NO: 208288 - protein, 94 aa, Glycine max
  Coding DNA Sequence Number=SeqID_91510
  Gene Ontology: Mol. function=DNA binding; Biological process=DNA integration
  Homolog annotation: Hit_ID=Q1SLU3; Match level="QueryCoverage=70%, HitCoverage=4%, E-value=9e-22, Identity=75%"; Hit description =Integrase, catalytic region
SKPASSPTDPGMRLAEADSPPFPDVHSKKQGTVARSSSEAEYQALASATCELQWLVFLLEDLGVTCTKLPVLYCENCSALHIAANPFGDQLPHS

SEQ ID NO: 208289 - protein, 142 aa, Glycine max
  Coding DNA Sequence Number=SeqID_91511
  Gene Ontology: Mol. function=DNA binding; Cellular component=oxygen evolving complex; Biological process=DNA integration
  Homolog annotation: Hit_ID=Q1T2A5; Match level="QueryCoverage=99%, HitCoverage=15%, E-value=3e-45, Identity=61%"; Hit description =Integrase, catalytic region
MAKLTTVRLWLALASTKNWYVHQLDFNNAFLHGELLEDVYMTIPQGIASPGPNKACKLLKSLYGLKQASRKWYERLSTLLLQLGFTQAHGDHSLFVRCTHSSFSALLVYVDGIVLVGDSMHVFFEIKAALHQQFGIKDLASL

SEQ ID NO: 208290 - protein, 203 aa, Glycine max
  Coding DNA Sequence Number=SeqID_91512
  Gene Ontology: Mol. function=DNA binding; Biological process=DNA integration
  Homolog annotation: Hit_ID=Q1ST43; Match level="QueryCoverage=61%, HitCoverage=9%, E-value=2e-34, Identity=55%"; Hit description =Integrase, catalytic region; Peptidase aspartic, catalytic
MVCKNQNNDAGSSNHGAVINAQMDPFQNQNSPYYVDPGENPATVLVYTPLNGSNYHSWACVMRRAISGKNKIHFIDGSIPMPDSFYPYFDLWECNNNLVHSWLMDSVSSSIAQSIVYMDSAADVWRDLKERFSQGDLKMNLQNTSTEADHSVNQIHVARERGDGHTTNSGTEGFIHDFFGDEELVIEDHAVSEIPNSQGQCSP

SEQ ID NO: 208291 - protein, 286 aa, Glycine max
  Coding DNA Sequence Number=SeqID_91513
  Gene Ontology: Mol. function=protein serine/threonine kinase activity; Cellular component=intracellular; Biological process =protein amino acid phosphorylation
  Homolog annotation: Hit_ID=Q66MH7; Match level="QueryCoverage=88%, HitCoverage=71%, E-value=1e-123, Identity=85%"; Hit description=MAPKK
  Pfam annotation: Domain name=Pkinase; Domain location=17-261; Score =222.3; E_value=1.1e-63; Accession=PF00069.15; Description=Protein kinase domain
  Pfam annotation: Domain name=Pkinase_Tyr; Domain location=17-261; Score=21.1; E_value=9.2e-14; Accession=PF07714.7; Description =Protein tyrosine kinase
  Pfam module annotation: Pfam domain module=Pkinase::Pkinase_Tyr; Domain location=17-261::17-261
MPSDGKELEFDFLLDDLETIKVIGKGSGGVVIQMNIQEDIRKQIVQELKINQASQCPHVVVCYHSFYHNGVISLVLEYMDRGSLADVIKQVKTILEPYLAVVCKQVLQGLVYLHNERHVIHRDIKPSNLLVNHKGEVKITDFGVSAMLASSMGQRDTFVGTYNYMSPERISGSTYDYSSDIWSLGMVVLECAIGRFPYIQSEDQQSWPSFYELLAAIVESPPPSAPPDQFSPEFCTFVSSCIQKDPRDRLTSLELLDHPFIKKFEDKDLDLGILVGGLEPPVNFPR

SEQ ID NO: 208292 - protein, 46 aa, Glycine max
  Coding DNA Sequence Number=SeqID_91514
MAERAKPIDFELTLKPFYQRASEAEKGFEIGVPFVFAQPYNCAPLL

SEQ ID NO: 208293 - protein, 315 aa, Glycine max
  Coding DNA Sequence Number=SeqID_91515
  Gene Ontology: Cellular component=cellulose and pectin-containing cell wall
  Homolog annotation: Hit_ID=Q9FE06; Match level="QueryCoverage=88%, HitCoverage=92%, E-value=1e-101, Identity=63%"; Hit description =Putative phi-1 protein
  Pfam annotation: Domain name=Phi_1; Domain location=44-315; Score =522.5; E_value=4.7e-154; Accession=PF04674.3; Description=Phosphate -induced protein 1 conserved region
MLILRLAIFVASLVVVVQSHVPNIWEAKPFHHMLSLVQPDPVVLNYHRGPLLKGNVTVHINWYGNFTPIHRSIIVDFIQSLGSIPHSRHHPSPFSWWRITARYRGGPRTLTVGNQTLDNTYSLGKSLKTSHLLALASKNSPPTTRSNANAIHVLLTSADVAVDGFCMSRCGTHGSGRVAKRRIAFAWVGNPVTQCPGECAWPFHQPVYGPQTPPLVPPNGDVGVDGMLISLATVLAGAVTNPFGNGYYQGSVTAPLEAVSACAGIFGKGAYPGYTGNVLVDNVTGASYNALGLHGRKFLLPAMWDPVTSTCKTLV

SEQ ID NO: 208294 - protein, 105 aa, Glycine max
  Coding DNA Sequence Number=SeqID_91516
MQVYRQHEWRDTQALNTWLDTANGAGEFGVDIASGAGEFGVASSRYSHWRLGLSNVLDETGEAGYAWQEAGYACFRVAVQGAGEQDGLANTACETSLYPPMVLAI

SEQ ID NO: 208295 - protein, 64 aa, Glycine max
  Coding DNA Sequence Number=SeqID_91517
MVRRFRRNKRKMEPYLEVLDRHWDSQLHKDLYATGYWLNPACRFNAKEFEKHRNTQSGILELID

SEQ ID NO: 208296 - protein, 115 aa, Glycine max
  Coding DNA Sequence Number=SeqID_91518
MYTITSFNLDYAKLNCVWLEERLSRLEAALNSKKGRCYAKVLSKTISIFRLKSILEIVGLNYIYMRLAQAQMLVAENAKLQYRIIHLLRALKEADLKLEKATVHEQLQSMKLQGS

SEQ ID NO: 208297 - protein, 533 aa, Glycine max
  Coding DNA Sequence Number=SeqID_91519
  Gene Ontology: Mol. function=transferase activity; Cellular component= nucleus; Biological process=regulation of transcription
  Homolog annotation: Hit_ID=Q1RZ85; Match level="QueryCoverage=85%, HitCoverage=68%, E-value=1e-141, Identity=50%"; Hit description =Asp/Glu racemase; Polynucleotidyl transferase, Ribonuclease H fold
  Pfam annotation: Domain name=PPR; Domain location=241-275; Score =25.7; E_value=0.00016; Accession=PF01535.11; Description=PPR repeat
  Pfam annotation: Domain name=PPR; Domain location=303-337; Score =23.0; E_value=0.0011; Accession=PF01535.11; Description=PPR repeat
  Pfam annotation: Domain name=PPR; Domain location=349-383; Score=4.7; E_value=2.1; Accession=PF01535.11; Description=PPR repeat
  Pfam annotation: Domain name=PPR; Domain location=415-449; Score =45.1; E_value=2.3e-10; Accession=PF01535.11; Description=PPR repeat
  Pfam annotation: Domain name=PPR; Domain location=450-484; Score=3.7; E_value=2.7; Accession=PF01535.11; Description=PPR repeat
  Pfam annotation: Domain name=PPR; Domain location=486-519; Score =15.4; E_value=0.11; Accession=PF01535.11; Description=PPR repeat
  Pfam module annotation: Pfam domain module=PPR::PPR::PPR::PPR::PPR::PP R; Domain location=241-275::303-337::349-383::415-449::450-484::486 -519
MFKRCGAPRRKSKWKKVLVARNRYTIIASHTHGSGRVEPHQNPGATQAVDLYPLKIKIHGHKCNHANQNREASGEPNFETTAQSGGRQVHFPVTDMRNLRAAAPDPSPDSDPRTRGKRLRHPEFHHSMRAPRWNSPRAKSVRQNGATKRRHVERHVPRVRPSQLPPRRRRFVRANAPRWRVPQLLHVPHGGVFVADAYKVFAEMRDKNVFAWTAIVAAHVACRDMVSARRLFDLAPQRDVVLWNVVVSGYIELGDMVAARELFDRMPDRDVMSWNTVLSGYATNGEVESFVKLFEEMPVRNVYSWNGLIGGYVRNGLFKEALECFKRMLVLVEGEGKEGSDGVVVPNDYTVVAVLTACSRLGDLEMGKWVHVYAESIGYKGNLFVGNALIDMYAKCGVIEKALDVFDGLDVKDIITWNTIINGLAMHGHVADALSLFERMKRAGERPDGVTFVGILSACTHMGLVRNGLLHFQSMVDDYSIVPQIEHYGCMVDLLGRAGLIDKAVDIVRKMPMEPDADVQECGNGRAGTSAAH

SEQ ID NO: 208298 - protein, 327 aa, Glycine max
  Coding DNA Sequence Number=SeqID_91520
  Gene Ontology: Mol. function=acyltransferase activity; Biological process=metabolic process
  Homolog annotation: Hit_ID=Q1RYA6; Match level="QueryCoverage=58%, HitCoverage=46%, E-value=2e-69, Identity=66%"; Hit description =Diacylglycerol acyltransferase
  Pfam annotation: Domain name=DAGAT; Domain location=79-265; Score= -32.0; E_value=1.5e-11; Accession=PF03982.3; Description =Diacylglycerol acyltransferase
MQRTAAATEEPRRSSGDASAAEGEKVFKGSEVFGDTSPNYLKTILALALWLGTIHFNAALVLFAIFFLSLHKAFLEGCYARLFGLLFVLMVIPVDEKSKFGRKLSRYICKHVCAYFPITLHVEDMKAFHPSRAYVFGYEPHSVLPIGVVALADNTCFMPLPKIKVLASSAVRLLSTLFCCEVTKKRFTSLLDAGYSCILIPGGVQEAFLIEHGSEDPFLPFILAPTVPYPFPRRQTIDGKVDGERCMLENTLGRVRELPVRRIVNGGEGERKNGDMHGSYGESDGGESRSSGIAAELDRRDDPKVDSGVGEKISSDKCAYSLGERRG

SEQ ID NO: 208299 - protein, 73 aa, Glycine max
  Coding DNA Sequence Number=SeqID_91521
MSDGDHDKKKPKKGLGDGGGWTFEARDDVGGSLGGFSGGGVRHGRVGVMIVTETTSGTSKGTFSTMKEKKEVV

SEQ ID NO: 208300 - protein, 200 aa, Glycine max
  Coding DNA Sequence Number=SeqID_91522
  Gene Ontology: Mol. function=transcription factor activity; Cellular component=nucleus; Biological process=regulation of transcription, DNA-dependent
  Homolog annotation: Hit_ID=Q1S1X7; Match level="QueryCoverage=88%, HitCoverage=13%, E-value=1e-32, Identity=46%"; Hit description =Integrase, catalytic region; Zinc finger, CCHC-type; Peptidase aspartic, catalytic
MGTPLTTSICLFELNNTKSKSKKENMSHVPYASVVGSLMYAIVCTRQDLAQAINMMAKYMGKPRKEHRKIVKKIFRYLKGTTDIGLIHQGDTSFALARHSDFDYAIDLDVRQFVIGYAFTIGNSLVSLKATLHPIVFLSSTEAEYMTLVEATKEGGDCWTKRSVWTTLLEPSNLVLFCMVANVYLVALIQLCCKKSVQSS

SEQ ID NO: 208301 - protein, 133 aa, Glycine max
  Coding DNA Sequence Number=SeqID_91523
  Gene Ontology: Mol. function=nucleic acid binding; Biological process= DNA integration
MELHHKVSEEKTTFALWLKLEKLFITKSIYNKLLLKQCLFGLCMKEGTPLKDHLDELNSILLELRDIDVKLEDENLAMILLASLPPSYENFISSLSVGKDCITLEEVKSSFFQESFDTKHLKMVMKPLPLNYQ

SEQ ID NO: 208302 - protein, 159 aa, Glycine max
  Coding DNA Sequence Number=SeqID_91524
MGFDDIDNIFQGFDVKEMHNVESWCIVLHRNFGSVNGEPSLDDVEGGLILKSSTAWTTWGWFWFLAIVRVRRFLGNLEEESLGCKEVSKRECEGVKREKEIMGESEKIWAFSKRILPALGDSAQVHLKRCVLLNLHPGSQSIYWAHVCGAQIPTKLIGR

SEQ ID NO: 208303 - protein, 107 aa, Glycine max
  Coding DNA Sequence Number=SeqID_91525
  Subcellular localization annotation: CTP_CleavageSite=30; ConfidenceScore=5.53e-01
MGRLARHSLGKASTFIAPKATGVMANVSKRATSKKQPEKPMSTTQRRRTLSETESKDDRYLIFRKQKVALPSNETSMPQAKKVKQTQQAPSPSTTQPPSSKLEMEGA

SEQ ID NO: 208304 - protein, 133 aa, Glycine max
  Coding DNA Sequence Number=SeqID_91526
MVIAIQEEDVACIEMQSNLWSKQVSEGTKKVMRKSNKGKRVCKGKARGSKSSKSSRSSCGASKKVIRPGLGRWDKPKYDYKLGADETKIGLVSKQLCATMWGGSEVELKKLPVVNSVGGAVFFGVGFMGMERV

SEQ ID NO: 208305 - protein, 88 aa, Glycine max
  Coding DNA Sequence Number=SeqID_91527
MYVRIEGVTVVAEGFSGMMRIILRIIQDQQGLWRKVLVARYGVSIGEGGNRNSSLDSMWWRETWWECVEKRMRFYTIDKNLTVFIIKV

SEQ ID NO: 208306 - protein, 61 aa, Glycine max
  Coding DNA Sequence Number=SeqID_91528
  Gene Ontology: Mol. function=acyltransferase activity; Biological process=metabolic process
  Homolog annotation: Hit_ID=Q1RYA7; Match level="QueryCoverage=100%, HitCoverage=23%, E-value=9e-20, Identity=61%"; Hit description =Diacylglycerol acyltransferase
MGLPLVPVFCFGQTKAYKWWKPPGRLMQNLARSPIPFKNPLYIVVGRPIELEKNPEPTMEQ

SEQ ID NO: 208307 - protein, 234 aa, Glycine max
  Coding DNA Sequence Number=SeqID_91529
MLRALKNLDSMYLEELLAILKFHEQELQQDEGLKREKSITLNSQKNEKTSMSREQVLRSSSKALNVNDSSDDESKEDSDEDELVFIFHKNLKRLRNKNLEKSHDRKKFFKTKEKEGIVSTWEDLDDNSSDEDNEEANICLMADTTLNQTKKMRSQKSVSFLNNEFLKNEELEGQPQDVVNGTDNLNKLLGYCRSSSDKSGNGYDGKVYVHDEDTIICYFCGKTRLITSKCRDHP

SEQ ID NO: 208308 - protein, 159 aa, Glycine max
  Coding DNA Sequence Number=SeqID_91530
  Homolog annotation: Hit_ID=Q1RYA6; Match level="QueryCoverage=25%, HitCoverage=9%, E-value=3e-10, Identity=77%"; Hit description =Diacylglycerol acyltransferase
  Subcellular localization annotation: CTP_CleavageSite=38; ConfidenceScore=5.22e-01
MPSMQFLGMNHTRFFQLALLHLVTALASCLLQKQNFLLAAPTSSATLLLQALAPFFFGPIDSAHMVVSSSSSSVPLLLRVSSALSRSTLSVQITDHPHAHPAQMRTSYVADEEPTTATMNTSTSTFTNRKKTKKIRRSTAHPREKTKKKHCAKMAGEIF

SEQ ID NO: 208309 - protein, 94 aa, Glycine max
  Coding DNA Sequence Number=SeqID_91531
MDFLIGMYLVCQSPQISEQARKPKYSSKKILKTQQLKIGSRERKDNDATNGEKHDCGTLKEGQCKEELLLHSNSKCDLRECRRRGGNDMTCTRG

SEQ ID NO: 208310 - protein, 110 aa, Glycine max
  Coding DNA Sequence Number=SeqID_91532
  Gene Ontology: Mol. function=acyltransferase activity; Biological process=metabolic process
  Homolog annotation: Hit_ID=Q1RYA6; Match level="QueryCoverage=94%, HitCoverage=25%, E-value=8e-26, Identity=54%"; Hit description =Diacylglycerol acyltransferase
MGKVFNGVEEFSESRNVFKTVPALVLYLGAIHFNLALILWATVFLPLSKGLLVFGLLLVFVLIPVDENSIFGHKLSKYICKHICSYFPITLHVEEAKAFRPDQAYGKEKF

SEQ ID NO: 208311 - protein, 119 aa, Glycine max
  Coding DNA Sequence Number=SeqID_91533
  Subcellular localization annotation: CTP_CleavageSite=35; ConfidenceScore=5.21e-01
MSQPHSLISKRSMHLPFTTFLLIHLLPNFSHSILSLNEAATSYSSPLLSFLDFSIFTELFFFGDFITTPWNEEKSLKAFVPHCREDILTTTIGRLKHPGGCAIGVGVTISQYFGRSCGF

SEQ ID NO: 208312 - protein, 142 aa, Glycine max
  Coding DNA Sequence Number=SeqID_91534
MASYGGELLLDSSSPRSGISSLSSFSILLPFILQEAKESIDEEDPRTNSPPSSIIFFHSPLRKNPKELCNPTSKIGLISGKDIRDEIERKKRDHMLRKSLEEELEELDSSLSVQSRLSAHSRLASKFRLSAQSRSGRNPGLA

SEQ ID NO: 208313 - protein, 73 aa, Glycine max
  Coding DNA Sequence Number=SeqID_91535
MDRDPSCRDRQLKEGFLGIFGEWRRGYIVGSRSLGLGGCVQGEDSKGPSKTKEALAQALKDRHYAEKEVMGWL

SEQ ID NO: 208314 - protein, 106 aa, Glycine max
  Coding DNA Sequence Number=SeqID_91536
MTISTPFTVEKRLPSRIAHHLEEETEGLRAEDVWVQRGVVTGGFGGGVGVTCGSLSLSKIIGRPVRVTMFYENAPTIWDQHRLKGALKPGDPQGLHSEESFRASPS

SEQ ID NO: 208315 - protein, 67 aa, Glycine max
  Coding DNA Sequence Number=SeqID_91537
  Homolog annotation: Hit_ID=Q2HS44; Match level="QueryCoverage=100%, HitCoverage=28%, E-value=5e-08, Identity=40%"; Hit description =Hemopexin
MEERLDHGLASWDWFEFFPNFRVENGLSSKSDHSPIVIGLHVRRKRHHCKSFRFENSWLLEPNIEGV

SEQ ID NO: 208316 - protein, 73 aa, Glycine max
  Coding DNA Sequence Number=SeqID_91538
MERYVANQKSHNHDDLVEVERHLEHLERENHDDLIIEVEICLANQKSHNSVMGMSGPYLLKPFHMLHFNVFIK

SEQ ID NO: 208317 - protein, 219 aa, Glycine max
  Coding DNA Sequence Number=SeqID_91539
  Gene Ontology: Mol. function=nucleoside-triphosphatase activity; Cellular component=membrane; Biological process=DNA replication
  Homolog annotation: Hit_ID=Q9CAM7; Match level="QueryCoverage=51%, HitCoverage=33%, E-value=2e-42, Identity=78%"; Hit description =Replication factor, putative; 74998-73295
MKHVVIIEEQSVETQGPEGICIFANGKETSKNMLFEITSDEPLKCGSMSSSSSSNAYDVPWVENYRSSNVINIVDNEDTVSRLQVIARDDNMPNLILFGPPGTGKTTSIIALAHELLRGPNYKEAVLELNASNDRGIDVVRNKIKMFAQKKVMLSSRRHKIVILAEVDRFWIFFINGFLFFLKIMVAEWRRKKDDWRCHFKEKMIQEEAHHHRKPWIRA

SEQ ID NO: 208318 - protein, 639 aa, Glycine max
  Coding DNA Sequence Number=SeqID_91540
  Gene Ontology: Mol. function=RNA-directed DNA polymerase activity; Biological process=RNA-dependent DNA replication
MEIKPTFLSLISAHQFVSANHEDPYTYLSTFYELCGKMGIPEGEEEVVYLRLFPFSLTRKAKAWLQSHPNQSLTSLSVVEEKFLNRFFPPSRYISAKSDVSTFKPKTKMILDAVASGTIMFVDVEQATRIIDAFASTDHQSQHNRQSIQKRGVLDLILKGFSKESRLPQRNYKTKDLELVLHEILEVDSKDSAPIKMFISMWWSGSNQKWLVVATNDRGTIPLGLGFALSATFHVECNSSPAYTNIGKLHEEAPHNKRKKYIGKETIELEVGCGATIQKSPPLKHKDPEIFTIPCTIGHLFIEKVLSDLGASINLIPISMLNKIWDVDIRPTRMALQLANRLTKPPHGIVADVPFMKTARGLIDMDDGQFKIRVQDEEVVLNLFKAMKHPNDEKSCFRIDVLDDMYANKLKQVSNSSLHEKALINAFEALDEEEEVEIDDCFKSIDTLKKIPKEELQTNGSTIKKIESCDEGSGKEGGIVLGHIISSKGIKVDEAKVDVIERLPPPTLHTTPDWSLQFELMCDASDYTMGVEFDLKIKDKKGSENVVADHLFRLNNSEVTIKEVEIQEEFPNEKLLKKKFFKDANHYVWDDPYLFMIVVDNLIRRCVTEAEAKSILWYCHNSPYEGYFNGERTAAKVLQ

SEQ ID NO: 208319 - protein, 135 aa, Glycine max
  Coding DNA Sequence Number=SeqID_91541
MSEAQMIPHDTQLHDAQTKKKVEEEEALIAATTKEMVASNQAEAYATTMDNTTICGIIIDLTNSGIMEETPKASNLAIANEGYCCTHTHHMSVPKTLEPFPLTIDPTPQSILPTPPLPSSSPPPTQPPLPPPAQD

SEQ ID NO: 208320 - protein, 118 aa, Glycine max
  Coding DNA Sequence Number=SeqID_91542
MYPPLELIHKRCTVSCSQYNNPSRCTLYLYHKGCTLQCVKTKNSQAVSPLNLCKGKQKISQAVSPLKSFVSGEGKNQKNSQVVSPLNSLGKREGRHKRIQAVSPSILLAKGEVNEEEE

SEQ ID NO: 208321 - protein, 215 aa, Glycine max
  Coding DNA Sequence Number=SeqID_91543
MKHSYEKTYYYDSCSGKEKCKKEGSSSPKQQGSKFPSGKHVPNPSNKVILHYIAQTKKTKVLRDNEIVTTPIEACHILLGKPWKIERNVKLYGKTNKFSFVHEGRKIKHAPLSPKEASDGAKSLSFEINAHYFELCDHEESSSIGTHDESVMLHGSSFATYVEHETLKCFDKEDFNSRTNSLKVGGDDVDQTRNMDNEALQCWTDLQYKEWLLDC

SEQ ID NO: 208322 - protein, 120 aa, Glycine max
  Coding DNA Sequence Number=SeqID_91544
MQVEYCNPNIKTEKLDAIGTCHPQQLIIKTFFSLCRERCQQVLEIVNESKVFWGGLKSDNVTIATYPLAGERGEIQKVHLSRRKTRGVVTNVYSRKTLVKPKDEERIVKVLDLETISSDI

SEQ ID NO: 208323 - protein, 798 aa, Glycine max
  Coding DNA Sequence Number=SeqID_91545
  Gene Ontology: Mol. function=identical protein binding; Cellular component=cellulose and pectin-containing cell wall; Biological process=negative regulation of enzyme activity
  Homolog annotation: Hit_ID=Q1RYB7; Match level="QueryCoverage=91%, HitCoverage=96%, E-value=0.0, Identity=81%"; Hit description =Protease-associated PA; Proteinase inhibitor I9, subtilisin propeptide
  Pfam annotation: Domain name=PA; Domain location=373-476; Score=62.4; E_value=1.5e-15; Accession=PF02225.12; Description=PA domain
  Pfam annotation: Domain name=Peptidase_S8; Domain location=138-605; Score=27.5; E_value=3e-08; Accession=PF00082.12; Description =Subtilase family
  Pfam annotation: Domain name=Subtilisin_N; Domain location=39-120; Score=87.0; E_value=5.8e-23; Accession=PF05922.7; Description =Subtilisin N-terminal Region
  Pfam module annotation: Pfam domain module=PA::Peptidase _S8::Subtilisin_N; Domain location=373-476::138-605::39-120
MSSSGYTTSSALFFLFLTVLAAKVSFCFSTKCRIWIGWQVYVVYMGSKSGEHPDDILKENHQILASVHSGSIEQAQASHIYTYRHGFRGFAAKLSDEQASQISKMPGVVSVFPNSKRKLHTTHSWDFMGLLDDQTMETLGYSIRNQENIIIGFIDTESPSFSDTDMPAVPPGWKGQCQSGEGFNSSSCNRKVIGARYYRSGYEAAEGDSDAKKSFRSARDSTGHGSHTASIAAGRFVANMNYKGLASGGARGGAPMARIAVYKTCWDSGCYDVDLLAAFDDAIRDGVHILSLSLGAESPQGDYFSDAISVGSFHAVSRGVLVVASAGNEGSAGSATNLAPWMLTVAASSTDRDFTSDIMLGNGAKIMGESLSLFEMNASTRIISASAANGGYFTPYQSSYCLESSLNKTKSKGKVLVCRHAESSTESKVEKSKIVKAAGGVGMILIDETDQDVAIPFVIPSAIVGKKTGEKILSYLRTTRKPESRIFGAKTVLGAHPAPRVAAFSSKGPNALNPEILKPDVTAPGLNILAAWSPAAGNMFNILSGTSMACPHVTGIATLVKAVHPSWSPSAIKSAILTTATILDKHHRPIIADPEQRRANAFDYGSGFVNPARVLDPGLIYDLKPADFVAFLCSLGYDPRSLHQVTRDNSTCDRAFSTASDLNYPSISVPNLKDNFSVTRIVTNVGKAKSVYKAVVSPPPGVRVSVIPNRLIFSRIGQKINFTVNFKVTAPSKGYAFGLLSWRNRRSQVTSPLVVRVAPGKNGLGEMQRLSLVEEDEEGFTFNVMKPMREVGRCFSRS

SEQ ID NO: 208324 - protein, 71 aa, Glycine max
  Coding DNA Sequence Number=SeqID_91546
MALGVMAIRPGELLLQPVSSPKRVGSFTPKLFGGPGEPEASLGEPGSRKLPVMTLLPLPFDIFRVLDQNIE

SEQ ID NO: 208325 - protein, 68 aa, Glycine max
  Coding DNA Sequence Number=SeqID_91547
MMRSSGGAAVRRSCSLALVRKFGIVSEQCLCCGGTNEVEPRGENIQAKRKRVEEQEAERCHKRLQCQR

SEQ ID NO: 208326 - protein, 148 aa, Glycine max
  Coding DNA Sequence Number=SeqID_91548
MVVKLEISNFIVCRVLIDQRSSTNILYWSTFKKFDIPTSQIKPFSEQLIGFLGETTYTMGHVNLLTTFRNEKCSKTIMIRNQLPSTIHILINVKEGEVDFLEEVFGLSGSLEETNFTSLKDIDLSFIEITLPFFLSCLCIHLKNNLAY

SEQ ID NO: 208327 - protein, 295 aa, Glycine max
  Coding DNA Sequence Number=SeqID_91549
  Gene Ontology: Mol. function=RNA-directed DNA polymerase activity; Cellular component=chromatin; Biological process=chromatin assembly or disassembly
MDSIHTALNAKIDSILERFTTIMVTPSSPSSLQPPPPLPVHQPHMKLEVPRFDGHDPLGWIFKISQFFDYQAILEHERLTIAAFYMDGPALSWFQWMSRNGYFPSWPAMLQALESRFAPSYYDDPQGTLFKLRQTGTVTEYLTEFESLANRTFGLTPSCLLSCFVSGLILELRREVQALCPMSLLQVTELARLQEDKMLDHRSSHYSYSSSSLTPPKPQAPSANPTPRLPVKRLTAEELAFRRDQGLCYHCDDKWSPGHRCRMRLHLFIANEDFNFSSDFLDSPLNVVPEPVLVP

SEQ ID NO: 208328 - protein, 858 aa, Glycine max
  Coding DNA Sequence Number=SeqID_91550
  Homolog annotation: Hit_ID=Q10S87; Match level="QueryCoverage=99%, HitCoverage=99%, E-value=1e-64, Identity=28%"; Hit description =Expressed protein
MGGLLHMFEFNQGRMAKKVHAQRSNNGDLESSGNGMELQVETSQVHCAEGELPYSCQVEDGWSKKNSYSNVVSVKKLNKEDLSKQSGTTRNNAASLVARLMGIDTMPLPLETNSVVPLDESKHKNMERKFSKKGMNRRGSVGRGSSNFNSSSQMEFDSFYQDIDGDHDDGCRQNFGKPRPREHPQEEELQKFKKEFEAYQESRFKECSKDVEIGSGSRRIPSQENLRKEKMLQIASSKTDSHTFKTKLPNGNMMEPIPTTKKDFFPSRSKTLSRDFEESLMMKSGSRLDICASSAQIVILKPGSDRICNCNHEENCINLSGTLHGRKGLEDFLEEVRERLECELQGIRASGIETPYNEKLSDAKEVRESVTRDAEPNLLRSESTRSYKSKMQFNGPSSPELFNIDTRRFLSERLRNIVNGELHLDIPEVACYNDRVRLKQDTTKCANDKSQWRILKEKKELQTGSYRHKLDDNVLFHKDLSPRNLERSLSAPASGTSFGRLLLEDRHILTGALIQRKLEAVEAMPVDVKKKKKDGFNIKEKLSNFTLGLRGKLFGKRVQSIVESHGSEYGPILRDIRSGPTVFMKYGERHENSTEVPPSPASMCSCVHEKNWRQTGYSSLTSTPDVSSLDDIFIPKVFRDISSGLNELKRQLSQLDSDGSEDFTTKQEPVESELVQLDDPAESYVRDLLVASGLYFGSWDKSLLRGDTFAKPIGNSVFEEVEESHDNLIKEDERSTKDQQNKNKLEHKVLLDLLNEALSIVLGPPLTLSRFRRKLSNSSLQPPPCGNELLKLTWDIVSVSLNPSSNASLYSLDSLVAQDLGSISWSGLTNDHIDTLEREMACLITDDLVEEFTNDMVF

SEQ ID NO: 208329 - protein, 126 aa, Glycine max
  Coding DNA Sequence Number=SeqID_91551
MGPKREELKGFLVIIPKVVTSLLTVSRGIIPFDKHIATVGTTSNNMLSKRKTLNEGSLLSSKSETQHDHRFTSTPYVPMDPGIGPLFNSLCVQKGVGFCVHQMNKYLSHAYIKKHTKSIKELYTRT

SEQ ID NO: 208330 - protein, 122 aa, Glycine max
  Coding DNA Sequence Number=SeqID_91552
MYVGIKGITEKGWRVKAAFVAMVSGDKRGMTVVDSDGLPQWRSQRVARNTGGDTKKEGMELRSKSLTKDLFNPKAFSSGSGGFELVHALWLKQRRSLDASDLNIPPRVLDDDISCTYTNVSY

SEQ ID NO: 208331 - protein, 106 aa, Glycine max
  Coding DNA Sequence Number=SeqID_91553
MEKMDVHIITRGIPKGKWALRAKTARPGELMLTPEVTGSPKRAGNFTLKSLGGPGKPEASLGELGSRKLNEKTLLPLLFGIFRILDQNIEQVFVLCGNWCRTMQFS

SEQ ID NO: 208332 - protein, 58 aa, Glycine max
  Coding DNA Sequence Number=SeqID_91554
LASGLPGPPKDFRVKLPARLGEPVTSGVSISSPGRAVFALSAHFPINRHAREVEKRFE

SEQ ID NO: 208333 - protein, 125 aa, Glycine max
  Coding DNA Sequence Number=SeqID_91555
  Gene Ontology: Mol. function=RNA-directed DNA polymerase activity; Biological process=RNA-dependent DNA replication
QKDAQAKVEYVKRLHEQVKAQIAKKNEIHAKQANKNRKKVVLEPGDWVWVHMRKERFPKQRKSKVQPRGDRPFQVLERINDNAYKIDILGGDSEDLRANAFQEGGNDENPKTAQIQGFMTRSRTK

SEQ ID NO: 208334 - protein, 76 aa, Glycine max
  Coding DNA Sequence Number=SeqID_91556
MAMVDHQKLGMDPYVWLKFKISNVGSFISDEQLHSNDEERISFDNGDDMNSRLSVRTSDDAYFLQGLMFLKGSSNY

SEQ ID NO: 208335 - protein, 40 aa, Glycine max
  Coding DNA Sequence Number=SeqID_91557
MASNRKKQQLGSQWRRRLAEEASQIASESTATATIKATTL

SEQ ID NO: 208336 - protein, 46 aa, Glycine max
  Coding DNA Sequence Number=SeqID_91558
MQTGGNSSDGLKASDVDPRLVFHHGVPSGGAKFAYDTIQRILALST

SEQ ID NO: 208337 - protein, 535 aa, Glycine max
  Coding DNA Sequence Number=SeqID_91559
  Gene Ontology: Cellular component=integral to membrane; Biological process=vesicle-mediated transport
  Homolog annotation: Hit_ID=Q9FFF8; Match level="QueryCoverage=78%, HitCoverage=38%, E-value=1e-25, Identity=26%"; Hit description =Arabidopsis thaliana genomic DNA, chromosome 5, P1 clone:MOP10
MAKEEITSFAVIHHSLYMYIGHSNGNISVLKLDQEPSWHLVQMKYTIPLSASYGNSEVSDDTVVTHILPQPAAESKRVLIIFRNGQMILWNIRESRSIFKTGENMLQPLHTETKKVTSACWVCPFGSKAIVGYNNGELFIWSIRSLNIGNGSASEHSYQNTPLLKLNLGYKSDKISIGSIKWVYAGGKASRLYIMGASDCATSNLLQVVLLNEHTEARTIKLGLHLSECCIDMEIISTSTEQSKNKQDSFILLGKSGHLYLYDDILIERYLLQCQSKSTPSLPKEVTVKLPLAESSITTAKFISNNPNVLTFEDEYYRQLITSYPLFVPVETNQKDEISLSSAKFTGFSKVQNLYITGHSNGAINFWDASCPIFTPILQLKQQSENDCSLSGIPLTALYFDSNSPLLVSGDQSGMVRFLNLVCVFRFKTEPYATNSFMSLTGGTKKGTDHIIQSVKHVKINGAILSLNIDPSLMHLAVGSDQGHLAIPCIQRNAFEKSSIYRPVEEYIGLQQGYYHKNHCQTNPSGTTAARRGHL

SEQ ID NO: 208338 - protein, 174 aa, Glycine max
  Coding DNA Sequence Number=SeqID_91560
  Gene Ontology: Biological process=heat acclimation
  Homolog annotation: Hit_ID=Q6L541; Match level="QueryCoverage=49%, HitCoverage=33%, E-value=6e-23, Identity=44%"; Hit description =Putative F-box protein family
RLHPLAIGVREQQVVEDGVLRDYWLKQVMTGAGGDEGAYGPNDVQFEATVGVEGVRDASIIAVGELDPEEANLVEVLEDLGRGVVGDVAVKVFIEADGEGGGGGRGCGSGGRRGGGGGEAFGVEELAEGVTGLVRGSRGGGRVTVGDDAVDTDDDVLDLQDEGVEAARDDAAAA

SEQ ID NO: 208339 - protein, 386 aa, Glycine max
  Coding DNA Sequence Number=SeqID_91561
  Gene Ontology: Cellular component=integral to membrane; Biological process=vesicle-mediated transport
  Homolog annotation: Hit_ID=Q9FFF8; Match level="QueryCoverage=88%, HitCoverage=28%, E-value=3e-19, Identity=25%"; Hit description =Arabidopsis thaliana genomic DNA, chromosome 5, P1 clone:MOP10
MLTAILWYTDGQGAPVNGSITKDGLESSERNHIEDATTKQQYILLCSEKALYVYSLVHAIQGVKKVLYKKRFHSSTCCWASTFYSPSDVGLILIFTSGKVELRSLPELSLIVETSIRGYNYSPPKLKSFSGCQICCSSKGDLVLVNGNQEFFVVSLLVQRNIFRLLDSISCIYRKNMMLSPEVFVPGPVIYKEKKKGIFSSVIKDFAGSKEKHAPILETEDTTESIQELSAIFSNENFPCDADNNDNLTVDEDELELNIDDIDLDDHEEKHKDQSILGALNKKKLTGKFQALKGRLKEMKGNIQKTSSKEEQQDEQAGAVDQIKKKYGFSSSNETSFAKLAESKLQENMKKLQGINLRTTEMQDKAKSFSTLANQVLRTAEQERRN

SEQ ID NO: 208340 - protein, 97 aa, Glycine max
  Coding DNA Sequence Number=SeqID_91562
MEYLTKHVTEFFQIENEYENIENSYGKGRKKYMKWASKMALSLGARTKIELRYFKKSKSIFDRKVGLGYLHSWLVEVHIEVEAQTDRRHLNALNSSA

SEQ ID NO: 208341 - protein, 177 aa, Glycine max
  Coding DNA Sequence Number=SeqID_91563
MTRTKKTSQMTFEAAKEIADMIDVLTAAIERPKHPGRVHAVGADVTIKHYLGQASRGSRTSLSMAAEDLDQMQSRMQPQMQSQGLTLPVEAEVGPSVAHVDDVSLGNDQVKLGVEEVQDVDAHVLVPTQEDKQVAEGLVKLVDILDPDVDPLYLMTLTIQQLSLKPLQVQWDASVFG

SEQ ID NO: 208342 - protein, 70 aa, Glycine max
  Coding DNA Sequence Number=SeqID_91564
MLDQKAGEVRYDELAVTKFLPRCIIVSTVLAMMHIQMFYAATRGHGRGHKQGYYEDYDDENMRSTSPHCP

SEQ ID NO: 208343 - protein, 52 aa, Glycine max
  Coding DNA Sequence Number=SeqID_91565
MTSPWRFKKLSDKVKDSLNHSKINNNTKLAQRVVSRLKNQAFKIPLKESRIK

SEQ ID NO: 208344 - protein, 90 aa, Glycine max
  Coding DNA Sequence Number=SeqID_91566
  Homolog annotation: Hit_ID=Q1RVB5; Match level="QueryCoverage=57%, HitCoverage=3%, E-value=1e-09, Identity=55%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MLIIDNHLNDVNELKSLLSKEFDMKNLGPAKKILGMEIHRDKKPIWLWLSKQGGSDCWKSIIQSLGAISTTKMEYMAVAKASKEVVWLQG

SEQ ID NO: 208345 - protein, 55 aa, Glycine max
  Coding DNA Sequence Number=SeqID_91567
MASARGGDYHLDDTHTLGGDYWSTSVRLVKSMEESFMRFVGILLLDMKSEDHVLE

SEQ ID NO: 208346 - protein, 245 aa, Glycine max
  Coding DNA Sequence Number=SeqID_91568
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=99%, HitCoverage=56%, E-value=2e-86, Identity=60%"; Hit description =Protein kinase like protein
  Pfam annotation: Domain name=Pkinase; Domain location=1-206; Score= -46.1; E_value=8.1e-06; Accession=PF00069.15; Description=Protein kinase domain
MGIIYRDLKPENVLIRSDGHIMLTDFDLSLKGNDTTSTAQIVFDEDRPSNTGSNEHSKNMSSCMLPNCMVPSVPCFHPKQGGSKRSSRSGSLEIIAEPIEVRSTSFVGTHEYLAPEVISGEGHGNGVDWWTLGVFIFEMFYGMTPFKGLEHELTLANIVARALEFPKEPMIPGAARDLISQLLVKDSRMRLGSRMGAVAIKHHPFFNGVNWPLLRCATPPYIPSSDKCKELLPLYNCTNNALDFY

SEQ ID NO: 208347 - protein, 94 aa, Glycine max
  Coding DNA Sequence Number=SeqID_91569
MERSMIDAASGGALGDMTPAEARNLIEKMASNSQQFSARNDSIVLIGVHEVATDSSSSTENKKLEGKLDALVNLQFGVNEQLEAYAANIYNRPQ

SEQ ID NO: 208348 - protein, 101 aa, Glycine max
  Coding DNA Sequence Number=SeqID_91570
MKPCQASVPLPDGHAPQPRVVPQAPETDIPHVSELGALLTSARPAVEEPRHAEVCYGIAERLELHLSLGVVTPSSSIHEVIEECLKMARSVTQDQLVYVRS

SEQ ID NO: 208349 - protein, 405 aa, Glycine max
  Coding DNA Sequence Number=SeqID_91571
  Gene Ontology: Mol. function=protein serine/threonine kinase activity; Cellular component=integral to membrane; Biological process=protein amino acid phosphorylation
  Homolog annotation: Hit_ID=Q1SB06; Match level="QueryCoverage=97%, HitCoverage=44%, E-value=3e-62, Identity=39%"; Hit description =Protein kinase
MVASLKGIDGFISIDCGASNDYLDEETSIFFKTDTDFIETGENFLTSSQFIQTNDPDLGRQLHTLRSFPEGNRNCYTLKPEYKQGEQKSYLIRAMFGYGNYDGKNHAPTFDLYLGVNYWINVNTATNSYIWTEIIHAPTTDTIQVCLVNIDTGTPFISSLELRPLSTSIYQIMSQSYLHLKGRFDVGGPVVNFYKRYKDDIYDRRWYWRDVKDWYKINTTIDVNKSGNDIYQVPAEILKTAVQSFNRSYDLYHDYEIEWNVHLNKYSRYYVYFHFAEIQKLAPGLRRIINITLNDENILSEPITLEYMKPVTISNKNATQGFVRFSIRATAESDAPPILNAFEVYELITDLNSPTDIKDVDAMENIKRYYGISRIDWQGDPCVPEIFRWSGLDCSYGINPRIISL

SEQ ID NO: 208350 - protein, 267 aa, Glycine max
  Coding DNA Sequence Number=SeqID_91572
  Gene Ontology: Mol. function=protein serine/threonine kinase activity; Cellular component=integral to membrane; Biological process=protein amino acid phosphorylation
  Homolog annotation: Hit_ID=Q9LIG2; Match level="QueryCoverage=91%, HitCoverage=27%, E-value=2e-75, Identity=56%"; Hit description =Receptor-like protein kinase
  Pfam annotation: Domain name=Pkinase; Domain location=3-238; Score =36.4; E_value=1e-10; Accession=PF00069.15; Description=Protein kinase domain
  Pfam annotation: Domain name=Pkinase_Tyr; Domain location=3-234; Score=17.1; E_value=1.6e-13; Accession=PF07714.7; Description =Protein tyrosine kinase
  Pfam module annotation: Pfam domain module=Pkinase::Pkinase_Tyr; Domain location=3-238::3-234
MAWTLSDLQANILTRVHHRCLTPLIGYCNEGTRTALIYEYMTNGDLAEKLSGQSQTFLGWEQRFQIALDSAIGLEYLHNGCKPPIIHRDVKTRNILLDENLRAKISDFGLSRIFSDDGDTHVSTAIAGTPGYLDPEYNTTNRLNEKSDVYSFGIVLLEIITGRTVILKAQVRTHIIKWVSSMLADDGEIDGVVDTRLQGEYDSEAARKVIDVAMACVAPSSVNRPTMNQVVMELKQCFPVGKLGTTSTGSSEIVSAGEISGLSSLAR

SEQ ID NO: 208351 - protein, 506 aa, Glycine max
  Coding DNA Sequence Number=SeqID_91573
  Gene Ontology: Mol. function=protein serine/threonine kinase activity; Cellular component=integral to membrane; Biological process=protein amino acid phosphorylation
  Homolog annotation: Hit_ID=O81070; Match level="QueryCoverage=91%, HitCoverage=91%, E-value=4e-76, Identity=43%"; Hit description =Putative receptor-like protein kinase
  Pfam annotation: Domain name=Pkinase; Domain location=256-473; Score=- 5.3; E_value=3e-08; Accession=PF00069.15; Description=Protein kinase domain
  Pfam annotation: Domain name=Pkinase_Tyr; Domain location=257-473; Score=4.7; E_value=9.3e-13; Accession=PF07714.7; Description=Protein tyrosine kinase
  Pfam module annotation: Pfam domain module=Pkinase::Pkinase_Tyr; Domain location=256-473::257-473
MAKHFVLAIYQLCLTLAALIHAQDQCNQASLALTVDSWMKQATKMKLLVNSLEKQFWNVRSFPEGTRNCYTLYLLPRVNSNKCLVRARFMYGNYDGKDSLPKFDLYLGPNWWNSVEFENASSVTTKEIVQVATSDYIQICLVNTNNGTPFISILEIRVLNDGTYVSESIQLLERFDIGLQEGQNVKDLSNNSLTGSIPDSLSELKSLRILNIGGNKLSGSIPATLSERTRNGSLLILSVDSKKQEFSYSEVQSITNNFERIVGKGGFGTVYYGCIGETQVAVKMLSPSTQGYQQFLTEAKILTRVHHRCLTPLIGYCNEGTGTALIYEYMTNGDLAEQLSGESQTLIGWEQRLQIALDSAVGLEYLHNGCKPPIVHRDVKTRNILLNENRHVVLLEIITGRAAIMKTHEKTHIIKWVGSMLLADDGEIDGVVDTRLQGEYDSEAARKVVDVAMACVAPSSVNRPTMNQVVIELKQCLCKAKTENTSTGSIELVSVGAISGVSSLAR

SEQ ID NO: 208352 - protein, 104 aa, Glycine max
  Coding DNA Sequence Number=SeqID_91574
MWVQAIGLFAQATCAPEFGLSKTIQSEITHATYLSFARINRLFHSSLLQGCENKTTMDTSEPYTGAMKGTMHKPQANIRADQKFSPVDVFKQINWGTNPGISMD

SEQ ID NO: 208353 - protein, 37 aa, Glycine max
  Coding DNA Sequence Number=SeqID_91575
MSAWTFKDGYYRKTVFECFVDIAGNAADAAAIAVTAT

SEQ ID NO: 208354 - protein, 70 aa, Glycine max
  Coding DNA Sequence Number=SeqID_91576
MARSVFAPCPYLRDLYGKELKRLLVIIPKVVISLLMVSRGIIPFEGHISAVGTTSNNMLSKRKTLDEGSL

SEQ ID NO: 208355 - protein, 70 aa, Glycine max
  Coding DNA Sequence Number=SeqID_91577
MANNSEAWMPGSLSELDWLSEAYPLSEEVSSLSEYETLENVESESSTLSMKPANPARILSLLALSASKLA

SEQ ID NO: 208356 - protein, 210 aa, Glycine max
  Coding DNA Sequence Number=SeqID_91578
MASKKRCASSSRPQEPYDTFRFVSEIAQERYKTNTENHIDLALVKEFYSNLYDPEDRSSRQCKVRGKTIKFDAATLNTFLETLVVLEPRERYPTYSRYGHTHPDHQAITAKLCLPGQGFVLNAEGAPWKLLRKDLTTLAQTWSVLSYSNLAPTSHTFDLNMDRARFVYGLVMKMDMDLGSMISCQISQIAQSNSSRLGFLALITPRFPDF

SEQ ID NO: 208357 - protein, 97 aa, Glycine max
  Coding DNA Sequence Number=SeqID_91579
MVVEQTCKKLETNNKTNKNNQDMNIALQTKRYYRHPKLKKQWGFLLTSEKERQHFFFARALHHRKDNSVGSRGSAPAMPLVFSLSLPLSTTRTCRLK

SEQ ID NO: 208358 - protein, 289 aa, Glycine max
  Coding DNA Sequence Number=SeqID_91580
  Homolog annotation: Hit_ID=Q1SM20; Match level="QueryCoverage=40%, HitCoverage=30%, E-value=1e-13, Identity=34%"; Hit description =Nucleic acid-binding, OB-fold
MARIPDKIQDINGSKETLKLVVRITDLWFVGTPDKSEQAEMIIVDCNGDQIHAVCKRDQIKSWKSILKENCTYMMHNFKVVKNDDIIGVVDEVVYQQVSSKSMRVAFKLKNLRLTELGIEAHSVMTPHSQTSSQLSACIHCYKKTDVDTAPFTCACGKYNQQVVLRYRLEVMVNHKEECTKFLLWDHECTKLIGQSADEVNRLKIADGDVDLNVSPEVLDKLLGYSLVFKVKVQPKFKNFVVLKYSSDLDLIKTIVDLLPDAEASYKTDIPLPDYNDPPNYETMSAKFD

SEQ ID NO: 208359 - protein, 250 aa, Glycine max
  Coding DNA Sequence Number=SeqID_91581
  Homolog annotation: Hit_ID=Q1SP02; Match level="QueryCoverage=99%, HitCoverage=53%, E-value=1e-14, Identity=29%"; Hit description=IMP dehydrogenase/GMP reductase
CWIYEHFLSVSECNADPDYDEVSPRVCRWIVTKKTVKKVSTVTYRQCLDCLRILDVCWMPYAEHRPIQDFHLISCFSGQLHWGPVVVRYRPEKVMRQFGYVQCIPAHPVHSWVSYDDVNDTWTHYSDYLATAGDLCIVSGQCAPDYIDWFFVILHPFMTVPQTDPPQDAYATHPSHIPHEAAPTSTHADPDADEPKHAVEACHAIAEALEQHLNAPSTSTHEEVIQKCLRIARGVTEDVRSQRRRRTDHQ

SEQ ID NO: 208360 - protein, 97 aa, Glycine max
  Coding DNA Sequence Number=SeqID_91582
MEDTPVSPRLALPPKGRLRQLATPLGTDIAMLCTSPYCAYAHLHHVVTHALYVGLVFCHGKPEDAPLSPCVALSPKGRLRQLATPLGTIVRELGQSI

SEQ ID NO: 208361 - protein, 108 aa, Glycine max
  Coding DNA Sequence Number=SeqID_91583
  Subcellular localization annotation: CTP_CleavageSite=30; ConfidenceScore=5.09e-01
MHSYHAPHKHLFSIIIVATCPFAGGRRVTRGMRVPRKEYARNRHQRLFEENVEKTEGKPVKKKILSSGVVFTLEEGDHFKALDLENDPFYLVRNRNDKLSKSYFCGRA

SEQ ID NO: 208362 - protein, 181 aa, Glycine max
  Coding DNA Sequence Number=SeqID_91584
MESWEWRTTKFWEDAWVPNTGKLREHNISEASMLRMEFFSPCLVSDHSRPNLEEDLCISLRYVEGIRHGGGVEEYQSYPMCGVGSILDSPTNGYIKLSCDGFMKSFISRATCGGVFWDEQGPSLLVTMDLNNGVCGHDHPCFKLVEEVRWRLSDVEAYTLSHVDRDANKFANVFAHYVVSN

SEQ ID NO: 208363 - protein, 32 aa, Glycine max
  Coding DNA Sequence Number=SeqID_91585
MESKDAIHALLMKAVRAKYKCGLESIPHIDKN

SEQ ID NO: 208364 - protein, 167 aa, Glycine max
  Coding DNA Sequence Number=SeqID_91586
  Gene Ontology: Mol. function=transporter activity; Cellular component= membrane; Biological process=oligopeptide transport
  Homolog annotation: Hit_ID=O80436; Match level="QueryCoverage=89%, HitCoverage=28%, E-value=1e-13, Identity=31%"; Hit description =Putative peptide/amino acid transporter
MILFSLSSLPILSKEVSNTEKSLYYIALPFLAVGYAGHAASYRRPLESRINRQITYEELLIIANYKFVGVVATYFLSHVGGFAIQFVKSWPTRFGVATLFVTVATLLYLTGIGSYRKGTPGGSPLTTFFRVLIASCSKKSYALLRNANELYDENVDPTMPRHTNCLR

SEQ ID NO: 208365 - protein, 340 aa, Glycine max
  Coding DNA Sequence Number=SeqID_91587
  Gene Ontology: Mol. function=transporter activity; Cellular component= integral to membrane; Biological process=oligopeptide transport
  Homolog annotation: Hit_ID=O80436; Match level="QueryCoverage=48%, HitCoverage=31%, E-value=2e-16, Identity=30%"; Hit description =Putative peptide/amino acid transporter
MGGTYFMKQGNEMNPYLGKLQLPLFTLVVFHKLAETLISFIWGIVRDKVRENRRKYLAPIGMAGAIVCSILCCITAASVERRRLDVVRKHGVMEKNPKDKGTIPMTMFWLIPQYVLLSALSAISSFCSSRFYTDQAPESLRDYFVDITLGVSRAGIMGSVVTVYAIGKDKAHGGRKMRWGGRRDPCEQERNDGEVGVIIGVTMLMDVMMAKAMMVVGKQQKSLTQCSISIHFIDDSQAQQHVPSVAQLFHLGGSNQVLAQTCSFNNLDSLIDNTVPKFIHLNGIFNTFHESCQANYAKRTDRAWAAAEVAIVDPCNATLVMAEFFTDLRLSNGMCQLPFL

SEQ ID NO: 208366 - protein, 283 aa, Glycine max
  Coding DNA Sequence Number=SeqID_91588
  Gene Ontology: Mol. function=transferase activity; Biological process= biosynthetic process
  Homolog annotation: Hit_ID=Q07A02; Match level="QueryCoverage=92%, HitCoverage=48%, E-value=1e-106, Identity=72%"; Hit description =Sulfoquinovosyldiacylglycerol synthase type 2
  Pfam annotation: Domain name=Glycos_transf_1; Domain location=89-233; Score=56.5; E_value=8.7e-14; Accession=PF00534.10; Description =Glycosyl transferases group 1
MQLSLPFVSEEFLHRAADLTLVPSAAIAGDLLAARVTAASENMCFLVCLLLCSKILTEFFSCWYPANKIRLWNKGVDSEKFHPKYRSHEMRLRLSNGEPDKPLIVHVGRLGVEKSLDFLKREELEKMFEGMPAVFTGMLVGEELSQAYASGDVFVMPSESETLGLVVLEAMSSGIPVVAACAGGIPDIIPVDQDGKTSYLYNPGDFEDCLSKLRPLLLNKELRETMGKAAREEMEKYDWKEATRKIRNEQYNAAIWFWRKKRAQLLRPFQWLAKRFFPSPQVN

SEQ ID NO: 208367 - protein, 127 aa, Glycine max
  Coding DNA Sequence Number=SeqID_91589
  Subcellular localization annotation: CTP_CleavageSite=70; ConfidenceScore=5.08e-01
MSRKSKRVCFSPDVNDKPTLFLKYNGGGGNDKDNRVSRNGKRVTRPCTFRFSMDTNLSPAKFLLQLGEKVASAIRNVSVRRRSSRKVSSSTLVRSRSLSDLTDSHRAETVEDCIEFLHSSSSRERPS

SEQ ID NO: 208368 - protein, 265 aa, Glycine max
  Coding DNA Sequence Number=SeqID_91590
  Gene Ontology: Mol. function=nucleic acid binding; Biological process= RNA-dependent DNA replication
  Homolog annotation: Hit_ID=Q1SXJ0; Match level="QueryCoverage=41%, HitCoverage=48%, E-value=7e-25, Identity=51%"; Hit description =F7F22.15, related
MSHIPWCLQKRKKSDILLIFLTFLRSWRSPFPLENPCNRLSKALIDLGANINLMPLSMCQRIRNLKITPTRVTLQLVDFSITMPYGVVEDVLVKVQQFTFPVDFGIMDVKEDLDIPLILGCPFMLTAKCVMDMGNGNLEMSVEDQKEIPLGEYAFEELKKDFVTKKPKVELKYVFLEAHDTKPVVISNELSSVEEEHLVESHGGEYDVAPCGACRPWIFFINEVLCFFKIMVAEWRRKKDDWRCHFKEKMSQEEAHHHKKPWIKA

SEQ ID NO: 208369 - protein, 82 aa, Glycine max
  Coding DNA Sequence Number=SeqID_91591
MLSKTEASSTLQTSSQRSQRVLQFQMSTLLLHLIELRSWSVEEGSRQLKCFIQLHIFDGEGARPLGLEFFRKKLLDQRPQKS

SEQ ID NO: 208370 - protein, 229 aa, Glycine max
  Coding DNA Sequence Number=SeqID_91592
  Gene Ontology: Mol. function=RNA-directed DNA polymerase activity; Cellular component=chromatin; Biological process=RNA-dependent DNA replication
MSFGLCNAPATFQRCMLAIFANLVEKCIEVFMDDLSVSDSSIESCLSNMELVLKRCVENNLVLNWEKCHFMVQKGLVLGHKISSQEIEVDKTKIDVIEKLPPPSRKNHTKRNSNPKGNCTERKLSHLEQEELRSTRIVAPNTSQPKRNCTKHENSRLAPKVSLSLSQNSIQTTLETPPPPPTTTSGHHKPPLLATEPPHREECFNQSEILRIHLKDSMENNPSIPQGFS

SEQ ID NO: 208371 - protein, 191 aa, Glycine max
  Coding DNA Sequence Number=SeqID_91593
  Gene Ontology: Mol. function=RNA-directed DNA polymerase activity; Cellular component=intracellular; Biological process=RNA-dependent DNA replication
MEGAVTMMDIPGESVAWTRLGYFPMNGTTLHLRVESGDTVVTKRVVIVFIVFIRDPKGERLMSTPVMVASNWSQEFQLMCDANDYVVGAVLGQHRDHAAIKYLLTKADSKLRLIRWVLILQEFDIVIKDKKGCENLVVDHLSRLVNEEVTREEQDIRDEFPDKSLLSVGERPWFADIANFKAVGIIPNDLN

SEQ ID NO: 208372 - protein, 88 aa, Glycine max
  Coding DNA Sequence Number=SeqID_91594
MEVQVGQLAKQLAEKSTRNFVVNTEKNPKKECKVVLTRRKRKESLETEKRAKGVVEDVSDKEVEDERKEKELRDKKNKKNEKNEKEKN

SEQ ID NO: 208373 - protein, 116 aa, Glycine max
  Coding DNA Sequence Number=SeqID_91595
MDVVDFLLVCEENSLRTWEEVVEKYFLESKTAEGKAEISIFHQFPNESLSEALDRFCGLLQRTPTHGFTQNKLLAKKIETLTEALNKLPQQLHYVQPASSYVMQVGEYTLCGGAHE

SEQ ID NO: 208374 - protein, 179 aa, Glycine max
  Coding DNA Sequence Number=SeqID_91596
  Gene Ontology: Mol. function=tRNA-pseudouridine synthase activity; Cellular component=ribonucleoprotein complex; Biological process=RNA processing
  Homolog annotation: Hit_ID=Q8H5T5; Match level="QueryCoverage=52%, HitCoverage=15%, E-value=1e-35, Identity=75%"; Hit description =Putative centromere/microtubule binding protein
ASTYVKTMCVHLCLLLGVGSHMQELRRVRSGIMGEKDNMVTIHDHGGAEWVYDNYRDGTYLRRVVMPLEILLTNYKRFFVKDSSVDAICYGAKLYEGLTIVHNIPLRHNQVKVGVKEVRDADALISVLTQEVQLVGQILNTFVVWLTHLVKRLSEQGVVGPKKPAHALDVNCNFRKFQE

SEQ ID NO: 208375 - protein, 204 aa, Glycine max
  Coding DNA Sequence Number=SeqID_91597
  Gene Ontology: Mol. function=ribonucleoside-diphosphate reductase activity; Cellular component=cytoplasm; Biological process =deoxyribonucleoside diphosphate metabolic process
  Homolog annotation: Hit_ID=P49730; Match level="QueryCoverage=53%, HitCoverage=63%, E-value=2e-27, Identity=65%"; Hit description =Ribonucleoside-diphosphate reductase small chain
YIYLGCNTENKRGYISYGSVQVERASTLLFKENKGGYIPCGSLLVKDFTRLLEISRTVGCMGTGLQETHEVAVKPPISQDEFVGEANAMRHSTKDSEASIQRRAHWAFLMMHGMVSKRRLYISEWIFSMDDAVGGGEEGEDVGDEGALAVAEGGPMAEVLRENRSGFGARSGSSVILVDYFDSLVKLPATVVQKAEKYTLAIVA

SEQ ID NO: 208376 - protein, 117 aa, Glycine max
  Coding DNA Sequence Number=SeqID_91598
MIGQKVVIDYQKPKRYRDGEGIEAFILYCLRAIHFSLSMNIISQIPMLEVWWYAGKERVLGGREGKTKLRGRGGREAIVDKSGAFAPTYPPSKRKSDLRSSSFKGESSDSFYLKGDH

SEQ ID NO: 208377 - protein, 70 aa, Glycine max
  Coding DNA Sequence Number=SeqID_91599
MAATAGRTSCQVARWCSGGASEGREKKMLAGIVSQITGFSYRASGPRRGGRRTMFIVVRGVGANNYLCVN

SEQ ID NO: 208378 - protein, 173 aa, Glycine max
  Coding DNA Sequence Number=SeqID_91600
  Gene Ontology: Mol. function=transferase activity; Biological process= DNA integration
  Homolog annotation: Hit_ID=Q1S1G2; Match level="QueryCoverage=83%, HitCoverage=11%, E-value=5e-24, Identity=36%"; Hit description =Integrase, catalytic region; Zinc finger, CCHC-type; Peptidase aspartic, catalytic
  Subcellular localization annotation: CTP_CleavageSite=36; ConfidenceScore=5.13e-01
MKNQPASTKLVSISAGRMLAFVLNNHGEHASSGRVGASNQGVKVIKLFPERLKFGIVVSNREITLLEGINFFLELSNPKDISLCESFSEVSPGVNGSLKEDYTLSNGRNQYGASEEAHLVFGDKSHAYITRPSLKVGSCEYRSNKDGRWAFTRDLRKVELVEEVGDPPHQRKC

SEQ ID NO: 208379 - protein, 1486 aa, Glycine max
  Coding DNA Sequence Number=SeqID_91601
  Gene Ontology: Mol. function=RNA-directed DNA polymerase activity; Cellular component=chromatin; Biological process=chromatin assembly or disassembly
  Pfam annotation: Domain name=Chromo; Domain location=1174-1222; Score= 19.9; E_value=0.0044; Accession=PF00385.14; Description='chromo' (CHRromatin Organisation MOdifier
  Pfam annotation: Domain name=Cu-oxidase; Domain location=1192-1343; Score=-10.1; E_value=0.0013; Accession=PF00394.12; Description =Multicopper oxidase
  Pfam annotation: Domain name=Cu-oxidase_2; Domain location=1385-1486; Score=74.2; E_value=4.1e-19; Accession=PF07731.4; Description =Multicopper oxidase
  Pfam annotation: Domain name=RVP_2; Domain location=271-388; Score= -19.2; E_value=3.1e-05; Accession=PF08284.2; Description=Retroviral aspartyl protease
  Pfam annotation: Domain name=rve; Domain location=922-1091; Score =37.7; E_value=3.9e-08; Accession=PF00665.16; Description=Integrase core domain
  Pfam annotation: Domain name=zf-H2C2; Domain location=863-904; Score =29.1; E_value=1.5e-05; Accession=PF09337.1; Description=His(2) -Cys(2) zinc finger
  Pfam module annotation: Pfam domain module=Chromo::Cu-oxidase::Cu -oxidase_2::RVP_2::RVT_1::Retrotrans_gag::rve::zf-H2C2; Domain location=1174-1222::1192-1343::1385-1486::271-388::410-600::61 -135::922-1091::863-904
MADHGTRNTTTERLEDAIARLTNSQANLTEHYTDLSGRVDSILDHLRMRDAHQNQPSPSSSNNHRNSVKLDIPCFDALESRFAPTFYDDPKGALFKLVQRGSVNDYLTEFERLANRVVGLPPPFLLSCFISGLNPELRREVLALQPISLLQATALAKLQEDKLRDKRSSFQRPFQPSPSSSSTSLNPKVKPPYVQRTPEDMSFRREKGTNTTAQMGTDASSTTMGAMPPDDGDPDSITPNSCLEDNGGDSEPAMDTGFPHISLHAMSGLPSSETFRVYGTIKNTRLTILIDSGSTHNFLQARVAQFLNLPVETTRPLRVLIGNGSVLDCNQHCPDTQLSIQGHSFPVTFHLLQISGADAVLGIDWLKQFGPITTDYTSFIMRFTHLGQEISLHTDVALGPKPASAAQVKCLIHIASTVSHLPLVAEPVARLLRRYDKLFQPSTHLPPSCKVNNRITLLPSTAPDEHEPILFSSPFGEEEGRHMANLDLRQGFHQILMNEADIEKTAFRTHHGHYEYFVMPFGLCNAPSTFQVAMNHLLAPFLRCLAAVFFDDILVYSDSLSSHVQHLDIIFQALLRGQYYLKQTKCLFAQTQLEYLGHVVSSNGVAPEPSKIQAIIQWPTPTSAKDLRAFLGLTGFYRKFIQKYAAIATPLTHLFCKDAFEWSQESQDAFDKLKTSITSAPVLALPNFNEPFTVETNASSTTMWAMLIQQGHPLAFFSKNFSPRLSHASTYVRELHAIIAAVRKWRQYLLGRPFTILTDHKSLRELMSQYKVGAANVVADALSRRPPASGQLLLLSMPQMDFMRDIQQTLENDPSFWELVRNIKANPSAYPQFSLSKGYLLFNGRIWLNKTNPYIPSLLLEFHATPLGGHLGIAKTTHRLESSFFWQGMKQDVKQFIRECKVCQQNKSSTRRMAGLLQLLPTPTGVWEDISMDFVTHLLPSNGFTVILVVVDRFSKGVHLGALPTGFSAFKVATVFLDIICKHHGFPRSIISDRDPVFPSAFWRELFRIYDTRLRLNTTYHPQSDDQTEWCYNTSLHSSSGLTLFEVMYGKPPPSIPHYIPSLTNNEAVESLVESRQVMHAKLQKRLEKAQDSMKKYANVRCEDITFSVGQWVYVKLRPTRQRSVAEVAYRLELPARACIHPVFHCSLLRHHHGAPPSATEPWPREIMGHKPLQCPLCILDSKFDTSTSPPTQLVLTQWVGQPPEDTSWEPWPELQEAYHLEDKVVFEGGGIVSTHASNNDERRPPRAAAAKKLIQPVSPKMTNDVYKLPVESGKTYLLRIINAALNEELFYKIAGHSLTVVSVDNLTAIATLQYTGTLSTTPTLFTIPPPRNATQIANDFNKSLKSLNSKKYLSKVPQTVDYSLLDLGLTIVHLVEQEMGVYNYTATPPVVASQTTNDTKAYRLAFNSTVHVVLQDTGAIAPKSLPVHLHGFNFSVVGSGVGNYDPKTNQNNFNLVDPVERNTIGVPTGGWIAFRFRADNPGKNS

SEQ ID NO: 208380 - protein, 568 aa, Glycine max
  Coding DNA Sequence Number=SeqID_91602
  Gene Ontology: Mol. function=transporter activity; Cellular component= integral to membrane; Biological process=oligopeptide transport
  Homolog annotation: Hit_ID=Q9M390; Match level="QueryCoverage=99%, HitCoverage=100%, E-value=0.0, Identity=71%"; Hit description =Peptide transport-like protein
  Pfam annotation: Domain name=MFS_1; Domain location=34-513; Score =39.6; E_value=1.1e-08; Accession=PF07690.6; Description=Major Facilitator Superfamily
  Pfam annotation: Domain name=PTR2; Domain location=96-497; Score =515.9; E_value=4.3e-152; Accession=PF00854.12; Description=POT family
  Pfam module annotation: Pfam domain module=MFS_1::PTR2; Domain location=34-513::96-497
MAEDDIYTQDGTITISKKPANKKKTGNWKACYFILGNECSERLAYYGMSTNLVNYLRERFNQGNATAANNVTTWSGTCYITPLIGAFLADSYLGRYWTISSFSIVYVIGMILLTLSASAPGLKPSCDANGCHPTSAQTATCFIALYLIALGTGGIKPCVSAFGADQFDDSDEKEKIKKSSFFNWFYFSINIGALVASSVLVWIQMNVGWGWGFGVPAVAMVIAIIFFFGGSRLYRLQIPGGSPLTRICQVIVAALRKIGLQVPNDKSLLHETIDLESVIKGSRKLDHTNRFKCLDKAAVETESDHTKDLSNPWRLCTVTQVEELKSVISLLPVWASLIAFATVYGQMSTMFVLQGNTMDQRIGPHFKIPSASLTIFDTLSVIFWAPVYDRFIVPFASKYTGHKQGFTQLQRMGIGLVISTIAMVVAGILEVYRLGIVRKNNYYDVETIPLSIFWQVPQYFLVGCAEVFTNIGSLEFFYGQAPDAMRSLGMALSLTTNALGNYISTLLVIIVTKVTTRHGKLGWIPDNLNRGHLDYFYWLLTVLSFLNFLVYLWVAKRYRYKKVAGNAH

SEQ ID NO: 208381 - protein, 733 aa, Glycine max
  Coding DNA Sequence Number=SeqID_91603
  Gene Ontology: Mol. function=helicase activity; Cellular component =mitochondrion; Biological process=metabolic process
  Homolog annotation: Hit_ID=Q8W0G9; Match level="QueryCoverage=86%, HitCoverage=99%, E-value=1e-154, Identity=36%"; Hit description =Putative fertility restorer
  Pfam annotation: Domain name=PPR; Domain location=114-148; Score =20.6; E_value=0.0058; Accession=PF01535.11; Description=PPR repeat
  Pfam annotation: Domain name=PPR; Domain location=149-183; Score =25.5; E_value=0.00019; Accession=PF01535.11; Description=PPR repeat
  Pfam annotation: Domain name=PPR; Domain location=184-218; Score =47.1; E_value=5.8e-11; Accession=PF01535.11; Description=PPR repeat
  Pfam annotation: Domain name=PPR; Domain location=219-253; Score =26.7; E_value=8e-05; Accession=PF01535.11; Description=PPR repeat
  Pfam annotation: Domain name=PPR; Domain location=255-289; Score =44.5; E_value=3.7e-10; Accession=PF01535.11; Description=PPR repeat
  Pfam annotation: Domain name=PPR; Domain location=290-324; Score =45.6; E_value=1.6e-10; Accession=PF01535.11; Description=PPR repeat
  Pfam annotation: Domain name=PPR; Domain location=325-358; Score =36.7; E_value=8.1e-08; Accession=PF01535.11; Description=PPR repeat
  Pfam annotation: Domain name=PPR; Domain location=390-424; Score =19.8; E_value=0.0099; Accession=PF01535.11; Description=PPR repeat
  Pfam annotation: Domain name=PPR; Domain location=427-461; Score =42.8; E_value=1.2e-09; Accession=PF01535.11; Description=PPR repeat
  Pfam annotation: Domain name=PPR; Domain location=462-496; Score =38.5; E_value=2.3e-08; Accession=PF01535.11; Description=PPR repeat
  Pfam annotation: Domain name=PPR; Domain location=497-531; Score =44.5; E_value=3.5e-10; Accession=PF01535.11; Description=PPR repeat
  Pfam annotation: Domain name=PPR; Domain location=532-566; Score =31.1; E_value=3.9e-06; Accession=PF01535.11; Description=PPR repeat
  Pfam annotation: Domain name=PPR; Domain location=567-600; Score =22.7; E_value=0.0013; Accession=PF01535.11; Description=PPR repeat
  Pfam annotation: Domain name=PPR; Domain location=601-635; Score =25.2; E_value=0.00023; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=114 -148::149-183::184-218::219-253::255-289::290-324::325-358::390 -424::427-461::462-496::...
  Pfam module annotation: Domain location=497-531::532-566::567 -600::601-635
MVELPKSLSPHRLLKLLKAEKSPLSALNVFDAAVRRPGFSPSSAVFHHILRRVAADPGLLLAHAPRIIAAIHCPCPEDVPLTLLKAYAKTRMPNEALHVFQTMPHVFGCSPTIRSFNTLLNAFVESHQWARAENFFKYFEAARVSPNVETYNVLMKVMCKKGEFEKGRGLLTWMWGAGMSPDRITYGTLIGGVAKSGDLGFALEVFDEMRERGVEPDVVCYNMIIDGFFKRGDFVKAGEMWERLLREELVFPSVVSYNVMISGLCKCGRFSEGLEIWERMKKNERKCDLFTYSALIHGLSEAGDLGGARKVYEEMVGRGVRPDVVTCNAMLNGLCKAGNVEECFELWEEMGKCSLRNVRSYNIFLKGLFENGKVDDAMMLWDGLLEADSATYGVVVHGLCWNGYVNRALQVLEEAEHREGGMDVDEFAYSSLINALCKEGRLDEADGVVELMNKRGCKFNSHVCNVLIDGFVKHSKLDSAVKVFREMSGKGCSLTVVSYNILINGLLRAERFREAYDCVNEMLEKGWKPDIITYSTLIGGLYESNMMDAALRLWHQFLDTGHKPDIIMYNIVIHRLCSSGKVEDALQLYSTLRQKKCVNLVTHNTIMEGFYKVGNCEMASKIWAHILEDELQPDIISKFEAPGQIAFGYGWWTTYSTNRNIMLSGTWVQYSLPLGYLKFGVAKQNRTGVLVSGIFVCVMMLKVSSASLGNPVTQILVILVISPISAVIDAKAK

SEQ ID NO: 208382 - protein, 256 aa, Glycine max
  Coding DNA Sequence Number=SeqID_91604
  Gene Ontology: Cellular component=chloroplast thylakoid membrane
MIALKSIHPFFTPIYIKYNIHRSRCLNTKDSVLCLCKSNQSESQAPQPGDIRKQELLAQIAMLQTQKVRLMDYFDERSEYLTQFGEEAKAEFDKIGEDALQGLDEASARITANIESQMVEFEESAELNRQEIQEREKELDKFEVQMEDGRNEGLFFKNLRKKAPVDKAKAKEEAEKIKDVAREKAGSRTRKGIYLLFIGLLTFAIVDSVASSSTDWRKIAVLGAILVALVSQFIYEQTMSIETGKIRKIDTEEENN

SEQ ID NO: 208383 - protein, 113 aa, Glycine max
  Coding DNA Sequence Number=SeqID_91605
  Gene Ontology: Cellular component=exocyst; Biological process =exocytosis
  Homolog annotation: Hit_ID=Q9FGH9; Match level="QueryCoverage=64%, HitCoverage=11%, E-value=6e-18, Identity=57%"; Hit description =Leucine zipper protein
MLFLLFHHFALLLLRRRQHLRLTRTTNSLLSHHSGSFEWAEGLVAVLHEQAKLVLKAKHGMLEHVLDVNEAHDDELVGEELAPLSDDSDELVQGVEEGSRIGGVGPDCVVGGE

SEQ ID NO: 208384 - protein, 104 aa, Glycine max
  Coding DNA Sequence Number=SeqID_91606
  Homolog annotation: Hit_ID=Q1SN43; Match level="QueryCoverage=92%, HitCoverage=18%, E-value=1e-13, Identity=39%"; Hit description =Nucleic acid-binding, OB-fold, subgroup
MLWSLFNLPKSRVFKNMDSLRVSLSQLSDGAISTNVDFLEVIPKKRLNGLKIAERSMILCTFKHIMDDEEWWYTAYTCSKVVYPDSNIFFCPKCNKHVVNVVLR

SEQ ID NO: 208385 - protein, 93 aa, Glycine max
  Coding DNA Sequence Number=SeqID_91607
MVGNGGVVVHFWLVEKLWNVIARKFDGSAIGMALKITRKDPIGAFWQCIGGVNGRAKNELADGCRIAASIDLQWKSSTIRRKWDLNQTRTRRG

SEQ ID NO: 208386 - protein, 197 aa, Glycine max
  Coding DNA Sequence Number=SeqID_91608
  Gene Ontology: Mol. function=DNA binding; Cellular component=nucleus
  Homolog annotation: Hit_ID=Q2HUC6; Match level="QueryCoverage=46%, HitCoverage=17%, E-value=3e-11, Identity=38%"; Hit description=ELM2; AT-rich interaction region; Homeodomain-related
MNGDKFTTIAFITKEKRGNRNAIQNEKVEYYNICRQDYTQLGDPDEFVEGLNPMKQGHLKALESLVNEDFDNSNENSHSSCLKNEDVELNQSQNNLSFEDNHIPRPVIPIGPRFQAEVPTWEDRTNIQHNDDSLKLMGIQLWPMPNISENKTNDVGGGSIDCVKLHIREARELLKLEIGATFSSWKFDEMGEDVSKS

SEQ ID NO: 208387 - protein, 65 aa, Glycine max
  Coding DNA Sequence Number=SeqID_91609
MAIWGLYDGVQRERENRVDHRPLMDGLTYFHPTKAHGDDKYCSLVKKAGRSIGECLEAEGRRPVA

SEQ ID NO: 208388 - protein, 298 aa, Glycine max
  Coding DNA Sequence Number=SeqID_91610
  Homolog annotation: Hit_ID=Q2HUC6; Match level="QueryCoverage=39%, HitCoverage=19%, E-value=2e-23, Identity=46%"; Hit description=ELM2; AT-rich interaction region; Homeodomain-related
MKKQAFGSEDILEPNKSSHQRPRNQMHKIDTLSIPNAKCAKRKLDQYMCGHKVATDLGLITREKCSNQNAILNEKVEQCSICRQDYPQLGVSDALIEGPNPKQGYLENHRKDLVTSCNYVTTTETSMEKSNMEFSKALEPLFNGDFDNSSETSVSSSSENEDKELSQPPNNLSSEDNHIPRPVIPIGPRFQVEVPKWEGTTNVRHHHSDDDLKWLGIQLFPTLNISENKTKDIGEGRHDSCSCKFPGSVDCVELHVRETRELLKLEIGTTFSSWKYDEMGKVVSKSWTSEEQKKFESL

SEQ ID NO: 208389 - protein, 355 aa, Glycine max
  Coding DNA Sequence Number=SeqID_91611
  Gene Ontology: Mol. function=oxidoreductase activity; Cellular component=membrane; Biological process=electron transport
  Homolog annotation: Hit_ID=Q8LF37; Match level="QueryCoverage=89%, HitCoverage=64%, E-value=1e-120, Identity=66%"; Hit description =Cytochrome P450, putative
  Pfam annotation: Domain name=p450; Domain location=41-353; Score= -109.4; E_value=5.4e-06; Accession=PF00067.12; Description=Cytochrome P450
MEIIATIFFCILLIFSSLILSYPLIKKHKKQQHVVAKPKLPPGSMGWPYIGETLQLYSQDPNIFFASKQKRYGEIFKTHILGCPCVMLASPEAARFVLVTHAHLFKPTYPKSKEKLIGPSALFFHQGEYHTRIRKLVQTSLSPESIRKLIPDIENEVVSSLELWVSAAGQVINAFQEMKKTHGPPLNPSSSQFSFNIGILSVFGHLEDNYRDQLKENYCIVEKGYNSFPNRIPGTAYSKALLARRRIREIISEIICKRKEQRLMERDLLGHLLNYKDEKGQMLSDDQIADNVIGVLFAAQDTTASVLTWILKYLHDDQKLLEAIKAEQMAVYEANEGGKMPLTWGQTRNMPITHR

SEQ ID NO: 208390 - protein, 180 aa, Glycine max
  Coding DNA Sequence Number=SeqID_91612
  Gene Ontology: Mol. function=DNA binding; Biological process=DNA integration
MVRSMLKSKKLPKEFWAEAVAYVVYLSNDFQQEVYREKHHKKHGVEGSLTFHTKCLEALLFSLPLLANFKSSQEIYEVIENKDNLTLFCLFVDCEPMSFQEAIKNKNWKNSMDEEIKTIKKNDTWELISLPKGHKAIGMKWVFKAKKNAKGEVERYKARKKAIIIELASTMMRNLLPLLD

SEQ ID NO: 208391 - protein, 104 aa, Glycine max
  Coding DNA Sequence Number=SeqID_91613
  Homolog annotation: Hit_ID=Q47522; Match level="QueryCoverage=49%, HitCoverage=70%, E-value=1e-14, Identity=70%"; Hit description=LacZ protein
VPPVQLLTGWCVTAKAPPDISAGKCSGHAARRVPFAIQAAQLLGRAIGAGLFAITPAGERGMCCKAIKLGIRFLTAIDGGNIAQQWQCPTSETANQHNAVLSPV

SEQ ID NO: 208392 - protein, 144 aa, Glycine max
  Coding DNA Sequence Number=SeqID_91614
MKALLGTQDIWEIVEKGYPKPENEGSLSQTQKDSLRDSRKIGKKTLYLIYHGLDDNAFEKVKSSPNEEEESSHNNYSRRKLIRSTKKVITIIEANEGEVVMEIEEEDKVMDKEKDEVGGLMTTTTTSKEVMGKATEDRGITSQM

SEQ ID NO: 208393 - protein, 67 aa, Glycine max
  Coding DNA Sequence Number=SeqID_91615
MSGINRLHVWNWMLNTSILTSQVASYEFTTLTCIPGVITYCGAKIQIFCLWVDKPGMPKAEFSCTFF

SEQ ID NO: 208394 - protein, 271 aa, Glycine max
  Coding DNA Sequence Number=SeqID_91616
  Gene Ontology: Mol. function=farnesyl-diphosphate farnesyltransferase activity; Cellular component=integral to membrane; Biological process= lipid biosynthetic process
  Homolog annotation: Hit_ID=O22107; Match level="QueryCoverage=23%, HitCoverage=23%, E-value=4e-25, Identity=59%"; Hit description =Squalene synthase
MADEAVVVLDDIYPLLKLNMAARNAEKQIPPEPHWVFCYTMLHKDDSSIETDVKVPILIAFHRHIYHHDWHFSCEGMFPVEQGDLHKRWKLVNMKLRNFHKCVVLPIGSLSSGLCRHRTILFKNIVELSNYIAECAWVYEEAALVLLGRLADYIGLPCRIARGCKYCVADHRSSCLVKIKDDKQLSRVFQDPSMTILRKLLRKVEIIKSSRSGEPNFESHHVEANDLQSVVDQYFQIRDTSKPARHIETHFGVNKELTASLTKAWLEKMGI

SEQ ID NO: 208395 - protein, 151 aa, Glycine max
  Coding DNA Sequence Number=SeqID_91617
  Gene Ontology: Mol. function=kinase activity; Cellular component =intracellular; Biological process=intracellular protein transport
  Homolog annotation: Hit_ID=Q9LFL3; Match level="QueryCoverage=70%, HitCoverage=26%, E-value=5e-33, Identity=65%"; Hit description=TOM (Target of myb1)-like protein
MATYVRCIVGNLSATWTIQRGTTRHYFRTQQNKRKERERESWKKNLVSFLVDREIAQLVCGLTPGFDHHEGLVAVVDDGLRVIDEPNHLVEDTLGGDFGEGLLAVLDKGFEEDKGEVLNPRALEDDPLLDSADEFDATELVGIDEIAEIEI

SEQ ID NO: 208396 - protein, 227 aa, Glycine max
  Coding DNA Sequence Number=SeqID_91618
LIILGHKSLSSFHKSMLLLSPALFHPHRPANSCGCHPEEHFIGFCPSCLYERLTILKHDGSSSIDTRPITSLTSPEANCQPFTTTLDGNHLPKSSSITFNPKLCSTKSFPALKNEGLSCALEPRRKSCDVIPYSPLFSISNPDDKHEIPIKEPKVETCNLTSSSIIELEADVEAEKTLKARDDLLDIDSQGKKSSSRDLKECIWFDTTNFRKKFRKWRQKQKMKKRE

SEQ ID NO: 208397 - protein, 260 aa, Glycine max
  Coding DNA Sequence Number=SeqID_91619
  Gene Ontology: Mol. function=triose-phosphate isomerase activity; Cellular component=membrane fraction; Biological process=metabolic process
  Homolog annotation: Hit_ID=Q1GZK6; Match level="QueryCoverage=64%, HitCoverage=67%, E-value=3e-53, Identity=57%"; Hit description =Triosephosphate isomerase
  Pfam annotation: Domain name=SecG; Domain location=170-221; Score =32.0; E_value=2.1e-06; Accession=PF03840.4; Description=Preprotein translocase SecG subunit
  Pfam annotation: Domain name=TIM; Domain location=1-205; Score=166.0; E_value=9.3e-47; Accession=PF00121.9; Description=Triosephosphate isomerase
  Pfam module annotation: Pfam domain module=SecG::TIM; Domain location= 170-221::1-205
MQSLLTGSRLAWGAQNIAKYEEGAYTGEVSAEMLRDFGAQYVIIGHSERSTAYCESDENIAEKFMMAKRHGLIPILCVGETLLEREAGVMERVVGKQLETIIRLFGGEAFAGTIVSYEPIWAIGTGLAASAEQAVAMHTFIRETVAAADKAAAQTLKILYGGSVNPQNAHGKGADMGAAFGSGASGSLFGVSGSSNLLSKLTSIFITVFFATSLTLAFMSSHKAGSGSVVKAPLTQQAPAKGEAAEAVKPVENTPKDIPN

SEQ ID NO: 208398 - protein, 308 aa, Glycine max
  Coding DNA Sequence Number=SeqID_91620
  Gene Ontology: Mol. function=oxidoreductase activity, acting on NADH or NADPH; Cellular component=membrane; Biological process=ATP synthesis coupled electron transport
  Homolog annotation: Hit_ID=Q1GZL5; Match level="QueryCoverage=90%, HitCoverage=35%, E-value=3e-91, Identity=59%"; Hit description=NADH -quinone oxidoreductase, chain G
MYSMAEAIGGITGAKGGILPPAANSTGMHLMGVMPSATGMHARAMIEIPRKAYLLLNIEPELDCQHAALASDAMAKAECVIALTAYKSAALENADILLPIAPFTETSGTFMSMEGRVQSFQAVTRPLGEARPGWKVLRVLANTLGLSGFEYNSSEEVKNAIFNGEKPSAVVWRSLNNNLKELVEIQVNIKKEGLQRIGEVPQYEFDPIVRRSAPLQKTKYNIRPMARMRAEQLAELGLADGDIVVARQDKGSAVLKVRLDNHVAKGCVRVAAAHPLTAGLGDLMGDITLEKASAEQVAIYEKQLTEMA

SEQ ID NO: 208399 - protein, 59 aa, Glycine max
  Coding DNA Sequence Number=SeqID_91621
MDHIQWTSLEFNKGSTVAQRLISEYIPQYNYSLLAFGWMLLKMSYRMSRHHASDHADYI

SEQ ID NO: 208400 - protein, 197 aa, Glycine max
  Coding DNA Sequence Number=SeqID_91622
  Homolog annotation: Hit_ID=UPI000044A741; Match level="QueryCoverage =37%, HitCoverage=18%, E-value=3e-09, Identity=53%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPCARPPRPRDKTQTPALRAPRNSNLLSATPGGPETNVAKCDTWCELQNPVNHRVFERKLRPKPLGRGHACLGVTHRFPNANM

SEQ ID NO: 208401 - protein, 105 aa, Glycine max
  Coding DNA Sequence Number=SeqID_91623
MEASLCIPGKGFILDTEGQPGKLLRKDLTTMECLRHGVSSHLNTDRARLVYGLIARMKMNIGGLISAQMTMMAQSNSSRLGFPALITACVDQGELDLMLLAPTKT

SEQ ID NO: 208402 - protein, 91 aa, Glycine max
  Coding DNA Sequence Number=SeqID_91624
MKTLGGVDDIYYAALINKQKRQKKLAKAIANKDKALETFGLAIKVKRILREQKGKVQTKKPAHQQKEEEKIVIEEQRMKKKHEVPRPSLPV

SEQ ID NO: 208403 - protein, 75 aa, Glycine max
  Coding DNA Sequence Number=SeqID_91625
MGSEIYPEDHENPRAFFSSSSPILLDPSIQYPWGYSIIYKVPPLVLLTKATLSPTCEILEPTLATSTLTRDNSRF

SEQ ID NO: 208404 - protein, 136 aa, Glycine max
  Coding DNA Sequence Number=SeqID_91626
MEKSDKMNFKEKKEKKGYITWEDNVLNYSSDSEKKIISLGIMMKDYENGEEQSRYIDSNFSKHMACIKVYSYFSPRKVNMQFMETTNKGHLINNPNNWKWKLLEVGSWKLEMKVIGSWKLEVENGGWKLEGEVTKN

SEQ ID NO: 208405 - protein, 57 aa, Glycine max
  Coding DNA Sequence Number=SeqID_91627
MQGIKFKHRPNQLWNATPIALAERRVEVARKNARRQFPTTTNDTTVGGGEGLWNHLL

SEQ ID NO: 208406 - protein, 356 aa, Glycine max
  Coding DNA Sequence Number=SeqID_91628
  Gene Ontology: Mol. function=protein serine/threonine kinase activity; Cellular component=membrane; Biological process=protein amino acid phosphorylation
  Homolog annotation: Hit_ID=Q9LK35; Match level="QueryCoverage=96%, HitCoverage=44%, E-value=1e-123, Identity=61%"; Hit description =Receptor-protein kinase-like protein
  Subcellular localization annotation: CTP_CleavageSite=37; ConfidenceScore=5.09e-01
MVMMKLVKWVSFVLVVYWFLVNGSFATFTPRDNYLIACGSSQSITSQDRTFVPDSQHSSLKLKTGNSVVASSNSSVPSPIYQSARIFTEKASYRFQVEEVVTDDFVLLCNFSFRNYNGSYMFREYAINVTSDTFTVTFIPSNGSVAFVNAIEVVSMPNDLFVDQALALNPTAAFNGLSELAFETVYRLNIGGPLLTPQNDTLGRTWENDQKYLHVNSSVTKVSVNPSSIKYHAGVTPETAPNWVYATSEVMGDANVPDSNFNITWVFSVDPNFSYFIRVHFCDIISKSLNTLVFNLFINTDIALGSLDLSSITNDLAVPYYKDFVSNASADSNILTVSVGPDSMADITNATMNGLE

SEQ ID NO: 208407 - protein, 58 aa, Glycine max
  Coding DNA Sequence Number=SeqID_91629
  Homolog annotation: Hit_ID=Q1RUG8; Match level="QueryCoverage=81%, HitCoverage=42%, E-value=1e-07, Identity=52%"; Hit description=Zinc finger, GRF-type
MSRQIVFAIVVEELPFEQQRRQGIMRDCFMLVHYHNKMQIDVISFRGLMKTLMLVQLK

SEQ ID NO: 208408 - protein, 275 aa, Glycine max
  Coding DNA Sequence Number=SeqID_91630
  Pfam annotation: Domain name=TolA; Domain location=7-269; Score= -115.5; E_value=0.0019; Accession=PF06519.2; Description=TolA protein
MKSTLSPQDQAIRKRAAVLSVLMHVLLFLGMIFMIDWKAVHVNPSVMEATLWDSLPSKQPVKPVTKPVDPTPPPPAPEPKPEPKPPEPKPPQPEPKPDPQVKQAEQEAQIALKKQEDEKKRQLEEEKKKEEEKKKQEEKLKKIQEALRKQEEEEKLKKIQDAMRQQDMEAQQSAASAADPSVLAYYMGLMKRKIKSTMNPALCPASNPELLVDIQLTNSGDISGMPKLVKGSGDAVCDDAVIRAVLAAKPFDLPDDPATRKQMVDLIHLKYRPRS

SEQ ID NO: 208409 - protein, 324 aa, Glycine max
  Coding DNA Sequence Number=SeqID_91631
  Gene Ontology: Mol. function=metal ion transporter activity; Cellular component=integral to membrane; Biological process=response to nematode
  Homolog annotation: Hit_ID=O64738; Match level="QueryCoverage=92%, HitCoverage=92%, E-value=3e-93, Identity=58%"; Hit description=Zinc transporter 6, chloroplast precursor
  Pfam annotation: Domain name=Zip; Domain location=22-321; Score =288.7; E_value=1.1e-83; Accession=PF02535.12; Description=ZIP Zinc transporter
MASACVTNATRAAACRDGAAAAHLKMISIFVIFVTSVAGMSSPVALAGIFRGKPLYDKAIVVIKCFAAGVILSTSLVHVLPDAYAALADCHVASRHPWRDFPFAGLVTLVGALLALVVDLAASSHVEQHAHAQYAPVEKEAAVELGGSAGDGDGEKGEELAKLKQRLVSQVLEIGIIFHSVIIGVTMGMSQNVCTIRPLVAALAFHQIFEGMGLGGCVAQAGFSFGTITYMCFMFAVTTPIGIILGMALFSLTGYDDSSPNALIMEGLLGSISSGILIYMALVDLIAVDFFHNKLMNSNRLLKKASFVALTLGSAAMSILALWA

SEQ ID NO: 208410 - protein, 100 aa, Glycine max
  Coding DNA Sequence Number=SeqID_91632
MTNIEIIFRCAAAAPSLHAAARVAFVTHAEAMQGKTSTCWVPIWQFPRRFRHAGGGGGLSDRHADVEHDGLDGDGDGENKGGGISRKEDKGAILSFHIKM

SEQ ID NO: 208411 - protein, 498 aa, Glycine max
  Coding DNA Sequence Number=SeqID_91633
  Gene Ontology: Mol. function=protein-tyrosine kinase activity; Biological process=protein amino acid phosphorylation
  Homolog annotation: Hit_ID=Q0WN89; Match level="QueryCoverage=98%, HitCoverage=84%, E-value=1e-170, Identity=59%"; Hit description =Protein kinase like protein
  Pfam annotation: Domain name=Pkinase; Domain location=332-497; Score=- 87.0; E_value=0.0022; Accession=PF00069.15; Description=Protein kinase domain
  Pfam annotation: Domain name=Pkinase_Tyr; Domain location=332-497; Score=-110.3; E_value=1e-05; Accession=PF07714.7; Description =Protein tyrosine kinase
  Pfam module annotation: Pfam domain module=Pkinase::Pkinase_Tyr; Domain location=332-497::332-497
MAAALECWSSRTTAAAATSTDDDTVEQVLMRTHHRSEGTTTTSTPNNNNNKDPSSAIPVHKKLQKLTRNVSEAIASFRNSLNLDSPPSSKADASSRKLAWGSVVRNLTQLYPGSQLPEKLMSNIRKHYDSLPLSYAQAEFDMKDVFLHIKLMEQASESDQPAILIQEECDYEVQGSALRLTFACNSPISWPAMSGALDSSSICCKRMQIFEKKGFTLGVVLLVVQSGHDKLVRTRVESALKFAMKRPKTGAVKLPFGLCGCQEENSKGGDLVEIEEEISDGYRGKEFENSGQRIQLQVPLPSSSFVVSVDEWQTIKSGGDEIEKWLLNSDSVEFVEQIGPNSFKGVYLGKRVKIEKLKGCDKGNSYEFELHKDLLELMTCGHRNILQFCGICVDDNHGLCVVTKFMEGGSVHDLMMKNKKLQTKDIVRIAVDVAEGIKFMNDHGVAYRDLNTPRILLDRHGNACLGDMGIVTACKSVGEAMEYETDGYRWLAPEDYVP

SEQ ID NO: 208412 - protein, 1710 aa, Glycine max
  Coding DNA Sequence Number=SeqID_91634
  Gene Ontology: Mol. function=binding; Cellular component=clathrin vesicle coat; Biological process=intracellular protein transport
  Homolog annotation: Hit_ID=Q2RBN7; Match level="QueryCoverage=97%, HitCoverage=97%, E-value=0.0, Identity=83%"; Hit description =Clathrin heavy chain, putative, expressed
  Pfam annotation: Domain name=Clathrin; Domain location=1124-1265; Score=134.2; E_value=3.6e-37; Accession=PF00637.10; Description =Region in Clathrin and VPS
  Pfam annotation: Domain name=Clathrin; Domain location=1270-1416; Score=124.0; E_value=4.3e-34; Accession=PF00637.10; Description =Region in Clathrin and VPS
  Pfam annotation: Domain name=Clathrin; Domain location=1419-1602; Score=66.0; E_value=1.2e-16; Accession=PF00637.10; Description =Region in Clathrin and VPS
  Pfam annotation: Domain name=Clathrin; Domain location=545-681; Score= 52.7; E_value=1.2e-12; Accession=PF00637.10; Description=Region in Clathrin and VPS
  Pfam annotation: Domain name=Clathrin; Domain location=682-824; Score= 98.3; E_value=2.2e-26; Accession=PF00637.10; Description=Region in Clathrin and VPS
  Pfam annotation: Domain name=Clathrin; Domain location=829-968; Score= 127.9; E_value=2.8e-35; Accession=PF00637.10; Description=Region in Clathrin and VPS
  Pfam annotation: Domain name=Clathrin; Domain location=975-1120; Score=131.5; E_value=2.3e-36; Accession=PF00637.10; Description =Region in Clathrin and VPS
  Pfam annotation: Domain name=Clathrin-link; Domain location=338-361; Score=33.0; E_value=1e-06; Accession=PF09268.1; Description=Clathrin, heavy-chain linker
  Pfam annotation: Domain name=Clathrin_propel; Domain location=102 -133; Score=0.2; E_value=1.1e+02; Accession=PF01394.10; Description =Clathrin propeller repeat
  Pfam annotation: Domain name=Clathrin_propel; Domain location=148 -191; Score=21.9; E_value=0.0023; Accession=PF01394.10; Description =Clathrin propeller repeat
  Pfam annotation: Domain name=Clathrin_propel; Domain location=19-55; Score=22.6; E_value=0.0014; Accession=PF01394.10; Description =Clathrin propeller repeat
  Pfam annotation: Domain name=Clathrin_propel; Domain location=202 -242; Score=14.4; E_value=0.42; Accession=PF01394.10; Description =Clathrin propeller repeat
  Pfam annotation: Domain name=Clathrin_propel; Domain location=260 -295; Score=15.2; E_value=0.24; Accession=PF01394.10; Description =Clathrin propeller repeat
  Pfam annotation: Domain name=Clathrin_propel; Domain location=303 -337; Score=22.5; E_value=0.0015; Accession=PF01394.10; Description =Clathrin propeller repeat
  Pfam annotation: Domain name=Clathrin_propel; Domain location=59-99; Score=18.0; E_value=0.034; Accession=PF01394.10; Description =Clathrin propeller repeat
  Pfam module annotation: Pfam domain module=Clathrin::Clathrin::Clathri n::Clathrin::Clathrin::Clathrin::Clathrin::Clathrin-link::Clathrin _propel::Clathrin_propel::Clathrin_propel::Clathrin_propel::Clathrin _propel::...
  Pfam module annotation: Pfam domain module=Clathrin_propel::Clathrin _propel; Domain location=1124-1265::1270-1416::1419-1602::545 -681::682-824::829-968::975-1120::338-361::102-133::148-191::19 -55::202-242::260-295::303-337::59-99
MAANAPITMKETFTLGSVGINQQFITFTHVTMESDKYICVRETGPQNSVVIIDMSMPMQPLRRPITADSALMNPNSRILALKAQVPGTTQDHLQVFNIETKAKMNSHQMKEQWITPNTLGIVTQMSVYHWSVEGNGEPMKMFDRTANLANNQIISYRCDPNEKWLVLIGIAPGSAERPQLVKGNMQLFSVDQQRSQALEAHAASFASFRVAGNDKDSTLICFASKSMNAGQVTSKMHVIELGAQPGKPSFTKKQADLFFPPDFADDFPVSMQISNKYGLIYVITKLGLLFVYDLETSTAVYRNRISPDPIFLTTEAPSVGGFYAINRRGQVLLATINEAAIVPFVSGQLNNLELAVNLAKRGNLPGAEELVVKRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIFIKARATPKVVAAFAERREFDKILIYSKQVGYTPDYMFLLQTILRADAQGAVNFALMMSQMEGGCPVDYNTITDLFLQRNLIREATAFLLDVLKPNLPEHGYLQTKVLEINLVTFPNVADAILANGMFSHYDRPRIAQLCEKAGLFIRALQHYSELPDIKRVIVNTHAIEPQALVEFFGTLSKEWALECMKDLLLTAKEYCEQLGVDACIKLFEQFKSYEGLYFFLGAYLSSSEDPDIHFKYIEAAAKTGQIKEVERVTRESNFYDAEKTKNFLMETKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDADLWEKVLNPENEFRRQLIDQVVSTALPESQSPDQVSAAVKAFMTADLPHELIELLEKIVLQNSAFSGNFNLQNLLILTAIKADPSRVMDYINRLDNFDGPAVGEVAVEANLYEEAFAIFKKFNLNVQAVNVLLDNLRTIDRAVEFAFRVEEEAVWSQVAKAQLREGLVSDAIESFIRADDSTHFLEVIKASEDAEVYHDLVRYLLMVRQNTKEPKVDSELIYAYAKIDQLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYRPEKLMEHIKLFSTRLNIPKLIRACDEQQHWMELTYLYIQYDEFDNAATTVMNHSPEAWDHMQFKDIIVKVASVELYYKAVHFYLQEHPDIINDLLNVLALRVDHTRVVDIMRKAGHIRLVKPYLVAVQSNNVSAVNEALNEIYVEEEDYDRLHESIDLHDNFDQIGLAQKGKAAYNIPPPYLRIAKSLWAMGYEIEKHELLEMRRVAAYIYKKAGRWKQSIALSKKDNLYKDCMETCSQSGDRELSEDLLVYFIEQEKKECFASCLFVCYDIIRPDVALELAWMNNMIDFAFPYLLQFIREYTGKVDELIKDKIEAQKVEKAKEKEEKEVLAQQNMYAQLLPLALPAPPSMGGGGYAPPTPPIGGMGMPPMPPFGMPPMGGGSGSY

SEQ ID NO: 208413 - protein, 196 aa, Glycine max
  Coding DNA Sequence Number=SeqID_91635
MAFLKTRRWHTGCQTDPTVGAGTVHLQRKLHTDMSERGTFGNKAKQNLNRAKESEIVSTEEEEDGGSIAKQWITPEKVSHQMACASLDCNTTACTVVVRRGDSSEMEVWWQCKHAHNMHITFQAKGTLRQKGEISKRRSLEKVWRVERSSKIGRQAKRGPPECGNRSPEVGRLIERSTEDNRVPGGERLSLVLCKK

SEQ ID NO: 208414 - protein, 241 aa, Glycine max
  Coding DNA Sequence Number=SeqID_91636
  Homolog annotation: Hit_ID=Q9LUZ9; Match level="QueryCoverage=31%, HitCoverage=25%, E-value=2e-18, Identity=51%"; Hit description=RING -H2 finger protein ATL5O
  Pfam annotation: Domain name=zf-C3HC4; Domain location=121-162; Score= 20.9; E_value=0.0011; Accession=PF00097.15; Description=Zinc finger, C3HC4 type (RING finger)
MPTQTESPSNSLSQLAENMFSDNNRNIMLAAIIFLLLVILFVLLLHVYAKWFLFQVQSRSQTRRRRTPVTVSGVLEPSHFHSINIEASPTCSKGLDSATLSAIPLFVQGPEKTEETEELECVICLSVIEEGEIGRRLPKCGHAFHMECIDMWLSLHCNCPICRAPIVVSGDSHLGSVDGDSDGVVEIGVVTPGYEISGSEHGGVSGSVPEASSSLLGFSLKRLLSKVFLSPDHVTELDGSH

SEQ ID NO: 208415 - protein, 266 aa, Glycine max
  Coding DNA Sequence Number=SeqID_91637
  Gene Ontology: Mol. function=transporter activity; Cellular component= membrane; Biological process=transport
  Homolog annotation: Hit_ID=Q7X9B8; Match level="QueryCoverage=89%, HitCoverage=46%, E-value=1e-129, Identity=99%"; Hit description =Ferrous ion membrane transport protein DMT1
  Pfam annotation: Domain name=Nramp; Domain location=1-236; Score =262.0; E_value=1.2e-75; Accession=PF01566.9; Description=Natural resistance-associated macrophage protein
MAISFAWMFGEAKPSGKELLLGVLIPKLSSKTIQQAVGVVGCLIMPHNVFLHSALVQSRQVDRSKKGRVQEALNYYSIESTLALVVSFIINIFVTTVFAKGFYGSELANSIGLVNAGQYLEETYGGGLFPILYIWGIGLLAAGQSSTITGTYAGQFIMGGFLNLRLKKWMRALITRSCAIFPTMIVALIFDTSEESLDVLNEWLNVLQSVQIPFALIPLLCLVSKEQIMGTFRIGAVLKKNWRLYHFPFLCRGLWGGVCAAILDIP

SEQ ID NO: 208416 - protein, 568 aa, Glycine max
  Coding DNA Sequence Number=SeqID_91638
  Homolog annotation: Hit_ID=Q1SKV9; Match level="QueryCoverage=80%, HitCoverage=83%, E-value=1e-124, Identity=51%"; Hit description =Bromodomain
  Pfam annotation: Domain name=Bromodomain; Domain location=227-317; Score=68.9; E_value=1.6e-17; Accession=PF00439.15; Description =Bromodomain
MQWILNLVTSSFTLSVYRERARVDPNETKRLEVEKIAEVKKGRDPLQFHGGVVVVVVFKLNAGESHRGHLPEPERMKRKRGHKKGKAKGTTNHGSSSANANSKEEETSGLDDKDHSGMEVDTPSSTGTDQQHNYNVANINPDGSVDKAAIGRVKVKLKTPKLLDSQPTSSDAPTPTQSDTERMEDSANLLPDMKLSTLSKRAASIKIKSSSNHQTFSASTQHNNKQELDASLVVIRKVMKMDAAEPFNVPVNPEALGIPDYFDIIDTPMDFGTICNNLEKNEKYMNSEDVFKDVQYIWDNCYKYNNKGDYILDLMRRVKKNFMKYWAAAGLYSEQSKGTKEDIALSGDGKAGKGGQLKQKTKKRHGRHHKHDCLCAICVLKRRRKEREENARIARGNFGSSGDKHANEESIQVESPGGEDSSSNIDESIGTDGDVDEEKGEVAKMEISEKQCSPSERKHPSIDVDNDDDNDDHGLEEGEEEEEEGEEEEEEEEEENEEEEDEEEIEMNSQKREMNETLKHGGTLAEKSNVGDATALHDEYRTKQQEGQAVAVPQQKKPKVFPSLFDQY

SEQ ID NO: 208417 - protein, 351 aa, Glycine max
  Coding DNA Sequence Number=SeqID_91639
  Gene Ontology: Mol. function=pseudouridylate synthase activity; Biological process=tRNA processing
  Homolog annotation: Hit_ID=Q1SKV8; Match level="QueryCoverage=98%, HitCoverage=98%, E-value=1e-121, Identity=66%"; Hit description=TRNA pseudouridine synthase
  Pfam annotation: Domain name=PseudoU_synth_1; Domain location=187 -347; Score=22.3; E_value=7e-05; Accession=PF01416.10; Description =tRNA pseudouridine synthase
  Pfam annotation: Domain name=PseudoU_synth_1; Domain location=54-147; Score=18.4; E_value=0.00016; Accession=PF01416.10; Description=tRNA pseudouridine synthase
  Pfam annotation: Domain name=Spin-Ssty; Domain location=115-158; Score=8.9; E_value=0.034; Accession=PF02513.7; Description=SpinSsty Family
  Pfam module annotation: Pfam domain module=PseudoU_synth_1::PseudoU _synth_1::Spin-Ssty; Domain location=187-347::54-147::115-158
MTENLKHTVDLECSDNNINRPSKISIIEYPIDSDIDEEEEMIKNPRNGIQRYLVAIEYIGTRFSGSQKQLNVRTVVGVLEDAGVHALSNVCHVDIQRISKRRPGEVLTPHEPAVVGRAVNHFLQKQDSDLMVIDVRCVPSDFHARFKAQERIYFYRLLSGPEPLSTFEKDRAWHVPEELSLPAMQEACRVLVGFHDFSSFRAAGCQAKSPIRTLDELSVNEVIESPYFPSLMDREQHNKVSGDLRSCPNNSETDIPPTSNPSIDKVMASSQDVGFGKRRRHRCLVVTARARAFLYHQVRLLVGVLKAVGTGNLTIPDVERILNARTVTAASPMAPACGLYLGEVKYDLPTT

SEQ ID NO: 208418 - protein, 82 aa, Glycine max
  Coding DNA Sequence Number=SeqID_91640
MRHSRRQIILTLTINREFIEGKINYLGVYDVTVMVFFIYGSLGSLSSLLSPFGVGFSTKGAASVVVKVLQVDDGWFVVGGTP

SEQ ID NO: 208419 - protein, 134 aa, Glycine max
  Coding DNA Sequence Number=SeqID_91641
  Gene Ontology: Mol. function=oxidoreductase activity, acting on single donors with incorporation of molecular oxygen, incorporation of two atoms of oxygen
  Homolog annotation: Hit_ID=Q1RT74; Match level="QueryCoverage=67%, HitCoverage=55%, E-value=1e-29, Identity=64%"; Hit description =Glyoxalase/bleomycin resistance protein/dioxygenase
MWLFNYGIGIHLLESEKVPVEKREINPKENHISFQCSDMKVIMQKLDAMKIEYVRAVVEEGGIKVDQLFFHDPDGYMIEICNCQNLPVLPISSCPLKQLAAGEATTLNINCFADESVSMLMMDNLVMDMLKISI

SEQ ID NO: 208420 - protein, 423 aa, Glycine max
  Coding DNA Sequence Number=SeqID_91642
  Gene Ontology: Mol. function=ion channel activity; Cellular component= integral to membrane; Biological process=ion transport
  Homolog annotation: Hit_ID=Q5H8A5; Match level="QueryCoverage=98%, HitCoverage=27%, E-value=3e-81, Identity=78%"; Hit description =Putative ion channel POLLUX, chloroplast precursor
MGLCNNEALLAPGSELWMFNEVPEKEREKKLVDGGLDVSELENIKLVHREGNAVIRRHLEGLPLETFDSGENEDLFILLLTLSIGGFDDKLCGEDVSELGTITVSSAGSLLLVVIVEDVDLIIVVVASKEVAEDEFRDVDLIFLVDLHGNTVAIVEDGDGIGLGVDGDLEGIHGRVVLLVVGGVDEDLVEDLVEAEDVGDGAVHHLVVLVHPQRLRVLPDGADVGVEVEEDELQLCLSLILILADESVEDSVAHSDSRSLATLLLIRDIQSKRLPYKDTGFSHNSWIRDMQQASVKSIIISEILDSRTRNLVSVSRISDYVLSNELVSMALAMVAEDKQINRVLEELFAEEGNEMCTKAAELYLFDKEEVCFYDIMIRGRTRNEIVIGYRLANQDRAIINPSQKSLPRIWSIADVFVVIAKGD

SEQ ID NO: 208421 - protein, 679 aa, Glycine max
  Coding DNA Sequence Number=SeqID_91643
  Gene Ontology: Mol. function=ion channel activity; Cellular component= integral to membrane; Biological process=ion transport
  Homolog annotation: Hit_ID=Q5H8A5; Match level="QueryCoverage=89%, HitCoverage=70%, E-value=0.0, Identity=70%"; Hit description =Putative ion channel POLLUX, chloroplast precursor
  Pfam annotation: Domain name=DUF1012; Domain location=442-651; Score=- 9.2; E_value=0.0012; Accession=PF06241.3; Description=Protein of unknown function (DUF1012)
  Pfam annotation: Domain name=TrkA_N; Domain location=366-503; Score= -2.1; E_value=0.023; Accession=PF02254.8; Description=TrkA-N domain
  Pfam module annotation: Pfam domain module=DUF1012::TrkA_N; Domain location=442-651::366-503
MTEKIPLNSLRTHPSASEREPHKHKGNLSQLNSAQCRMRKSNEEFPNLSLRKPPLKRSKTIPNPKHTHFSVSVSDSDEQWNYPSFLGTTTKKKKTSFKPHNLNLPKPSLVPPPPPPPPPPPSTSSSPLSSQVTRPQHHQRSPILYLLFIASIVFVPHSAYLQYKLTKLEDEKLNLCCQIDFCPGNERTSLQKVDGSFSYILNADSRTVALYIVVVTLILPFMLYKYLDYLPQIVNFLRRTNNNKEDVPLKKRVAYMVDVFFSIYPYAKLLALLFATLFLIGFGGLALYAVTGGSLAEALWHSWTYVADSGNHAETEGTGQRIVSVSISSGGMLIFAMMLGLVSDAISEKVDSLRKGKSEVIEKNHILILGWSDKLGSLLKQLAIANKSIGGGVIVVLAEKEKEEMEMDIAKLEFDFMGTSVICRSGSPLILADLKKVSVSKARAIIVLASDENADQSDARALRVVLSLTGVREGLGGHVVVEMSDLDNEPLVKLVGGELIETVVAHDVIGRLMIQCALQPGLAQIWEDILGFENAEFYIKRWPELDGLFFKDVLISFPDAIPCGVKVAADGGMIIINPDDSYVLRDGDEVLVIAEDDDTYAPGPLPEVHKGLCSRIHDPPKYPDKILFCGWRRDIDDMIMLWWPCLGHKGPPGGFKPLQAGDFIFLSFRKIKQKQETRS

SEQ ID NO: 208422 - protein, 83 aa, Glycine max
  Coding DNA Sequence Number=SeqID_91644
MAMDNEDMNTDRSSIGNPVNAGFGGINRDQRGNWITGVDSTHPYAPVVQKIEALCHQAWSLSFIHTYREGNKCAGIGTPRGKT

SEQ ID NO: 208423 - protein, 478 aa, Glycine max
  Coding DNA Sequence Number=SeqID_91645
  Homolog annotation: Hit_ID=Q5QM96; Match level="QueryCoverage=39%, HitCoverage=30%, E-value=6e-72, Identity=65%"; Hit description =Rubisco subunit binding-protein beta subunit-like
  Pfam annotation: Domain name=YTH; Domain location=307-397; Score =165.6; E_value=1.2e-46; Accession=PF04146.6; Description=YT521-B -like family
MKVVRVYRGRRIILRIFNVKKTSLCVRKNLRVSIKDCISPDLTSFATSSGDVAAGFTGVHESEALSCYSSVSTSVGVQSKTVKGSVIAKNNPKSSGLMKPNKLKSTHRNGILTSTISETVADTGKDIKILNKAPHLRSNFPAATAPNTYHQIGKFSSLANPTCHVSPPTNHRPNTSTNYRPTGRVSNVNDRVLLGDNKFRSGQSEMSMEMTRGPRGHYNNFLLQPSLVKDALAITICRDEYNLSDFQTEYEIAKFYVIKSFNEDDVHKSVKYNVWTSTPNGNKKLNAAFLDAEAKLRQTGTKCPVFLFFSVNASRQFVGVAEMLGPVDFKNDMNFWKLDKYNGFFPIKWHIIKDVPNNQFVHIILPSNENKPVTYTRDTQEIGLKEGLEMLNIFRSYTAKTSLLDDFDFYERREKLFRSQRSTKHKHARPEQEVYGNDNYQNTVKAREKKMEMQSSGTKQGTLIKHTKNLSLNNSGFR

SEQ ID NO: 208424 - protein, 387 aa, Glycine max
  Coding DNA Sequence Number=SeqID_91646
  Gene Ontology: Mol. function=ribonucleoprotein binding; Cellular component=nucleolus; Biological process=rRNA processing
  Homolog annotation: Hit_ID=Q2PEP5; Match level="QueryCoverage=98%, HitCoverage=50%, E-value=0.0, Identity=83%"; Hit description =Putative WD-40 repeat protein
  Pfam annotation: Domain name=BOP1NT; Domain location=1-218; Score =351.2; E_value=1.7e-102; Accession=PF08145.2; Description=BOP1NT (NUC169) domain
  Pfam annotation: Domain name=WD40; Domain location=219-271; Score =18.1; E_value=0.032; Accession=PF00400.22; Description=WD domain, G -beta repeat
  Pfam annotation: Domain name=WD40; Domain location=275-313; Score =1.3; E_value=26; Accession=PF00400.22; Description=WD domain, G-beta repeat
  Pfam module annotation: Pfam domain module=BOP1NT::WD40::WD40; Domain location=1-218::219-271::275-313
RKIYDEYNDEVVELTKDEIKLVRRLLKNRAPHSDFDPYPDSVDWFKWEDAKHPLSNAPEPKRRFIPSKWEAKKVVQYVRAIRQGLITFDKPKEEDGPYHLWGDDSGSTERANHLAYIPAPKQKLPGHDESYNPPLEYIPTQEEINSYQLMFEEDRPKFIPKRFASMRSIPAYENAMKDCFERCLDLYLCPRVRKKRLNIDPESLKPKLPSRKELKPYPTTCYIEYKGHEDAVTSISLEASGQWMASGGMEMGPLFSVICKGSRDGTVRIWEVETGRCLRRWEVGESVSCVAWNPLPDIHLLAVSVGQDVLLLNTCLGDEEEQKRIKELLWVDSSTASDDSGNKAPSVSWLKDDKHMGLRLRHFKTVTAVEWHRKGDYFSTVMPADIL

SEQ ID NO: 208425 - protein, 108 aa, Glycine max
  Coding DNA Sequence Number=SeqID_91647
  Homolog annotation: Hit_ID=Q5N7I7; Match level="QueryCoverage=85%, HitCoverage=25%, E-value=2e-21, Identity=60%"; Hit description =Putative NTS2 protein
  Pfam annotation: Domain name=DUF803; Domain location=14-108; Score= -46.3; E_value=7.9e-08; Accession=PF05653.4; Description=Protein of unknown function (DUF803)
MATSSSSSSWREGMSSDNIKGLCLALSSSFFIGASFIVKKKGLKKAGASGIRAGSGGYSYLYEPLWWVGMITMIVGEIANFAAYAFAPAILVTPLGALSIIIRHDKKI

SEQ ID NO: 208426 - protein, 166 aa, Glycine max
  Coding DNA Sequence Number=SeqID_91648
MGQPWKFHLRKRRRSLRFWGWKEQQRRLLRPEASENEETNKGCGQERFHVNSVVPTKPYLVTQVTWLEDRPSPSTVNGDGTAYMASADESIKVSRREGEAKGHKFDGCGGAGLDGGDGIGMALTCTGWTANGRFYLSDHLGSPLLGAKILEEIGSDASLVKYAEFC

SEQ ID NO: 208427 - protein, 118 aa, Glycine max
  Coding DNA Sequence Number=SeqID_91649
  Subcellular localization annotation: CTP_CleavageSite=45; ConfidenceScore=5.12e-01
MNSTKRGERTQKRRAAANATLHYSPTLVIARQRTRRPHVARAPIAAAVVRVTRTHLRVVKLTQPELVLLVVIGGGVLHWRRRVCVRRREEGNGRGSWGWRVRELQKVRVTVRRRELVC

SEQ ID NO: 208428 - protein, 225 aa, Glycine max
  Coding DNA Sequence Number=SeqID_91650
  Homolog annotation: Hit_ID=Q2PEP5; Match level="QueryCoverage=44%, HitCoverage=11%, E-value=2e-14, Identity=63%"; Hit description =Putative WD-40 repeat protein
MKAKKHAHAEEEGVAPLPSPTLSDSDSDYEDSSADDHHESSVSLDSQSQSELEDASPENGSSGVVESAENESSQYELEVLSCCSIRLAITNMLRSNPFRTLLMKKTVEVRALISIWKELRVTPPRMRLSLLSSSSNIYDLALVAPRNTVGDVPLKWYEDEPHIGYDIKGKKIKKKEKQDKLDSFLASVDDSKNWLVSYVCITYFLHFNFHYCILLFGYSHLACFL

SEQ ID NO: 208429 - protein, 125 aa, Glycine max
  Coding DNA Sequence Number=SeqID_91651
MGRSKFTVEKGSSQNNSPTVQNAHHVKGPSGLGGVMIGIGQQVYSILLLSVFFLEVYATGFIPYIGKLLNFLLLSWMYAYYCFEYVVHNFMYKWNFNEVALDRRLDYFESYWPFFAGFGCEWGVG

SEQ ID NO: 208430 - protein, 71 aa, Glycine max
  Coding DNA Sequence Number=SeqID_91652
MTEKKAQEIPKDRSEPPCLGTHHPPCYHHFSGVNMYMHMRQGRRPHLLVICHPSKYRDGLHTWSTVSTSNN

SEQ ID NO: 208431 - protein, 100 aa, Glycine max
  Coding DNA Sequence Number=SeqID_91653
MLLSHQVFHAAADACLLLKQASLKAYFIHKPTSYYGSSTLYLIRMLNPVTYPKANLLNPYVDQLKHITNQKTSSKKNHGEKSLTSTSAMEHILNAVKAKL

SEQ ID NO: 208432 - protein, 133 aa, Glycine max
  Coding DNA Sequence Number=SeqID_91654
  Gene Ontology: Mol. function=dihydrolipoyllysine-residue acetyltransferase activity; Cellular component=pyruvate dehydrogenase complex; Biological process=metabolic process
  Homolog annotation: Hit_ID=Q1SLQ8; Match level="QueryCoverage=73%, HitCoverage=14%, E-value=5e-10, Identity=47%"; Hit description =Dihydrolipoamide succinyltransferase
MLPSCCTTSALFWFVGFPAMLIHPSTGTAVHCQWVGDIRWVGWMCGKLNSTSLQQEAVSLNQPPALINIHLACRRETSSWLPLKGVPLSGLSSMERFHDRIGNVLSRELQMYSYLGKSVTLVSNYSPVSLTLD

SEQ ID NO: 208433 - protein, 217 aa, Glycine max
  Coding DNA Sequence Number=SeqID_91655
  Gene Ontology: Mol. function=dihydrolipoyllysine-residue acetyltransferase activity; Cellular component=pyruvate dehydrogenase complex; Biological process=metabolic process
  Homolog annotation: Hit_ID=Q1SLQ8; Match level="QueryCoverage=99%, HitCoverage=35%, E-value=4e-96, Identity=83%"; Hit description =Dihydrolipoamide succinyltransferase
  Pfam annotation: Domain name=2-oxoacid_dh; Domain location=3-217; Score=257.7; E_value=2.4e-74; Accession=PF00198.13; Description=2 -oxoacid dehydrogenases acyltransferase (catalytic domain)
LRTQLNSLQEASGGSRISVNDLVIKNFMNLSLKRFKEHYSNMCPHCERKSQAAALALRKVPQCNSSWANDYIRQYHNVNINVAVQTDNGLFVPVVRDADKKGLSKIGEEVKQLAKKAKENSLKPQEYEGGTFTVTNLGGPFGVKQFCAIINPPQAGILAVGSAERRVVPGSGAEEFKFASFMSVTLSCDHRVIDGAIGAEWLKAFKGYIENPETMLL

SEQ ID NO: 208434 - protein, 111 aa, Glycine max
  Coding DNA Sequence Number=SeqID_91656
  Gene Ontology: Mol. function=transition metal ion binding
MYPVERYMKILKRYTKNLHHSGASIVERYIAEEAFEVCSRYIEKTKPVGLSESQHDERVAALVKEGNQKMTKNRLLKKHNKTFLNWFKDTIFGYDNAFEMLRKLADEPKRN

SEQ ID NO: 208435 - protein, 175 aa, Glycine max
  Coding DNA Sequence Number=SeqID_91657
  Gene Ontology: Mol. function=RNA-directed DNA polymerase activity; Biological process=RNA-dependent DNA replication
MGYDMPTKGSDDAELNLMEGGMWRQISLLGGQVERRWRKPLFDNEVDMAVSFLNEVEGHRIQPHIPDQWVWVADPQGQHSARGAYNLLTKAVTHKIQDGVFKELWKLKVPFKIVFFAWRLIKDRLPTRVNLRRRQIELHDVFCPFCGSSEESASSYMTSSFNAAKYFHCGGNHPP

SEQ ID NO: 208436 - protein, 438 aa, Glycine max
  Coding DNA Sequence Number=SeqID_91658
MEATQGSWSEFVHFSWHYLTQSEVCIKDEKEREVKNSCDSLNLVLVLFPIVCGFFSRSNTNTTSETQTPRSRRTFSNPSTPPSAWFQNDYSQIHNRSFNRLRSFDERFRFYDNTYLLRHRHRHMRTEPEEEEKEIGIDNVPTAPPQQGTEAEHEREDLDAKISPPPPATRTKGVRRNFKRTHQAETIEKHEANDLPVMDSQPPPVTRTKGVRRNAKRTYQPETMEKRETNDFEAQNSQPPASPPCPPLPTTRTRGVRRNAKPEGNDSVVKSSPPPPPPKVFQNLFSLKKGKHKNRHIVCVATITRASVSNKREHGSSSNVMMAGNESPLNPIPPPPPLPPFKLPGWKFRGRQIGSSRSGSPDDLDEVSVDTPTTSTHDETRSQVNSPFAKNGEDSASVSALSLFCPSPDVDTKAHHFIESFRAGLRMAKMNFRAGDWE

SEQ ID NO: 208437 - protein, 1087 aa, Glycine max
  Coding DNA Sequence Number=SeqID_91659
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=93%, HitCoverage=37%, E-value=0.0, Identity=41%"; Hit description =Aldo/keto reductase; Sigma-54 factor, interaction region
  Pfam annotation: Domain name=AAA_2; Domain location=595-735; Score= -30.2; E_value=0.0018; Accession=PF07724.4; Description=ATPase family associated with various
  Pfam annotation: Domain name=AAA_3; Domain location=596-734; Score =13.5; E_value=1.1e-05; Accession=PF07726.2; Description=ATPase family associated with various
  Pfam annotation: Domain name=AAA_5; Domain location=596-740; Score =108.2; E_value=2.4e-29; Accession=PF07728.4; Description=ATPase family associated with various
  Pfam annotation: Domain name=AAA_5; Domain location=896-1042; Score =9.0; E_value=0.00037; Accession=PF07728.4; Description=ATPase family associated with various
  Pfam module annotation: Pfam domain module=AAA_2::AAA_3::AAA_5::AAA _5; Domain location=595-735::596-734::596-740::896-1042
MWGQSVSCHSESQNSHSVLWRRVMIPPLNNKDLQEIIKVRHPDLELHVGKLIETFERVNSISMVQIAGFHLGSSASVYCPCRFSLRDLLKWCKRIAGLGFCFDGSLSENQCFCVYKEAVDVFASFSSSIKNRLSVMKEIAGLWKVPVSAAETLYPCDKPIIQLQQHKRPFVEIRSSMHVLERIACSVKYNEPVLLVGETGTGKTTIVQNLALRLDQKLTVLNLSQQSDVADLLGGFKPMDAQSVYVSLYGEFLSLFTKTFPKENNDGFITRMQNYLEDHRQKFLIDKNGEALLKRLQIAVGKSVKLIQPGSSKKRKRPLEEKLIQEWERFCIKLHSVCQSNRSSAMMFSFVEGSFVTALRNGDWVLLDEVNLAPPETLQRIIGVLEGEHGVLCLAERGDMDYIHRHPKFRIFACMNPATDAGKRDLPFSLRSRFTEYFVDDVLDDDDLSLFISQFISSAYMDQQLVNKIVCFYKEAKKESEERLQDGTNQKPQYSLRSLYRALEYTRKAERKFKIQKALYDGFSMFFVSLLDGSSAEIMRQKISSLLLEGKMPPHVHFSHYLDTSKSNGYSGNYVQTKSVQEHLGNLARAVLMRYPVLLQGPTSSGKTSLVRYLAAITGHDFVRINNHEYTDLQEYLGSYITDTSGKLVFNEGVLVKAVRNGYWIVLDELNLAPSDVLEALNRLLDDNRELYVPELQERIKADPNFMLFATQNPPTLYGGRKMLSRAFRNRFVEIHVGEIPDGELSTILSERCQIYIGHAEKMVEVMKDLRLHRQSSRVFAGKHGFMTPRDLFRWADRFQRFGNSYEDLAKDGYYLLAERLRNEDEKSVVQKVLKKHLGVTLNKKNLHDQISFRGHSSCNFNVGLGGSESLESVLLTKSMQRLYFLVERCYNLREPVLLVGETGGGKTTSVSSDINHASSTLDLLNGMIRNCKEGQVFSPDVSGEDLNVLEQIKLDLNGLHQKWQSIFVWQDGPLIKAMRDGDLFLVDEISLADDSVLERLNSVLEPERMLCPKSPCYEGMGRVFVCSLTLTFFGFEPMTNRSPRHNFTAVPGLASYFSCLKEVLEGIRRRAFLQLVDICTEKLEIS

SEQ ID NO: 208438 - protein, 345 aa, Glycine max
  Coding DNA Sequence Number=SeqID_91660
FNGVSDVRRLERQLDNLIIGGLKLYVNVPKKDSTSPEATATQGTLNVIREGPSHKYNDLRAEWYSDAWVGRLKNLATFDIAKDNISWEAEELAKEETQHGSMSIHTLEKWNPKMKTGHKLVWVLCWGIPLVAWDMAQIRKIVVAIGDIVEVDDDVEELRRLDRARVLIRTPWRPTLQHTVNLHIIGELYKVHIMEETGLDNGKCSYQARSNLRLSDEIDSDVSDTESPLSKAIGALDSDYAPRRNDGNSTDGGTTKGNKGNLLLPNGTTIDDEPGDNNPGGRKWDGSSGTTHIRIAPCCTNKEILRDQREPRNGSRGEQVMVGTTHETTIVDLVQSQEIQDDIGP

SEQ ID NO: 208439 - protein, 430 aa, Glycine max
  Coding DNA Sequence Number=SeqID_91661
  Gene Ontology: Mol. function=DNA binding; Cellular component=oxygen evolving complex; Biological process=DNA integration
  Homolog annotation: Hit_ID=Q0KIN0; Match level="QueryCoverage=79%, HitCoverage=22%, E-value=6e-39, Identity=53%"; Hit description =Integrase core domain containing protein
MSVVVTFFEETHFFSSSKQDINSIQKVLLIPSFNPVVFPIRENSNQEQNHSRPPTNRAVNFPYDGSFIIPSSSSPPHDDDSGCPITLKKGIWSTQNPHPIYLSYHRLSSSHFSCISTLSFLTIPKNVHEALDHPGWRQAMIVEMQALEHSDTWELVPLLPGKKVVGCRWVYAIKVGPNGEVDRLKAQLVAKGYTQIYGLDYGDTFSPVAKITTILLFFAMAAIVIGPKYALCILEEIGMTNSRPIDSPMDPNQKLMANQDQFTVVAHQSTAVAVDVRRASCGGRVRRPLVVERRLLLSCASPAPAPPFVALETAAGRAAEEEKLGHGYGGRHSAAISNPQHHRYLVAFFQISATPFHHGRFLITLTRPNISFAISVASQFMQAPHVDHWKAMIRILRYIKKAPRQGLLYENKGNTQIFGFCEADWARDAP

SEQ ID NO: 208440 - protein, 96 aa, Glycine max
  Coding DNA Sequence Number=SeqID_91662
  Gene Ontology: Cellular component=integral to membrane; Biological process=defense response to Gram-negative bacterium
  Homolog annotation: Hit_ID=Q9LTR7; Match level="QueryCoverage=71%, HitCoverage=47%, E-value=1e-20, Identity=60%"; Hit description =Arabidopsis thaliana genomic DNA, chromosome 5, P1 clone:MHM17
MDTADQRKGEYPPTRDTENPLLGKFDKPLPCFGCGIGWFSLLLGFVCPLMWYYATILYFGNYYHKDPRERAGLAASAIAALLFTIAAVITVAVIFL

SEQ ID NO: 208441 - protein, 1489 aa, Glycine max
  Coding DNA Sequence Number=SeqID_91663
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=98%, HitCoverage=55%, E-value=0.0, Identity=49%"; Hit description =Aldo/keto reductase; Sigma-54 factor, interaction region
  Pfam annotation: Domain name=AAA_5; Domain location=1-109; Score= -12.3; E_value=0.015; Accession=PF07728.4; Description=ATPase family associated with various
MVVVAVTRKVIGKEERVAGRWAASRKALKEGCWVLLDEINLAPQSVLEGLNAILDHRAEVFIPELGNTYKCPPSFRVFACQNPSHQGGGRKGLPKSFLNRFTKVYVDELVEEDYLSICESKFSTIPRTLLTKLLLFNKRMHEDTTVNQKFAKDGFPWEFNLRDVFRSCEIIEGAPKYSGLYSFLNIVYIQRMRLAADRKEVLRVFKEVFEVTPFINPYPRIQLNSHHLIVGNVTIKRNHVQLTTSSSKQLLMLPEIRQSLESAARCVERQWLCILTGPSCSGKTSLIRLLANLTGNVLNEVNLSSATDISELLGSFEQYDALRNFSKVVAQFECYVNEYISLQLETSNEAIFRETDFYIRWMAFLSGLKFDCLSSSAANCFENLCFLIGQLKLQIQKNSVPVSYSFHELDLAMKTVLKMKADVVSTKFEWVTGLLIKAIEQGEWIVLENANLCNPTVLDRINSLVEPCGSITVNERGIVDGNPLVIHPHPNFRIFLTVNPHYGEVSRAMRNRGVEIFMLQPYWLDDRSGYNDEDVEFKDVRRFLVLSGIPIAQLVDSMARAHTYAKNKGSELNEHITYLELSHWVHLFLQLLKNGCCPIWSLKISWEHIYLSSLGVEGEKIIDFAKTKYLSATNLAGYDDLTACPLALPGGWPLPLSVRDYVYYSKEASIKQNCMYLEFLGTQIASHQYRIARKRHSTACVQTPSDHVRAYLMDMMTLRELMFPKASNVMISDYGRECKYDSELTNRMLFFAANWTIEQATESDFKFYLLRFKWFSSQMQPFCQFFSNFVILIEQMIKHPIWEYISCRDKLDADLKLMPLLSLDLVDLAPSNSKIKYLCNAISCFDPLRLTYQQRNIESQHNFDEEVSIESQHSFGEKTSCFIRLLKSLYFLQDEILNKFVISTPKLIEDQSFDYKLQLYSNLIEDHALFWHYFISSEFDHMMISWHCLVKDARKFIDMCPEAVDNFLMESQKIEEFSFSVNSEKSLLWIHGGHPFLPSSSDLLDQQHQLLKFVETIWPRKTGSCYQENFECTILGQDIPCLSGILSSHLTDVVASFDHDLRFLVTQDVSNSSFLMAKWNHEDGIHIVEKLKEMHQILSRRFEHEKHKLQLNTGSKDLSAFAENSAACCSFTPVMLCEKSVFEAWQDTFLPVDYTSLFWDMKLLQKLTSIHLDDLEELHQAVGCVSNLLDFALKFSLSFSSRPPQMFLPHQKILWTLNAWASVDSVNLKIASFILEMWFKWHESIWVYFPKSVKIDGSDEIELPHMLVEPFSALAVFQMTQSTHAIKEFWVQCLKSRVTSFNLWHCSHHGTHLPDFLLSAARCLFQQIIYAHRKSFEADQFARIKYIFFSEKNVLTEESIDLLSSLVASSRHHRLKNSVQKFIVPLLRELYLQSNTADFNYTIGCAWAHVGALRINLLLSCKDIDPAMKYYCKYSQLVETISSLELEIQVRKECGYLAGQVLTQEADKRKAQRLEKLQAECRKLQRKQR

SEQ ID NO: 208442 - protein, 52 aa, Glycine max
  Coding DNA Sequence Number=SeqID_91664
IVFRAEPSKYKKLIDVCMDFLKQHDALEVLVKSRGTAKELQEFVDDACSWQV

SEQ ID NO: 208443 - protein, 264 aa, Glycine max
  Coding DNA Sequence Number=SeqID_91665
  Homolog annotation: Hit_ID=Q1RZJ4; Match level="QueryCoverage=99%, HitCoverage=5%, E-value=9e-81, Identity=60%"; Hit description =Aldo/keto reductase; Sigma-54 factor, interaction region
MDEYAAYSDIIQPIQVAVYEMKFGLSLVLSSTWEKKCLNELGQEDINVIMEMIYTLMRFPRAASCMFISVKHDIGLDMRPSYRLDSATGFYLVDVDLMVRLVTLSSGVAADQKVSGVHYRASVYWNILVQIAHCTANAKIIDDKSYMLMHKIFNVFAKLWLNKKDDVKSESDFNSQQYKFKPRAFEIESVIEVELPPLANSVAPETFLEWKEKSSDKIVPSQDEKPKQLEESIPFLSHVVLIHNRLFGSSDLVQTGLNELNHPD

SEQ ID NO: 208444 - protein, 251 aa, Glycine max
  Coding DNA Sequence Number=SeqID_91666
  Homolog annotation: Hit_ID=Q1RZJ4; Match level="QueryCoverage=99%, HitCoverage=5%, E-value=5e-90, Identity=66%"; Hit description =Aldo/keto reductase; Sigma-54 factor, interaction region
MAQMLKVLAPLQQQILSVLNEWEDHNDLQNFLDIIDMLLTLPSDTPLAKAFSGLQFLLHKAEVMQENGSKFSFSNQFKSVYDLLSSWQKIELDSWPALLDEVMDQYENNAGELLYNGHSTICYTASVFRVQHSIYDGGLEEFIQTSSIGEFRKRLQILFAFLGQNHISACLKINSSSSQSEQSTFLYNIFGFYAQFLPIVLKCIDASRKEVEIELSKLVKLCRWVHGKSYLSIESLKKGRQKLKKLIQKYT

SEQ ID NO: 208445 - protein, 1311 aa, Glycine max
  Coding DNA Sequence Number=SeqID_91667
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=99%, HitCoverage=26%, E-value=0.0, Identity=67%"; Hit description =Aldo/keto reductase; Sigma-54 factor, interaction region
MQDQHKSWWFLQLSGNIPYLLLTNSRLSCVTSGIPEVENKNSPEESFLMEWKTAIDYYFKSVVSVLLLQQTCLNPHKDITLEQVDSSSSFLNQLVQIQQKQLTAATAFDKQLKCFRECVSTLGKLFSLSSSTDNNINHMCSIIPKQFASYKCLWQQKQLFDTLCSTSQEELLLLRILENSHLNTCHRARPLARQMIASIEEFLPLFCKSKESLDCYLIGRTKAVTAVTYSSHLCIVTQEIEQLVSENFKTIRDFKDRFLELQEHDLDRSTARKVLIQHFQEIADKAKLVEEEFTMAIKGNSNQVDLSEDIFCERNSVELNARFNEALMSTCQHLATVLQNLCLPSNIPMVDESMVKIVSWESLFESFVTNLSLDILCQNLFKAISFGEKLVNCCDDNNNSYLHVEAHFRNLHLLMDQLLNFGDELMKNFLAMHKSVSVTTHVIANILASLFSKGFGISPENQEEDGTLNTSGDASGTGMGEGVGLKDVSDQITDEDQLLGAREQQNEKQDDSNEVPSSNNTGIEMEQDFEADAMSLSEDSGEDDDIDGENEELESEMGPAGPDSEAVGEKVCDENEDETPNDTREKYESGPSVKDRDGGNRELRAKDDSTTNEPGDGNCDEGDAQDDETVTPDEIGDGENADEVTMDKDTAYSDPTGLKPDVLDQTSDTVMDLDVNEDADLMEDGEPDEQVDLAENRNEGNRDEETCSPDEVMEEANTEVDVNSGKDDQENADLNSTEPKKDVSRLSELNNEQVSPAELASQSKVDWQTSGSENVAAESNVSNSHHDFDSTLLGGLPSSSMSDMDVEMPNSSNSGGFGENQPKSHHPWTDHSFIQEKHTNPRRSIGDALEYKKERVNVSGDVPEDNNEMQGEMEDENADEYGYVSEFEKGTTQALGPATLEQVDRNIDCDKLDKECLAGEDAKLQFEKEKSEMNSVNNSSLIPQNEKREKVNTSTMEKSREDGSVYPIASMNIDLENRLEDLVSFGNSYLSENNDNISQPFQHDKDLGKCQEPFDVPDHVKDNATALWRRFELSTTKLSHELTEQLRLVMEPTVASKLQGDYRTGKRINMKKVIPYIASDYSKDRIWLRRTRPNKRDYQVVIAVDDSHSMSENGCGDVAIEALVTVCRAVSQLEMGSLAVASFGTKGNIKLLHDFDRPFTGESGVKMISNLTFKQENTIADEPVVDLLKYLTNKLDTAVAKARLPSGHNPLQQLVLIIADGRFVEKKKLKQCVRDVSTGNRMVAFLLLDNSQESIMDLKEASVEGGQTKIFKYMDSFPFPYYIVLRNIEALPRTLANLLRQWMELMQHSTG

SEQ ID NO: 208446 - protein, 119 aa, Glycine max
  Coding DNA Sequence Number=SeqID_91668
  Homolog annotation: Hit_ID=Q1S3N5; Match level="QueryCoverage=46%, HitCoverage=23%, E-value=2e-23, Identity=81%"; Hit description=Zinc finger, B-box
  Pfam annotation: Domain name=PLATZ; Domain location=81-119; Score= -40.8; E_value=0.024; Accession=PF04640.4; Description=PLATZ transcription factor
MTHGEFLEENASSRFGFGARFGLVWTLKNKKDNKHLALTATTKVGGFNGEGVVREKEEEEENNKWPSWLQPLLKTRFFVQCKVHADSHKSECNMYCLDCVNGALCSACLSSHKEHRIIQ

SEQ ID NO: 208447 - protein, 50 aa, Glycine max
  Coding DNA Sequence Number=SeqID_91669
  Subcellular localization annotation: CTP_CleavageSite=29; ConfidenceScore=5.05e-01
MGSPASHSIGSLTSPGSRKLFWSAGLTKRAVHSISSLGIMGDFARRTLVK

SEQ ID NO: 208448 - protein, 138 aa, Glycine max
  Coding DNA Sequence Number=SeqID_91670
MKTLWKMKYLEESKTVKEEGKGLDVEGKEASDQGNGDPKSNIHSIQRGDEIFDNWFHQTLNTSHTHQHTSKHACAHLSLSLSQRALRGRARARLTGALPKGGKMHGVATNEGISTSHVDKSRAFAPTYPPLERKSDLR

SEQ ID NO: 208449 - protein, 103 aa, Glycine max
  Coding DNA Sequence Number=SeqID_91671
MSILTLGSKKEEKENFQSKRKQRKRKKKERRKISNQRKKERKGNSQSKSGKRKKERKGNSQSKSGRKQKEKKENSQPKRNNSQSQVVTYLWFGIRMKHLPVRG

SEQ ID NO: 208450 - protein, 265 aa, Glycine max
  Coding DNA Sequence Number=SeqID_91672
  Gene Ontology: Mol. function=binding; Cellular component=anaphase -promoting complex; Biological process=regulation of mitotic metaphase/anaphase transition
  Homolog annotation: Hit_ID=Q9STS3; Match level="QueryCoverage=98%, HitCoverage=49%, E-value=6e-92, Identity=60%"; Hit description=Cell division cycle protein 23 homolog
  Pfam annotation: Domain name=APC8; Domain location=1-135; Score=99.7; E_value=8.5e-27; Accession=PF04049.4; Description=Anaphase promoting complex subunit 8  Cdc23
MGSKDSCRTELRIAIRQLSDRCLYSASKWAAEQLVGIEEDPAKFTPSNTRFQRGSSRICRKSRTHETAAVITPVVGVLYDATPVNVMEKDELVDGDFYLWQSPISVAAGEKQKEEETIELGGPLGKSDAINHELVSLERELSTIRKNGKVDPFCLYLYGLVLKQKGNENLACTVLVESVNYYPWNWNAWTKLQSLCKKVDILNSLNLNSHWMKDFFLASVYQELRMHNDSLSKYEYLLGTFGYSNYLQAQIAKVQYSLREFAAAD

SEQ ID NO: 208451 - protein, 73 aa, Glycine max
  Coding DNA Sequence Number=SeqID_91673
MQIGLVIARGGCRPREPLVLHKKNVTLWSIECVEHVYIPFAPTALVDVTEKWMLCFSTIGGGRLLVNITIIMS

SEQ ID NO: 208452 - protein, 367 aa, Glycine max
  Coding DNA Sequence Number=SeqID_91674
  Gene Ontology: Mol. function=specific transcriptional repressor activity; Cellular component=mitochondrion; Biological process =regulation of transcription, DNA-dependent
  Homolog annotation: Hit_ID=Q45Q23; Match level="QueryCoverage=76%, HitCoverage=96%, E-value=1e-139, Identity=89%"; Hit description=PHB2
  Pfam annotation: Domain name=Band_7; Domain location=36-228; Score =102.3; E_value=1.4e-27; Accession=PF01145.15; Description=SPFH domain  Band 7 family
MNFNNVNAPKVPGGGVAALLKVGIIGGLVVYGAANSLYNVEGGHRAIVFNRVVGVKDKVYPEGTHIMIPWFERPVIYDVRARPHLVESTSGSRDLQMVKIGLRVLTRPVPDQLPTVYRTLGENYNERVLPSIIHETLKAVVAQYNASQLITQRENVSREIRKILTQRASQFNIALDDVSITSLTFGKEFTAAIEAKQVAAQEAERAKFVVEKAEQDKRSAVIRAQGEAKSAQLIGEAIANNPAFITLRKIEAAREIAHTISNSANKVYLNSDDLLLNLQEKVNGSWEAKRRRGVMILEEMFFCSSSSSSQQLQPFENPSSNLLLLSGPPSSYVNDDEDIRKYFAAFHLYDTLPAAVLIDDFGDFFDN

SEQ ID NO: 208453 - protein, 908 aa, Glycine max
  Coding DNA Sequence Number=SeqID_91675
  Gene Ontology: Mol. function=protein transporter activity; Cellular component=soluble fraction; Biological process=ER to Golgi vesicle -mediated transport
  Homolog annotation: Hit_ID=Q1SYF4; Match level="QueryCoverage=87%, HitCoverage=88%, E-value=1e-101, Identity=31%"; Hit description =Frigida-like
  Pfam annotation: Domain name=Frigida; Domain location=542-821; Score =110.4; E_value=5.3e-30; Accession=PF07899.2; Description=Frigida -like protein
  Pfam annotation: Domain name=Pox_A_type_inc; Domain location=130-152; Score=9.9; E_value=3; Accession=PF04508.3; Description=Viral A-type inclusion protein repeat
  Pfam annotation: Domain name=Pox_A_type_inc; Domain location=168-190; Score=0.9; E_value=61; Accession=PF04508.3; Description=Viral A-type inclusion protein repeat
  Pfam annotation: Domain name=Pox_A_type_inc; Domain location=53-75; Score=11.7; E_value=1.6; Accession=PF04508.3; Description=Viral A -type inclusion protein repeat
  Pfam module annotation: Pfam domain module=Frigida::Pox_A_type _inc::Pox_A_type_inc::Pox_A_type_inc; Domain location=542-821::130 -152::168-190::53-75
MESSSEQRLQSLERCIEEKEKKLVSIKRQFGREIDAKEREYDVVTRKVEERNRELESVQRRITDCEWKLDTVRRMITESDEVYQQKQRGIQDSDRELAEKEAHRSLIADMIREREQELRAKDAEFQQVLDEGMALKNKVAQLNDDLKTKKEELDVVTRSLINEQATETTIKSMRARIKQLLRQPYESESKQKQFEGQAKELESKQKHYERQVKELQSKQKQYEGRVKELKLNEKLYERKVRELGSREKQYETRMKELESNEKQCETRMKEVESNAKQYEKRVKELVSHERQYVKSVIELNSKEKQIEGQMVDLESKKNQYEGLVKELESKEARCKVLLKELESIEKKIQEQMKDLEFKKNQCESSRKSFEEEKLSKQKSNDQQHFTNANSASLFNQQNFTGADNSKNLPLFINLLEKYELMCSQVSDALQTFANPTKLVLDTIKGFYTSHSRQGLIEYDASISRRICNLLMDELKKSSPVIGIRVKQEAIKLATDWKANLVAGDKDCLEVLDFFKFVATYEIGSSFDAIELQRLLDIIALQYQTLQAIGKIKEPSDNQSSPTIDGRNLHFPSIKHINESVNLHTSSDPAKLVLDIILVPIASEKQGSEGAIIIDESHILLLEQLMRISPRVKPRVREEALKIAFALKANIRESAENSLTILGFLLLLSAYGLVSYFRKDELFKQLESAAQHKQAVELFRTLGFVDKIFDFVRNLIMKQQHIEAVRFICAYKLADKIQPVDLLRQHVAKVKSVTNRFACMKESVEQKIKVRDEEIVGLRTVLECISENNLESHQDLGKEINDRIVDLEKQKENVVRLTSGPSSEVEEKTCGGEAVTVTVHKPEEKKRLVGVSLPINNQWGNISKGPRTSVTYPRFAPLPPPPPPPYASPGMSVAAIEEENMLWLCRKWI

SEQ ID NO: 208454 - protein, 110 aa, Glycine max
  Coding DNA Sequence Number=SeqID_91676
AQLVARTTVLLAEFYVITDNTIIVTQRIIKKLPIEANFRLTNCKSTLAKPPPYTLANLVVDVEASIGGRDSGAQDRERGEGEQLVIEVVMEVRGGRARARRVPSRNRDGK

SEQ ID NO: 208455 - protein, 141 aa, Glycine max
  Coding DNA Sequence Number=SeqID_91677
PSSEVEEKTCGGEAVTVTVHKPEEKKRHVGVSLPINNQWGNISKRPRTSVTYPRFAPLPPPPPPPPPPPPPLPPPPPPPPPLPPPPPPRPPQYQRVFMPMPGASQFVFPENYFRPANPMAWSGNNGTNYYGNSRPPYPPFG

SEQ ID NO: 208456 - protein, 82 aa, Glycine max
  Coding DNA Sequence Number=SeqID_91678
  Homolog annotation: Hit_ID=Q84T74; Match level="QueryCoverage=81%, HitCoverage=35%, E-value=1e-22, Identity=73%"; Hit description =Expressed protein
MVAKREVNGGGEGTALIFTYGTLKRGFSNHPLLQDLIRSGDASFVGTYRTAVKYPLVCGPYKVPFLLNIPGSGRWVHGEIYS

SEQ ID NO: 208457 - protein, 54 aa, Glycine max
  Coding DNA Sequence Number=SeqID_91679
MLGVDHLGSKHQAKTEAGADSNSENGNNSSNAEPHEGRPKRNISKPNYLKDYDT

SEQ ID NO: 208458 - protein, 1196 aa, Glycine max
  Coding DNA Sequence Number=SeqID_91680
  Gene Ontology: Mol. function=zinc ion binding
  Homolog annotation: Hit_ID=Q2QSD0; Match level="QueryCoverage=49%, HitCoverage=50%, E-value=3e-30, Identity=23%"; Hit description=PHD -finger family protein, expressed
  Pfam annotation: Domain name=C1_3; Domain location=235-265; Score =5.9; E_value=0.1; Accession=PF07649.3; Description=C1-like domain
  Pfam annotation: Domain name=PHD; Domain location=236-285; Score =25.0; E_value=0.00018; Accession=PF00628.19; Description=PHD-finger
  Pfam module annotation: Pfam domain module=C1_3::PHD; Domain location= 235-265::236-285
MRLESGTCNVCSAACSSCMHPNRALMGSKAEEFSDENCRLGEVNQYCDESDRSSLGSRACERLKHGVSETSHKPSVSSTHDSLSENAENSQALSEKYQDSKCLESLDDSTSCISRTKGSGNGPTVDISSLSECCMENVDSSLTKERVPIIVPGEKSLADKENLNNGTAKVSIEICPKSEEDTENNVDVAEDDDHKYSAHDGLHEKVEELIKSSGRAEPQSEDESDESDVVEHDVKVCDICGDAGREDLLAICSRCSDGAEHTYCMREMLEKVPEGDWLCEECKCAEETANRKLAAKRQALESSTGSPKASSPKRIVPLSRESSFKSMDKEKMKSGQQKIPMHNHLGGDDTELARSLSAGPRSQNARSTLLKSNSFNNNSKPRVKLVDEVVPQKQKGVVEHISKNMETPAGMISKSMSFKLSNLGRSNAVESKVKMISSKPGTTQDLKASRHAKDSASFDRKFLSKIDRPVICSTMVSSVVSTSKGDPKLTPHGETAKPSTVNNNREFKVNQDGKLYSLSKSMNNTSSKSPEPQVSSDRTSTSVDETQQDKLPRSQDTANQVDKAKDSSIDHVMSGVTNASKSSFCRKCKDFGHATECCTVSGTQEFGAESSVIATSSSKEEMHEGNRLKAAIQAALLRRPEIHKRKEAPDQTNEFPTSSTGLKREVTSQKQVLVSSTLKNSISAEESNMKQEIIVNSTVETSKCPSANDLKQVKFCRTDFCSQLRKSDSVGPTSGKPVVRDLPNNAMEISSILSKMSVIPEYEYIWQGVFKVHRNGMPPDLYTGIQAHLSACASPKVHEGLLDHMIRNDLALRGTSDGVELLIFASNQLPEDSQPVMTLSETRCSPKRMDEEFIDQDHNMRDSVPEHRQYIESKPPEAMETSVSSRIVETKTNHDISVKQENSLSSGIPSVGYQEIDTASNINRDKILDRTNNDENQQRPKRKQMEDDLDINVEATFLGDLTVKAVNCQLPNDKKVKHIDLSDTAVEASAVSCQKMPWNEVNGKFENGESYSKKLQTGFGGIHGCYDSGARESFNGSFASLVNDLGSCSSGENKRCKKPCDEKIIHEDLGAMERTFFPVDTRKKKDSGMVLNEPRAYVDQFQVGIPNLELGLGGETKPSHKGMLPFFVGAVDKKNSQEKTPDILTDEREDENVAASLSLSLSFPSSNKEHVKPVTKAEDGHNVNSPYLLFGRFTDK

SEQ ID NO: 208459 - protein, 335 aa, Glycine max
  Coding DNA Sequence Number=SeqID_91681
  Gene Ontology: Mol. function=kinase activity; Cellular component =integral to membrane; Biological process=positive regulation of I -kappaB kinase/NF-kappaB cascade
  Homolog annotation: Hit_ID=Q1T2M3; Match level="QueryCoverage=83%, HitCoverage=57%, E-value=1e-108, Identity=72%"; Hit description =Protein kinase
MEMKMQLKSSAKGKVGEKEKVIRRIGVSEKEMGWGRGMLEGVVVVGCLCLLGWAGLWFLNRRLYKEYEEKRVLVQIIFSVVFAFSCNLLQLVIFEIIPILSKEARVVNWKVDLFCLILLLVFLLPYYHCYLMLKNNGVRAERAALGAILFLFAFLYAFWRMGIHFPMPSPDKGFFTMPQLVSRIGVIGVTVMAVLSGFGAVNLPYSYLSLFIREIEETEIKALERQLMQSIETCVSKKKKIILCQMEMDNKQGSEEKLNARSLIKRIVGTVVRSVQEDQKEQDIKGLEAEVLALEELSKQLFLEVYELRQAKCLDSSADDVCVHILLNHHSKFPI

SEQ ID NO: 208460 - protein, 187 aa, Glycine max
  Coding DNA Sequence Number=SeqID_91682
  Gene Ontology: Mol. function=oxidoreductase activity; Cellular component=cytoplasm; Biological process=bile acid catabolic process
  Homolog annotation: Hit_ID=Q1S3A6; Match level="QueryCoverage=71%, HitCoverage=48%, E-value=1e-44, Identity=64%"; Hit description =Aldo/keto reductase
  Pfam annotation: Domain name=Aldo_ket_red; Domain location=5-170; Score=-34.5; E_value=2.9e-07; Accession=PF00248.11; Description =Aldoketo reductase family
MAITLNNGFKIKMPIIEGKEIRDLILNSIKIGYRPSLMNIVKIYYFLLLNTFCSNYDVLLTRDCLAYSKIKPAVNQIETHPYLQRVLSEARDLCHCTHSTRRCWSKGWMVWVWPKKYKKTVAQIALRWGIQRNTVVIPKLSKLERLKENFQVFDFELSKEDMELIGSICRKYRTNQPAVFWGIDLYA

SEQ ID NO: 208461 - protein, 49 aa, Glycine max
  Coding DNA Sequence Number=SeqID_91683
MELWKKNGKRGLRCYSQKETIGYVKLLALLVCCDELMMIIRICISCSFV

SEQ ID NO: 208462 - protein, 36 aa, Glycine max
  Coding DNA Sequence Number=SeqID_91684
MGAKENVTNVDGSKKGMNDFKEAKSTMKDFKEVGYE

SEQ ID NO: 208463 - protein, 94 aa, Glycine max
  Coding DNA Sequence Number=SeqID_91685
  Homolog annotation: Hit_ID=Q1SXT5; Match level="QueryCoverage=66%, HitCoverage=9%, E-value=2e-10, Identity=57%"; Hit description=Sugar transporter superfamily; Major facilitator superfamily MFS_1
MTPLVTLFTLSPQPQRENLGSINPSNGPGPNPEGGHVSMKKYALSGKKIPHVGQYRTDAEPSRPRQRGPRMVLHCEAQAQSQKRESKPTNAGKE

SEQ ID NO: 208464 - protein, 217 aa, Glycine max
  Coding DNA Sequence Number=SeqID_91686
  Gene Ontology: Cellular component=integral to membrane
  Homolog annotation: Hit_ID=Q1S3A5; Match level="QueryCoverage=78%, HitCoverage=50%, E-value=4e-60, Identity=68%"; Hit description=3-oxo- 5-alpha-steroid 4-dehydrogenase, C-terminal
MVFLFHNQPMEVVLVQMLRLAWVAATLPIIVASIPTPKLNCLRGTLLGFARRGKIMHSSSQKVTISQRFFLHFYVVAFIWTTLLLVGTWAYAYSMVPLVVEPFSYSTITSFLTGGSTIRTDTHKLRQGYVAWQAVFLLLMMEVHVLRRLYETIHVFNYSPSARMHAVGEIHASLTKYAGSIPGLILLHHKAFSDSTEHAMVLGTTLFLLPQNFVYLA

SEQ ID NO: 208465 - protein, 145 aa, Glycine max
  Coding DNA Sequence Number=SeqID_91687
  Gene Ontology: Mol. function=heat shock protein binding; Cellular component=integral to membrane; Biological process=protein folding
  Homolog annotation: Hit_ID=Q9FMD2; Match level="QueryCoverage=67%, HitCoverage=76%, E-value=3e-40, Identity=77%"; Hit description =Arabidopsis thaliana genomic DNA, chromosome 5, P1 clone:MTG13
  Pfam annotation: Domain name=DnaJ; Domain location=43-105; Score =117.4; E_value=4.1e-32; Accession=PF00226.21; Description=DnaJ domain
MYYVKEAAHVDPMFVADNTNPKLLVRLVVVGESETDLGNAAEDYYKVLEVEYDATDENIKLNYRRLALKWHPDKHGGDSAVTAKFQEINEAYNVLSDPTKRLDYDLTGICEIEKYSLQEYLARFKSMILTCNGLGINQTDRWYLF

SEQ ID NO: 208466 - protein, 77 aa, Glycine max
  Coding DNA Sequence Number=SeqID_91688
MRGGFVGGRRREGQTRVGHGLGAVYGVLSEKVSDVAILIQCWLEIGSPVTRTTVSCDLFVLFSIIIILMSDPAFVVT

SEQ ID NO: 208467 - protein, 324 aa, Glycine max
  Coding DNA Sequence Number=SeqID_91689
  Homolog annotation: Hit_ID=Q75K33; Match level="QueryCoverage=82%, HitCoverage=82%, E-value=2e-75, Identity=57%"; Hit description =Expressed protein
  Subcellular localization annotation: CTP_CleavageSite=49; ConfidenceScore=5.69e-01
MVLAYAAMLSSTLPFQKSVPLTSQRSGTAFGSSFQFNRENGTVVTPLVVCHAKKKLSFMEQILDYIEGGPKLRKWYGAPDILEKDGTAIEDNEDDYPEDEVRDAVLVTDGDSEMGQMVILSLIVKKARVKTLVKDKRVALEAFGSYVEFLIIDHMMLVAKSMAGDTSDKRFVKKALRGVRTIICPNEGFLSSVGSLQGVQHVIVLSRLSVYGGQSGFQSMMKSNAKKLAEQDESVLKTSGIPYTIIRTGALQDTPGGKQGFTFDEGCAASGSISKEDAAFVCVAAFDCVPQTGFIFEVANGDNKVSDWKECLATLMEKASQKLQ

SEQ ID NO: 208468 - protein, 271 aa, Glycine max
  Coding DNA Sequence Number=SeqID_91690
  Homolog annotation: Hit_ID=O81313; Match level="QueryCoverage=33%, HitCoverage=53%, E-value=1e-34, Identity=81%"; Hit description =Protein INDEHISCENT
  Pfam annotation: Domain name=HLH; Domain location=138-185; Score =27.9; E_value=3.6e-05; Accession=PF00010.16; Description=Helix-loop -helix DNA-binding domain
MDTNTSTLFTNVNSTWNLEKMETNEQQQQHDDHSIILQVQDPMGSGIWPINNYQNLLQMHQTPNTTTSSTVIVPPSSSSGFLGDILGVHHNLEEDEEPEEELGAMKEMMYKIAAMQPVDIDPATIRKPKRRNVRISDDPQSVAARHRRERISEKIRILQRLVPGGTKMDTASMLDEAIRYVKFLKRQIRLLQSIPQPSRQPPQCIGVASTTPHASTLLLAPSSDWPFAPNVLPRSTAVSASMDMSAGLGFDGHAHACDGSSSFNHHEVISE

SEQ ID NO: 208469 - protein, 363 aa, Glycine max
  Coding DNA Sequence Number=SeqID_91691
  Gene Ontology: Mol. function=protein C-terminus binding; Cellular component=intracellular; Biological process=response to DNA damage stimulus
  Homolog annotation: Hit_ID=Q70X85; Match level="QueryCoverage=95%, HitCoverage=36%, E-value=9e-67, Identity=41%"; Hit description=MEI1 protein
  Pfam annotation: Domain name=BRCT; Domain location=153-232; Score =26.4; E_value=0.0001; Accession=PF00533.16; Description=BRCA1 C Terminus (BRCT) domain
MVDICVLDCSYAPEGDKYKVAKRWGHIHIVTRKWFDQSIARKACLNEELFAVQHGSVSSHKVTRDLTMQHSQEKDFGKLHSAASSGATDSNVQVFSCAEFMDRDLEATQSEHMSSVSNVPLFAKEADSEPLPLQTCSELNFDGAVANDSESDDNDLYLSECRILLVGFEACEMRKLVNMVRKGGGSRYMSFNDKLTHIVIGNPTEMEKKDVRSLAALGVIYVVKTAWLEDCDREKKQVPVLRRHIAYDLLYPKAKGAVTGSMSMDHAKISSFHQRLHQVDFEIVKPESLEKRKEEKKDMGINGHSFSEAIGRTMLQNQLPDNKLSSQRMTQHNSSVQYTKSANVFRGKLFCFSNLYPEEKASH

SEQ ID NO: 208470 - protein, 144 aa, Glycine max
  Coding DNA Sequence Number=SeqID_91692
  Gene Ontology: Cellular component=intracellular
  Homolog annotation: Hit_ID=Q70X85; Match level="QueryCoverage=80%, HitCoverage=11%, E-value=4e-45, Identity=73%"; Hit description=MEI1 protein
MLKTKPFQGANVFMSRNLVPPEVFDKLHDAVKDNGAQIHLCCDPSRNGPNDYHIISSSKHEKFDDLKSKGCKLLGPICVLSCAKGGRPLPKQGFTCCLAMDGVKVLASGFDTDEKVYSIGYQQQVVIIFKVVKLESLCRLVELP

SEQ ID NO: 208471 - protein, 319 aa, Glycine max
  Coding DNA Sequence Number=SeqID_91693
  Gene Ontology: Mol. function=transcription factor activity; Cellular component=nucleus; Biological process=regulation of transcription, DNA-dependent
  Homolog annotation: Hit_ID=Q1SCT6; Match level="QueryCoverage=90%, HitCoverage=96%, E-value=1e-51, Identity=40%"; Hit description=CCAAT- binding transcription factor, subunit B
  Pfam annotation: Domain name=CBFB_NFYA; Domain location=182-238; Score=134.5; E_value=2.8e-37; Accession=PF02045.6; Description=CCAAT- binding transcription factor (CBF-BNF-YA) subunit B
MKNLCEKDSGPTHLTYYALGRTSWGTSSESDVQQSSMSKSLSLKISVLPQQCHKTKLLNFQYQDRDSSSTQSSGQSYPEVGSAQSGQISVQCSNCSACSTLNTTGGKSVEGVISSTVGIQDYTFPLSQLCYNQSLAHTAFHFAEPCFIGLVAAPYAPQPNINDAQLVGMSPARIPLPPDLIEGPMYVNAKQYHAILRRRQYRAKLEAQNKLIKERKPYLHESRHLHALKRARGSGGRFLNAKKLTSANHGDSITTCSDVFQQHESDFRLCGYPSRIGRSVQGYSVEINIIYQSLCDKLFWHTSKCSIGKSSLAHLHYYV

SEQ ID NO: 208472 - protein, 270 aa, Glycine max
  Coding DNA Sequence Number=SeqID_91694
  Gene Ontology: Cellular component=intracellular
  Homolog annotation: Hit_ID=Q2R9I2; Match level="QueryCoverage=97%, HitCoverage=50%, E-value=2e-54, Identity=47%"; Hit description=BRCA1 C Terminus domain containing protein, expressed
  Pfam annotation: Domain name=BRCT; Domain location=26-101; Score =45.4; E_value=2e-10; Accession=PF00533.16; Description=BRCA1 C Terminus (BRCT) domain
MVFLFKAGSLLDVDSHILYSPLPCRVPLPGFESFRFCFSQYDEKDRNLLRNLCFHLGAKYGEKLTKKVTHLLCKFTNGPKYEAACKWGIQSVTSEWIFECVKQNGVVAIDQFLPKEVTAQDRDAGICTVSQFPTQAVQMISDLPSQLSSQSQTLRGTTNKNVSCGVDNHETSFRIPSNYSKKARLVEEPCLSNKKPSASNSGIHADDKNFSKDNMLIDAGEAFHAVPDVAAAIEDLLEQTSKNRFTHLIAQSLVKIIPILILSLDYLNTG

SEQ ID NO: 208473 - protein, 814 aa, Glycine max
  Coding DNA Sequence Number=SeqID_91695
  Gene Ontology: Mol. function=signal transducer activity; Cellular component=chromatin assembly complex; Biological process=signal transduction
  Homolog annotation: Hit_ID=Q9FUF3; Match level="QueryCoverage=75%, HitCoverage=100%, E-value=0.0, Identity=95%"; Hit description=FAS2
  Pfam annotation: Domain name=PMEI; Domain location=25-184; Score =62.2; E_value=1.7e-15; Accession=PF04043.6; Description=Plant invertasepectin methylesterase inhibitor
  Pfam annotation: Domain name=WD40; Domain location=204-241; Score =23.1; E_value=0.001; Accession=PF00400.22; Description=WD domain, G -beta repeat
  Pfam annotation: Domain name=WD40; Domain location=254-292; Score =25.8; E_value=0.00015; Accession=PF00400.22; Description=WD domain, G-beta repeat
  Pfam annotation: Domain name=WD40; Domain location=302-340; Score =34.6; E_value=3.4e-07; Accession=PF00400.22; Description=WD domain, G-beta repeat
  Pfam annotation: Domain name=WD40; Domain location=344-382; Score =31.2; E_value=3.6e-06; Accession=PF00400.22; Description=WD domain, G-beta repeat
  Pfam annotation: Domain name=WD40; Domain location=551-590; Score =13.6; E_value=0.74; Accession=PF00400.22; Description=WD domain, G -beta repeat
  Pfam module annotation: Pfam domain module=PMEI::WD40::WD40::WD40::WD4 0::WD40; Domain location=25-184::204-241::254-292::302-340::344 -382::551-590
MASKIFYLLSLLLLAHLLQPHVFVKGDGSLIEKTCKNTKYYNLCFSSLKSNPSSANADPKGLAVIMVGIGMANATSTSLYLSSKMLGTANNNDSTFKRVLKECAEKYKYASDALQASAQDLVNEAYDYASMHIIAAYDYSNVCHNLFKLYSGLVYPSELAPREDGNHLAKGGRENPFLSVYVASSSFFYTPNLKTPIRKTMKGGTVQISWHDGKPVLTLDFHPHSATLATAGADFDIKFWQIKPAGSPKKLPVVSYLSNLSYHSSAVNVIRFSSSGELLASGADGGDLIIWKLHSTDAGQTWKVLKMLRSHHKDILDLQWSTDATYIISGSVDNCCIIWDVNKGTNLQTLDTHAHYVQGVAWDPLGKYVTSLSSDRTCRIYMNKPHKSKGIEKINYVCQQVISKADQPLFKNSKETKFHLFHDETLPSFFRRLAWSPDGSFLLVPAGSYKISTASESVNAAYIFSRKDLSRPAIQLPCASKAVVAVRFCPIFFKLRGTNSAINLRIAKSLWAMGCIMLILLTAAGLFKFPYRIIFAVATLNSLYIYDTESTSPIAVLAGLHYAAITDITWSSDAHYLALSSQDGFCSLVEFENDELGSPYSLSEGKVSNKDGRSTVQTTNDTVTVPTGNVSAVLAESKKMESEDTADDVVIEASGNIGAVVTESGKTVTQEKAGMIQSTGNLADFRKNEAAGKAVYMVIEATGDVGGVIADSRKNEAEEKTDDMVIETTGSIDAAELDRRKAEPEDKAEKQPANLDSDGKQAEAKEKTKTLQSSLDGIKSGAEEKAGPQLFNPKSTPISNKPAKKRITPTAIDP

SEQ ID NO: 208474 - protein, 450 aa, Glycine max
  Coding DNA Sequence Number=SeqID_91696
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q5NA51; Match level="QueryCoverage=75%, HitCoverage=78%, E-value=1e-129, Identity=62%"; Hit description=Leaf senescence related protein-like
  Pfam annotation: Domain name=DUF231; Domain location=270-427; Score =123.5; E_value=5.8e-34; Accession=PF03005.6; Description=Arabidopsis proteins of unknown function
  Subcellular localization annotation: CTP_CleavageSite=29; ConfidenceScore=5.54e-01
MSALNRTIISFNKTSSFNHRRTLGIVSPRVIHNNRFGCVSLRLQVLVIFVSVVSFFLAIGGYMYVLPSLSHAFFNGQVPLLLSEHNSNGSVRECDVFDGSWVQVKKDHTLYNATECPFVERGFDCLGNGRSDRDYLGWRWKPRSCEIPRFDVRGVLEMLRSKRVVFVGDSMSRTQWESLICMLMAGVEDKRGVYEVNQNQITKRIRFLGVRFSAFNFTIEFFRSVFLVQQGRVPRHAPKRVKSTLLLDKLDDISDQWVNSDILIFNTGHWWVPSKLFDMGCYFQVGSSLKLGMTIPTAFRIALETWSSWVDREINKNRTRIFFRTFEPSHWSLHDCCSDLTRWICNVTQYPTLETNGRDQSLFSDTILQVVKNVTIPINVLHVTSMSAFRSDAHVGNWSDNPSIQDCSHWCLPGVPDMWNEIILSQLFTEFEIPSQQIESLSKFSYLLVD

SEQ ID NO: 208475 - protein, 261 aa, Glycine max
  Coding DNA Sequence Number=SeqID_91697
  Homolog annotation: Hit_ID=Q47522; Match level="QueryCoverage=14%, HitCoverage=45%, E-value=7e-14, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRSNDCKLTDINASTIETTHSNAKTLSFFSNKIGGRNCTILEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 208476 - protein, 317 aa, Glycine max
  Coding DNA Sequence Number=SeqID_91698
  Homolog annotation: Hit_ID=Q1SCT7; Match level="QueryCoverage=82%, HitCoverage=62%, E-value=1e-70, Identity=53%"; Hit description =Ataxin-2, N-terminal
  Pfam annotation: Domain name=PAM2; Domain location=207-224; Score =24.2; E_value=0.00045; Accession=PF07145.5; Description=Ataxin-2 C -terminal region
MVWILFLSFSFFFWFLKSMNNGNSAVDKTTCADSIGKILPNHSELSQSSSGVDLCRSGSKDHAKQLSSELPALSCSFSDGESRIQLNSVNNLHGVNDNTVEENWIQAEDVQLLKSEDLQSSLKLKKDGSDEGGLSTNVALCAPSTRILSKTPKETGSVGESKSVISRGRLGRSLGSDYVAATSGPGLSPSSSVGSLSSEKSTLNPNAKEFRLNPNAKSFIPSQSHARPRSPMSDGSFYFPATVSTIPNMPAMSMGIGVGTTFAGPQPVVYNPQAAQMPSQPYFHPNGPQYGQLLGHPRQVLYMPSYLPEMPYKGRDH

SEQ ID NO: 208477 - protein, 366 aa, Glycine max
  Coding DNA Sequence Number=SeqID_91699
  Gene Ontology: Mol. function=pyridoxal phosphate binding; Biological process=metabolic process
  Homolog annotation: Hit_ID=Q1RT21; Match level="QueryCoverage=99%, HitCoverage=60%, E-value=1e-153, Identity=73%"; Hit description =Aminotransferase, class V family protein
MSRESTQIHEQLLSFFIGTKPLHALISQQDSGPYVEIDVRSGESDGYDAVFLSPHKFLGGPDSPGVLLMNKALYLLGSSPPSTCGGGTVTYVNAFNEQDTLYLENIEERETGGTPPIIQTVRAALAFWVKEYISYEDIEKREQLYINKALERLGSNPNIEVLGNLKAKRQAILSFLIYSTTTNSCSAGEWSDGNKENEGELDLWAETGNQRGKPLHGPFVAALLNDLFGIQARGGCACAGPYGHELLHINKSHSLAIRSAVQEGYIGVKPGWTRVSFPYYMSEEDFEYILKAIEFIAVYGQRFIPLYSFNLINGSWRLKTQKFEAQTKEGTDKFEVAKCVASSLRKFPSQGILQEEVDPNIFCFRI

SEQ ID NO: 208478 - protein, 247 aa, Glycine max
  Coding DNA Sequence Number=SeqID_91700
  Homolog annotation: Hit_ID=Q9LVJ8; Match level="QueryCoverage=77%, HitCoverage=31%, E-value=1e-30, Identity=42%"; Hit description =Arabidopsis thaliana genomic DNA, chromosome 3, P1 clone: MDC16
SFAALKDFGDVGSVAYEDGAAEFDVADRKRRMRAEQQVLGRLWVRMNLQQIGQPKSSNGYGHQKSEKEGATKSDNKLPSVKSNSSSRLAGVVTGNKGGGYGSPSHDRLVYLTTCLIGQHVEVQNLTFFTAYVIITVLLGIILKMARLTKAASLQGQGSGVEFVSEAPSKTLIIPANDLAQVIAKDVAVSRDGLPSESHYDMHHEIMVDSVISQSCHVETGRELQRWVPDEDDQQCPELENIFDGPWN

SEQ ID NO: 208479 - protein, 524 aa, Glycine max
  Coding DNA Sequence Number=SeqID_91701
  Gene Ontology: Mol. function=phosphatidylcholine-sterol O -acyltransferase activity; Cellular component=endoplasmic reticulum; Biological process=lipid metabolic process
  Homolog annotation: Hit_ID=Q6XSH3; Match level="QueryCoverage=99%, HitCoverage=68%, E-value=1e-177, Identity=86%"; Hit description =Lecithine cholesterol acyltransferase-like protein
  Pfam annotation: Domain name=LACT; Domain location=1-486; Score= -78.2; E_value=2.3e-07; Accession=PF02450.6; Description =Lecithin:cholesterol acyltransferase
MYMAAYDWRIAFQNTEVRDQTLSRIKSNIELMVATNGGNKAVIIPHSMGVLYFLHFMKWVEAPAPMGGGGGPDWCSKYIKAVVNIGGPFLGVPKAIAGLFSAEARDIAVARFCEVNSLVQHFLLHLTIYLHERKQIQIASGTNAIAIFFFVRLTVQYLRLKLNLVLSCHISRTIAPGFLDNDLFRIQTLQHVMKMTRTWDSTMSMIPRGGDTIWGGLDWSPEEGYHPSQRKHSSDYTQLTDQETNQTNVVNYGRMISFGRDVAEAHSSKIEMADFRGAIKGRSVANTTCRDVWTEYHEMGFEGVRAVAEHKVYTAGSIVELLQFVAPKMMARGSAHFSYEIADNLDDPKYNHYKYWSNPLETKLPNAPDMEIFSMYGVGLPTERSYIYKLTPFAECYIPFEIDTTQDGGSDEDSCLQGGVYTVDGDETVPVLSSGFMCAKGWRGKTRFNPSGMRTYVREYDHSPPANLLEGRGTQSGAHVDIMGNFALIEDVIRVAAGAKGEDLGGDKVYSDIFKWSEKIKLPL

SEQ ID NO: 208480 - protein, 317 aa, Glycine max
  Coding DNA Sequence Number=SeqID_91702
  Gene Ontology: Mol. function=DNA binding; Cellular component=nucleus; Biological process=regulation of transcription
  Homolog annotation: Hit_ID=Q1RT19; Match level="QueryCoverage=89%, HitCoverage=46%, E-value=8e-74, Identity=51%"; Hit description=No apical meristem (NAM) protein
  Pfam annotation: Domain name=NAM; Domain location=3-190; Score=145.8; E_value=1.2e-40; Accession=PF02365.6; Description=No apical meristem (NAM) protein
MVKTVGVRFHPTGVELVVYFLKRKVMGKKICDGFIAELDIYKYAPWDLPESMNAIPTRSTIVGRWLGSLSMLTGVRFPGRVYREDFVGRGKTHFRDLYTSRVSPMASGYKSCLRTGELEWYFFCPLEKKYGSGSKMKRATEIGYWKATGKDRVVQHNNRTVGMIKTLIFHTGKSPRGERTDWVMHEHRLEDKDLADKGIAQDSYVVCKVFQKEGLGPGKGTHYARPFNEEEWDDEEIGIPCAALTAQVPTLPITSDGSVANDNHLPASGCIGSASTSCLSGSVPSLGTVNPTGPNDQAVNDDILPMLHIFNDDKWFE

SEQ ID NO: 208481 - protein, 56 aa, Glycine max
  Coding DNA Sequence Number=SeqID_91703
MDKSVADTQAALEFRSKRKRRDGTGARVAMVAGCQHVEKLYLLPLYFGTHYKVRSL

SEQ ID NO: 208482 - protein, 82 aa, Glycine max
  Coding DNA Sequence Number=SeqID_91704
  Subcellular localization annotation: CTP_CleavageSite=7; ConfidenceScore=5.07e-01
MVGIGLSAPLGAQRNFLSIGIALSASFTLSERPKVVIFKIPVVKLWKHVLRSSRQNLKMIQRLTNSGLQFYWTRFRQKSKIS

SEQ ID NO: 208483 - protein, 91 aa, Glycine max
  Coding DNA Sequence Number=SeqID_91705
  Homolog annotation: Hit_ID=Q2QWP2; Match level="QueryCoverage=75%, HitCoverage=52%, E-value=1e-09, Identity=49%"; Hit description =Expressed protein
MEASIMLPLERTSSIEREPRTLNINQIQSARELAIYILNTKTIEEASRIFTEGLQPVVSAAPKMGLGEEVEVLDSKVASVAAFRDIASAPF

SEQ ID NO: 208484 - protein, 151 aa, Glycine max
  Coding DNA Sequence Number=SeqID_91706
  Homolog annotation: Hit_ID=Q9FRL4; Match level="QueryCoverage=33%, HitCoverage=11%, E-value=9e-15, Identity=64%"; Hit description=3 -methyladenine DNA glycosylase, putative; 31680-30045
MTKAENSVEKNENVAVAVDRNVMILTPTTATMQSLISPLGFPLATGSAGATLPVPNVRTFSLYNLEDLPRPSQMDQLCDKWRPYRSVASWYMWRFVEAKGTPSSAVAVATDAGLQQQQHHHQHQQQEQQQLQQHPPQPQLLDPINSMFNLG

SEQ ID NO: 208485 - protein, 82 aa, Glycine max
  Coding DNA Sequence Number=SeqID_91707
MAARNNNVATLEGGGAGGRMDWVGDDTHGTRRWHRTNRQNDACKRVLPNPSAHKGYADWAPKLGMMLTPYLMDLGVVIHTIL

SEQ ID NO: 208486 - protein, 567 aa, Glycine max
  Coding DNA Sequence Number=SeqID_91708
  Homolog annotation: Hit_ID=Q69NN2; Match level="QueryCoverage=96%, HitCoverage=58%, E-value=2e-47, Identity=31%"; Hit description =Hydroxyproline-rich glycoprotein-like
  Pfam annotation: Domain name=DUF1296; Domain location=18-77; Score =137.9; E_value=2.8e-38; Accession=PF06972.2; Description=Protein of unknown function (DUF1296)
  Pfam annotation: Domain name=UBA; Domain location=21-62; Score=13.8; E_value=0.087; Accession=PF00627.21; Description=UBATS-N domain
  Pfam module annotation: Pfam domain module=DUF1296::UBA; Domain location=18-77::21-62
MVPGSKTEGGGTGTTHLLSARVRKTIQSIKEIVGNHSDADIYVALKEANMDPNETTQKLLNQDPFHEVKRRRDRKKETQNVGNRGQPSADSRRPSENNSGQGMKFHTHSERNVRRTNYSRSTFPGISREFRVVRDNRVNHIYKEVTPLSQQHSTSVTEQLNVNISDKGSSISTNHRSSGSRNSSQASNGPSDSHARYAPKTIDRKIVYEDKDKQGMISNAAGRVQPIKPNSVHQNSALVASTSSAVGVYSSSTDPVHVPSPDSRSPGVVGAIRREVGFVGVRRQSSDNKAKQSFAPSSPHVVGKDGTSADSFQSVGAVSKTEQFSQTNVTEPSLSGMPVSRPSLNNQHNNRPHQQLVGHQRVSQQNKEWKPKSSQKPNCNNSPGVIGTPKKAAAAASPPAENSGDIESNTVELQDKLSQVNIYENQNVIIAQHIRVPETDRCRLTFGTIGTELDSSRPQSKYHIIGASEKSNEELTASLTVPAPELSTDDVSGSKQVDLRDEHIRSLGSDSPVSGATSEQQLPDNKDSSNTKNLDNYANIGLVRDSSPSYAPSEQQQQDSHDMPGFA

SEQ ID NO: 208487 - protein, 415 aa, Glycine max
  Coding DNA Sequence Number=SeqID_91709
  Gene Ontology: Mol. function=zinc ion binding
  Homolog annotation: Hit_ID=Q6YUB8; Match level="QueryCoverage=91%, HitCoverage=100%, E-value=1e-106, Identity=53%"; Hit description =Major intrinsic protein-like
  Pfam annotation: Domain name=DZC; Domain location=159-194; Score =84.3; E_value=3.8e-22; Accession=PF08381.1; Description=Disease resistancezinc fingerchromo
MLTCIACTKQLNNGSLRQEEEEEAVSVHTPSTKQAIKALTSQIKDMAVKASGAYKSCRPCSGSSNGNRNRKYADSDIGSDSARFNWAYRRTGSSNSTPRMWGKEVENGGRVKGLSSGEGTPASVSGRTESVVFMEEDEPKEWIAQVEPGVLITFVSLTQGGNDLKRIRFSREMFNKWQAQRWWAENYDKVMELYNVQRFNQQAVPLPTPPRSEDESSKIESARDSPATPPLSKERAPRHFHHPTGMGYSSSDSLDRHQIQPHPCYETSGLTSTPNLSNISAPKTERSSLDASVRTSSSGEDHSGEFSISNASDMETEWVEQDEPGVYITIRALPGGTRELRRVRFSGSAFLLSSFFFAEKGLEKCMRDCGGKRIVLGYKNNTCDDCDYRRAFTQINCFSRLTQYSLKALQQCRAF

SEQ ID NO: 208488 - protein, 1054 aa, Glycine max
  Coding DNA Sequence Number=SeqID_91710
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=96%, E-value=0.0, Identity=87%"; Hit description =Glycosyl transferase, family 48
  Pfam annotation: Domain name=Glucan_synthase; Domain location=176 -964; Score=896.7; E_value=1.1e-266; Accession=PF02364.6; Description= 1,3-beta-glucan synthase component
MATQFRGRDSDLWKRICADEYMKCAVIECYESFKHVLHDLVIGETEKSIISSIIKEVESNISKNTLLTNFRMGFLPSLCKKFVELVEIMKNGDPSKRGTVVVLLQDMLEVVTDMMVNEISELAELHQSSKDTGQQVFAGTEAKPAILFPPVVTAQWEEQIRRLYLLLTVKETAVEVPTNSEVRRRVSFFTNSLFMDMPRAPRVRKMLSFSVLTPYYSEETVYSKNDIEVENEDGVSIMYYLQKIFPEEWNNFLERLDCKKDSDIWEKEENILQLRHWASLRGQTLCRTVRGMMYYRRAIKLQAFLDMASEKEIFDGYKAIAVPSEEEKKSHRSLYARLEAMADLKFTYVATCQQYGNQKRSGDRRATDILNLMVNNPSLRVAYIDEVEEREGGKVQKVYYSVLVKAVDNLDQEIYRIKLPGPAKLGEGKPENQNHAIIFTRGEALQAIDMNQDNYLEEALKMRNLLEEFNEDHGVRPPTILGVREHIFTGSVSSLAWFMSNQETSFVTIGQRVLARPLKVRFHYGHPDVFDRIFHFTRGGISKASCGINLSEDIFAGFNSTLRRGNVTHHEYIQVGKGRDVGLNQISLFEAKVACGNGEQILSRDIYRLGHRFDFFRMLSFYFTTVGFYISSMLVAITVYAFLYGRFYLSLSGLEEAIIKIARKKGDDPLKAAMASQSLVQIGLLMTLPMVMEIGLERGFRTALSDIIIMQLQLAPVFFTFSLGTKMHYFGRTLLHGGAKYRATGRGFVVRHERFADNYRMYSRSHFVKGIEISILLICYGLYGSAAPDSTAYALLSVSMWFLACSWLFSPFLFNPSGFEWQKIVEDWDDWAKWISSRGGIGVPSIKSWESWWDEEQEHLQYTGIWGRIWEVILALRFFVYQYGIVYHLHVARGDKSIGVYGLSWLVVVAVIVILKIVSMGSKTFSADFQLMFRLLKMFLFIGTIVILILMFVLLSFTVGDIFASLLAFMPTGWAFIQIAQACKPLVKGIGMWGSIKALSRGYEYVMGVIIFAPVAIMAWFPFVSEFQTRLLYNQAFSRGLQIQRILAGGKKNK

SEQ ID NO: 208489 - protein, 50 aa, Glycine max
  Coding DNA Sequence Number=SeqID_91711
MDLPLCCIPLQAYPFFKGVEWNKLYQMEASFIPESDSQTQSSSRSGPWRK

SEQ ID NO: 208490 - protein, 123 aa, Glycine max
  Coding DNA Sequence Number=SeqID_91712
  Homolog annotation: Hit_ID=Q2QWN1; Match level="QueryCoverage=86%, HitCoverage=47%, E-value=5e-33, Identity=65%"; Hit description =Expressed protein
MPQRIEGNQFAKYHELVIESYKDLAFSEYARVGRALTLYEVGDREEAIAEMEDVSISLKGYPEIHAALAAALYADKHAALLAENQFAIATLLDPHFTDLSYVRDTKHRPPSLISSLQHFITLS

SEQ ID NO: 208491 - protein, 233 aa, Glycine max
  Coding DNA Sequence Number=SeqID_91713
  Gene Ontology: Mol. function=nucleotide binding; Cellular component =membrane; Biological process=small GTPase mediated signal transduction
  Homolog annotation: Hit_ID=Q40207; Match level="QueryCoverage=98%, HitCoverage=100%, E-value=2e-88, Identity=74%"; Hit description=RAB1Y
  Pfam annotation: Domain name=Arf; Domain location=2-199; Score=-98.4; E_value=0.036; Accession=PF00025.11; Description=ADP-ribosylation factor family
  Pfam annotation: Domain name=Miro; Domain location=15-154; Score =13.8; E_value=0.00025; Accession=PF08477.3; Description=Miro-like protein
  Pfam annotation: Domain name=Ras; Domain location=15-201; Score =145.9; E_value=1.1e-40; Accession=PF00071.12; Description=Ras family
  Pfam module annotation: Pfam domain module=Arf::Miro::Ras; Domain location=2-199::15-154::15-201
MDSSSGHQEFDYLFKLLMIGDSGVGKSSLLLSFTSDAFEDLSPTIGVDFKVKYVMMGGKKLKLAIWDTGIHFVVIPFMITLLMDTAEWRWPFQVSVVVKFDFGLAANVVPLTNAVYDVTRRDTFTNLSEIWAKEIDLYSTNQDCIKMLVGNKLDKDGDRVVTKKEGIDFAREYGCLFIECSAKTRVNVQQCFEELVLKILDTPSLIAEGSKGVKKNIFKDRPPQSDASASSCC

SEQ ID NO: 208492 - protein, 419 aa, Glycine max
  Coding DNA Sequence Number=SeqID_91714
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT13; Match level="QueryCoverage=92%, HitCoverage=47%, E-value=0.0, Identity=85%"; Hit description=Beta-1 ,3-glucan synthase, putative
  Pfam annotation: Domain name=DUF605; Domain location=61-245; Score= -121.8; E_value=0.0072; Accession=PF04652.6; Description=Protein of unknown function, DUF605
  Subcellular localization annotation: CTP_CleavageSite=39; ConfidenceScore=5.46e-01
MGAGRSWFQNPNIGLTKWRWRGRRMSNPDQTVLNRRPSRSAATTTFSLEVFDNDVVPSSLASISPILRVANEIETERPRVAYLCRFYAFEKAHRLDQSSSGRGVRQFKTLLLQRLERDNPTSLASRAKKTDAREIQSYYQQYYEHYVRTLDQVNQADRAQLSKAYQTAGVLFEVLCAVNKTEKVEEVAPEIIAAARDVQEKTEIYTPYNILPLDAAGASVPIMQFEEIKAAVSALWNTRGLNWPNSFEQQRQKTGDLDMLDWLRAMFGFQLDDRAVDSVMKNLFKNYKSWCKFLGRKHSLRLPQGQQEIQQRKLLYMGLYLLIWGEASNVRFMPECLCYIFHNMAYELHGLLAGNVSIVTGENIKPSYGGDDEAFLRKVITPLYQVIQKEAKKSGHGKAPHSAWCNYDDLNEYFWSVFL

SEQ ID NO: 208493 - protein, 259 aa, Glycine max
  Coding DNA Sequence Number=SeqID_91715
  Gene Ontology: Mol. function=zinc ion binding; Cellular component =integral to membrane
  Homolog annotation: Hit_ID=Q1SJ34; Match level="QueryCoverage=83%, HitCoverage=48%, E-value=7e-38, Identity=41%"; Hit description=Zinc finger, RING-type
  Pfam annotation: Domain name=zf-C3HC4; Domain location=105-145; Score= 9.9; E_value=0.015; Accession=PF00097.15; Description=Zinc finger, C3HC4 type (RING finger)
MEHLGQIEERIRCLEAVVFRARQRQRQRPSHAPIQVTNYAGELGTVADLPAEEERLHQEFGGIDVGGEMVGDGRTCKRKASYLVAKALGVETSQGEGFATNLFHCNVCLDRARDPVLTCCGHLFCWPCFHKLSYAYSDVRECPVCKGDVPEEGIVPIYGNFLLDLVHIELRVLGSGSDIEELLLQSRSYCGLKSPPVKLIEEPVLLNGGAMTAMAEWHGGFFVNCDRQFVMGGPLWQCYRLQWFICQSFGLPPYSAIHH

SEQ ID NO: 208494 - protein, 623 aa, Glycine max
  Coding DNA Sequence Number=SeqID_91716
  Gene Ontology: Mol. function=protein serine/threonine kinase activity; Cellular component=spindle pole body; Biological process =protein amino acid phosphorylation
  Homolog annotation: Hit_ID=Q75PK5; Match level="QueryCoverage=76%, HitCoverage=78%, E-value=1e-156, Identity=60%"; Hit description =Mitogen-activated kinase kinase kinase alpha
  Pfam annotation: Domain name=Pkinase; Domain location=228-503; Score =276.1; E_value=6.9e-80; Accession=PF00069.15; Description=Protein kinase domain
  Pfam annotation: Domain name=Pkinase_Tyr; Domain location=228-503; Score=116.4; E_value=8.1e-32; Accession=PF07714.7; Description =Protein tyrosine kinase
  Pfam module annotation: Pfam domain module=Pkinase::Pkinase_Tyr; Domain location=228-503::228-503
MPAWWNRKWSKSKEEQEQPEEEDEEEEPRAAFQLNFMSGERDKNKGRSCSKKKTKSFDDKVKGVPLPLPSHSLSDPIQSFGSVSVSGGSSISSSTSYDDHPISPPNTNRKLQTNAADVVAAKRPNTLTSVLFQSGAKLIHGICLTCRGREEVRFNVRSKSPGPGSRGPTSPTSPLHQRLHALSLDSPTGSECHPLPLPPGSPTSPSSVLSNARANGHLENATSNVSKWRKGKLLGRGTFGHNMYSPQCLYSGQITETISILLPMSDSENGQMCAIKEVKVVFDDHTSKECLKQLNQEINLLNQLSHPNIVQYYGSELVEESLSVYLEYVSGGSIHKLLQEYGPFKEPVIQNYTRQIVSGLAYLHGRNTVHRDIKGANILVDPNGEIKLADFGMAKHINSSASMLSFKGSPYWMAPEVVMNTNGYSLPVDIWSLGCTIIEMATSKPPWNQYEGVAAIFKIGNSKDMPEIPEHLSNDAKKFIKLCLQRDPLARPTAQKLLDHPFIRDQSATKAANVSITRDAFPCMFDGSRTPPVLESHSNRTSITSLDGDYASKPALAAPRALRSSRDNTRIITSLPVSPSSSPLRRSSYPMTSNATFALDPWHETSRYRANTPPGGSPRMRLI

SEQ ID NO: 208495 - protein, 66 aa, Glycine max
  Coding DNA Sequence Number=SeqID_91717
MRGKPLINARGVEDVPASVKLPYTVLFFKTCQADNTFSLPCHDMVGDNYEHNNNHFGLNNAGGWSI

SEQ ID NO: 208496 - protein, 68 aa, Glycine max
  Coding DNA Sequence Number=SeqID_91718
  Subcellular localization annotation: CTP_CleavageSite=29; ConfidenceScore=5.36e-01
MKKIKDSRKHKSYPKSSKVISRKQRRLVKFDNVKPMTRKMPRHTCNVQTEFRNSYLAIAMSHIDLGEN

SEQ ID NO: 208497 - protein, 152 aa, Glycine max
  Coding DNA Sequence Number=SeqID_91719
  Gene Ontology: Mol. function=RNA-directed DNA polymerase activity; Cellular component=chromatin; Biological process=chromatin assembly or disassembly
MVKGSELDQGCYNSGISLDKVAANAGSRPPWHPLTAPLDATPHAQGIPPEVFFEGATIDQNIIEEDDDKTTKGRCESKRHYSKLIVAMMSSKGRLRNVVRMHSDLVVALEQVQLRELTGSTELIQELVYSLDGKPVADGEGIEGPIVNAKPS

SEQ ID NO: 208498 - protein, 476 aa, Glycine max
  Coding DNA Sequence Number=SeqID_91720
  Gene Ontology: Mol. function=RNA-directed DNA polymerase activity; Cellular component=chromatin; Biological process=chromatin assembly or disassembly
  Pfam annotation: Domain name=RVP; Domain location=350-454; Score= -9.3; E_value=0.032; Accession=PF00077.10; Description=Retroviral aspartyl protease
  Pfam annotation: Domain name=RVP_2; Domain location=344-468; Score= -56.1; E_value=0.023; Accession=PF08284.2; Description=Retroviral aspartyl protease
  Pfam module annotation: Pfam domain module=RVP::RVP_2::Retrotrans _gag; Domain location=350-454::344-468::108-198
MADTSHPSNNSDDLKEAILCLTHHQQSLDETMQTMTLRIDDLLSRLPPFLPPHQPFASLPPPTPPQPASNHRIKLEVPRFDGSDPLGWIFKINQFFEYHGTPKPEHLTVASFYMDGRALAWFQWMTGNGQFTLWPVFLQALQTRFAHTQYEDPTEALLKLTQRGTVAQYLFEFEDLANRIIGLPAPFLLSCFISGLTPEIRHEVQAHQPLTLVQAAGLARLQEEKILDTRSTPRSRAPPQPLSPFPPPPRAPPPPPHTSLPPPPGRPMPPTVKRLPQEEIASRRERGLWFNCDDKFHRGHRCASRAFLLITKDDNPSLPHIEAYDPLPEPLDPMDPYPTQISFNCLAGHVAPETLRFLGLVGGQAVVLLVDEGSTYNFIQQHLVTRLGLSPCPTTPLRVMVGNGQQLECTCVYEAILVEIQETKFIVDLHVLPISGANAVLGVQWLKALGPVLTDYNSLTMKFFHDGRFVELKGDT

SEQ ID NO: 208499 - protein, 488 aa, Glycine max
  Coding DNA Sequence Number=SeqID_91721
  Gene Ontology: Mol. function=transmembrane receptor activity; Cellular component=membrane; Biological process=defense response
  Homolog annotation: Hit_ID=Q1SI46; Match level="QueryCoverage=98%, HitCoverage=46%, E-value=1e-125, Identity=50%"; Hit description =Leucine Rich Repeat, putative
  Pfam annotation: Domain name=LRR_1; Domain location=237-258; Score =1.0; E_value=1.9e+02; Accession=PF00560.23; Description=Leucine Rich Repeat
  Pfam annotation: Domain name=LRR_1; Domain location=260-281; Score =5.2; E_value=31; Accession=PF00560.23; Description=Leucine Rich Repeat
  Pfam annotation: Domain name=LRR_1; Domain location=283-305; Score =5.8; E_value=23; Accession=PF00560.23; Description=Leucine Rich Repeat
  Pfam annotation: Domain name=LRR_1; Domain location=307-326; Score =10.0; E_value=3.9; Accession=PF00560.23; Description=Leucine Rich Repeat
  Pfam annotation: Domain name=LRR_1; Domain location=330-355; Score =8.6; E_value=7; Accession=PF00560.23; Description=Leucine Rich Repeat
  Pfam annotation: Domain name=LRR_1; Domain location=374-395; Score =7.8; E_value=9.9; Accession=PF00560.23; Description=Leucine Rich Repeat
  Pfam annotation: Domain name=LRR_1; Domain location=397-422; Score =13.4; E_value=0.84; Accession=PF00560.23; Description=Leucine Rich Repeat
  Pfam annotation: Domain name=LRR_3; Domain location=237-256; Score =27.3; E_value=5.6e-05; Accession=PF07725.3; Description=Leucine Rich Repeat
  Pfam module annotation: Pfam domain module=LRR_1::LRR_1::LRR_1::LRR _1::LRR_1::LRR_1::LRR_1::LRR_3; Domain location=237-258::260-281::283- 305::307-326::330-355::374-395::397-422::237-256
QKHPEIEYYELSKKVVDYAKGIPFVLKLLGHRLHGKEKEIWESQLEGQNVQTKKDEKKILMDIACFFYGLRLEVKRIKLLLKDHDYSVASGLERLKDKALISISKENMVSMHDIIKETAWQIAPQESIEDPRSQIRLFDPDDVYQVLKYNKGNEAIRSIVVNLLRMKQLRLNPQVFTKMNKLHFLNFYSVWSSSTFLQDPWGLYLSQGLESLPNELRYLRWTHYPLESLPSKFSAENLVELHLPYSRVKKLWLKVPDLVNLKVLKLHSSAHVKELPDLSTATNLEIIGLRFCVGLTRVHPSVFSLKKLEKLDLGGCTSLTSLRSNIHMQSLRYLSLHGCLELKDFSVISKNLVKLNLELTSIKQLPLSIGSQSMLKMLRLAYTYIETLPTSIKHLTRLRHLDLRYCAGLRTLPELPPSLETLDVRECVSLETVMFPSIPQQRKENKKKVCFWNCLQLDEYSLMAIEMNAQINMVKFAHQHLSTFRDAQ

SEQ ID NO: 208500 - protein, 589 aa, Glycine max
  Coding DNA Sequence Number=SeqID_91722
  Gene Ontology: Mol. function=DNA binding; Cellular component=nucleus; Biological process=regulation of transcription
  Homolog annotation: Hit_ID=Q6YZ61; Match level="QueryCoverage=82%, HitCoverage=72%, E-value=1e-30, Identity=42%"; Hit description=MYB transcription factor-like
  Pfam annotation: Domain name=Myb_DNA-binding; Domain location=474 -524; Score=26.3; E_value=0.00011; Accession=PF00249.21; Description =Myb-like DNA-binding domain
MGSTRMGQVQILNQLSTFSPLDHRHIVLGALPSCVNILVKEEEKHRISCGSPVHSHENIDSQCSADKFPVMDGKVQSETPCQEIPSIASSFNYTHSNQSGSIDQCSRPSEGVIESGSSASAVYSNLKSDISMSDGEICLDKLSIRELHELFKVTFGRETTVKDKQWLKRRIAMSLTNSCDVSATTFIIKDNKIVRKFEEDSSGNMNAGSLISSENMTEEDVNFKDSSAVDACGIDDNQVVSETRSENGLEYENYQTGQRAAKRIRRPTKRYIEELSENESREHNPRLSISNKTVGFGHVSPTSNVRPARNAFSEARTYSTRLDSLGGSNVQIPCVSRVRRSRPRKDIASLMHLGNVPLVLHVFPVVPFYSCCVFPEKFHPTGMGEAEKLSNKLLEHSSDAGSDFSDKVLKSRMPAKFHQPSSSEPVKEQCPVICPIELRQELRPKRADPSGHTSDDNNIVTVPTAKGGMRRKHHRAWTLVEVIKLVEGVSRCGAGRWSEIKRLSFASYSYRTSVDLKDKWRNLLKASFALAPADEGINSRKHGTAPIPEKILLRVRELAEMNSQVPPNYSSSQLASGGGSVHGDRSGYL

SEQ ID NO: 208501 - protein, 446 aa, Glycine max
  Coding DNA Sequence Number=SeqID_91723
  Gene Ontology: Mol. function=nucleotide binding; Cellular component =intracellular; Biological process=signal transduction
  Homolog annotation: Hit_ID=Q5W796; Match level="QueryCoverage=96%, HitCoverage=96%, E-value=0.0, Identity=80%"; Hit description =Putative GTP binding protein
  Pfam annotation: Domain name=Dynamin_N; Domain location=112-220; Score=-22.6; E_value=0.0011; Accession=PF00350.13; Description =Dynamin family
  Pfam annotation: Domain name=MMR_HSR1; Domain location=110-221; Score= 119.8; E_value=7.9e-33; Accession=PF01926.13; Description=GTPase of unknown function
  Pfam annotation: Domain name=TGS; Domain location=337-413; Score =131.4; E_value=2.5e-36; Accession=PF02824.11; Description=TGS domain
  Pfam module annotation: Pfam domain module=Dynamin_N::MMR_HSR1::TGS; Domain location=112-220::110-221::337-413
MGIIEKIKEIEAEMARTQKNKATEYHLGQLKAKIAKLRTQLLEPPKLRLGFGPQSQPNVGCINHCTQDVLALHMIQFTIQDYENDFIHFSSSPGSSGGGEGFEVTKFGHGRVALIGFPSVGKSTLLTMLTGTHSEAASYEFTTLTCIPGIIHYNDTKIQLLDLPGIIEGASEGKGRGRQVIAVAKSSDIVLMVLDASKSEGHRQILTKELEAVGLRLNKRPPQIYFKKKKTGGISFNSTLPLTHVDEKLCYQILHEYKIHNAEILFREDATVDDLIDVIEGNRKYMKCVYVYNKIDVIGIDDVDRLARQPNSVVISCNLKLNLDRLLARMWDEMGLVRVYTKPQGQQPDFGDPVVLSADRGGCTVEDFCNHIHRSLVKDVKYVLVWGISARHYPQHCGLSHNLRDEDVVQIVKKKEKEEGGRGRFKSHSNAPARISDREKKAPLKT

SEQ ID NO: 208502 - protein, 98 aa, Glycine max
  Coding DNA Sequence Number=SeqID_91724
MKSQHLKNHDQYEEGEEEEEEEEVEERDKSMRKAIEKVDSVGTGILGKHNDQQHTYFYLFFPLSPKQASKRKGWVCIRFQRPIKRHHQHILFSLTSLS

SEQ ID NO: 208503 - protein, 1479 aa, Glycine max
  Coding DNA Sequence Number=SeqID_91725
  Gene Ontology: Mol. function=helicase activity
  Homolog annotation: Hit_ID=Q1SF68; Match level="QueryCoverage=94%, HitCoverage=99%, E-value=0.0, Identity=80%"; Hit description=AAA ATPase; DEAD/DEAH box helicase, N-terminal
MGSRGRPLFDLNEPPAEDNDEREGIVCFQPQKTHPSTNPHTSDLFATSSAAQGIINNHAFSHASSVSGFQPFVRPKSTGVPELDAESKTAGDQDAKVSSKDEVRVMDSRILSSANAQSTEREEGEWSDEEGGFANANGGNNAIANGGNNAIANGGNNLPQRSQASEEPATSGMVDGGVAVASDSKSRNIKSSDSINDEKSSHASIGLESNSSEQKSNSIPNLESNIKSEASIDAQEEPPLIPKPKEVKGIEASHALRCANNPGKRRIDQRKEEMLGKKRNRQTMFLNLEDVKQAGPIKTSTPRRQTFSSPVISRTIKEVRTVPAQVERVGIAKDQKLTDTSSAEGGNHAEAQEPKSDCNGDTSGPLVRSRRLNSETEPPTEGNLPPIPRQGSWKQLSDSRQQKNVFHSNRKSGLSGQSSNDVKLVNKKHLSIKKQTPISSQSQDTSVERLIREVTSEKFWHHPEETELQCVPGRFESVEEYARVFEPLLFEECRAQLYSTWEESTETVSRDTHIMVRVKANESRERGWYDVKVLPVHEFKWSFKEGDVAILSSPRPGSVRSKQNSSSLAQDDGESEVTGRVVGTVRRHIPIDTRDPPGAILHYYVGDSYDPSRQVFVQIFPLKGSFDDCVDMVDDDHIIRKLQAGSIWYLTVLGSLATTQREYIALHAFRRLNLQMQTAILQPSPEHFPKYEQQTPAMPECFTQNFVEYLRRTFNEPQLAAIQWAAMHTAAGTSSGTTKRQEPWPFTLVQGPPGTGKTHTVWGMLNVIHLVQYQHYYTSLLKHVAPESYKQVNEINSDNAPTGSIDEVLQNMDQNLLRTLPKLVPKPRMLVCAPSNAATDELLARVLDRGFIDGEMKVYRPDVARVGVDSQTRAAQAVSVERRTEQLLVKSREEIMGWMHQLKNREAQLVQQLHGLHRELNATAAAVRSQGSVGVDPDLLMARDQNRDALLQNLAAVVENRDKVLVEMSRLALLESRFRPGSGFNLEEARASLEASFANEAEIVFTTVSSSGRKLFSRLSHGFDMVVIDEAAQASEVAILPPLSLGAARCVLVGDPQQLPATVISKAAGTLMYSRSLFERFQQAGCPTMLLSVQYRMHPQIRDFPSRYFYQGRLTDSESVAKLPDEPYYKDPLLRPYIFYDIRHGRESHRGGSVSYQNIHEAQFCLRLYEHVQKTVKSLGLGKITVGIITPYKLQLKCLQREFDEVLNSEEGKDLYINTVDAFQGQERDVIIMSCVRASSHGVGFVADIRRMNVALTRARRALWVMGNANALLQSEDWAALINDAKSRNCYMDMDSLPKDFLVSKAPVYTSLPGKPSSNMRGMRSGGPRYRSMDMHMESRLGPPSEDDENMGAPVSSRNGNHRQLRYSMENSLDDVEHGGDKSRDAWQYGIQKKHNSSGTMGKRDRFGQILGLSAKLYEPHEILSLGRGGEEHAMLDKPNLLSYLAHMLVLVLTNLGHIAGWMCWGKTAEICKPYFYME

SEQ ID NO: 208504 - protein, 193 aa, Glycine max
  Coding DNA Sequence Number=SeqID_91726
  Gene Ontology: Mol. function=acetylglucosaminyltransferase activity; Cellular component=membrane; Biological process=electron transport
  Homolog annotation: Hit_ID=Q1SQ47; Match level="QueryCoverage=88%, HitCoverage=43%, E-value=3e-87, Identity=84%"; Hit description =Glycosyl transferase, family 14
MNQPSNILLLTWYHSECPPKSSGSAWTILSRSFAEYCIVGWENLPRTLLLYYTNFVSSPEGYFQTVICNSEDYKNTTVNHDLHYITWDNPPKQHPRSLGLKDYRRMVLTSRPFARKFKRNDPVLDKIDRDLLKRYHGKFSYGGWCSQGGKYKACSGLRTENYGVLRPGPSSRRLKNLLTKLLSDKFFHKQQCR

SEQ ID NO: 208505 - protein, 109 aa, Glycine max
  Coding DNA Sequence Number=SeqID_91727
MHFLITFIRTELARLPYQQCHGMQEMTLDLCLPLLKRQEEQIAAGKIILPKRTNKQKRTVGKLPEKKNRIVFGKAEFHNIVDPTNFQIEEMFCRDKPGSISRCTESVSR

SEQ ID NO: 208506 - protein, 59 aa, Glycine max
  Coding DNA Sequence Number=SeqID_91728
  Subcellular localization annotation: CTP_CleavageSite=33; ConfidenceScore=5.21e-01
MGMMGSPNLTSQLRANGAMVYAQQLRMSQGQIRQQLSQQGSLNTAQSRSVVFMIFQDVV

SEQ ID NO: 208507 - protein, 112 aa, Glycine max
  Coding DNA Sequence Number=SeqID_91729
  Gene Ontology: Cellular component=transcription factor TFIID complex; Biological process=transcription initiation
  Homolog annotation: Hit_ID=Q1SF84; Match level="QueryCoverage=97%, HitCoverage=19%, E-value=4e-23, Identity=53%"; Hit description =Histone-fold
MNHKNLADLSVCPVILRRENWDLKIPGYSSEEKKNQNKPLLNDLHKRRLDMVRTLMESLPSESSVNSSKEMSIQGISNPPPVGTHHLVRPLSSEQLISHAAGSQMLQQMTRF

SEQ ID NO: 208508 - protein, 97 aa, Glycine max
  Coding DNA Sequence Number=SeqID_91730
  Gene Ontology: Cellular component=transcription factor TFIID complex; Biological process=transcription initiation
  Homolog annotation: Hit_ID=Q1SF84; Match level="QueryCoverage=60%, HitCoverage=10%, E-value=1e-10, Identity=62%"; Hit description =Histone-fold
  Pfam annotation: Domain name=TFIID_20kDa; Domain location=38-94; Score=7.5; E_value=0.00049; Accession=PF03847.4; Description =Transcription initiation factor TFIID sub
  Subcellular localization annotation: CTP_CleavageSite=15; ConfidenceScore=5.16e-01
GQKSLSLTGSLPDATASGATTPGGSSSQGTEATNQVLGKRKIQDLVGQVDPQGRLNPEVIDLLLELADDFLDSGDPFWDQKGNGRVTSRGIKSLTQQ

SEQ ID NO: 208509 - protein, 63 aa, Glycine max
  Coding DNA Sequence Number=SeqID_91731
MVGQLIVNVIEGEKRKQGRNRQKKLILDSLVETSGGRDVWWKRDMVHGGSGGGGVIRFQGFEK

SEQ ID NO: 208510 - protein, 87 aa, Glycine max
  Coding DNA Sequence Number=SeqID_91732
  Gene Ontology: Mol. function=DNA binding; Cellular component=nucleus; Biological process=regulation of transcription, DNA-dependent
  Homolog annotation: Hit_ID=Q9ATD3; Match level="QueryCoverage=99%, HitCoverage=32%, E-value=1e-41, Identity=88%"; Hit description =GHMYB36
  Pfam annotation: Domain name=Myb_DNA-binding; Domain location=14-61; Score=43.2; E_value=8.6e-10; Accession=PF00249.21; Description=Myb -like DNA-binding domain
MGRSRCCSKEGLNKGAWTALEDRILTEYINIHGEGKWRHLPKRAGLKRCGKSCRLRWLNYLRPGIKRGNITNDEEELIIRLHNLLGN

SEQ ID NO: 208511 - protein, 70 aa, Glycine max
  Coding DNA Sequence Number=SeqID_91733
MGLTLNDGCRFSPDGSAESKTCTERFIIAHASYSINLAILSWLDPLNALNNGKNLKCVETQYLWYCWCNS

SEQ ID NO: 208512 - protein, 90 aa, Glycine max
  Coding DNA Sequence Number=SeqID_91734
MPPHKNIHTHINISMSTKANLIRALKISVVKRSTKVQHIKETMHNVNVMGVLVIKKIDGTLKIKTLEFGVTETMNSGVDVRRMLTGTRQQ

SEQ ID NO: 208513 - protein, 920 aa, Glycine max
  Coding DNA Sequence Number=SeqID_91735
  Gene Ontology: Mol. function=nucleoside-triphosphatase activity; Cellular component=membrane; Biological process=defense response
  Homolog annotation: Hit_ID=Q1SI25; Match level="QueryCoverage=95%, HitCoverage=99%, E-value=0.0, Identity=67%"; Hit description=NB-ARC domain, putative
  Pfam annotation: Domain name=LRR_1; Domain location=435-457; Score =0.2; E_value=2.6e+02; Accession=PF00560.23; Description=Leucine Rich Repeat
  Pfam annotation: Domain name=LRR_1; Domain location=478-499; Score =0.0; E_value=2.8e+02; Accession=PF00560.23; Description=Leucine Rich Repeat
  Pfam annotation: Domain name=LRR_1; Domain location=501-522; Score =11.6; E_value=1.9; Accession=PF00560.23; Description=Leucine Rich Repeat
  Pfam annotation: Domain name=LRR_1; Domain location=524-546; Score =8.2; E_value=8.2; Accession=PF00560.23; Description=Leucine Rich Repeat
  Pfam annotation: Domain name=LRR_1; Domain location=548-570; Score =4.1; E_value=49; Accession=PF00560.23; Description=Leucine Rich Repeat
  Pfam annotation: Domain name=LRR_1; Domain location=572-594; Score =11.1; E_value=2.4; Accession=PF00560.23; Description=Leucine Rich Repeat
  Pfam annotation: Domain name=LRR_1; Domain location=596-617; Score =4.3; E_value=44; Accession=PF00560.23; Description=Leucine Rich Repeat
  Pfam annotation: Domain name=LRR_3; Domain location=478-497; Score =16.8; E_value=0.078; Accession=PF07725.3; Description=Leucine Rich Repeat
  Pfam annotation: Domain name=NACHT; Domain location=89-242; Score= -9.0; E_value=0.00028; Accession=PF05729.3; Description=NACHT domain
  Pfam annotation: Domain name=NB-ARC; Domain location=50-345; Score =133.6; E_value=5.4e-37; Accession=PF00931.13; Description=NB-ARC domain
  Pfam module annotation: Pfam domain module=LRR_1::LRR_1::LRR_1::LRR _1::LRR_1::LRR_1::LRR_1::LRR_3::NACHT::NB-ARC; Domain location=435 -457::478-499::501-522::524-546::548-570::572-594::596-617::478 -497::89-242::50-345
MHCVIPMSNTHLSKSNYNFLLKFPSDFCAYMQTPFPYRNESEAIKSIVENVTHLLDKRELFVADNPVGVEPRVQEMIQLLDLKSSNHVLLLGMWGMGGIGKTTTAKAIYNKIGRNFEGRSFLAHIREVWGQDTGKICLQKQILFDICKQTETIHNVESGKYLLKQRLCHKRVLLVLDDVSELEQLNTLCGSREWFGRGSRIIITSRDKHILRGKGVDKVYIMKGMDERESIELFSWHAFKQESLPEDFIELSANLIEYSGGLPLALEVLGCYLFDMEVTEWKTVLQKLKRIPNCQVQKKLKISYDGLSDDTEREIFLDIACFFIGMDRNDVICILNGCGLFAEHGIRVLVERSLVTVDDKNKLGMHDLLRDMGREIIRAKSPKEPEERSRLWFHEDVLDVLSKETGTKAVEGLTLMLPRTNTKCLSTTAFKKMKKLRLLQLAGVQLAGDFKNLSRDLRWLCWHGFPLKCIPTDFYQGSLVSIELENSNVKLLWKETQLMEKLKILNLSHSSNLTQTPDFSNLPNLEKLILIDCPRLSKVSHTIGRLKEVVMINLKDCVSLRNLPRSIYKLKSLKTLILSGCLMIDKLEEDLEQMKSLTTLIADNTAITRVPFSLVRSRSIGYISLCGHEGFSRDVIPSIIWSWMSPTKNPSCLVQSYVGMSSLVSLNIPNSSSQDLSTISKDLPKLRSLWVDCSSKPQLSRDTRIILDALYATTNLGELESTATTSQVPNIKTSALIECNSQNMTTSGCYYGLLPGDNYPDWLTFNFDGSSVTFDVPRVNGRNLKTMMCIIHCFTPDNFTSDGLKNVLIINHTKNTIQLYKRDTLVSFEDEEWHIVVSNIEPGNNVEVIVVFENRFIVKKTTVYLIYDEPIDKKLEYCHASDKNVIVSSGDENISTVRWISLQEEPTNDFKQKQKRRKIE

SEQ ID NO: 208514 - protein, 248 aa, Glycine max
  Coding DNA Sequence Number=SeqID_91736
  Gene Ontology: Cellular component=chloroplast thylakoid membrane
  Subcellular localization annotation: CTP_CleavageSite=25; ConfidenceScore=5.25e-01
MIALKAIQASSFALHHNNVRLPHTRASSVLCFCSKSNKNEPDNSQPPPEGDAQSQELLAQIAMLQTQKVRLTDFLDERSAYLAQFGEEAKAEFDKIGEDALKGLDEAGARITANIESQMLEFEESTELNRLEIEESENKIVEFEGQMEKDRNEGLFFKNLGQKAPVYKAKAKEEEEVEKIKDVNSESSGSKTRKNVYLFFIGLLTFGIVDSLASSSGADWKKVAVLGGILVVLFSLFINEQNKDNKKD

SEQ ID NO: 208515 - protein, 197 aa, Glycine max
  Coding DNA Sequence Number=SeqID_91737
  Homolog annotation: Hit_ID=Q1T034; Match level="QueryCoverage=39%, HitCoverage=13%, E-value=4e-08, Identity=39%"; Hit description=Zinc finger, CCHC-type
MELNTKAKYTLTFALSKYQYNKICRLRTAKEIWDSLSINYDDIEDVRMRKVVTMTRHYENFIMNGGEFMDNMFRRLQAQINMKALDNFPKDDSDGEKSINSDDEQPNIYLMADTDDKVEVKSYSESDTSSCASSDDEEDMPYDVLLQDEVQVENWHALGKGTGFSVIYRDSKGQPMAVATLSIPHSYAIKVAESLAF

SEQ ID NO: 208516 - protein, 37 aa, Glycine max
  Coding DNA Sequence Number=SeqID_91738
MTTGRELLGAKCEALLANTEISLEAKEAVSRTIAMIS

SEQ ID NO: 208517 - protein, 191 aa, Glycine max
  Coding DNA Sequence Number=SeqID_91739
MDSAFSSLGFVIFGISISFYAFIVQSLTQNGNNGAELAPPAYWVSSPPSPPTPPLLSPYPPPPPSQSKTLRPGALPPHPNNRPNVRRPPPPHRRHHHRRPPPPPPPPPPHTMNAGKKVGLLFVGIAAIMQVGVVGFLANIGWILQNLGGRNMKKKASMERHGGFEESLEHELCNLMPSFRPPWRYCVYWYC

SEQ ID NO: 208518 - protein, 393 aa, Glycine max
  Coding DNA Sequence Number=SeqID_91740
  Homolog annotation: Hit_ID=Q1SF91; Match level="QueryCoverage=59%, HitCoverage=100%, E-value=5e-77, Identity=65%"; Hit description =Transcription activator-related
  Pfam annotation: Domain name=QLQ; Domain location=12-48; Score=66.2; E_value=1e-16; Accession=PF08880.1; Description=QLQ
  Pfam annotation: Domain name=WRC; Domain location=78-123; Score =101.5; E_value=2.5e-27; Accession=PF08879.1; Description=WRC
  Pfam module annotation: Pfam domain module=QLQ::WRC; Domain location =12-48::78-123
MMSASAGARNRSPFTQIQWQELEQQALVFKYMVTGTPIPPDLIYSIKRSLDTSISSRLFPHHPIGWGCFEMGFGRKVDPEPGRCRRTDGKKWRCSKEAYPDSKYCERHMHRGRNRSRKPVEVSSATSTATNTSQTIPSSYTRNLSLTNNSNPNITPPPPPSSFPFSHLPSSMPIDQSQPFSQSYQNSSLNPFFYSQSTSSRPPDADFPPQDATTHHLFMDSAGSYSHDEKNYSLVLNRANCYDVLYLLILDSRHVHGIREDVDERAFFPEASGSARSYTDSYQQLSMSSYKSYSNSNFQNINNDATTNPRQQEQQLQQQQHCFVLGTDFKSTRPSKEKEAETTTGQRPLHRFFGEWPPKNTTTDSWLDLASNSRIQTGDDPASSSLLSLSHPF

SEQ ID NO: 208519 - protein, 75 aa, Glycine max
  Coding DNA Sequence Number=SeqID_91741
MNDAGWDSASKRLSGRRKFGVVCLQLKALDFLPRGWQKVSGKCTLRGFKIIASFPLTGYGFRLAYLSICTSTLHV

SEQ ID NO: 208520 - protein, 91 aa, Glycine max
  Coding DNA Sequence Number=SeqID_91742
MFNEFWRVATNPDGTTVALAKVQWSCNEMRGHHHGLCLILAHWLWWRSVISFKKLVEAIELEWCIGILWPARGAMRRGRNRVGGGAVRDGN

SEQ ID NO: 208521 - protein, 105 aa, Glycine max
  Coding DNA Sequence Number=SeqID_91743
  Gene Ontology: Mol. function=protein dimerization activity
  Homolog annotation: Hit_ID=Q1SR56; Match level="QueryCoverage=54%, HitCoverage=27%, E-value=7e-09, Identity=44%"; Hit description=HAT dimerisation
MTKEKNQFVIPFKPSNPSNSFLIPGVKYFNERMREIIATDVIVHEYLFGIVDDEVWMWAFQYGNPDFQKALLKTVNKISLTTDMWKSSHQAVGYMVVTGHFIDVE

SEQ ID NO: 208522 - protein, 252 aa, Glycine max
  Coding DNA Sequence Number=SeqID_91744
  Gene Ontology: Mol. function=protein dimerization activity; Biological process=regulation of transcription, DNA-dependent
  Homolog annotation: Hit_ID=Q1SR56; Match level="QueryCoverage=80%, HitCoverage=94%, E-value=3e-43, Identity=47%"; Hit description=HAT dimerisation
  Pfam annotation: Domain name=hATC; Domain location=141-227; Score =101.2; E_value=3e-27; Accession=PF05699.5; Description=hAT family dimerisation domain
MREIEEKAYGEQDPLYTYAPSNEDWEKVLKVCKLLEVFNLATHIISGTEYPIANLFLAEVWRAKQLEEIVKENVKKVQNALQQLYDEYVALNNEESSSNERNVGGINSSSVHLPYTSSMIGFDQLMSLMHEKEIVPPMKSELDAYLEKKNTYIPNNGNSSFSALEWWRNNNFKYKILSKKARDILAVPISIVASESTFSAGGRVIDEYRSRLNEESIEALICDEDWIRHNYNLKRKTKVDDQPLEEITLKIS

SEQ ID NO: 208523 - protein, 229 aa, Glycine max
  Coding DNA Sequence Number=SeqID_91745
  Gene Ontology: Mol. function=nutrient reservoir activity; Cellular component=apoplast; Biological process=auxin mediated signaling pathway
  Homolog annotation: Hit_ID=Q9M3Y4; Match level="QueryCoverage=52%, HitCoverage=59%, E-value=5e-55, Identity=88%"; Hit description =Germin-like protein
  Pfam annotation: Domain name=Cupin_1; Domain location=1-119; Score =58.0; E_value=3e-14; Accession=PF00190.13; Description=Cupin
  Pfam annotation: Domain name=Cupin_2; Domain location=9-84; Score =22.4; E_value=0.0016; Accession=PF07883.2; Description=Cupin domain
  Pfam module annotation: Pfam domain module=Cupin_1::Cupin_2; Domain location=1-119::9-84
VNGLGVSAARLDIAKGGSIPMHTHLAATELLIMVQGQISAGFMTPTALYTKTLKPGDIMVFPQGQLHFQVNSGNGKTTAFLAFSGANPEAQLLDLLLFGNSLPSELVAQTTFLEVEQVKKVKARFGGRGLKEGRGEEKERGERNFDYTFYLVKKRGEIIKEKEQAIAPFPSSSETLTTRRRREHHRHRRIQRNVVLFNGATLEAENVMDLIKLKFRQRLSWWQRSRECI

SEQ ID NO: 208524 - protein, 75 aa, Glycine max
  Coding DNA Sequence Number=SeqID_91746
MNEKLWDGTQKPSNISVNLALQHLYDWKQIHSCIRHSRGNFIAARTQCYQGRSFTSGSRGNSIAYSDGNEQKSIS

SEQ ID NO: 208525 - protein, 541 aa, Glycine max
  Coding DNA Sequence Number=SeqID_91747
  Gene Ontology: Mol. function=mating pheromone activity; Cellular component=nucleus; Biological process=regulation of transcription, DNA-dependent
  Homolog annotation: Hit_ID=Q4VYC8; Match level="QueryCoverage=97%, HitCoverage=98%, E-value=0.0, Identity=68%"; Hit description =Nodulation signaling pathway 1 protein
  Pfam annotation: Domain name=GRAS; Domain location=129-446; Score =240.3; E_value=4.2e-69; Accession=PF03514.5; Description=GRAS family transcription factor
MEPNPTSDHSLDWFEGSVSYFPPLLDYPYDSGDIQDYQLWEQDITSHYQTDTNTSSSPNATNISTTTTPLETCDSNNNLPLSDLPKKRNATDESSPKPPQNHKHKKIKSKPINNEAYTGHAEGTTTTTVRKSGGNKKGGAKANGNNCNNKDGRWAEQLLNPCAAAITGGNLNRVQHLSYVLHELASPTGDANHRLAAHGLKALTQHLSSSPSSGSITFASSEPRFFQKTLLKFYEVSPWFSFPNNIANASILQVLGEDTDNNSRTLHILDIGVSHGMQWPTFLEALSRRPGGPPPLVRLTVVTASSSTENDTPFCIGPPGDNFSSRLLGFAQSMNVNLQINKLDNCPLHTLNAQSVDTSPDEIFVVCAQFRLHQLNHNAPDERSEFLKVLRNMEPKGVILSDNNMGCCCNCCGDFTTGFSRRVEYLWRFLDSTSSAFKGRESDERRVMEGEAAKALTNQRETNEGKEKWCERMKEAGFVGEVFGEDAIDGGRALLRKYDGNWEMKVEDDNTSVGLWWKGQSVSFCSLWKLDGNYKTSTFTS

SEQ ID NO: 208526 - protein, 160 aa, Glycine max
  Coding DNA Sequence Number=SeqID_91748
  Gene Ontology: Mol. function=nutrient reservoir activity; Cellular component=apoplast; Biological process=auxin mediated signaling pathway
  Homolog annotation: Hit_ID=Q9M3Y4; Match level="QueryCoverage=99%, HitCoverage=100%, E-value=6e-36, Identity=42%"; Hit description =Germin-like protein
  Pfam annotation: Domain name=Cupin_1; Domain location=52-150; Score= -7.5; E_value=0.0024; Accession=PF00190.13; Description=Cupin
MVLILFFLALISSTSHASNFNDFCVADLKAPESPSGYPCLPPNTLTADNFVFTLQLPNTTNPLLKAGINTAFVNDFPALNGLGVSAARVVIEKDGFFPLHTHSDATELIITVEVFSSSNPDVQLFNDIFANNVPSHILAQTTFLDVAQVKKLKARFGGSG

SEQ ID NO: 208527 - protein, 66 aa, Glycine max
  Coding DNA Sequence Number=SeqID_91749
MSERNVLIAKNYGILSNILHLRLLEQTTFTILWNRNRVRYVCVRAPLSSTIAQELFIDFVFLFRVR

SEQ ID NO: 208528 - protein, 35 aa, Glycine max
  Coding DNA Sequence Number=SeqID_91750
MVEKGDSGVWKQGTIDVAVIFRLEKAVISSLENGE

SEQ ID NO: 208529 - protein, 275 aa, Glycine max
  Coding DNA Sequence Number=SeqID_91751
  Homolog annotation: Hit_ID=Q4VYC7; Match level="QueryCoverage=56%, HitCoverage=93%, E-value=1e-46, Identity=73%"; Hit description =Coiled-coil-helix-coiled-coil-helix domain containing protein
MAVEMVVGIFQVSSKKSYGFKEYRDEEEEKTTIENWVQSLNARESELRAQKSRFRMGQTESAEAVAETQTTTHHSSNPTSVESVLVEAAEYGNQNTESVEEMTQKALECPCVADLRTGSSGSQFSEAFLCFVKSTSEEKPGYRDYFNVGMIKSSVVICKARTVYIHLLHCRAASRLIQMHSLRTFWAKPKMKARSWSQFKNIKYFLPNGLGDEDMFKSKGKDPLEGLGGPMTRARARKAKEALQQVLSILFESKPKFQGEKSKVVSCIMAQMEED

SEQ ID NO: 208530 - protein, 715 aa, Glycine max
  Coding DNA Sequence Number=SeqID_91752
  Gene Ontology: Mol. function=catalytic activity; Biological process =guanosine tetraphosphate metabolic process
  Homolog annotation: Hit_ID=Q76JT3; Match level="QueryCoverage=99%, HitCoverage=99%, E-value=0.0, Identity=77%"; Hit description=RelA -SpoT like protein PsRSH1
  Pfam annotation: Domain name=HD; Domain location=235-339; Score=40.3; E_value=6.7e-09; Accession=PF01966.12; Description=HD domain
  Pfam annotation: Domain name=RelA_SpoT; Domain location=429-539; Score=172.2; E_value=1.3e-48; Accession=PF04607.7; Description =Region found in RelA  SpoT proteins
  Pfam module annotation: Pfam domain module=HD::RelA_SpoT; Domain location=235-339::429-539
  Subcellular localization annotation: CTP_CleavageSite=75; ConfidenceScore=5.43e-01
MAVSTIALYASPPSSVCSTPHQINAHASYDFELGSRSSSPAGSTAPPSTSQKPVMGGLSCLFSSPAPAVKHAPPLSSNFSGEEDEMKELSSSFSYSPSKFAGSSWKRDQSPVSVFHGPVSCSSSGRSSTGSSSRIRSFRGGTSGLFDGFVRNALGSSCLDYDLDAGDSSAMIDELTFNLEDNFVEGGFHFEPYAKKLLLGAQMRHKIFCEEFVIKAFCEAEKAHRGQMRASGDPYLQHCLETAVLLALIGANSTVVAAGLLHDSLDDAFLTYDYIVGMFGAGVADLVEGVSKLSHLSKLARENNTASKSVEADRLHTMFLGMADARAVLIKLADRLHNMMTLDALPVAKRQRFAKETLEIFAPLANRLGISTWKEQLENLCFKHLNPSHHEELSSKLVESYDDAMITSAIERLEEALKDEGISYNVISGRHKSLYSVYCKMLKKKLTIDDIHDIYGLRLIVDKEEDCYKALTVVHRLWSEVPGKLKDYICRPKFNGYQSLHTVVMGEGKVPLEVQIRTKDMHLQAEFGFAAHWRYKEDDCQHSSFVLQMVEWARWVVTWQCEAMSRDCSSVGYADSVNPPCKFPSHADDCPYSYKPDCGQNGPVFVIMIENDKMSVQEFSANSTVLDLLKRSGRASSRLTTYRFPLKEELRPRLNHKPVSDPNSKLKMGDVIELTPAIPDKSLTEYREEIQRMYDRGLTVSSMGTAASTMVGSRS

SEQ ID NO: 208531 - protein, 115 aa, Glycine max
  Coding DNA Sequence Number=SeqID_91753
  Subcellular localization annotation: CTP_CleavageSite=49; ConfidenceScore=5.11e-01
MEHHEKKQGSEWLSALHSRLQNYNQNQHSSMSAPTTMYHTTCTSIELSRSVSGKVRFCELKIPKSKEHSANSKFPKAKNTAPRRTQRHKVDRTGYKNPFAGFGGFGTFRPLWMDC

SEQ ID NO: 208532 - protein, 196 aa, Glycine max
  Coding DNA Sequence Number=SeqID_91754
  Gene Ontology: Mol. function=hydrolase activity; Cellular component =nucleus; Biological process=metabolic process
  Homolog annotation: Hit_ID=P0AFQ7; Match level="QueryCoverage=98%, HitCoverage=78%, E-value=2e-72, Identity=66%"; Hit description =Putative deoxyribonuclease ycfH
  Pfam annotation: Domain name=TatD_DNase; Domain location=1-188; Score= 224.6; E_value=2.1e-64; Accession=PF01026.11; Description=TatD related DNase
LVGDRDNIALACGVHPLNQETPYDVEEFRRLAAEEQETKAQQQASFREHIRTGIALDKPIIVHTRDAREDTLAILREEQVERCGGVLHCFTEDKETAAQLLDLGFYISFSGIVTFRNAEQIREAARYVPLDRILVETDSPYLAPVPHRGKENQPAFTRDVAEYMAVVKGVDLATLAAATTENFSRLFKVPMSRLGG

SEQ ID NO: 208533 - protein, 91 aa, Glycine max
  Coding DNA Sequence Number=SeqID_91755
  Gene Ontology: Mol. function=NADH dehydrogenase (ubiquinone) activity; Cellular component=mitochondrion; Biological process =electron transport
  Homolog annotation: Hit_ID=Q42155; Match level="QueryCoverage=67%, HitCoverage=94%, E-value=8e-11, Identity=61%"; Hit description=NADH dehoydrogenase
MNKGLFGVGFLLVLANLLHPLHDELILALFIEVALVLALPGEVELSQPACVAIIFFDDPSTSISSSLIDRLASFYSFFRFNTEEEYSGLEI

SEQ ID NO: 208534 - protein, 697 aa, Glycine max
  Coding DNA Sequence Number=SeqID_91756
  Gene Ontology: Mol. function=nucleic acid binding; Cellular component= chromatin; Biological process=DNA integration
  Homolog annotation: Hit_ID=Q1RWN2; Match level="QueryCoverage=99%, HitCoverage=52%, E-value=0.0, Identity=55%"; Hit description =Peptidase S8 and S53, subtilisin, kexin, sedolisin; Integrase, catalytic region; Zinc finger, CCHC-type
PKVFWPEAAKWTVHVLNRSPTLTVKDKTPEEMWSGIKPKVDYFKVFGCLTHVHVPDQKRTKLDDKSLQCVLLGVSDESKAYRLFDPVARKIIVSRDVSFEEDKGWNWGRTAEEVKHDVLIWEGSNDSEDASSENEEEAVVEGTETAGVTDQDAEATTSTSSDSSNEDASVHATAEGRSRRAPNYLQDYETGEGLSEDEDYFAMFISDDEDYFAMFTSHEDPSSFEEAERDEKWRKAMDLEIEAIKKNETWQLTTLPKGAKKIGVKWVFRTKLNENGEVDKLKARLVAKGYAQQQGIDYNEVFAPVARWDTIRMVLALPAQKGWNVYQLDIKSAFLHGELTEDVYVEQPPGYVRKGEEEKVYKLKKALYGLKQAPRAWYSKIEAYFVKEGFERCDHEHTLFVKTGGGKRILIVSLYVDDLIFTGNDACMFESFKKSMKIEFDMTDLGKMKYFLGVEIQQNSEGIYLSQKKYACELLEKFGLQNCNSVKNPIVPGFKLSKKGEGARIDATAYKQLIGSLMYITVTRPDLMYVVCLLSRYMASPTELHMQAAKRVLRYLKGTVELGVFYKRGDVKDLVAYTDSDYAGDIDDRRSTSGYVFLLSGGAVSWASKKQPVVTLSTAEAEYVAAAVCACQCVWMRKVLEKIGLSQSKDLTKKEVVRLIHCGTSNQVADIMTKPLKLDVFLKLRVQLGVREVSNLN

SEQ ID NO: 208535 - protein, 497 aa, Glycine max
  Coding DNA Sequence Number=SeqID_91757
  Gene Ontology: Mol. function=nucleic acid binding; Cellular component= chromatin; Biological process=DNA integration
  Homolog annotation: Hit_ID=Q1RWN2; Match level="QueryCoverage=99%, HitCoverage=37%, E-value=1e-150, Identity=53%"; Hit description =Peptidase S8 and S53, subtilisin, kexin, sedolisin; Integrase, catalytic region; Zinc finger, CCHC-type
  Pfam annotation: Domain name=zf-CCHC; Domain location=251-268; Score =24.2; E_value=1e-04; Accession=PF00098.13; Description=Zinc knuckle
MSAESSNFVQPAIPKFDGHYDHWAMLMENFLRSKEYWHLVETGIPTVAKGIQSTEAQRKSIEDHKLKDLKAKNYLFQAIDRNIMETILDKGSSKSIWDSMKQKYQGTSRVKRAQLQALRKEFEVLQMKGGEKVEEYFARTLTIVNKMKIYGENITQVMIVEKILRSMTSRFDYVVCSVEESNNLDSLTVDELQSSLLVHEQRMNSHGGDTRDEQALKVSHEEQNGGRGRGRGFGRGRGRGRGRQSPNKATVECFKCHKLGHFQYECPRWKESANYAEIYEEEEMLLMSLVEADNLQQEETWFLDSGCSNHMCGNREWFSTIDEAFRHSVKLGNDSKMEVLGKGNIRLQINGAIHVVTDVYYVPDLKNNLLSVGQLQERGLALLIQDGKCKLYHPRRGLIMQTEMTANRMFVLLASVVLEETSTFLQLATEDSSQLWHGRFGHLSYKGLRTLQHKQMVKGLPFFKDSSKSCPGCFVGKQHRDVIPKKSQWRASHKLQL

SEQ ID NO: 208536 - protein, 184 aa, Glycine max
  Coding DNA Sequence Number=SeqID_91758
  Homolog annotation: Hit_ID=Q1SKD7; Match level="QueryCoverage=90%, HitCoverage=43%, E-value=1e-16, Identity=28%"; Hit description =Ankyrin
MALRKLSTKRSRKDVAAKGTSTAPEFDSHRFRSIEHQQRFEAIKGWSFHRERRVQLRDDEYTDFQEEIARRRWTSLVTPMAKFDSDIVLEFYANAWPTEEGVRDMRSWVRGQWIPFDADALSQFLGYPLVLEEGQECEYSQRRNRADGFDEEAIAQLLCIPGQDFARTVVERRGADHVHQHDYL

SEQ ID NO: 208537 - protein, 62 aa, Glycine max
  Coding DNA Sequence Number=SeqID_91759
MYLRVYLYGGGDNDDDNVDSSDNDIGVNTNGGGADIEIVYWLVMVLMTVVVVVLLRMVIVKC

SEQ ID NO: 208538 - protein, 118 aa, Glycine max
  Coding DNA Sequence Number=SeqID_91760
FIGGPTRRINTNPCLFLLYQLNIFPFTLAFENYTVIYKTKVERKDIDMIDEEEAQIGSDRSSATSNKAEIYNEEARKKTQKHKPKRVESVNELPFIVGKLCRAEQVGTNWGSEVLQVL

SEQ ID NO: 208539 - protein, 70 aa, Glycine max
  Coding DNA Sequence Number=SeqID_91761
MRQVVGRYTQVIIRTKTTSADPDPCIRWQVEIPRVVIRTNTTSVNPYPCVRWQAETPKGYPYTHLCYPDL

SEQ ID NO: 208540 - protein, 125 aa, Glycine max
  Coding DNA Sequence Number=SeqID_91762
MDLEGKGRGIYFGAKSIFAPASIKFGSSLPLLKVLGGGTHILLKLDVVGCHLLHHLLQGRTIPQVWMISLTRITGVGVRIIFLLLRSKWLSRLHGRNIKSPSMVIFHHGDAAGDKGEEVKGDAIH

SEQ ID NO: 208541 - protein, 114 aa, Glycine max
  Coding DNA Sequence Number=SeqID_91763
  Gene Ontology: Mol. function=nucleic acid binding; Biological process= DNA integration
  Homolog annotation: Hit_ID=Q1S9I4; Match level="QueryCoverage=81%, HitCoverage=10%, E-value=5e-15, Identity=46%"; Hit description =Integrase, catalytic region; Zinc finger, CCHC-type
MEETKSIDEKLNRFGVIINNQKSLGKIYGTQDHIRKILRSLPKEAKYLARLKLDELVGSLKVHEQKIMDEIQPRKRNNIALKASTSSRKTAHQQATSKEEEDTTSREEDEVAFI

SEQ ID NO: 208542 - protein, 64 aa, Glycine max
  Coding DNA Sequence Number=SeqID_91764
  Gene Ontology: Mol. function=ferredoxin-NADP+ reductase activity; Cellular component=thylakoid membrane; Biological process=electron transport
  Homolog annotation: Hit_ID=Q41014; Match level="QueryCoverage=99%, HitCoverage=26%, E-value=2e-20, Identity=75%"; Hit description =Ferredoxin--NADP reductase, root isozyme, chloroplast precursor
MGTSIYFGLEAKQPKFKKSSCGMHVRATSKLVGPKAPGETCHIVIDHGGNVPYWEGQSYGVIPP

SEQ ID NO: 208543 - protein, 179 aa, Glycine max
  Coding DNA Sequence Number=SeqID_91765
MDEDQWAYDNTMSQEVDMDYENEQECGVNEPHVDCSDAFNTSQVFGTRDDILQWAPLVAHENGFVAGCMLVPVACWFSRKIMFLTNGMRHIYHVEAKLHDESRLIQRCFDDNKDDDKGDDKKLKGQSKNEFKMFKIESRTFQDSRGKLISRIKNQDSRIKLSRIKIKIQDLRFKNQEKT

SEQ ID NO: 208544 - protein, 43 aa, Glycine max
  Coding DNA Sequence Number=SeqID_91766
MLMMLKIHCDDFVYVHGGALTLLDVPVTLLDVPGGGKGVVKEF

SEQ ID NO: 208545 - protein, 333 aa, Glycine max
  Coding DNA Sequence Number=SeqID_91767
  Homolog annotation: Hit_ID=Q2PER5; Match level="QueryCoverage=32%, HitCoverage=34%, E-value=1e-41, Identity=71%"; Hit description =Putative early nodulin-like 2 predicted GPI-anchored protein
  Pfam annotation: Domain name=Cu_bind_like; Domain location=33-116; Score=105.4; E_value=1.7e-28; Accession=PF02298.8; Description =Plastocyanin-like domain
MELEIRACLLLFLFSLFSCSQAYTFYVGGKDGWVLYPSENYNHWAERMRFQVSDTLVFKYKKGSDTVLVVNKDDYEKCNKKNPIKKFEDSESEFQFDRSGPFYFISGKDGNCEKGQKLIIVVLAVREPPPYYPPTPPNTPYVPITPPKAPYHPNPPYVPTPPNTPYVPITPPRAPYVPAPPQTPTVPTPPETPYHPPYVPIPPPKTPSPISSPPYVHPKPPSPIHYPPNVPTPPKTPSPVYTPPNVPTQAPSPANHPPYIPTPPQTPSPVYTPPNFPTPPKIPSPVYTPPKAPSPSNNPPYVPTPPKTPSPSYNPPNVPTPPKTPSPIYTPPN

SEQ ID NO: 208546 - protein, 68 aa, Glycine max
  Coding DNA Sequence Number=SeqID_91768
MGPVLARTCLGGWPPIGRPCVIGNALAFVDEMRWTLEVGVVSLLPAVGHPQAVVVPRPAPAWGRGTSR

SEQ ID NO: 208547 - protein, 122 aa, Glycine max
  Coding DNA Sequence Number=SeqID_91769
MFSKKEGMMRILKLTKYRPKAQVEKDEGPSGERQSPRVEKDEGLETYQGNPCGVYPDLSSFTGSGVIQNSVASIVTTYPSAGGRCKAHGGVFQGRKTRRVATNVYSGKTLEKPKCVVYELYV

SEQ ID NO: 208548 - protein, 115 aa, Glycine max
  Coding DNA Sequence Number=SeqID_91770
  Subcellular localization annotation: CTP_CleavageSite=35; ConfidenceScore=5.19e-01
MAYLRLMQWHLLVSNTTLKCLRCSWNRFLNVGSFKANVAGSTGARKIFLDMNEEFEETMKVSFQNSSSTYFTLKLKLMLCGFIKSSINFTETWCTAVDKGNYIDENMLGFCGRMS

SEQ ID NO: 208549 - protein, 219 aa, Glycine max
  Coding DNA Sequence Number=SeqID_91771
MAADPTQTFMGYLTPTLGESNTIRPLDLSKGATFDFKHGFLQMLENNPFSGATLEDSMHNLKKLIKLSNIARQNHASVEYEGMGLAKLFTSKQHLFMEPMQKYFFSPMKTNTRDIGNFVQREQESLPLLFCGVNYHFWKVHIKIFMGSINKGICQAVVNGYTIPTQEVNNETIKKPYESWSTKETKRAKYDSKATNIMKKMMVLSKPRGEGGELVFKTK

SEQ ID NO: 208550 - protein, 86 aa, Glycine max
  Coding DNA Sequence Number=SeqID_91772
MVNHMADLATLTKNMRNRPLAYSPKEEEKKVPAERDWETLDQVILDSGETTIREVPQEVAGWLIKESSEEDSEEHMHEISSQEPYC

SEQ ID NO: 208551 - protein, 88 aa, Glycine max
  Coding DNA Sequence Number=SeqID_91773
MDVQASEEYGVHAFQKRLQVDEVQWGKLLVAIVIVPLLDATTLVVGDVLSMFMMFMTSLLVMAKEMKEEFEEMLKVSELVKTSELRLI

SEQ ID NO: 208552 - protein, 58 aa, Glycine max
  Coding DNA Sequence Number=SeqID_91774
MMVKATSTVEAITGDAAWMDRTAFDDARKESPEVKKKKMNNRHEEEREWCTKKNPTIH

SEQ ID NO: 208553 - protein, 329 aa, Glycine max
  Coding DNA Sequence Number=SeqID_91775
  Gene Ontology: Mol. function=RNA-directed DNA polymerase activity; Biological process=RNA-dependent DNA replication
GIGVRVPSGYDYAWDLLISSTPFVEWKEMLWRMGTGSRFSICRNGPKLSHLFFTDNVLLFTKAKPTKGVMSKRKSKLSNVSNIRFTNNLGKYLGFNIVHGHVTNSHFDLLLERVQRAHFQNVEFLGKLIWDVLHHPNKLWVQEVDMIHIHDVDLRICDVFSRGWKLENLYTNITTEVRDSILGMSVVIHPSILDTWAQIPENAKFFLWQVGHDAFPTREFLRRMHTIADELYLRCGTITEYISHILWKCGSIDLVGKFFNISLPSDESLSLGWLNWIHISITKVPGSSLSAPSMPTMVSSIQFVARQVSLNVDGSCVANPGPASYGGLL

SEQ ID NO: 208554 - protein, 77 aa, Glycine max
  Coding DNA Sequence Number=SeqID_91776
MVQMFVRDSTSKQWQTTFACALYGFWIAKNRKVLQEVDIQHNELFYFIKQCASLFALDCKDNISTPVTNMLYNQHAL

SEQ ID NO: 208555 - protein, 122 aa, Glycine max
  Coding DNA Sequence Number=SeqID_91777
  Gene Ontology: Mol. function=ribonuclease H activity; Biological process=DNA integration
MKNAFDKKVRSCKFHEGDLVLKKVSHVVKDNRGKWAPNYEGPFVVKRAFSGGALVLTNMDGEELPSPEQNRLRQWSNAGTGLKAETNRGKMGRTQAEARITIDRSSFHAQHWTSGKRSWGTT

SEQ ID NO: 208556 - protein, 97 aa, Glycine max
  Coding DNA Sequence Number=SeqID_91778
MSARKDDQSRSKTEESPDDADRTFPNRHRPNIIGGLNRKNNSGHCRCRPGKMTRSRSKTEESPDDADRKFPNRHRPNIIGGLNRKNNSGHWSLNSPD

SEQ ID NO: 208557 - protein, 110 aa, Glycine max
  Coding DNA Sequence Number=SeqID_91779
MPEVDEVQERMKADMEAMKEQMATMMKAMMSMKKIMEVIAVAIAIVSDVFGVDPTPPSGLNQISHPTSDVRGKRLASAGGPHCVQIQNKHAFVLYGLPPNYTPPNVAYTP

SEQ ID NO: 208558 - protein, 223 aa, Glycine max
  Coding DNA Sequence Number=SeqID_91780
  Gene Ontology: Mol. function=phosphoprotein phosphatase activity; Cellular component=intracellular
  Homolog annotation: Hit_ID=Q1RY25; Match level="QueryCoverage=79%, HitCoverage=43%, E-value=4e-26, Identity=37%"; Hit description =Reticulon
  Pfam annotation: Domain name=Reticulon; Domain location=1-142; Score=- 54.4; E_value=0.0039; Accession=PF02453.8; Description=Reticulon
MWRDVSRSAFVFGFGSFIIVSSSYAKDINLRGIINVEDSNYVVGEEDAIWMLKLILPYLNEFLSKLKALFSGDPGTTIKLAVLLFVLARCGSYITVWKMAKFGFFGVFTVPKICSSYSAQLTEYGNFWIRRFRDAWDSCTHKKAVALGIFGLVWNLSSVVARIWAVFVLFAAFRYYQQHYLVRDEWGEDEAGCDETWQDPVGVRPKQGPATNFSDTNKIKKGF

SEQ ID NO: 208559 - protein, 56 aa, Glycine max
  Coding DNA Sequence Number=SeqID_91781
MAVGGVQHIVKQLKKAKQTSTVAEHQTNAPLILANFVPLKVLMRVLQECERRIAIF

SEQ ID NO: 208560 - protein, 100 aa, Glycine max
  Coding DNA Sequence Number=SeqID_91782
  Subcellular localization annotation: CTP_CleavageSite=84; ConfidenceScore=5.09e-01
MTNMVQASCSWTIVVSLLKSPPKYCLILMPFMVRILLVVGSSNITAPYGITSLMMNACPFDAILPRKGPVTRAMSKRLQEDWARAGEESPTVLMNLRIDF

SEQ ID NO: 208561 - protein, 226 aa, Glycine max
  Coding DNA Sequence Number=SeqID_91783
  Gene Ontology: Mol. function=RNA-directed DNA polymerase activity; Cellular component=intracellular; Biological process=RNA-dependent DNA replication
MDDFSIVDSSFYLYLANLDIVLKRCVEINLVLNWEKCHFMVIEGIVLGHKIFVHDIEVDKAKVEVLEKLPPQTNVKGIRSFLGYVGFYRCFTKDFSKIVKPLSNVLNKEVSFHFDKLCFEAFDTLKQKLISAPIITTPNWTLDFEIMCDASDYVVGAVQGQRKNKIFHVIHYASKEFDLEIKDKKGSENTMADHLSRLSIDEVTTQGPEIQEEFLDEKLFNITVRP

SEQ ID NO: 208562 - protein, 123 aa, Glycine max
  Coding DNA Sequence Number=SeqID_91784
MAFGRPEHQGHVRVAWTGVTISQYFGQASRASSTLSPSINQQQLANIIGGIKDDIKKQLQDEIRNEVQDEIRKESAPIKALEIQALLARVSTKGSCARLEGSGLLKELLNGDDDLMGLFVVVG

SEQ ID NO: 208563 - protein, 97 aa, Glycine max
  Coding DNA Sequence Number=SeqID_91785
MHRRLQTHHQHLIRLIQLGHLAWSGIYSTCLSLQSQGFAPFACPTSDQFRAEVAWPGDWPEAQAGEAPVEAPGDAEEVCMDEEMSDLLGFLGGSGAT

SEQ ID NO: 208564 - protein, 79 aa, Glycine max
  Coding DNA Sequence Number=SeqID_91786
MHDKRSLHNIKGILSNLCQQAYGVPLSNLLLSIYTPIIRDAPTTFASSTTCDDKKLKGQSKNEFKMFKIESRTLQDSRG

SEQ ID NO: 208565 - protein, 165 aa, Glycine max
  Coding DNA Sequence Number=SeqID_91787
MNYSNATKDSDVGQDYDDLCKESEVNLAEVKDIIQDSIKGRCLKFEENLMKDVNPRYLRNPIAKENMNKDLNEFENEVKGCSFRQIYCKGLRIIQDSNKHFSPSRKYEQNSRKAHSKDEEVGFGELIEKSTKARKDSNSENEEEMVIDTFKFGFDDSLEDITERF

SEQ ID NO: 208566 - protein, 95 aa, Glycine max
  Coding DNA Sequence Number=SeqID_91788
MHEQYDSQTIIRRILTSEENEEDAKKKKQQRRSRSHEEEEPGTEEQDPRRKKKHERREKKQQGTRRGRRRQMAQRRGRRRRKAAQRRGRRKAALK

SEQ ID NO: 208567 - protein, 231 aa, Glycine max
  Coding DNA Sequence Number=SeqID_91789
MKITWRLSLTPTSSPIIKKEKYSQATHHEEELPIVDALAIIIPKPLVNDILQSFDNFNYCIPESDKGIEVAPMANQENLSLGIMAATLLAPQQSAIPPSSIVDPPQDNEDPTNADLFSFIDIWSSYSMPSKASEESHNRTITCFDEVVNHFKKIAFDKNLENSLADPDYKEKLRQTVNGVVKLNDLMADELREEMETFLDVFNNAFEAHQLCNPHASDIADIKSSTEQDRT

SEQ ID NO: 208568 - protein, 100 aa, Glycine max
  Coding DNA Sequence Number=SeqID_91790
MGKRKLELGFEDQKIDFDLFVEDKPAPEHNVCLQGFNFLEKGLKNKLEKYFLKNSPFAKCKPRAKRIFVHALSCDSQALSTQPLHLRLIWSIKLAKVELS

SEQ ID NO: 208569 - protein, 435 aa, Glycine max
  Coding DNA Sequence Number=SeqID_91791
  Gene Ontology: Mol. function=ligase activity; Cellular component =cytoplasm; Biological process=response to auxin stimulus
  Homolog annotation: Hit_ID=Q9ZNS2; Match level="QueryCoverage=92%, HitCoverage=68%, E-value=1e-164, Identity=69%"; Hit description =Putative GH3-like protein
  Pfam annotation: Domain name=GH3; Domain location=29-435; Score =434.8; E_value=1.2e-127; Accession=PF03321.4; Description=GH3 auxin -responsive promoter
MPQHQPTLMEPVLSYNNSTNNGNGNSDYDIISWFEDVSQNAGFVQTQLLFQILKQNYGVEYLKKWLGSYNILEMDACALESLFSSVVPLASHADFEPFIQRIADGDTAPLLTQQPITTLSLSSSGTTEGRQKFVPFTRHSAQTTLQIFTLAAAYRSRIYPIRQGGRILEFIYSSNRFKTKGGLTVGTATTHYYASEEFNIKQHKTKSFTCSPQEVISGGDYKQSTYCHLLLGLFFSDQVEFITSAFIYSMVQAFTTFEELWREICNDIRDGTLSSRIKSPKMRKAVLDIISPNPNLAAKLEDACKGLEVVDWFGLIPKLWPNAKYVYSIMTGSMQPYLKKLRHYANGLPLVSADYGSTESWIGVNVDPSLPPEDVTFAVVPTFSYFEFIPLHRNEKNFSSGGDDFIEDKPIPLSQIKVGQEYEVVLTTFTGIHFS

SEQ ID NO: 208570 - protein, 89 aa, Glycine max
  Coding DNA Sequence Number=SeqID_91792
LGRIDGDPVLRETRIWATWEYVSSVGGGQQGMETLGTSGGVLLPKTKLDQSRTNPGIVGDWNIVEASGNRLPACVIDYTEGWITGNRLP

SEQ ID NO: 208571 - protein, 152 aa, Glycine max
  Coding DNA Sequence Number=SeqID_91793
MDDLQDTIGYSGQRGSDNLGELASRLYLLELGAWGSIYVVPVYGNHSQLPSMWLCKPPIPGRLGGIVGSCYVSSVTEQRTHPCNQQRSGSGEKSKISFDVSYPNFVRGLLLDDMQPLIGRFKILGTLCCTICKSRDAPKIKRKQGYAIREIP

SEQ ID NO: 208572 - protein, 97 aa, Glycine max
  Coding DNA Sequence Number=SeqID_91794
  Subcellular localization annotation: CTP_CleavageSite=40; ConfidenceScore=5.04e-01
MDQHFIAFYFFTIFKISMSWPILAHQESSGGSNRSPGRACCFKFKPLARLCKLGGKLLLHFSYKMALEAGGKGFNPFGNQVSLKISEEKKKEGENEG

SEQ ID NO: 208573 - protein, 103 aa, Glycine max
  Coding DNA Sequence Number=SeqID_91795
MIMKGQDIYSRQDEVATSPSSSESEEANGEESSEEIDSQEERDLLMVRRLLGGQSCHLAGDIFLLDIGYKVAPTNVDEKKLGLRQLNKPSAAINRRQTLSMSA

SEQ ID NO: 208574 - protein, 88 aa, Glycine max
  Coding DNA Sequence Number=SeqID_91796
MMKVEKKLIHRIGQQQSPRSKKSGDNNNLQGVKRVGGSEIEHETSLATCLTMIGFSPSGLVRKFVFLIVVHLAGENQLVTNSFIQHIK

SEQ ID NO: 208575 - protein, 259 aa, Glycine max
  Coding DNA Sequence Number=SeqID_91797
  Gene Ontology: Mol. function=voltage-gated potassium channel activity; Cellular component=membrane; Biological process=potassium ion transport
  Homolog annotation: Hit_ID=Q00XC0; Match level="QueryCoverage=99%, HitCoverage=30%, E-value=2e-85, Identity=62%"; Hit description=[PT] KOG0500 Cyclic nucleotide-gated cation channel CNGA1-3 and related proteins
  Pfam annotation: Domain name=IQ; Domain location=56-76; Score=21.6; E_ value=0.0028; Accession=PF00612.17; Description=IQ calmodulin-binding motif
MLAYAKAWLALKELGVDADLSNEVSDRPTFYLKKLRLIYGDDGEGLEDPRILEQKTRAAVIIQKRFRGMLHRVMMHQMLVERSVNGIFHKVLRERDPMSYTARAIDVFHSRLGFSLTEVHRKLNSILDHSDIVDEPTKIDKPSTLMSTALQAAAGRAMTVKRETGKQPQATTASQRARTAQPVDTGRAAGWGTSSLEDPIQKLQSRVDELTGRLVPLERKITNANAKQTAALTETNERLSELTSQLEALMQLTVSSMES

SEQ ID NO: 208576 - protein, 194 aa, Glycine max
  Coding DNA Sequence Number=SeqID_91798
  Gene Ontology: Mol. function=nucleoside-triphosphatase activity; Cellular component=membrane; Biological process=protein catabolic process
  Homolog annotation: Hit_ID=Q00TT8; Match level="QueryCoverage=98%, HitCoverage=31%, E-value=8e-92, Identity=89%"; Hit description=[O] KOG0652 26S proteasome regulatory complex
  Pfam annotation: Domain name=Peptidase_M41; Domain location=1-187; Score=306.2; E_value=5.9e-89; Accession=PF01434.8; Description =Peptidase family M41
MGAERKSAVMTPENRKLTAYHEGGHALVALRTAGARPVHKATIVPRGQALGMVMQLPEKDELQMTRRQLLAMLDVTMGGRVAEELIFGPEEITTGASSDLQQATRLAREMITRYGMSDKIGLASQDYASEEISSETRQLIEDEVKSMLDAAYKRAKSLLVAHEGDLHSIARRLLDAESVSGRELKELCGIAPAT

SEQ ID NO: 208577 - protein, 208 aa, Glycine max
  Coding DNA Sequence Number=SeqID_91799
  Gene Ontology: Mol. function=citrate transporter activity; Cellular component=integral to membrane; Biological process=potassium ion transport
  Homolog annotation: Hit_ID=Q00XK2; Match level="QueryCoverage=99%, HitCoverage=19%, E-value=4e-66, Identity=64%"; Hit description=[P] KOG2639 Sodium sulfate symporter and related arsenite permeases
  Pfam annotation: Domain name=TrkA_C; Domain location=59-128; Score =26.8; E_value=7.8e-05; Accession=PF02080.11; Description=TrkA-C domain
MRRERYPNEREIGLFELSKYGVPVLLSGLAYMLVAAPFLLPGGERDGANANDLDLEDLTVGAVIPRGSPVVNAEVAVLRGLNGLYLVSVQRGDTLMRGVQPNFILEVGDILIFTGLIDRIGEVCKEHGLVPLTHEVEAKMLEVKQETKQSEEDNVESSVTFPPRVRPVHASRESQRGRTSQDDSSISGVAWLHRNSTAAGGRTSIDLH

SEQ ID NO: 208578 - protein, 178 aa, Glycine max
  Coding DNA Sequence Number=SeqID_91800
  Subcellular localization annotation: CTP_CleavageSite=59; ConfidenceScore=5.60e-01
MEIRNNNNNGDSSIATMQVGSATTTAPMTNAYNAMLLMSTSNVMTSMNASDATTPILTSSMTTSTPASNMMSTTAMPIYSNSYLLSDTRLEQILPFITIPTMGTRTSYRGVHAFNKNNNGTPLSLRYPWGMPNCRPQGVELDSFQPSMEYRGKIQLLPKIEIETKMVKGMLIIMGQNN

SEQ ID NO: 208579 - protein, 90 aa, Glycine max
  Coding DNA Sequence Number=SeqID_91801
MKSHISGESSLGNELRRSVSEKLHHVDEADAAKQGRVLNLSFETELCILTASTYAVFGSFRHKQNLEVNKQTINISKGKNNKMSMLDGGG

SEQ ID NO: 208580 - protein, 201 aa, Glycine max
  Coding DNA Sequence Number=SeqID_91802
  Gene Ontology: Mol. function=potassium ion transporter activity; Cellular component=membrane; Biological process=potassium ion transport
  Homolog annotation: Hit_ID=Q06XL9; Match level="QueryCoverage=73%, HitCoverage=21%, E-value=2e-26, Identity=44%"; Hit description=KUP1
  Pfam annotation: Domain name=K_trans; Domain location=1-201; Score= -518.4; E_value=0.021; Accession=PF02705.7; Description=K+ potassium transporter
MASYFADPLYWPMFVIAIMASIIASKAMIFGTFSIIQQSLALGCFPCVKIVSQKRGFYFAKWNTKKSMCFDVLQDIDTLMCAMIEQEPFEHLLVKRLKEFIGCGFLASQRVIEDGKTEEKINSGDKERVVQEVEAVEKAVRGGVVHLIGESEMVASKGAGIWKRILIDYAYNFLKKNLRQSDKVFDIPHKRMVKVGMTYEL

SEQ ID NO: 208581 - protein, 305 aa, Glycine max
  Coding DNA Sequence Number=SeqID_91803
  Homolog annotation: Hit_ID=Q1RSK1; Match level="QueryCoverage=32%, HitCoverage=18%, E-value=1e-39, Identity=82%"; Hit description=Zinc finger, C2H2-type
MDEIHVTDPNAEVIALSPTTLMATNRFVCEICNKGFQRNQNLQLHRRGRNPPWKLRQRGSNELMKKRVYVCPEPSCVHHNPARALGDSTGIKKITADNMVKRNGMPLSTSSNNTTVSEFNNNYDPKNPLQEHIVPLPFKSTSAHMSATALLQKAAQMGATASNNNNNNSIIINSPTMMQKNFVISGMAGPHHNHNSSSYDHFHHPNPDQSHMQFFHKGQQEIDHNEGLMKNVEQEIGTGNSSLVHDFLGVGGATSRVHEPQNQKQQQQRLELDTLTHQRLQIMNHFHHHLPHGDSATMEKSIWDI

SEQ ID NO: 208582 - protein, 145 aa, Glycine max
  Coding DNA Sequence Number=SeqID_91804
  Gene Ontology: Mol. function=sequence-specific DNA binding; Cellular component=intracellular; Biological process=regulation of transcription, DNA-dependent
  Homolog annotation: Hit_ID=Q942Y5; Match level="QueryCoverage=67%, HitCoverage=55%, E-value=2e-45, Identity=86%"; Hit description =Putative HAP3-like transcriptional-activator
  Pfam annotation: Domain name=CBFD_NFYB_HMF; Domain location=37-102; Score=127.1; E_value=5e-35; Accession=PF00808.13; Description =Histone-like transcription factor (CBFNF-Y) and archaeal histone
  Pfam annotation: Domain name=Histone; Domain location=34-105; Score =12.0; E_value=0.0086; Accession=PF00125.14; Description=Core histone H2AH2BH3H4
  Pfam module annotation: Pfam domain module=CBFD_NFYB_HMF::Histone; Domain location=37-102::34-105
MGDNIGKVLDREGFKYNFTASASGTSAQDGVIKEQDRLLPIANVGRIMKQILPPNAKISKEAKETMQESVSEFISFVTGEASDKCHKEKRKTVNGDDICWALATLGFDDYSEPLKRYLYKYREMEGERANQNKGSNGYENNIANI

SEQ ID NO: 208583 - protein, 40 aa, Glycine max
  Coding DNA Sequence Number=SeqID_91805
MGHVPATNGSGFGYMSIRQSKGRVPAKGTYRSSEGSTQSY

SEQ ID NO: 208584 - protein, 88 aa, Glycine max
  Coding DNA Sequence Number=SeqID_91806
  Homolog annotation: Hit_ID=Q1S7C5; Match level="QueryCoverage=82%, HitCoverage=7%, E-value=6e-10, Identity=41%"; Hit description =Integrase, catalytic region
MQFLTENDRDVGIENIAYEIWEQQDQMILSRVLGCTYSNQLWEKIHEYFHLQTRAQARQLRMELRRRALDNNMVETQFVTKLKSNQTY

SEQ ID NO: 208585 - protein, 895 aa, Glycine max
  Coding DNA Sequence Number=SeqID_91807
  Gene Ontology: Mol. function=nucleoside-triphosphatase activity; Cellular component=membrane; Biological process=cell division
  Homolog annotation: Hit_ID=Q1RST2; Match level="QueryCoverage=98%, HitCoverage=71%, E-value=0.0, Identity=74%"; Hit description =Peptidase S1 and S6, chymotrypsin/Hap; Immunoglobulin/major histocompatibility complex; AAA ...
  Homolog annotation: Hit description=ATPase, central region
MGGLGLIILLFIFLQNPHVSMSDLIFTVGQGRNCNLWLKDPTVGNVLCKLSHIERGGSSVALLEITGGKGSIQVNGKTYRKNARLILSGGDEVVFGSSGKHAYIFQLLTNNNISPAVIPSSVSILEAQSAPINGTQVEARSGDPSAVAGASILASLSNLPKDLSLLSPPAKTGKNVQQNSDISSLPSGNEDDMPISEMKDATNDVASEVCSADKTVNENPSLDTAEVDINVDADVRKVTAATYELRPLLRLLAGSCPELDLSCGITKILEERRELRELLKDVDTPTILASTRRQAFRDSLEQRILKSKNIDVSFETFPYYLSDTTKSVLIASTFIHLKCMGFGKYASDLSSVSPRILLSGPAGSEIYQETLCKALAKHFGARLLIVDSLSLPGGAPSKEVDSAKESSRPEKPSSVFTKRSSQTATLQHKKPASSVDAEIVGGSTISSQAMLKQEVSTASSKGTTLKEGDRVKFVGNFPSAVSSLPNYPSRGPSYGSRGKVLLAFEDNRSSKIGVRFDKSIPDGNDLGGLCEEDRGFFCSANHLLRVDGSGGDDADKVAISDIFEVTSNQSKSGPLVLFIKDIEKAMVGNYEVLKNKFESLPPNVVVIGSHTLLDNRKEKTQPGGLLFTKFGSNQTALLDLAFPDNFGRLHDRSKETPKVMKQLGRLFPNKVTIQLPQDEAILSDWKQQLERDIETMKAQSNIVSIRTVLNRIGLDCPDLETLSIKDQTLTTESVEKIIGWAISYHFMHSSKASIKDSKLVISAESLNYGINILQGIQNENKNLKKSLKDVVTENEFEKKLLADVIPPTDIGVTFDDIGALENVKDTLKELVMLPLQRPELFCKGQLAKPCKGILLFGPPGTGKTMLAKAVATEAGANFINISMSSITSKWFGEGE

SEQ ID NO: 208586 - protein, 1336 aa, Glycine max
  Coding DNA Sequence Number=SeqID_91808
  Gene Ontology: Mol. function=nucleoside-triphosphatase activity; Cellular component=membrane; Biological process=cell division
  Homolog annotation: Hit_ID=Q1RST2; Match level="QueryCoverage=99%, HitCoverage=97%, E-value=0.0, Identity=67%"; Hit description =Peptidase S1 and S6, chymotrypsin/Hap; Immunoglobulin/major histocompatibility complex; AAA ...
  Homolog annotation: Hit description=ATPase, central region
  Pfam annotation: Domain name=AAA; Domain location=1054-1285; Score =229.1; E_value=9.9e-66; Accession=PF00004.19; Description=ATPase family associated with various cellular activities (AAA)
  Pfam annotation: Domain name=AAA_5; Domain location=1054-1232; Score=- 19.4; E_value=0.054; Accession=PF07728.4; Description=ATPase family associated with various
  Pfam module annotation: Pfam domain module=AAA::AAA_5; Domain location=1054-1285::1054-1232
  Subcellular localization annotation: CTP_CleavageSite=69; ConfidenceScore=5.78e-01
MVETRRGASSSKRSLSSPSSASNTKRSKVQTFLTFFATHLSYSMRIPLFLIWVSDLNLNSRWVSEDSSVAAPVNESGTGNESGEPELRPSDLPDTASLKVAGVCDKSPSEGEALVPPLCAGETAEKSKVAGLPPRSVKKRAAKSCPKTAWGKLLSQCSKVFASESFTVYLRFSGNESREFADLGLVVLHFYILVKVLNFGCVEINGIMEKLEAKAAEAAGIAAPTVYKYRCMQLLYPLGSRKAVSKTPHVCMTEPFFTVGQGRHCNLWLKDPTIGSVLCKLSHIERGGSSGALLEITGGKGSIHVNGKTYRKNARLILSGGDEVVFGSSAKYAYQLSNSNISTADIASSVSILEAQSAPLNGMQVEARSGDPSAVAGASILASLSNNICKELSLLPPAAKTGKNVQNTDISSLHSGCGDDIPDNEMNDTTNNAEPAGDFSADKTVLASSTTVNENPNLDSVEVDTNIDANVGKMTAAAYELRPLLRMLTGSCPEFDLSGSISKILEGRRELRELLKDVDTPTVLASTKREAFKDILQQRILIAEKIDVSFETFPYYLSDTTKNVLIASTFIHLKCNGFGKYASDLPSVSPRILLSGPAGSEIYQETLSKALVKHFGARLLIVDSLSLPGGSPSKEVDSAKESYCAEKPSVFSRKKNLHTAMLQHKKPASSVNAEIIGGPMLISSASSKGTTLKKGILGPSYGSRGKVLLAFEDNGSSKIGVRFDKSIPDGNDLGGLCEDDRGFFCSANHLLRVDGSGGDDLDKVAINEIFESKSGALVLFIKDIEKAMIGNYEILKSKFESLPPNVVVVGSHTQLDNRKEKTQPGSLLFTKFGSNQTALLDLAFPDNFSRLHDRSKEISKVMKQLSRLFPNKVTIQLPQDEALLSDWKQQLDCDIETMKAQSNVVSIRLVLGRIGLDCPDLETLCIKDHTLTTESVEKIIGWAISYHFMHSSEASIRDSKLVISAESIKYGHNILQGIQNENKNMKKSLKDVVTENEFEKKLLTDVIPPTDIGVTFDDIGALENVKETLKELVMLPLQRPELFGKGQLAKPCKGILLFGPPGTGKTMLAKAVATEAGANFINISMSSITSKWFGEGEKYVKAVFSLASKIAPSVIFVDEDTYENLMWRDWVKLSAEGIHGLQCDGENNGGLWSGKLGFTFANTLWVDSMLGRRENPGEHEAMRKMKNEFMVNWDGLRTKDKERILVLAATNRPFDLDEAVIRRLPRRLMVNLPDAPNREKIVSVILAKEELAPDVDFEAIANMTDGYSGSDLKNLCVTAAHCPIREILEKEKKERSLALTENQPLPQLCSSTDIRPLKMEDFIYAHEQHNNKIAAL

SEQ ID NO: 208587 - protein, 101 aa, Glycine max
  Coding DNA Sequence Number=SeqID_91809
MFLANSVSSKNFREPSMQKALAIYQYYDLGVFAVGSIQFLRFENSASERAMGLQKVCCFALLGHIFKPWKQPFCFQVDKAAAYIYTCTRWEPHANAMSRPN

SEQ ID NO: 208588 - protein, 140 aa, Glycine max
  Coding DNA Sequence Number=SeqID_91810
  Gene Ontology: Mol. function=zinc ion binding; Biological process =cell redox homeostasis
  Homolog annotation: Hit_ID=Q2HS43; Match level="QueryCoverage=93%, HitCoverage=38%, E-value=4e-31, Identity=51%"; Hit description=Zinc finger, RING-type; Thioredoxin-related
  Pfam annotation: Domain name=PHD; Domain location=44-88; Score=-0.4; E_value=0.062; Accession=PF00628.19; Description=PHD-finger
  Pfam annotation: Domain name=zf-C3HC4; Domain location=45-85; Score =21.8; E_value=0.00087; Accession=PF00097.15; Description=Zinc finger, C3HC4 type (RING finger)
  Pfam annotation: Domain name=zf-RING-like; Domain location=45-85; Score=13.1; E_value=0.0053; Accession=PF08746.1; Description=RING -like domain
  Pfam module annotation: Pfam domain module=PHD::zf-C3HC4::zf-RING -like; Domain location=44-88::45-85::45-85
MHIKVSQIKINNFGRAKNLSMLKTTIKLKPMVETNESHVVKEMHCVVCKEAFELGVLAREMLCKLHYHFDCILLWLSMRNSCPVCHYELSSEQPTYKNRVTGKIEEVVIRLTIWRLLSSRFAVRRLANENHLSMMYTCFS

SEQ ID NO: 208589 - protein, 144 aa, Glycine max
  Coding DNA Sequence Number=SeqID_91811
  Homolog annotation: Hit_ID=Q8RUA7; Match level="QueryCoverage=55%, HitCoverage=76%, E-value=6e-13, Identity=50%"; Hit description=Heat shock factor-binding protein 1
  Pfam annotation: Domain name=HSBP1; Domain location=48-122; Score =89.6; E_value=9.8e-24; Accession=PF06825.3; Description=Heat shock factor binding protein 1
MDDAKGSVFSGYFWQKIQKESVLVTRGSGNSKTKNSDGHDSQDPKQSPADMTAFVQNLLQQMQNRFQTMSDSIVTKNILLTCQICKLWNFFFLDVNALDDMGSRINELEQSINDLRAEMGVESSPSPATPAKPTEEITKEEGSA

SEQ ID NO: 208590 - protein, 406 aa, Glycine max
  Coding DNA Sequence Number=SeqID_91812
  Gene Ontology: Mol. function=RNA-directed DNA polymerase activity; Cellular component=chromatin; Biological process=chromatin assembly or disassembly
  Pfam annotation: Domain name=Chromo; Domain location=315-369; Score =53.7; E_value=6e-13; Accession=PF00385.14; Description='chromo' (CHRromatin Organisation MOdifier
MDQQNWAAKLLGYRFDIIYKPGLENKGADALSRMHDPAILGSLVHYPEWEGSKEVIQEVHEDEHLKKIIADLQAGHPTRPGFTYKKGDLSEDSCKSLLDGNEEKDPTICPGMQCLLQPLPIPTQIWKNLSMDFITGLPKSKGFEAVFVVVDRLSKYSHFIPLKNPYSARTLAEIFTKEVETQLKMSTAYHRQTDGQTETNLRHGFYGFRGQSIGETKVEAVQTENWWLVIGFFLKLCPHVQQSVETRINPKLAPRYYGPFQVIGHVGAVSYKLQLPPSSQIHPVFHISLLKKVVGNYQVDKELPKELENEPSTKWEPIQVLASRVVSARGDSVQQFLIQWKHKPVEEATWEDVSIMQSQFPEFRLEDKSSVQEGGIDRPLVQDAAQVNKPTVWRVYVRKNRRTEGQ

SEQ ID NO: 208591 - protein, 609 aa, Glycine max
  Coding DNA Sequence Number=SeqID_91813
  Gene Ontology: Mol. function=mismatched DNA binding; Cellular component=nucleus; Biological process=mismatch repair
  Homolog annotation: Hit_ID=Q1RSS9; Match level="QueryCoverage=99%, HitCoverage=65%, E-value=0.0, Identity=74%"; Hit description=ATP -binding region, ATPase-like
  Pfam annotation: Domain name=DNA_mis_repair; Domain location=225-340; Score=111.4; E_value=2.6e-30; Accession=PF01119.9; Description=DNA mismatch repair protein, C-terminal domain
  Pfam annotation: Domain name=HATPase_c; Domain location=23-157; Score= 28.7; E_value=2.1e-05; Accession=PF02518.16; Description=Histidine kinase-, DNA gyrase B-, and HSP90-like ATPase
  Pfam module annotation: Pfam domain module=DNA_mis_repair::HATPase_c; Domain location=225-340::23-157
MVVEAQIIKPIGKGIVHRICAGQVILDLSSAVKELVENSLDAGATSIEISLKDFGEQWFQVIDNGCGISPNNFKVLALKHHTSKLAEFHDLQSLTTFGFRGEALSSLCALGNLTVETRTASEPVATHLTFDSSGVLVAERKTARQIGTTVMVKKLFSSLPVRSKEFSRNIRREYGKLVSLLNAYALIAKGVRFVCTNTTGKNVRSVVLKTQGSGSLKDNIITVLGMNTFSCLEPVTLSISDSCKVEGFLSKSGQGNGRNLVDRQYFFVNGRPVDMPKVSKVVNELYRGANSKQYPIVILNFTVPTRTYDVNVTPDKRKIFFSEENALLQALREGLQQIYSASNVCYSVNEVVLPAEKEACVELCSSHGKSPIVMKLLSPNGSRPQKEQCSESNNGSISLDEINAECNNDTISQDEHEEKHITHSKNASESINEYLYSDVDEGLIRENDGNLMNQEFTLRAHCASKDDNSGRQSASPSSIIPDQTTLVSRTVESGSSSSKYSFNHSRHVQSTLNNFVSVNKRNRDSVIRALSEVPVLRNPHCQLKTANTETHDLITRSSLCFDQCDELARASEIEALKQLNPDNVFHKNENSVSFKGDSSDREPKSNMKV

SEQ ID NO: 208592 - protein, 236 aa, Glycine max
  Coding DNA Sequence Number=SeqID_91814
  Gene Ontology: Mol. function=mismatched DNA binding; Biological process=mismatch repair
  Homolog annotation: Hit_ID=Q1RSS9; Match level="QueryCoverage=94%, HitCoverage=20%, E-value=2e-40, Identity=49%"; Hit description=ATP -binding region, ATPase-like
  Pfam annotation: Domain name=MutL_C; Domain location=131-232; Score= -12.8; E_value=0.002; Accession=PF08676.1; Description=MutL C terminal dimerisation domain
ELDLKNNTPIGDTASINPSSIDMITADVFASDPPLHSSSVRLDSSKSSRKKICSNMQFSFQELKKRREKRLSLLQSSKFGCGKAKVKSCYSDATLELSRSEIAEQKERALAAAATELERFFKKEDFSRMKVIGQFNLGFIICKLDQDLFIVDQHAADEKYNFERLSQSTILNQQPLLRRLSKTRYKEIAYSDANFKRRPIKLELSPEEEIVASMHMDIIRWSTLKNDQFDYLSLCT

SEQ ID NO: 208593 - protein, 97 aa, Glycine max
  Coding DNA Sequence Number=SeqID_91815
  Homolog annotation: Hit_ID=Q1SND7; Match level="QueryCoverage=90%, HitCoverage=28%, E-value=2e-25, Identity=70%"; Hit description =Probable tumor-related protein T9L24.46 [imported]-Arabidopsis thaliana
MPGVIGVVMWDSGVVLGKFLEHVVDSGMLVLHGKKIVELGSSYGLVGNYVEVCSYSFYDTPAALLGSEVIVTDLPDRLRLLRKNIEINMEMFLYGVL

SEQ ID NO: 208594 - protein, 253 aa, Glycine max
  Coding DNA Sequence Number=SeqID_91816
  Gene Ontology: Mol. function=transition metal ion binding; Cellular component=nucleus; Biological process=proteolysis
  Pfam annotation: Domain name=Transposase_21; Domain location=62-241; Score=68.2; E_value=2e-20; Accession=PF02992.5; Description =Transposase family tnp2
MLSTSYYQAKQILCPMGMKYQKIHACPNDCILYRHEFEKMQKYLKCGVSWFKRLFANGDNAKDLTLHADGRNYDRMLRHPVNSSQWKNINGLYLDFSKERKYMMLSMMISYPRQPGNDINVYLGPLTEDLTKLWDEGIAVFDGYQNETFKLRVMLFCTINDFPTYENLSGYSVKSHRACPICEEDTKPDDDPLYPMMLTIPELFLKVMQVSWDLTMFGVYNDNVPLYIKHEDLFEMAHGGQCLNIFVIKIWIL

SEQ ID NO: 208595 - protein, 714 aa, Glycine max
  Coding DNA Sequence Number=SeqID_91817
  Gene Ontology: Mol. function=protein serine/threonine kinase activity; Cellular component=integral to membrane; Biological process=protein amino acid phosphorylation
  Homolog annotation: Hit_ID=Q9FG24; Match level="QueryCoverage=96%, HitCoverage=96%, E-value=0.0, Identity=50%"; Hit description =Receptor-like protein kinase
  Pfam annotation: Domain name=LRRNT_2; Domain location=29-68; Score =40.1; E_value=7.5e-09; Accession=PF08263.3; Description=Leucine rich repeat N-terminal domain
  Pfam annotation: Domain name=LRR_1; Domain location=117-139; Score =9.7; E_value=4.3; Accession=PF00560.23; Description=Leucine Rich Repeat
  Pfam annotation: Domain name=LRR_1; Domain location=141-163; Score =19.9; E_value=0.0089; Accession=PF00560.23; Description=Leucine Rich Repeat
  Pfam annotation: Domain name=LRR_1; Domain location=165-186; Score =5.8; E_value=23; Accession=PF00560.23; Description=Leucine Rich Repeat
  Pfam annotation: Domain name=LRR_1; Domain location=187-209; Score =6.0; E_value=22; Accession=PF00560.23; Description=Leucine Rich Repeat
  Pfam annotation: Domain name=LRR_1; Domain location=71-93; Score=4.4; E_value=44; Accession=PF00560.23; Description=Leucine Rich Repeat
  Pfam annotation: Domain name=LRR_1; Domain location=95-114; Score =11.2; E_value=2.3; Accession=PF00560.23; Description=Leucine Rich Repeat
  Pfam annotation: Domain name=Pkinase; Domain location=386-670; Score =47.4; E_value=2.2e-11; Accession=PF00069.15; Description=Protein kinase domain
  Pfam annotation: Domain name=Pkinase_Tyr; Domain location=386-670; Score=1.7; E_value=1.4e-12; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=29 -68::117-139::141-163::165-186::187-209::71-93::95-114::386-670::386 -670
MVHNYVFVNLTVLVVLSATLVSRCFAFTDPPDVTALQDLYRALNSPAVLNGWNGNDPCEESWTGVACSGSSVIHLKIRGLSLTGYLGGLLNNLQNLKQLDVSSNNIMGEIPLGLPPNATHMNLSHNFLNGPIGNVFTGLDNLKEMDLSYNNFTGDLPSSFGSLTDLNRLLLQNNRFTGSVTYLAELPLIDLNIQDNLFSGILPQHFQSIPNLWIGGNKFHAVDGSPPWAFPLDNVPIEQNTSRPPVTQANAIENYDPPKVRKQKNKHMGPGGIAFMVGTGTLLATGFALFIGIRLKKLHRQRMEDYERNHSSLPSQTKDVSTTAIDESLQIPPYNAASLLSPRRLTSQIHKRTGQTSRKSFSGRDRFTGRTKVYTVAEVQLVTNSFHEDNLLGEGSLGPVYRAEFPENKVFAVKNINMAGMSFIEEEKFLDVVCTASRLNHPNIVSLKGYCLEHGQHLLVYDYVRNLTLDDALHSAAYKPLSWGTRLRIALGVGQALNYLHSTFSPAVSHGNLKATNVLLDENLMPRVTDCGLAILRPLTSDKIKNRASEIDIRDIGYSSPDHGQPGIGSTKSDIFSFGVLLLELLTGRKPFDGSRPREEQYLAKWASSRLHDCDSLEQMVDPAIKRTFSSKALSRYADIISLCTQKLNVSLVQPVKEFRPPMSEIVDSLVSFSQNLLSKSGAADDTELDPLERSFRTTTSRFISSPALSYVSA

SEQ ID NO: 208596 - protein, 75 aa, Glycine max
  Coding DNA Sequence Number=SeqID_91818
MGEDQWMYDSIMSEEVDMDDENEQECGVNEQHVDCSDAFNTSQVFAIRDDVLQWVRSVAHENGFVVLIMRLDTNT

SEQ ID NO: 208597 - protein, 206 aa, Glycine max
  Coding DNA Sequence Number=SeqID_91819
  Gene Ontology: Mol. function=RNA-directed DNA polymerase activity; Biological process=RNA-dependent DNA replication
  Subcellular localization annotation: CTP_CleavageSite=52; ConfidenceScore=5.14e-01
MVQIAKEVTKLKSGTLSTNTQTNSKEQCKSITTRRGTLVGDLSREKSEQEVVVEEVNEDEEKNQLVKEKKNVVVDPPTKDLPYQHPPTRKDKERQYARFLKIFKRLQINIPFSKTLEQMPTYAKLMKELLTKKIFIKQDTIQLAARCSSIFQNDFPQKLQDLGSFTIPITFGNLKVGRALLDLVASINLIHLSFLAKIGDLDVKPT

SEQ ID NO: 208598 - protein, 120 aa, Glycine max
  Coding DNA Sequence Number=SeqID_91820
  Subcellular localization annotation: CTP_CleavageSite=48; ConfidenceScore=5.05e-01
MECRIFVKDSKSLCKSSSTSWRCSTMPFSIAQALDLAWRGRGRGRFVPAIMLRSKIILAVAEPRMPSLIAKPSVGADFVYEKESLICWIPFYYIFSLYASNLGPVNSLTSALICLSILKQ

SEQ ID NO: 208599 - protein, 173 aa, Glycine max
  Coding DNA Sequence Number=SeqID_91821
  Subcellular localization annotation: CTP_CleavageSite=56; ConfidenceScore=5.23e-01
MTFRGPRKARGKRSEVPTTLASPEEATPSSSTTPTPPISTPTQTPSLQGLGLPSIMSMDEFDTQVAWPGAQSSPFGGGGASAAQEPEPEEPAATAKGEDELTPPEPFYFDANVHMAQEEETSIDQIPEPSLVPIPDDSMPFAPAFELEQPIPQDSPAAQVLDLNEHAQEQSQE

SEQ ID NO: 208600 - protein, 306 aa, Glycine max
  Coding DNA Sequence Number=SeqID_91822
  Gene Ontology: Mol. function=methyltransferase activity; Biological process=metabolic process
  Homolog annotation: Hit_ID=P21507; Match level="QueryCoverage=42%, HitCoverage=29%, E-value=3e-65, Identity=96%"; Hit description=ATP -dependent RNA helicase srmB
  Pfam annotation: Domain name=DEAD; Domain location=184-302; Score =99.0; E_value=1.4e-26; Accession=PF00270.19; Description=DEADDEAH box helicase
MARRSCTSSPAAGEKPSTSRFGGRCAIRGQHHAKQPLFFNQLCRTVQQGGMIKRCRAARGIALDAGRGHTRGEKRRIADNQRVAFFCLLTPADDVVRMHRDAMRPRRRGDVLLRLRGGAALQFDGINTDVIRRALRQHQRNQTAAAADIQYAPYACHRRPGPEQHPIGADLHGTAIDKGFTRPTAIQAEAIPAALEGRDVLGSAPTGTGKTAAYLLPALQHLLDFPRKKSGPPRILILTPTRELAMQVADQARELAKHTHLDIATITGGVAYMNHAEVFSENQDIVVATTGRLLQYIKEENFDCRA

SEQ ID NO: 208601 - protein, 283 aa, Glycine max
  Coding DNA Sequence Number=SeqID_91823
MDMNLGYLISHQISLIAQHDTSRLGFPALITALCKARGVQSDSRSLENFSPTINLAYIKKNRWNLDDPTVTFRGPRKARGKRSEVPTTSTAPETPTPSSSTAPVPSSAPVIPPTSTQIPLPAPIAAGPSDFIFTPQMLHSMLQSIHREQFIIMQSLQGLGLPSIMSMHEFDAQVAWPGAQPSPSGGGGASAAQGPAPKEPATATIEGEDELTPPKPFYFDADANIAQEEGTSINQIHEPSPVPIPEETQPSAPVTEPKQPIQDSSAAPALDLNEHQPQDEQDV

SEQ ID NO: 208602 - protein, 100 aa, Glycine max
  Coding DNA Sequence Number=SeqID_91824
MVRQKNVVDVDSCISGSSSMRNLGMRDRRISSWLNGVKGKVHNRFMVLGCKSQHGYKGSEGGQGESKRVSLGMQGRETILERGVREVKQETLTDSEGPSR

SEQ ID NO: 208603 - protein, 365 aa, Glycine max
  Coding DNA Sequence Number=SeqID_91825
  Gene Ontology: Mol. function=structural constituent of ribosome; Cellular component=intracellular; Biological process=translation
  Homolog annotation: Hit_ID=Q9LSN0; Match level="QueryCoverage=50%, HitCoverage=51%, E-value=4e-72, Identity=66%"; Hit description =Arabidopsis thaliana genomic DNA, chromosome 3, TAC clone:K14A17
  Pfam annotation: Domain name=Ribosomal_S6; Domain location=143-233; Score=115.2; E_value=1.9e-31; Accession=PF01250.8; Description =Ribosomal protein S6
  Subcellular localization annotation: CTP_CleavageSite=66; ConfidenceScore=5.56e-01
MEAKSLLQGSSLKPSYPLPKLSKTTMMTANCVRFSFNYNNPCLLFANGYPSSSSLPLSLQNKPRKSASVIVSARKKDKKEDTHSSVPKPDEVTGFFPEAVLLKKRTVEEEGKLLPEFEDAEERQLFEALMLELDSDMDVEILRHYEVMYLIHEKHEEEVAAVNEKIQDFLREKKGQVWRLNDWGMRRLAYKIKKANNAHYMLINFELDAKYINDFKTLLDQDERVIRHLVIKRDEAITEDCPPPPEFHTLRANADDNDDEEFDENYDDDWDGEDEEDGNDGDDGENGIIFVDDDDDDIDSRNETPANVRQPDIRKLRAENVGMKVTFSLEKLPLKITSPENCMLGRLGVDSNPFRSKSSKRIKRN

SEQ ID NO: 208604 - protein, 254 aa, Glycine max
  Coding DNA Sequence Number=SeqID_91826
MAIVQSLKLVYLLQLQLELVYLIFCLHLVELFSSQMGGNESLRRREMSRERNSEREWVSVRNRGRGRERGGQWERKDPRRNYVGHKDEQHTTLTRANWRERSDISSFYFTRFPKDATEEDLWRNIGGRRYGFVRFRGVNNERNLERQLDNIMVRGLKLYVNIPKYKREMMRNAEYKKQIKMQGNDDKHELEAAQQRQPQHRIPSISYPTVVATNTWNTRKRRPYENAIYRYNRSQSTVQIDILMGEKKWFSDAW

SEQ ID NO: 208605 - protein, 142 aa, Glycine max
  Coding DNA Sequence Number=SeqID_91827
  Gene Ontology: Mol. function=nucleic acid binding; Cellular component= nucleus
  Homolog annotation: Hit_ID=Q011Q3; Match level="QueryCoverage=87%, HitCoverage=52%, E-value=8e-18, Identity=40%"; Hit description =Chromosome 09 contig 1, DNA sequence
VQLELCWAGAICSGPQVYFSQGAQIGMDMFAAAMDNPPQCFDGETTLQSYFTDFDYPNKPAACSLTGSGVASGIGAYYQVPKPDALVKLVTTLSAPCEADIPDLVLYESSKEDGFSAQGQIFSPQCVADIKSGSAPPPDKCS

SEQ ID NO: 208606 - protein, 106 aa, Glycine max
  Coding DNA Sequence Number=SeqID_91828
  Gene Ontology: Mol. function=zinc ion binding; Cellular component =integral to membrane
  Homolog annotation: Hit_ID=Q1RSS3; Match level="QueryCoverage=93%, HitCoverage=31%, E-value=1e-46, Identity=85%"; Hit description=Zinc finger, RING-type; SPX, N-terminal
MALPRQDTVFDSVSLTCGHIFCYTCACSTASVTIVDGLKAANPKEKCPLCREGRVYEDAVHLEELNILLGRSCREYWEQRLQMERVERVKQVKEHWETQCRAFMGI

SEQ ID NO: 208607 - protein, 1501 aa, Glycine max
  Coding DNA Sequence Number=SeqID_91829
  Gene Ontology: Mol. function=ATPase activity, coupled to transmembrane movement of substances; Cellular component=integral to membrane; Biological process=transport
  Homolog annotation: Hit_ID=Q1RSS5; Match level="QueryCoverage=99%, HitCoverage=99%, E-value=0.0, Identity=79%"; Hit description=ABC transporter, transmembrane region, type 1
  Pfam annotation: Domain name=ABC_membrane; Domain location=321-590; Score=76.9; E_value=6.3e-20; Accession=PF00664.13; Description=ABC transporter transmembrane region
  Pfam annotation: Domain name=ABC_membrane; Domain location=942-1214; Score=89.0; E_value=1.4e-23; Accession=PF00664.13; Description=ABC transporter transmembrane region
  Pfam annotation: Domain name=ABC_tran; Domain location=1286-1469; Score=181.5; E_value=2e-51; Accession=PF00005.17; Description=ABC transporter
  Pfam annotation: Domain name=ABC_tran; Domain location=664-835; Score= 134.1; E_value=3.8e-37; Accession=PF00005.17; Description=ABC transporter
  Pfam annotation: Domain name=MFS_1; Domain location=90-472; Score= -48.1; E_value=0.05; Accession=PF07690.6; Description=Major Facilitator Superfamily
  Pfam annotation: Domain name=SMC_N; Domain location=651-838; Score= -107.0; E_value=0.00085; Accession=PF02463.9; Description=RecFRecNSMC N terminal domain
  Pfam module annotation: Pfam domain module=ABC_membrane::ABC _membrane::ABC_tran::ABC_tran::MFS_1::SMC_N; Domain location=321 -590::942-1214::1286-1469::664-835::90-472::651-838
  Subcellular localization annotation: CTP_CleavageSite=37; ConfidenceScore=5.46e-01
MSSAAASTWITSFSCSPNATPNLPHWLRFIFLSPCPQRALLSGVDILLLLTLFVFALIKLYSRFTSIGNHNSELDKPLIRNNRVSNRTTAWFKLTLTTTAVWTILYTVACILVFTSSTDGTWKQTDGFFWLLQAITQLVLAVLIIHEKKFQAVVHPLSLRIYWIANFILVSLFTASGVIRLVSVGVEDGKHFSFLVDDTVSFISLPLSLFLLCVAVKGSTGIVSGEETQPLIDEETKLYDKSNVTGFASASAISKAFWIWINPLLSKGYKSPLKIDEIPYLSPQHRAERMSVIFESKWPKSDERSKHPVRTTLLRCFWREIAFTAFLAVIRLSVMFVGPVLIQSFVDFTAGKGSSVYEGYYLVLILLCAKFVEVLTTHHFNFNSQKLGMLIRCTLITSLYKKGLRLTGSARQDHGVGPIVNYMAVDSQQLSDMMLQLHAVWMMPFQVGIGLFLLYNCLGASVITALLGLLAVIVFAVVSTRKNKRYQFNAMMSRDSRMKAVNEMLNYMRVIKFQAWEEHFNGRILGFRKSEFQWLSKFMYSICGVIIVLWSTPLLISTLTFGTALLLGVRLDAGTVFTTTTVFKILQEPIRTFPQSMISLSQALVSLGRLDRYMSSRELMDDSVEREEGCGGHTAVEVKDGTFSWDDDGQLKDLKNINLKINKGELTAIVGTVGSGKSSLLASILGEMHKISGKVQVCGSTAYVAQTSWIQNGTIEENIIFGLPMNRQKYNEVVRVCSLEKDLEMMEHGDQTEIGERGINLSGGQKQRIQLARAVYQDSDIYLLDDVFSAVDAHTGTEIFKECVRGALKGKTVILVTHQVDFLHNVDLIVVMRDGMIVQSGKYDDLLASGMDFSALVAAHDTSMELVEQGAVMTGENLNKPLKSPKAASNNREANGESNSLDQPKSGKEGSKLIKEEERETGKVSLHIYKLYCTEAFGWWGIIAVISLSVLWQASMMASDYWLAYETSEERAQLFNPSMFISIYAIIAVVSVVLIVLRSYSVTVLGLKTAQIFFSQILHSILHAPMSFFDTTPSGRILSRASTDQTNVDVFIPLFINFVVAMYITVISIFIITCQNSWPTAFLLIPLAWLNIWYRGYFLASSRELTRLDSITKAPVIHHFSESISGVMTIRAFRKQKEFCGENIKRVNANLRMDFHNFSSNAWLGFRLELLGSLVFCLSAMFMIMLPSSIIKPENVGLSLSYGLSLNAVMFWAIYMSCFIENKMVSVERIKQFTNIPSEASWNIKDRLPPANWPGEGHVDIKDLQVRYRPNTPLVLKGITLSINGGEKIGVVGRTGSGKSTLIQVFFRLVEPTGGKIIIDGIDISALGLHDLRSRFGIIPQEPVLFEGTVRSNIDPTGQYTDEEIWKSLERCQLKDAVASKPEKLDTSVVDNGDNWSVGQRQLLCLGRVMLKQSRLLFMDEATASVDSQTDAVIQKIIREDFAARTIISIAHRIPTVMDCDRVLVVDAGRAKEFDSPANLLQRPSLFGALVQEYANRSSGL

SEQ ID NO: 208608 - protein, 209 aa, Glycine max
  Coding DNA Sequence Number=SeqID_91830
  Homolog annotation: Hit_ID=Q01AF2; Match level="QueryCoverage=54%, HitCoverage=61%, E-value=7e-09, Identity=32%"; Hit description=[J] KOG4771 Nucleolar protein
  Subcellular localization annotation: CTP_CleavageSite=16; ConfidenceScore=5.04e-01
MGRSRRKYKQSRTKVRVGLPKKNPRLFKPSFSVPPKLLQSLDQEPQWDDQGTVNTNYSSFGVLSDPNSLTELSSDPQTIDSGSDLEEDDLKSALGKKRRDGRSAPPQPLTAMQRIHISRLVAKYGDDYQSMLVDIKLNPMQHSIGTLQKLCMSSYNTYQFEFWSMGKEGDLDLWVDGEVGKIEGLDLGLFVGGAVRCEAVLSSLQPWWN

SEQ ID NO: 208609 - protein, 412 aa, Glycine max
  Coding DNA Sequence Number=SeqID_91831
  Homolog annotation: Hit_ID=Q00VM5; Match level="QueryCoverage=55%, HitCoverage=66%, E-value=2e-94, Identity=76%"; Hit description=[R] KOG0154 RNA-binding protein RBM5 and related proteins
  Subcellular localization annotation: CTP_CleavageSite=45; ConfidenceScore=5.25e-01
MWDDSDEPIARVTRRLGRRAVAHATMRATNMHGTAVASRARATPRASRGVARCSMMPMISSAKTGAGATARAVTMPTRPAREASVARVRRARGRSAVVVASSAASGDNEPKKDEGGADAEASDVEASDVEGNEGAHAGERAHPTIDELKEEVIEEEMEEVTVMGRVSEGLRSASENPGLRNLGGLGFFFLASTFAYSCYKVFRKATSGRARRKRTVNKNVEVVERLKHFFPHERNSLNRGVVKGLSLKTGYTSAEIFRKYLRYKLTEEPFTLDFVADVLALKNACELDGEEMKEILVESGERMLKKYGTLMTNLAGLTQSGMERKIDGAGKFAKLMYLADLDEFIDKTAGGEVQLKLKEMFGATDEDYNKVKITALGSDEVDVSSLNTMIASMDESSETGEETTDSERPAEE

SEQ ID NO: 208610 - protein, 146 aa, Glycine max
  Coding DNA Sequence Number=SeqID_91832
  Gene Ontology: Mol. function=oxidoreductase activity; Cellular component=cytoplasm; Biological process=antibiotic biosynthetic process
  Homolog annotation: Hit_ID=Q0IBA2; Match level="QueryCoverage=80%, HitCoverage=91%, E-value=1e-22, Identity=43%"; Hit description =Antibiotic biosynthesis monooxygenase domain protein
  Pfam annotation: Domain name=ABM; Domain location=18-82; Score=44.2; E_value=4.4e-10; Accession=PF03992.6; Description=Antibiotic biosynthesis monooxygenase
MTKDDEPKPFLLIARCRAKPENVDAYVDAARVADEGVRASEPGMLHHTFVRDPDDACSFAWSEVYADADALLFHLENPPLVEFVARHEALGDRFSIEVYGTLDAATKAKFSATGFPIKRGEPPSTPSARAAATSLERSSREGIYPR

SEQ ID NO: 208611 - protein, 225 aa, Glycine max
  Coding DNA Sequence Number=SeqID_91833
  Subcellular localization annotation: CTP_CleavageSite=19; ConfidenceScore=5.56e-01
MCNMKKSQEILISAAGNPSSSNKTGPTLNPTTTNAPASPIAQPPRFPSTCPNSPSPPTTTPFTTPTTTAPPITASSRARGAAAAPDPCPARSSDRSGTRRCCSVGASAAYGTCSDFPVAMGTDSSGELFGNGDPNWSSDVSEAKNSRRERERDGEKENVGVGFGVSGCSDANGNESGYGSEPGYRGDAEFGYGDEFDEEEDDPRLLFWGDQLGAACSSEPRKRYS

SEQ ID NO: 208612 - protein, 196 aa, Glycine max
  Coding DNA Sequence Number=SeqID_91834
MTHDFDILSLQRRPEKRYFPFLQTTTTTCERKTCRRTTARRARSRGMWATRAIDDDFDGARSPSAGRERRRRGEKRGRERRMMRGRIAFLAALTLALTLAPAWGWAKGEDDATEGKTTDDESPMVEDGVPFDAPSQSFASKEELRAALEKEARERGFEIPENVFEMSSAEETMASLGVSSAGNETGDLGIFRLHLQ

SEQ ID NO: 208613 - protein, 67 aa, Glycine max
  Coding DNA Sequence Number=SeqID_91835
MAEIIIASTALHTWINVYRSGLIPHHIFILAKILRIGKWVRPWVSTKTTWSGIHAQNPGKIGLCSVC

SEQ ID NO: 208614 - protein, 59 aa, Glycine max
  Coding DNA Sequence Number=SeqID_91836
MKTVVCLVMLCNQRVMVPWCNVRLEEARPAIPAKCERPRTKKTCKSSNDMMCDCETSKP

SEQ ID NO: 208615 - protein, 169 aa, Glycine max
  Coding DNA Sequence Number=SeqID_91837
MEVGGAWMATIHIKQSPNGDKWVWTNDTSGKYTIRSAYQLMDMNSKDDNTDRIFHAIWKLKIPNKVDLVGIIVFDQYGGLFFATPRQNFMQHSVCNTRLGIKSQGWLIWWVALTWSKWNYRNIIIFSNNSPNTRVSICTINGDLQRDYPIQGPAYREYFPTGTGINISP

SEQ ID NO: 208616 - protein, 65 aa, Glycine max
  Coding DNA Sequence Number=SeqID_91838
MRNGLSSELGRDRDSVAGDGNEMRVNVCGRGEGKAFGAKTELPLSFGARSRLGEILGRGVFRNLH

SEQ ID NO: 208617 - protein, 59 aa, Glycine max
  Coding DNA Sequence Number=SeqID_91839
  Gene Ontology: Mol. function=structural constituent of ribosome; Cellular component=intracellular; Biological process=translation
  Homolog annotation: Hit_ID=Q1STG0; Match level="QueryCoverage=58%, HitCoverage=28%, E-value=2e-12, Identity=94%"; Hit description =Ribosomal L22e protein
  Pfam annotation: Domain name=Ribosomal_L22e; Domain location=1-59; Score=13.9; E_value=2.2e-06; Accession=PF01776.7; Description =Ribosomal L22e protein family
MGLANRCKILMRYLKYLTKKYLKKHNVRDWLRVIASNKERSVYELRYFNIAENEGEEED

SEQ ID NO: 208618 - protein, 568 aa, Glycine max
  Coding DNA Sequence Number=SeqID_91840
  Gene Ontology: Mol. function=binding; Cellular component =intracellular; Biological process=protein kinase C activation
  Homolog annotation: Hit_ID=Q9FND7; Match level="QueryCoverage=95%, HitCoverage=88%, E-value=1e-137, Identity=45%"; Hit description =Selenium-binding protein-like
  Pfam annotation: Domain name=PPR; Domain location=127-161; Score =24.6; E_value=0.00035; Accession=PF01535.11; Description=PPR repeat
  Pfam annotation: Domain name=PPR; Domain location=196-230; Score=9.7; E_value=0.54; Accession=PF01535.11; Description=PPR repeat
  Pfam annotation: Domain name=PPR; Domain location=263-297; Score =39.8; E_value=9.7e-09; Accession=PF01535.11; Description=PPR repeat
  Pfam annotation: Domain name=PPR; Domain location=298-332; Score =10.1; E_value=0.47; Accession=PF01535.11; Description=PPR repeat
  Pfam annotation: Domain name=PPR; Domain location=334-368; Score =12.1; E_value=0.28; Accession=PF01535.11; Description=PPR repeat
  Pfam annotation: Domain name=PPR; Domain location=400-434; Score =12.8; E_value=0.23; Accession=PF01535.11; Description=PPR repeat
  Pfam module annotation: Pfam domain module=PPR::PPR::PPR::PPR::PPR::PP R; Domain location=127-161::196-230::263-297::298-332::334-368::400 -434
  Subcellular localization annotation: CTP_CleavageSite=32; ConfidenceScore=5.27e-01
MRASAKAISCTHPSLHLSHPNIESFVWNNLIRASTRSRVQNPAFPPALSLYLRMRLHAVLPDLHTFPFLLQSINTPHRGRQLHAQILLLGLANDPFVQTSLINMYSSCGTPTFARQAFDEITQPDLPSWNAIIHANAKAGMIHIARKLFDQMPEKNVISWSCMIHGYVSCGEYKAALSLFRSLQTLEGSQLRPNEFTMSSVLSACARLGALQHGKWVHAYIDKTGMKIDVVLGTSLIDMYAKCGSIERAKCIFDNLGPEKDVMAWSAMITAFSMHGLSEECLELFARMVNDGVRPNAVTFVAVLCACVHGGLVSEGNEYFKRMMNEYGVSPMIQHYGCMVDLYSRAGRIEDAWNVVKSMPMEPDVMIWGALLNGARIHGDVETCEIAITKLLELDPANSSAYVLLSNVYAKLGRWREVRHLRDLMEVRGIKKLPGCSLVEVDGVIREFFAGDNSHPELLNLYVMLDEIMKRLEKHGYERNTGEVLLDLDEEGKEFALSLHSEKLAIAYCFLRTSPGTTIRIVKNLRICSDCHVAIKIISKEFNREIIVRDCNRFHHFKNGLCSCKDYW

SEQ ID NO: 208619 - protein, 96 aa, Glycine max
  Coding DNA Sequence Number=SeqID_91841
  Homolog annotation: Hit_ID=Q1SBC2; Match level="QueryCoverage=61%, HitCoverage=8%, E-value=2e-08, Identity=40%"; Hit description=Zinc finger, RanBP2-type
MFSDLAVLLPSLAQLVVLHSAQQPILELAHPWPEWVQLMKCLLYKGYFCREEGKMLCNAGMGMKDFDVIRTVCLNFGRDHFHLLRFGRDLELCDRL

SEQ ID NO: 208620 - protein, 269 aa, Glycine max
  Coding DNA Sequence Number=SeqID_91842
  Gene Ontology: Mol. function=calcium:sodium antiporter activity; Cellular component=integral to membrane; Biological process=calcium ion transport
  Homolog annotation: Hit_ID=Q1RUS5; Match level="QueryCoverage=96%, HitCoverage=48%, E-value=1e-116, Identity=79%"; Hit description =Sodium/calcium exchanger membrane region
  Pfam annotation: Domain name=Na_Ca_ex; Domain location=17-150; Score =27.7; E_value=4.2e-05; Accession=PF01699.14; Description =Sodiumcalcium exchanger protein
MENVVKHTRKVVEVDPVTKTETIRHEKVWNYTIADISLLTFGTSFPQISLATIDAIQNIGKLYAGGLGPGTLVGSAAFDLFPIHAVCVVVPKAGELKKIADLGVWLVELFWSFWAYIWLYIILEVWTPNVVTLWEALLTVLQYGLLLTHAYAQDKRWPYISLPIARDERPEDWVPEETPYFQHEAHAEVDFSDIKHVNEENGDTVDIFSIHSENPTDPLYARVPSINDEAEILDKAKETTLVDTHLLTIWRQQFLDALRVFRFMLQVYL

SEQ ID NO: 208621 - protein, 98 aa, Glycine max
  Coding DNA Sequence Number=SeqID_91843
  Gene Ontology: Mol. function=calcium:sodium antiporter activity; Cellular component=integral to membrane; Biological process=calcium ion transport
  Homolog annotation: Hit_ID=Q1RUS5; Match level="QueryCoverage=93%, HitCoverage=17%, E-value=8e-42, Identity=88%"; Hit description =Sodium/calcium exchanger membrane region
FLFAFVPPCQIAHGWISFICSLLFISGIAYVVTKITDVISCVTGINAYVIAFTALASGTSWPDLVASKIAAERQKTADSAIANITCRFSISTFTSFLL

SEQ ID NO: 208622 - protein, 619 aa, Glycine max
  Coding DNA Sequence Number=SeqID_91844
  Gene Ontology: Mol. function=nucleoside transporter activity; Cellular component=integral to membrane; Biological process =nucleoside transport
  Homolog annotation: Hit_ID=Q1Z5W1; Match level="QueryCoverage=63%, HitCoverage=91%, E-value=1e-150, Identity=67%"; Hit description =Putative transport protein
  Pfam annotation: Domain name=LacY_symp; Domain location=233-567; Score=-319.9; E_value=0.056; Accession=PF01306.10; Description=LacY protonsugar symporter
  Pfam annotation: Domain name=MFS_1; Domain location=237-592; Score =80.0; E_value=7.6e-21; Accession=PF07690.6; Description=Major Facilitator Superfamily
  Pfam annotation: Domain name=Nuc_H_symport; Domain location=230-619; Score=687.9; E_value=7.3e-204; Accession=PF03825.7; Description =Nucleoside H+ symporter
  Pfam module annotation: Pfam domain module=LacY_symp::MFS_1::Nuc_H _symport; Domain location=233-567::237-592::230-619
  Subcellular localization annotation: CTP_CleavageSite=92; ConfidenceScore=5.39e-01
MVPFIIGAAAMGTSTFFAHNVAMTVLLFSIAQAMIIGAVPVFFSLPATFLKGTAAAAGFALACSIANIAGLQQRRAVVLRRMPAAQLAVGGRAASEAGESVEDTCALKHLLFPGPPFMATRLHNLHNQVRINAHPTKQCEFVVIIAVGSPFMATWLHNLHNQARINAHPTKQCEFVVIIAVGSPFMATVSQPQDAAPHPARPSRPPAPNPPRLSVIHKIGSTNTGESISMKTTIPKLSFMMFLEWFIWGAWFVPLWAFLSKNGFSPVEIAWCYACTSIAAILSPILVGSLADRFFQAQKVLSLLTIAGAILMFFAAQQTHFSSFFPLLLLYALTYMPTIALTNSIAFSHVGDVERDYPRIRVMGTIGWIASGIACGFLPPLLGFGDISASNVPLLITAASSLLLGLFALTLPATEPKSTGKFSLRVALGLDALHLLKDRSFLVFFVCSFLFSMPLAFYYIFAEGYLTEVGLPHATGWMTLGQVSEIFFLLALPFFIKRFGIGKVLLLGLVTAALRYVFFVFGGDQNLLTFGLLFMGILLHGVSYDFYFITAYIYVDKKAPVAMRNAAQGLITLACQGIGSLLGYRLGGYLMQEMFAYDQPRNGQTFNWAGMWMFGSVMI

SEQ ID NO: 208623 - protein, 208 aa, Glycine max
  Coding DNA Sequence Number=SeqID_91845
MEDICKRWTEYLDSTRSRVNHPQSINCDFCGEEHFNDNCHLYSMKNSWWGQELYPYNQYEERTPNLESVFTKFTAYHPSSTANQNSMQNQEIQVGNSYSMENYQWEQELQPYNQYEEERTSNLDNLLMQFKEVTEYTQQAFKSFEIQVGKLAEEVTKFMARREENFIKVEAQEESPVRKHDSKEKDEDKSEEKAQQWEKYSQVEIQQE

SEQ ID NO: 208624 - protein, 171 aa, Glycine max
  Coding DNA Sequence Number=SeqID_91846
MPPSHPLNQRFQHGRRQGTGFGQCSRQHSEWCFFFGRESVLEAKDERGWGSGFAGWFPHPSPFGAGASSHCSVVPLRCILLHGWPCIVMVPMDVLERVFPFLAGHASSSGITAIDLARLQEDKMLDRHHGQRSFSTHHSPLLPKPLTPFSTPSSKLPVKRLTAEEMAVCRE

SEQ ID NO: 208625 - protein, 94 aa, Glycine max
  Coding DNA Sequence Number=SeqID_91847
MSKVLLADALNFLVASKKYIHIKRSHGRRYLWKMTMDNGLPSVVDPWYKYLTKNDLMSGDDVVFYYRFNERAWEVMFRKQVKWDEAGCSLLFDD

SEQ ID NO: 208626 - protein, 211 aa, Glycine max
  Coding DNA Sequence Number=SeqID_91848
MGEQWRQFKYDLTSKWAFADDKESVDDTDMRKKAQANQKHNIAPHVLSREGYEYSENKLMDEKRKKKLEEVAQSGSTDTVIDPLSPIRQHMKWKMARTKKTGQMTSEAAKEIAEKIESLEEQASYGFFVAIGRPEHRSRVGVVGVGVTIKKYFGLAPRTSRMSSSMAPEDLEQLMQQIRDQLEESITEKVTQRLMLSFQATVHPEIRAIEI

SEQ ID NO: 208627 - protein, 142 aa, Glycine max
  Coding DNA Sequence Number=SeqID_91849
  Subcellular localization annotation: CTP_CleavageSite=30; ConfidenceScore=5.22e-01
RRYLSYRCLQLRSGPTSHCGWVDNTTSFLPANRRSSHFVASLWVPCLPKSFPKWHSLYNQVSGSVTFKVFLSEQKISCSSLDIPTECRLVFNHHRKSLKIGAGWRQFCQTLSLDAGTEIVFEFINPRVNRVLYWLCSVDEMR

SEQ ID NO: 208628 - protein, 144 aa, Glycine max
  Coding DNA Sequence Number=SeqID_91850
MAVKRPSRDWQHKPKKAHWVNHGFPKPNWWKNKQIGTLNMWVQVYNQINCRTGTGTGANSNSNSNSNGNGVDEDKRPERFRSINVWGEKGFSGFELMNDTTSRRCIGDMLGISMRIRQVQLNDLINYPNKNGYNASMRGNVGDI

SEQ ID NO: 208629 - protein, 121 aa, Glycine max
  Coding DNA Sequence Number=SeqID_91851
MVEFPDNEHGRYVVKVDGVTDAAGNAAKRFELTVDAHCSRASPSKSSALGVQDRSAGAPSSAKSVRTTADAWMSIGVVASFVVIVAIAALRRRGGEDNDAQTETLLCANKGIAAGGYGATL

SEQ ID NO: 208630 - protein, 195 aa, Glycine max
  Coding DNA Sequence Number=SeqID_91852
  Gene Ontology: Mol. function=transferase activity
  Homolog annotation: Hit_ID=Q1IA03; Match level="QueryCoverage=99%, HitCoverage=97%, E-value=7e-59, Identity=60%"; Hit description =Putative glutathione S-transferase
MDSPYVRRVAVSLELYGVAFESQPLSVFSTFEEFSRINPAVKAPTLVLDNGTRLMDSSLILNYFEAQAAPERRLLPVAPDALANDLQTLGFILAAAEKAVQNVYEHHLRPAEKQHNPWIERITHQLLAACREWNTLLERRPDNAVADQVAVTSTVIWTFIQSMIPHVVNAGDFKKIQAVADVFENQAAFKKYPFS

SEQ ID NO: 208631 - protein, 181 aa, Glycine max
  Coding DNA Sequence Number=SeqID_91853
  Homolog annotation: Hit_ID=Q1T493; Match level="QueryCoverage=96%, HitCoverage=32%, E-value=2e-09, Identity=24%"; Hit description =Nucleic acid-binding, OB-fold, subgroup
MLTLGKIKDATGVSGGDKYPLSVQNIKFGSKLYVNADITKIHEFRQSLFVPFYSGGIIHDKDGSQSQSSQSNVVEKILQNAQVVSIGEINNLRQDCYCLTLGTVDEIIIDAPWSYDSCPNCTTTFDPSKGGSACRSCHTSVIDTVPRMKHNRDKGNFLLWDATCIKLFGKTAGECRDELIA

SEQ ID NO: 208632 - protein, 87 aa, Glycine max
  Coding DNA Sequence Number=SeqID_91854
  Homolog annotation: Hit_ID=Q1SAZ0; Match level="QueryCoverage=70%, HitCoverage=4%, E-value=3e-15, Identity=64%"; Hit description =Integrase, catalytic region
MGNFREKEVFPLMFEDIKALLFECVNRMKHIEIDRHFIKKKLDAGIICLSFMSSNQQTSNILTKSLARPILECLASKLDMLDIYAPT

SEQ ID NO: 208633 - protein, 551 aa, Glycine max
  Coding DNA Sequence Number=SeqID_91855
  Gene Ontology: Mol. function=transferase activity, transferring glycosyl groups; Cellular component=nucleus; Biological process =protein amino acid ADP-ribosylation
  Homolog annotation: Hit_ID=Q11207; Match level="QueryCoverage=98%, HitCoverage=88%, E-value=0.0, Identity=59%"; Hit description=Poly [ADP-ribose] polymerase 2 (EC 2.4.2.30) (PARP-2) (ADPRT 2) (NAD(+) ADP-ribosyltransferase 2)
  Pfam annotation: Domain name=PARP; Domain location=366-545; Score =285.7; E_value=9.1e-83; Accession=PF00644.10; Description=Poly(ADP -ribose) polymerase catalytic domain
  Pfam annotation: Domain name=PARP_reg; Domain location=231-364; Score= 227.0; E_value=4.2e-65; Accession=PF02877.5; Description=Poly(ADP -ribose) polymerase, regulatory domain
  Pfam annotation: Domain name=SAP; Domain location=3-37; Score=48.1; E_ value=3e-11; Accession=PF02037.17; Description=SAP domain
  Pfam annotation: Domain name=WGR; Domain location=110-195; Score =123.2; E_value=7.1e-34; Accession=PF05406.5; Description=WGR domain
  Pfam module annotation: Pfam domain module=PARP::PARP_reg::SAP::WGR; Domain location=366-545::231-364::3-37::110-195
MASSKMRVEELRTELLHRGLSTTGTKPTLVRRLEAALRKQTTSDGGACSPRRTRKRARDSNHSEEIEVAEETKDEEEEEEKIVTATQKGVAVLDQWLPDYVKTNYHVLQLGGDVYDAMLNQTNVRDNNNKFYVIQVLESDNGSDFLVYNRWGRVGIKGQDTIHGPFKSRESAIQEFEQKFLAKTKNDWSNRNNFVSYPKSYAWLEMDYSGKKNESTVTENPGHSLGKQPQESKLEPRVAKFISLVCNMSMMNQQMMEIGYNAKKLPLGKLSKSTILKGYEVLKRLANVIDKGDRKVLEQLSGELYTVIPHDFGFKKMCEFVIDTPQKLKRKLEMVEALAEIEVATKLLKDDTEMQGDPLYTHYQCLHCELVPVEFGCVEFSMIEEYMKNTHAETHSNYTVDIVQIFRTSREGLRIAPPEAPVTGYMFGKGVYFADMFSKSANYCYATRTAKDGVLLLCEVALGEMAELLTAKYDADQLPNGKLSTKGLGGTAPDPSKARELEDGLVVPLGKPKTKSGKKGHLLYNEYIVYNVEQIRMRYIVHVNFNFKTRS

SEQ ID NO: 208634 - protein, 262 aa, Glycine max
  Coding DNA Sequence Number=SeqID_91856
  Gene Ontology: Mol. function=DNA binding; Cellular component=beta -galactosidase complex; Biological process=DNA integration
  Homolog annotation: Hit_ID=Q1S1E0; Match level="QueryCoverage=96%, HitCoverage=39%, E-value=2e-56, Identity=50%"; Hit description =Integrase, catalytic region
MHGEICALERNHTWVLTDLPQHKNVIGCEWVYKIKHNADGSIERYKARLVAKGYTQIEGLDYLDTFSPVAKITTVRLLLALTALSMKYTKLGQVCKLQRSLYGLKQASSQWYARLSTFLVAHGFKQSSADYSLFTLKRENSFTALLVYVDDIVLSGNDLSVISHITKLLDDTFKIKDLDNLEYFLGFEVTHGTSANLIFHERTKHIEIDCHLVRDKLLSGLIKLLSIALAQQLVDVYTKALAPGAFHFIRSKLGMNVIHSLA

SEQ ID NO: 208635 - protein, 82 aa, Glycine max
  Coding DNA Sequence Number=SeqID_91857
  Homolog annotation: Hit_ID=Q2XC52; Match level="QueryCoverage=59%, HitCoverage=6%, E-value=7e-17, Identity=85%"; Hit description =RelA/SpoT protein
MKHFTDTLISANIGTKAGTGPPLEVDGIDKLDVADKALAVEPPLMQQRGDLFVLIRFEVAEGQVLQLPLDMADRIPAARGIH

SEQ ID NO: 208636 - protein, 283 aa, Glycine max
  Coding DNA Sequence Number=SeqID_91858
  Homolog annotation: Hit_ID=O21999; Match level="QueryCoverage=19%, HitCoverage=35%, E-value=1e-21, Identity=90%"; Hit description=LacZ -alpha
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIGHIKWELEDLSFRYLEPDQYKQIATLLHERRLDRERFISDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 208637 - protein, 90 aa, Glycine max
  Coding DNA Sequence Number=SeqID_91859
MILIPILVVPEVKYLSSSPRENIPCLRGPEKYSPFRDPHLWYKLIPLLQSGNQMLITEGQFQVSFGTSRTVIFTIINEVSHVEVWFPNTN

SEQ ID NO: 208638 - protein, 57 aa, Glycine max
  Coding DNA Sequence Number=SeqID_91860
MKKKCQKIRGQEDERSKQGEQPKKVLMGKNSPPQSVCEVEKHVSIEGVETRLKGYKW

SEQ ID NO: 208639 - protein, 194 aa, Glycine max
  Coding DNA Sequence Number=SeqID_91861
  Gene Ontology: Mol. function=DNA-directed RNA polymerase activity; Cellular component=spindle pole body; Biological process =transcription
  Homolog annotation: Hit_ID=Q01F38; Match level="QueryCoverage=47%, HitCoverage=23%, E-value=3e-21, Identity=55%"; Hit description=[K] KOG2587 RNA polymerase III
  Pfam annotation: Domain name=RNA_pol_Rpc82; Domain location=5-157; Score=-80.1; E_value=0.028; Accession=PF05645.4; Description=RNA polymerase III subunit RPC82
MREYESVHAVTSALDDPHAQILSYINTKSSDTLNRCVTLSALTSHCECTSKLTAKQVMDSVRLLQRCAYLSVSHLHDVSDEEWVRLNPEHALHTALSHLAQTTVKHRFGDIACRLFRLLLKTPQLEQKQISELAMIPLKDCREILGKLLKHEYVRMQEVARTTDHAPSRTNYLWKVHLPSVISKMKRELSETFC

SEQ ID NO: 208640 - protein, 381 aa, Glycine max
  Coding DNA Sequence Number=SeqID_91862
  Gene Ontology: Mol. function=enzyme inhibitor activity; Cellular component=cell wall; Biological process=cell wall modification
  Homolog annotation: Hit_ID=Q9M5J0; Match level="QueryCoverage=66%, HitCoverage=98%, E-value=2e-94, Identity=62%"; Hit description =Pectin methylesterase isoform alpha
  Pfam annotation: Domain name=Pectinesterase; Domain location=91-370; Score=469.2; E_value=5e-138; Accession=PF01095.10; Description =Pectinesterase
MTNLYTCLDGFAYSKGRVGDRIEKKLLQISHHVSNSLAMLNKVPGVEKLTTSSESDEVFPEYGKMQKGFPSWVSSKDRKLLQAKVNETKFNLVVAKDGTGNFTTIGEALSVAPNSSTTRFVIHVTAGAYFENVEVIRKKTNLMFVGDGIGKTVVKGSRNVRTAKFALYCSFMNNDPKSNPNSVDNNGKWYVAAVVGAGFIAKGITFEKSAGPDKHQAVALRSDFIFGNAAVVFQNCNLYARKPNENQKNLFMAQGREDPNQNTGISILNCKIAAAADLIPVKSSFKSYLGRPWKMYSMTVVLKSYVDIDPAGWLEWNETFALDTLYYGEYMNRGPCSNTSGRVTWPGYRVINSSIEASQFTVGQFIQDNDWLNNTGIPFFS

SEQ ID NO: 208641 - protein, 267 aa, Glycine max
  Coding DNA Sequence Number=SeqID_91863
  Gene Ontology: Mol. function=enzyme inhibitor activity; Biological process=metal ion transport
  Homolog annotation: Hit_ID=Q1S041; Match level="QueryCoverage=63%, HitCoverage=93%, E-value=9e-51, Identity=60%"; Hit description =Pectinesterase inhibitor
  Pfam annotation: Domain name=PMEI; Domain location=30-174; Score =92.6; E_value=1.2e-24; Accession=PF04043.6; Description=Plant invertasepectin methylesterase inhibitor
MESKRNLLWVMGICMWLVLAHHRSGAAEEKIGKELIKSICKNRGNNELCMQVLSSDPDSDHADLEELAMISLKAAASNASSILNDCKRMIDDQNLEPKVQQGLADCKENLLDAESQIQDAIASILSNDKLDAQVWLKAALAAIDTCDDSIPGDDDILSRKSVAFRQLCNIAVAINKAILRSDYGSHDGAYELDASQTGRRRRYVLTKVKEMTACERDLMKETLPFWGGKRELQKDGSNNEGRRRKVDIVGRELRNLFAIGRTWLDCS

SEQ ID NO: 208642 - protein, 320 aa, Glycine max
  Coding DNA Sequence Number=SeqID_91864
  Homolog annotation: Hit_ID=Q53M14; Match level="QueryCoverage=37%, HitCoverage=71%, E-value=2e-23, Identity=48%"; Hit description =Expressed protein
MTFQITKRQERILALYEANNSLILINDSNKGKGGFSVSQIEFPNSKIIAIQAATTLRGDEEVIEGKGSGGDADGEIEVFADANDVENVEPEEEDLHANPAEFGEPAFGYVAGDGFLVAQLVRTFEGETARTVQIGAEFAAGRIQLVTGHSLGENTRRKVKALQHLVRRRGGGDRRREEEEEKEGGDGHAPSIIGIELKSGGFMEVYMNLPLGYHVEDSGLACKLHKSLYGLRQALRLLDLLKEFIFHRANILYLFEDTNLLASKLSILLMDRGVKLTAFDGQPSEDALIWRLMNLLVLLTNSAYLQVVHNLLRHLKDSPT

SEQ ID NO: 208643 - protein, 559 aa, Glycine max
  Coding DNA Sequence Number=SeqID_91865
  Gene Ontology: Mol. function=enzyme inhibitor activity; Cellular component=cell wall; Biological process=cell wall modification
  Homolog annotation: Hit_ID=Q7XAF8; Match level="QueryCoverage=98%, HitCoverage=98%, E-value=0.0, Identity=62%"; Hit description =Papillar cell-specific pectin methylesterase-like protein
  Pfam annotation: Domain name=PMEI; Domain location=26-182; Score =91.6; E_value=2.3e-24; Accession=PF04043.6; Description=Plant invertasepectin methylesterase inhibitor
  Pfam annotation: Domain name=Pectinesterase; Domain location=246-544; Score=719.5; E_value=2.3e-213; Accession=PF01095.10; Description =Pectinesterase
  Pfam module annotation: Pfam domain module=PMEI::Pectinesterase; Domain location=26-182::246-544
  Subcellular localization annotation: CTP_CleavageSite=65; ConfidenceScore=5.07e-01
MANNKLTFVIILIFLPSLLALADITPNTSVSPGTICKSTPDPSYCNSVLPPQNGNVYEYGRFSVRKSLSQATNFLNLVNRYLQLQRRSSLSTPAIHALEDCQSLAELNIDFLSSSLETVNRTTKFLPTSQADDIQTLLSAILTNQQTCLEGLQATASAWRLKNGLSVPLSNDTKLYSVSLALFTKGWVPENANVTAFQPSAKHRGFRNGRLPLKMSSRTRAIYESVSRRKLLQATVGDEVKVKDIVTVSKDGNGNFTTISDAVAAAPNKTSSTAGYFLIYVTAGVYEENVSIDKKKTYLMMVGDGINKTIITGNRSVVDGWTTFKSATFAVVGARFVGVNMTIRNTAGAEKHQAVALRNGADLSTFYSCSFEGYQDTLYTHSLRQFYRECDIYGTVDFIFGNAAVVFQNCNLYPRLPMSGQFNSITAQGRTDPNQNTGTSIHNCTIRPADDLAANIDAAETYLGRPWKNYSRTVYMQSFMDTVINSAGWREWDGDFALSTLYYAEFNNTGPGSTTANRVTWPGYHVINATVAANFTVANFLLGDNWLPQTGVPYASNLI

SEQ ID NO: 208644 - protein, 241 aa, Glycine max
  Coding DNA Sequence Number=SeqID_91866
  Gene Ontology: Mol. function=enzyme inhibitor activity; Cellular component=cell wall; Biological process=cell wall modification
  Homolog annotation: Hit_ID=Q7XAF8; Match level="QueryCoverage=96%, HitCoverage=41%, E-value=1e-38, Identity=39%"; Hit description =Papillar cell-specific pectin methylesterase-like protein
  Pfam annotation: Domain name=PMEI; Domain location=1-131; Score=15.3; E_value=0.0008; Accession=PF04043.6; Description=Plant invertasepectin methylesterase inhibitor
MLANQNGNIFDYGRISFRKSLSQARKFLNLVDSYLQGSLSLSQYSLGALEDWQFVVEQSLEYLSNIYATANQVSGFLHTSEAKDFETYLSAVLTNQQTCLNGLQSSDARAKNELSSSFSDDLKLHNVTLALFIKGWVPEIKIMTPLPQNGRHLNLKNDHLPVIMSNRVRAVYDSARHHRRNLLKTDLSVVVSDFAVVSQDESRNFTTINGAIVVAPNNTVVDNGYFLIFIVKGHSHNLGLM

SEQ ID NO: 208645 - protein, 1001 aa, Glycine max
  Coding DNA Sequence Number=SeqID_91867
  Gene Ontology: Mol. function=protein binding; Cellular component =integral to membrane; Biological process=protein amino acid phosphorylation
  Homolog annotation: Hit_ID=Q4VSU4; Match level="QueryCoverage=74%, HitCoverage=92%, E-value=1e-128, Identity=36%"; Hit description=Hcr9- OR2B
  Pfam annotation: Domain name=LRRNT_2; Domain location=206-266; Score =27.0; E_value=6.6e-05; Accession=PF08263.3; Description=Leucine rich repeat N-terminal domain
  Pfam annotation: Domain name=LRR_1; Domain location=271-290; Score =3.5; E_value=63; Accession=PF00560.23; Description=Leucine Rich Repeat
  Pfam annotation: Domain name=LRR_1; Domain location=297-320; Score =7.3; E_value=12; Accession=PF00560.23; Description=Leucine Rich Repeat
  Pfam annotation: Domain name=LRR_1; Domain location=322-344; Score =14.0; E_value=0.54; Accession=PF00560.23; Description=Leucine Rich Repeat
  Pfam annotation: Domain name=LRR_1; Domain location=383-405; Score =8.1; E_value=8.7; Accession=PF00560.23; Description=Leucine Rich Repeat
  Pfam annotation: Domain name=LRR_1; Domain location=411-433; Score =8.2; E_value=8.5; Accession=PF00560.23; Description=Leucine Rich Repeat
  Pfam annotation: Domain name=LRR_1; Domain location=459-481; Score =7.6; E_value=11; Accession=PF00560.23; Description=Leucine Rich Repeat
  Pfam annotation: Domain name=LRR_1; Domain location=483-505; Score =6.1; E_value=21; Accession=PF00560.23; Description=Leucine Rich Repeat
  Pfam annotation: Domain name=LRR_1; Domain location=507-528; Score =14.3; E_value=0.44; Accession=PF00560.23; Description=Leucine Rich Repeat
  Pfam annotation: Domain name=LRR_1; Domain location=529-543; Score =5.6; E_value=25; Accession=PF00560.23; Description=Leucine Rich Repeat
  Pfam annotation: Domain name=LRR_1; Domain location=546-568; Score =9.3; E_value=5.2; Accession=PF00560.23; Description=Leucine Rich Repeat
  Pfam annotation: Domain name=LRR_1; Domain location=575-594; Score =6.0; E_value=21; Accession=PF00560.23; Description=Leucine Rich Repeat
  Pfam annotation: Domain name=LRR_1; Domain location=596-619; Score =5.1; E_value=32; Accession=PF00560.23; Description=Leucine Rich Repeat
  Pfam annotation: Domain name=LRR_1; Domain location=620-642; Score =11.3; E_value=2.2; Accession=PF00560.23; Description=Leucine Rich Repeat
  Pfam annotation: Domain name=LRR_1; Domain location=644-663; Score =10.1; E_value=3.7; Accession=PF00560.23; Description=Leucine Rich Repeat
  Pfam annotation: Domain name=LRR_1; Domain location=668-690; Score =9.1; E_value=5.5; Accession=PF00560.23; Description=Leucine Rich Repeat
  Pfam annotation: Domain name=LRR_1; Domain location=692-714; Score =19.1; E_value=0.016; Accession=PF00560.23; Description=Leucine Rich Repeat
  Pfam annotation: Domain name=LRR_1; Domain location=716-739; Score =2.8; E_value=87; Accession=PF00560.23; Description=Leucine Rich Repeat
  Pfam annotation: Domain name=LRR_1; Domain location=742-765; Score =15.6; E_value=0.18; Accession=PF00560.23; Description=Leucine Rich Repeat
  Pfam annotation: Domain name=LRR_1; Domain location=812-834; Score =10.1; E_value=3.6; Accession=PF00560.23; Description=Leucine Rich Repeat
  Pfam annotation: Domain name=LRR_1; Domain location=836-858; Score =18.6; E_value=0.023; Accession=PF00560.23; Description=Leucine Rich Repeat
  Pfam annotation: Domain name=LRR_1; Domain location=860-882; Score =18.6; E_value=0.023; Accession=PF00560.23; Description=Leucine Rich Repeat
  Pfam annotation: Domain name=LRR_1; Domain location=884-906; Score =8.0; E_value=8.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=206-266::271 -290::297-320::322-344::383-405::411-433::459-481::483-505::507 -528::529-543::546-568::575-594::596-619::620-642::644-663::668 -690::692-714::716-739::...
  Pfam module annotation: =742-765::812-834::836-858::860-882::884-906
MGEACWCVWVLWWSLVEKMMTGGQFNTFGNDSYAGNPMLCGFPLSKSCNKSEDRLPHSTFQHEESGFGWKAVAVGYACGFLFGMLLGYNVFMTGNHNGSRVLLKIIFTSGYDSVVRMWDMENGLSIASSRPLGCTIGEDGAIHMYEIVNDGYESKAWHVAVWVPHSDLRAIFSLWRMNINNSLCWLLLPYFIFLLSLPSSSFSFCNHHDSSALLLFKNSLALNTSHHYYWFVDHFPWLHVYCSFSSKTESWKNGTDCCEWDGVTCDIISGHVIGLDLSCSNLQGQLHPNSTIFSLRHLQQLNLAYNDFSGSSLYSTIGDLVNLMHLNLSYSQISGDIPSTISHLSKLLSLDLGCLYMTFGDPNYPRMRVDRYTWKKLIQNATNLRELYLDGVDMSSIRESSLSLLTNLSSSLISLTLRDTKLQGNLSSDILCLPNLQKLSFGPNNNLGGELPKSNWSTPLRQLGLSYTAFSGNIPDSIGHLKSLNILALENCNFDGLVPSSLFNLTQLSILDLSDNHLTGSIGEFSSYSLEYLSLSNNKLQAPLQNLLQLDLSHNIIRGSIPQWFHEKLLHSWKNIAFIDLSFNKLQGDLPIPPNGIEYFLVSNNELTGNFPSAMCNVSSLNILNLAHNNLAGPIPQCLGTFPSLWTLDLQKNNLSGNIPGNFSKGNALETIKLNGNQLDGPLPRSLAHCTNLEVLDLADNNIEDTFPHWLESLQELQVLSLRSNKFHGVITCYGAKHPFLRLRIFDVSNNNFSGPLPKSYIKNFQEMMNVNVSQTGSIGLKNTGTTSNLYNDSVVVVMKGHYMELVRIFFAFTTIDLSNNMFEGELPKVIGELHSLKGLNLSHNAITGTIPRSFGNLRNLEWLDLSWNQLKGEIPVALINLNFLAVLNLSQNQFEGIIPTGGQFNTFGNDSYAGNPMLCGFPLSKSCNKDEDWPPHSTFHHEESGFGWKSVAVGFACGLVFGMLLGYNVFMTGKPPLLARLVEGVHISGLKRTNNRIHAN

SEQ ID NO: 208646 - protein, 200 aa, Glycine max
  Coding DNA Sequence Number=SeqID_91868
  Gene Ontology: Mol. function=hydrolase activity, acting on glycosyl bonds; Cellular component=cellular_component; Biological process =carbohydrate metabolic process
  Homolog annotation: Hit_ID=Q9FV64; Match level="QueryCoverage=97%, HitCoverage=51%, E-value=4e-40, Identity=46%"; Hit description=NTS1 protein
  Pfam annotation: Domain name=Glyco_hydro_28; Domain location=1-200; Score=-73.4; E_value=1.6e-05; Accession=PF00295.8; Description =Glycosyl hydrolases family 28
MAAATSQNNSTGKQSGHRRHAHKHKRQDQGFQLRHWNRRQPGTAPQACTLTYISIGYSTTDIAITNITCAHSHGVSIGSLGKWPEERSVNGISVTNCTFLNTTNGARIKTWMGTVPAEAKNIAYEGLIMKGVQNPIVIDQSYGFKKKSVSLQCSTSNPCEGVEIADVDLAYAGRPHNTSFVSSCSNAKTIFGGILNPPAC

SEQ ID NO: 208647 - protein, 143 aa, Glycine max
  Coding DNA Sequence Number=SeqID_91869
  Gene Ontology: Mol. function=hydrolase activity, acting on glycosyl bonds; Biological process=carbohydrate metabolic process
  Homolog annotation: Hit_ID=Q9FV64; Match level="QueryCoverage=79%, HitCoverage=25%, E-value=1e-14, Identity=41%"; Hit description=NTS1 protein
MEKDDFRLGETREAGQKELLLITTATGRALFLLGVVFLSCTLIGASSCGFETRRSLLLPVPKNGPAIFYVTKFGAVADDKTDNIDAFRAAWGEACRNSTTQAKVLIPAGTFRAAQTMFAGPCTSPKPITIEVIGTVKASTDPS

SEQ ID NO: 208648 - protein, 1271 aa, Glycine max
  Coding DNA Sequence Number=SeqID_91870
  Gene Ontology: Mol. function=RNA-directed DNA polymerase activity; Cellular component=chromatin; Biological process=chromatin assembly or disassembly
  Pfam annotation: Domain name=RVP_2; Domain location=334-458; Score= -46.4; E_value=0.0041; Accession=PF08284.2; Description=Retroviral aspartyl protease
  Pfam annotation: Domain name=RnaseH; Domain location=827-947; Score= -27.8; E_value=0.022; Accession=PF00075.14; Description=RNase H
  Pfam annotation: Domain name=rve; Domain location=1081-1237; Score =113.1; E_value=7.9e-31; Accession=PF00665.16; Description=Integrase core domain
  Pfam annotation: Domain name=zf-H2C2; Domain location=1022-1063; Score=23.7; E_value=0.00026; Accession=PF09337.1; Description=His(2)- Cys(2) zinc finger
  Pfam module annotation: Pfam domain module=RVP_2::RVT_1::Retrotrans _gag::RnaseH::rve::zf-H2C2; Domain location=334-458::582-772::105 -195::827-947::1081-1237::1022-1063
MADHGTRKTTTDRLEEAIVRLTNSHTSINDRYNNLAGKVDAILEHLRLRDSGVPSTTAPTPSPSHQRNTVKLNIPKFDGHDPLGWIFKITQLFQYQNTPEEERVTIASLYLDGAALSWYQWMFSNGLITSWDGFLQALESRFAPTFYEDPKGALFKLTQRGTVNEYLTEFERLANRVVGLPPPFLLSCFVSGLNPDLRREVMAFQPISLLQAQALAKLQEEKLRDKPVPIPRSFSHPKPLINQNTTLTSKPKSAFVQRTPAEMAFRREKGLCYNCDEKWHAGHRCKGKVMLFIAEEQAPSPDSVDHETIADPGTTMLDDHEPPTDSDCSHISLHALAGLPSSETFRIYGHIRNAKLTILVDSGSTHNFLQPRIAQFLHLQAQHTPPLRVMVGNDAMLTCDQVCPETQVSIQGHTFMVSFHLLPISGVDAVLDIDWLKGLGPVTTDYTESIMRFQHCGHDISLRADVAIGPEPTSATQLKRLLQTGSAAGFYQLHVLDPTPLEPPFAPHPIQSVEQLLRRYDHLFQPPSRLPPARQVVHRITLKPSTAPVSVRPYRYPHFQKNEIEKKISELLSAGLIRPSSSPYSSPVLLVKKKDGTWRLCVDYRALNSVTVQDRFPIPTIDKLLDELGRASWFSRLDLRQGFHQILMEENDIEKTAFRTHNGHFEYLVMPFGLCNAPSTFQSAMNTLLRPFLRQFVTVFFDDILIYNSSLSAHLHHLETILRTLQHESLEYLGHIVSSRGVTPEPSKIQAVIGWPPPKTTRDLRAFLGLTGFYRKFVKGYASIAAPLTKLLCKDSFQWTQESQTAFDLLKTAMTTIPVLALPNFFETFVLETDASSSTIGVVLIQNGHPLAYFSKSLGPRLLHASTYIRELHAIVAAVRKWRQYLLGRPFTILTDHKSIRELMTQVIQTPEQHYYLSKLLGYDYSIQYKSGASNVVADALSRAPAVDGELLILSVPQLDFLHDIKRSLETNLEFQQLTKSLQEDPASYPEHTLCDGLILFRGRVWLNNGNPSIPSLLFEYHATPLGGHLGIAKTTHRLESNFYWSSLKADVKRFIKECVSCQQNKNLHQRPSGLLQPLPVPANVWEDLSMDFITHLPPSHGFTVILVVVDRYSKGIHLGALPTGFTAFKVATLFMDIICKLHGFPKSIISDRDLVFVSSFWKELFRLSGTRLRLSTAYHPQTDGQTEVLNRVLEQYLRCFVHDRPASWFPYLALAEWSYNTSRHSGSGFTPFEIIFGKPPPTIVDYLPGTTKNEVVHSVLQERGDLHSKL

SEQ ID NO: 208649 - protein, 90 aa, Glycine max
  Coding DNA Sequence Number=SeqID_91871
MYLFKSHAIVPFERRVQVEVTKGQYETRSGGPRGIDSDLEDKTQISHAIFASDLDEAQTQRWLQIWAEGVVGRYSCVRVVSGVRVNIGVS

SEQ ID NO: 208650 - protein, 115 aa, Glycine max
  Coding DNA Sequence Number=SeqID_91872
MLWHVAIQWTSFGLAQATIMNQGSYSHQSLNQQLPQVSETMQLLQLQLNEDTALQFTKSSIIFSLLRQRSTRAQRASALNGSGSTSAKQGVKHEDAESVTRTEHALGARSNRSTR

SEQ ID NO: 208651 - protein, 250 aa, Glycine max
  Coding DNA Sequence Number=SeqID_91873
  Gene Ontology: Mol. function=structural constituent of ribosome; Cellular component=intracellular; Biological process=translation
  Homolog annotation: Hit_ID=Q1RV36; Match level="QueryCoverage=74%, HitCoverage=88%, E-value=5e-90, Identity=89%"; Hit description =Ribosomal protein L19e
  Pfam annotation: Domain name=Ribosomal_L19e; Domain location=2-149; Score=333.1; E_value=4.7e-97; Accession=PF01280.10; Description =Ribosomal protein L19e
MVSLKLQKRLAASVLKCGRGKVWLDPNEVNEISMANSRQNIRKLVKDGFIIRKPTKIHSRSRARRMKEAKRKGRHSGYGKRKGTREARLPTKILWMRRMRVLRRLLRKYRESKKIDKHMYHDMYMKVKGNVFKNKRVLMESIHKSKAEKAREKTLSDQFEAKRAKNKASRERKNARREERLAQGPGERPPAAQTATPATASQPPREAFFMQSIEEIQEVSRIYRDLVDGQLGKERITNDFSFDPPNKAYP

SEQ ID NO: 208652 - protein, 243 aa, Glycine max
  Coding DNA Sequence Number=SeqID_91874
  Gene Ontology: Mol. function=structural constituent of ribosome; Cellular component=intracellular; Biological process=translation
  Homolog annotation: Hit_ID=Q1RV36; Match level="QueryCoverage=77%, HitCoverage=88%, E-value=1e-90, Identity=90%"; Hit description =Ribosomal protein L19e
  Pfam annotation: Domain name=Ribosomal_L19e; Domain location=2-149; Score=332.3; E_value=8.4e-97; Accession=PF01280.10; Description =Ribosomal protein L19e
MVSLKLQKRLAASVLKCGRGKVWLDPNEVNEISMANSRQNIRKLVKDGFIIRKPTKIHSRSRARRMKEAKRKGRHSGYGKRKGTREARLPTKILWMRRMRVLRRLLRKYREAKKIDKHMYHDMYMKVKGNVFKNKRVLMESIHKSKAEKAREKTLSDQFEAKRAKNKASRERKNARREERLAQGPGEKPSAAPSAPSAIASLPAQSNYQKNEQDLDWISLELPIPDLASLLVADDIGVQFLRV

SEQ ID NO: 208653 - protein, 167 aa, Glycine max
  Coding DNA Sequence Number=SeqID_91875
  Gene Ontology: Mol. function=oxidoreductase activity
  Homolog annotation: Hit_ID=Q8H7N1; Match level="QueryCoverage=41%, HitCoverage=79%, E-value=3e-22, Identity=64%"; Hit description =Putative alcohol dehydrogenase
  Pfam annotation: Domain name=ADH_N; Domain location=40-119; Score= -6.2; E_value=0.0023; Accession=PF08240.2; Description=Alcohol dehydrogenase GroES-like domain
MEHKVATTTEGQPIRCKAAVCREAGEPLSIEEIIVAPPMPGEARIRITCSTLCQTDISFWNMQDHPVIYPRILGHEAIGKPMFLVERSLSLSLKVCTNMPRTMGWGKTIVLGVDKPGSKLNLSCSEVHVCGKSLRGYLFGGLKPKSDVPILLKRYMDKGTPRYLGPL

SEQ ID NO: 208654 - protein, 511 aa, Glycine max
  Coding DNA Sequence Number=SeqID_91876
  Gene Ontology: Mol. function=polygalacturonase activity; Cellular component=cellulose and pectin-containing cell wall; Biological process=carbohydrate metabolic process
  Homolog annotation: Hit_ID=Q2XTD7; Match level="QueryCoverage=77%, HitCoverage=85%, E-value=1e-141, Identity=58%"; Hit description =Polygalacturonase-like protein-like
  Pfam annotation: Domain name=Glyco_hydro_28; Domain location=139-484; Score=-21.7; E_value=4.4e-08; Accession=PF00295.8; Description =Glycosyl hydrolases family 28
MQIKYAKWVNGKDVYLVGIIYEIALALFHFLFCPYVLVLVLLPSSSLLFHHCFQSLLFLFEEEGHRPMKSLVAVLLVIVLSTALESNGEDDHERCKQEAVDPRPHSVSILEFGAVGDGKTLNTVAFQNAVFYAKSFADKGGAKLYVPSGKWLTGSFNLTSHLTLFLERGATIIASQDYAHWTAMDPLPSYGRGIDVPSGRYRSLIYGQNLSDVGSVWWDLIGTHSLNYSRPHIIELVGSDNITISNLTFLNSPAWSIHPVYCSNVQIQKITVHAPTEFPYTSGIVPDSSEHVCIYNSNISTGHDAIVLKSGWDQYGVAYGKPTSKVHIRGVYLQSSSGAGLAFGSEMSGGISDIIAEQLHITNSTIGIELKTTKGRGGYMKNIFISDAKLENIYLGISMTGSSGSHPDDKYDPNAVPDVGNVTFENVIGTNIAIAGNFSGIVDSPFTPICLLNATFSSSSESSSPSWFCSDIMGISEEVFPEPCPDLQNTYSNFSSCFSSLHPSSSYVSSA

SEQ ID NO: 208655 - protein, 104 aa, Glycine max
  Coding DNA Sequence Number=SeqID_91877
MGVLHGLKLKDCCPNVGVVFWIHLKHFVIARQSYMVTVYRDWIERKELVFYSVVNQVFDGAQRGFGDWETKKLSYGSSTKLAYDMQNMVIIIIKSTGDTFHQLV

SEQ ID NO: 208656 - protein, 199 aa, Glycine max
  Coding DNA Sequence Number=SeqID_91878
MSMTLFVKNTTLARINEPNFVKAAETPHGTYDVRKKAQAIQKQNMVPHVLSRGGYQLLEQKLMVDKTNKKQEEVSQSESTEAVFDPPSPINRHVKWKMARTKKIGQMTFVAAKEITNKIESLGSFVPHRRQDVLTVAIRRPEHGGRVRAAGAGVTIKHFFRPAKKTYRSSSSIDPKELEQLTQQIRDQLEELITEKVTR

SEQ ID NO: 208657 - protein, 57 aa, Glycine max
  Coding DNA Sequence Number=SeqID_91879
MEPRGIPNCGSSEKSALWVLEWMQMEESFVSLLYGVATATTLVLPNNLSDNLTSSKV

SEQ ID NO: 208658 - protein, 192 aa, Glycine max
  Coding DNA Sequence Number=SeqID_91880
  Homolog annotation: Hit_ID=Q5PHJ7; Match level="QueryCoverage=36%, HitCoverage=59%, E-value=7e-26, Identity=78%"; Hit description =Putative conserved membrane protein
  Pfam annotation: Domain name=Multi_Drug_Res; Domain location=12-104; Score=98.9; E_value=1.5e-26; Accession=PF00893.10; Description=Small Multidrug Resistance protein
MAFISHRREIMLYWILLALAIAAEITGTVSMKWASVNGGSAGYIFMLLMIALSYIFLTFAVKRIALGVAYAMWEGVGILFITLFSVMLFDEALSVMKAAGLITLIAGIALIKAGTFSRSEGDRSLGGLRLVGRFRSGGDRTGRLDPVRTTPEHPRLAGRGAAAGRDGVDQICLRQRNTACLAFPILGEKGRH

SEQ ID NO: 208659 - protein, 154 aa, Glycine max
  Coding DNA Sequence Number=SeqID_91881
  Homolog annotation: Hit_ID=UPI0000E45195; Match level="QueryCoverage =65%, HitCoverage=65%, E-value=1e-44, Identity=80%"; Hit description =conserved hypothetical protein
MGVLCGFIWLRAVFCPHPNPLPRGEGIVKCVVGGRILNSSHAQSVPSPACGRSHSSRPAIAHWLKQPTRVQYGPYHVNPYLALLRVEFTVPRTVASRAVRSYRTLSPLPDPITGPSAALPGTLPYGARTFLPSARLPRKGRRQSGDCLVSFGAG

SEQ ID NO: 208660 - protein, 416 aa, Glycine max
  Coding DNA Sequence Number=SeqID_91882
  Homolog annotation: Hit_ID=P0ACS5; Match level="QueryCoverage=23%, HitCoverage=94%, E-value=2e-36, Identity=60%"; Hit description=HTH -type transcriptional regulator zntR (Zn(II)-responsive regulator of zntA)
  Pfam annotation: Domain name=MscL; Domain location=29-159; Score =210.1; E_value=5.1e-60; Accession=PF01741.9; Description=Large -conductance mechanosensitive channel, MscL
DHVIMFLTDKKFVPDVEPIGQGKEITMSLFKEFRDFAMRGNVVDLAVGVIIGAAFGKIVSSLVANIIMPPLGLLIGGVDFKQFKWVLKPAEGDIPAVVMEYGNFIQTVFDFIIVAFAIFIAIKVMNKLRPEVSTVAYRWPPDSLPSHVYLYAGSCLSPSDCAQHAGDTADRVTGLPGLPARQNSILATTNFRMRIFAGFQRLEDRTAGATVPVATTGVMLWINTDRQQVADRFQAETKLPAVTDKTQALQIVIAVQAEAALGAYLMIHHLLLFIKADGVRRHVRQFCQLANAIHTISPAVAADRSPGGIRHAENRCSCQPAVASLPAAIEFAKQIAQCQRVAAHLQFRWEIAGVFQQSPGTAQFRRHTTVIVQRERRTFTRQIAQLALFLSGADVLLSQLIDKPHRNLLQACLPTA

SEQ ID NO: 208661 - protein, 115 aa, Glycine max
  Coding DNA Sequence Number=SeqID_91883
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=99%, HitCoverage=25%, E-value=6e-30, Identity=75%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=1-114; Score=-71.7; E_value=0.00074; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLNFN

SEQ ID NO: 208662 - protein, 349 aa, Glycine max
  Coding DNA Sequence Number=SeqID_91884
MINHSCEPNASTIELLTPVEFSPIVQQQFQVVPRIVFIAITGIEAGEEICIDYCPRRQPDQMRRILKCFCGKPSCRALVQLRLAVDRGGEPRLERYSSAPQSTRVALSLVAREKFRMDKVAAERAERLRAMREAATSAKTQENATESSSATLPQPFAGSEDGNTRAPGFYTEVGSQASANDARTLFEARKPPPPPPPPPPLRWLQDQRPPSQGGGCGVSRGRKAPRVGGVRHDQKPFNASVYYKTDPTARVRASRAADDVRRPVDSARTKLLVRAVPAIERSDIALESMNCARSTTHVALFERVSLNLSVYRCVVRANVCQHHHHSIHLEDATGRPRVMGAAAAADDEP

SEQ ID NO: 208663 - protein, 83 aa, Glycine max
  Coding DNA Sequence Number=SeqID_91885
MGEKLATQLAQASKVASSRSNSLLEESSGGPKWAWLLFAPPFLLSAPPFLFFGTDPKNNRITCFPVTRDFALDNGGHMNSAWQ

SEQ ID NO: 208664 - protein, 95 aa, Glycine max
  Coding DNA Sequence Number=SeqID_91886
MICLIGSMLMRYTLSKIVILLVKCSASSFEQSIQRQNIPMLNQFHAINQDSIENIVDVKAYGNCGYCAIAALLGFSTKPLSFTTIGVVVEYTLPL

SEQ ID NO: 208665 - protein, 143 aa, Glycine max
  Coding DNA Sequence Number=SeqID_91887
  Gene Ontology: Cellular component=chloroplast thylakoid membrane
  Subcellular localization annotation: CTP_CleavageSite=50; ConfidenceScore=5.36e-01
MALSATFMPPSSPKLNLYSKIRRPFYPHSVRLLKPVKIWASTTLDYSNVSTNDKSSPLKTSNWQWKFKDNFINIYYEEHVKESPEPPQNILMMPTISDVSMVEEWRLVAGDIVQRNGNTNWRATIVDWPGLGYSDRPKMDYKR

SEQ ID NO: 208666 - protein, 218 aa, Glycine max
  Coding DNA Sequence Number=SeqID_91888
  Gene Ontology: Mol. function=transferase activity; Cellular component= intracellular; Biological process=regulation of transcription
  Homolog annotation: Hit_ID=Q1SV87; Match level="QueryCoverage=95%, HitCoverage=38%, E-value=4e-23, Identity=35%"; Hit description =Pentatricopeptide repeat
MCSKKPHLSEAFQKKLSLPIQARLLWHNQQASHSTRSRPARLPRDHVWFRHFIEHLSRGTGVPAFSIHADQRCPDKDVGVEAVAEGLGMQLNAGSEVAGVGDAFEGEGEDETVGGEGGLTAELDEGVEGGKRGLGEGESTNEGVVHEGVGVGEVVEETESVGDGDSAGEKELAEDKRVCEDRFCRFGRGSASWVSGCCTCSAVKPMLLPFPKRIKHKS

SEQ ID NO: 208667 - protein, 397 aa, Glycine max
  Coding DNA Sequence Number=SeqID_91889
  Gene Ontology: Mol. function=diacylglycerol kinase activity; Cellular component=intracellular; Biological process=protein kinase C activation
  Homolog annotation: Hit_ID=Q6ZLQ1; Match level="QueryCoverage=74%, HitCoverage=74%, E-value=4e-60, Identity=37%"; Hit description =Putative pentatricopeptide (PPR) repeat-containing protein
  Pfam annotation: Domain name=PPR; Domain location=163-196; Score=4.4; E_value=2.2; Accession=PF01535.11; Description=PPR repeat
  Pfam annotation: Domain name=PPR; Domain location=97-131; Score=45.7; E_value=1.6e-10; Accession=PF01535.11; Description=PPR repeat
  Pfam module annotation: Pfam domain module=PPR::PPR; Domain location =163-196::97-131
MLAGYAKAGELGLARRVFSEMPLRDEVSLTGVLSACAQAGAFEFGKILHGFVEKAGFLYVGSVNNALIDTIDTYSKCGNVAMARLVFQNMPVARSIVSWTSIIAGLAMHGCGEEAIQLFHEMEESEVRPDGITFISLLYACSHSGLVEEGCVICEMPVSPNAIIWKTLLGACSIHGNIEMAELVKARLAEMDPENSGDHVLLSNVYAVAGKWKDVIYGFVAGEKPNEVTEEARDKQREIMLRLRTEAGYAPQLRSVLHDIEEEEKEDSVSKHSEKLAAAFGIAKLPKGRILRIVKNLRRLLVTEVIETLEYMTPVGRQKEASQMPHHLDFPATSILHGDDDHHSDPLLLVPVHPPLNQVVIVAYRDITEDNALGPLSRLAEIVWPGEVAVVVVAAVK

SEQ ID NO: 208668 - protein, 110 aa, Glycine max
  Coding DNA Sequence Number=SeqID_91890
MTNIVHVKLENDLIIFGGGHAATIVARAAKKGLVKPKAIAAVAPTWAGPLPIVFGRDSNMETRVNFFVIVEAIEGYSAGFIISVSIKFGFVNLQAHFLILNCKSIELCSM

SEQ ID NO: 208669 - protein, 391 aa, Glycine max
  Coding DNA Sequence Number=SeqID_91891
  Gene Ontology: Mol. function=ATP binding; Cellular component =chromosome; Biological process=DNA metabolic process
  Homolog annotation: Hit_ID=Q015B6; Match level="QueryCoverage=99%, HitCoverage=37%, E-value=1e-129, Identity=61%"; Hit description=[Z] KOG0161 Myosin class II heavy chain
  Pfam annotation: Domain name=SMC_N; Domain location=24-372; Score= -135.1; E_value=0.1; Accession=PF02463.9; Description=RecFRecNSMC N terminal domain
MQAVKTIENTLKQKSKELIDCEKRSRAATNELQQAKLDADDTNTSGIDVSTLQEALDSLNAELSTHQRALKEVEENWSRAKQAFDTSASEIAEKVSLAASYKREMEQHMGIIRKVEAAYRKAAKDIEEVKAEIEAGTKVIAYEKGRLTGLKEEAEKVAMDTTKEVCDREVAEAAGDITLNPDSLLRMYESTKVQMRAEEGRHKRPLEEVSDELSDRRRKLLKLENGVGSSEKILRKLKTGIKKRQKTMENKAHFVAKNVSHRFNWHMTRKGHAGQVIIDYENSKLTLHVKDGAKSKTITDTRSMSGGERSYSTLAFNLALGDESDSPFRAMDEFDVFMDAVNRRVSIETLLNFARENVDKQFLFITPQDISAVDATAADIKIQKMRAARPE

SEQ ID NO: 208670 - protein, 292 aa, Glycine max
  Coding DNA Sequence Number=SeqID_91892
  Gene Ontology: Mol. function=electron carrier activity; Cellular component=intracellular; Biological process=electron transport
  Homolog annotation: Hit_ID=Q00SE5; Match level="QueryCoverage=82%, HitCoverage=47%, E-value=8e-38, Identity=45%"; Hit description =Chromosome 19 contig 1, DNA sequence
MLLLLTLFVDGAIAEQKLTASHQAQYDYFGASVSVSGDYAVVGAYGDDDDGSMSGSAYVFVRSGSTWTQRKLTASDAAPNDQFGWSVSVSGEYVVVGAPGDNSNAGSAYIFVRSDTTWTQQQKLTASDAASEDNFGASVSISGEYAVVGAWADDDTWEQSGSAYVFVRSGMTWTQRKLTASDAASNDQFGWSVSVSGDYAVVGAPGDNSNAGSAYISAIKFENRAALKAAVDNCLAADDTGNCDCSSASVDCGAAGSLPISQWDTSLITDMNHLFYDESSFDANISAWNTAK

SEQ ID NO: 208671 - protein, 173 aa, Glycine max
  Coding DNA Sequence Number=SeqID_91893
  Homolog annotation: Hit_ID=Q00S27; Match level="QueryCoverage=88%, HitCoverage=9%, E-value=3e-26, Identity=44%"; Hit description =Chromosome 19 contig 1, DNA sequence
MDIDKDPEKCMQNVHKQLVKLATNRAVVSMFAFKADFDIKRRKARARLEDTRQAMLSRIDILKSQQTDEDHSDKITALYEVANEMARIVNTIVPQSPPTDPSAEGCIELLDEQLASLLKDVDVRARANALDAPNSAAVHIVMKVHAFDAIICRLNEHLLEFAAAELESELAEL

SEQ ID NO: 208672 - protein, 405 aa, Glycine max
  Coding DNA Sequence Number=SeqID_91894
  Gene Ontology: Cellular component=integral to membrane
  Homolog annotation: Hit_ID=Q2SN98; Match level="QueryCoverage=100%, HitCoverage=62%, E-value=1e-82, Identity=43%"; Hit description =Uncharacterized protein conserved in bacteria
EALKTVGKKFDFTELFEKRQEFRDEIITVIGNDLNGYVLEDVAIDYLEQTPKSLMDQFNILDAHGIRKITELIAAQNVVTNELEQNEKLAISKKNVEAREALLALERQQAEAEARQKREIETIRAREEAETAKVQEEQRQLSENARIEAQQLIEIRDQNRLREVEVAEQNRQRAVAIEAERVERARQLEQVTTDREVQLQGVERDKVVEQGKMDVANITRERISIDKTVAQEEERIKEVREVSEADRQKQVLILEAEAKAQDSLVREVMEAQARETASKHRAVELTTLAQAEHEAAGKQAEAKRLLADALRAEQAAPGLAEAQVREASALAIVKVGIAEARVIEAKAEASLKQGSNEAQVLAQSLQAQALGEEKMGLARATATESLGNAEAGVVQKKLLAEAEGL

SEQ ID NO: 208673 - protein, 63 aa, Glycine max
  Coding DNA Sequence Number=SeqID_91895
MVQVEEVGGHCHEIGGVAYGIWIKLKKSETLIWVVFVECPKPMVQVEKVGTLIWIWWSSQRFV

SEQ ID NO: 208674 - protein, 86 aa, Glycine max
  Coding DNA Sequence Number=SeqID_91896
MVSIPLARHGISMFCTGSEINWNFSRGDCIHSEGNDMEFRIVEDRCAVRPGLKTAVPFDYLDTSPGCVWDQFLRKADDRRVKTEIN

SEQ ID NO: 208675 - protein, 70 aa, Glycine max
  Coding DNA Sequence Number=SeqID_91897
MSDSDASHIETLEIEQRELSRNSNGQKFSQGGTSHIVTLEIEQRKLSKNSNGHNFSHGGPIQAHDISGRS

SEQ ID NO: 208676 - protein, 130 aa, Glycine max
  Coding DNA Sequence Number=SeqID_91898
MTDIVIILSNRGAHKKKGWGWNRVRATRPKPHLGNRVGNALDETNPKTMQDLGNHHEGWCAFSECHWPTMRDRDRGSGNRAEALPEAWWHNQNKKKGKSKFVGDKVRRQDSIEEATSRKEKNKEDRRKKE

SEQ ID NO: 208677 - protein, 83 aa, Glycine max
  Coding DNA Sequence Number=SeqID_91899
MGCPKRLSKIESNQHSLRKSSHKEHSYMHIHMHILWYIGTDANGDRVTTDRSLPLPGAKQAENVTARQPSILCIRSFFYYCLF

SEQ ID NO: 208678 - protein, 123 aa, Glycine max
  Coding DNA Sequence Number=SeqID_91900
MTKANVSVPRTIKWDEVTLPEKWVMDKATPSVPRPAPTIEQIRIKASRSEYESARRSFSIRTRSIPVRLSRSESQNQFPSINLQGLYTTSSIPRTTYNQEQEDDQKPIQSPTYSFMHEPYDVI

SEQ ID NO: 208679 - protein, 80 aa, Glycine max
  Coding DNA Sequence Number=SeqID_91901
MSVKNLVGRLEVHDKMDHTPEVRSLSLGKIIGKPVNVTLFCENVSTMYDRHKLKRALKHGVFTPRPRLRRVCQGLSLLIQ

SEQ ID NO: 208680 - protein, 141 aa, Glycine max
  Coding DNA Sequence Number=SeqID_91902
MVMGDFIGRLSFPACLHFSGENNETFSSLTSYPERRRSEFLIGGYVGARASLLSTTPPFVAMTQELVARGDTLQLSAPRHSVTPSVIDEQRPMWSSAPFPEMSAFSDGDFSSLTSYPELRRSEFLIRGYVGARALLLSAAP

SEQ ID NO: 208681 - protein, 462 aa, Glycine max
  Coding DNA Sequence Number=SeqID_91903
  Gene Ontology: Mol. function=phosphoribosylformylglycinamidine cyclo -ligase activity; Cellular component=cytoplasm; Biological process =purine nucleotide biosynthetic process
  Homolog annotation: Hit_ID=Q7WG60; Match level="QueryCoverage=75%, HitCoverage=100%, E-value=1e-167, Identity=84%"; Hit description =Phosphoribosylformylglycinamidine cyclo-ligase
MDNEDDDFGDELREIMTETYLAWFQAAWRDARDANREVRGFLSVHDTIWRTDLDTGEAFREDAGRGGLLIARPAGSDHHGLGHAFGLRDDLAQLADGFALLAQRGGDGVGLGRIHHQHHADAAVEDAVHLGVLDAALLLQPLEQLGHFPAVAPQAGRQAVLQDARHVVEQAAAGDMGQALDGGAVLGQRGQHLLDVDAGRGHDHVDQRLAVEVVVGLGAGAFQDLAQQRIAVGVGAAGRQAQHHVADLDRLAVDDGRLLDRAHGEAGQVVFAIGVHARHFGGFAADQGAARQFAALGDAAHHRRRRVHRKLAATEVIQEEQRLGALHQDVVDAHRHQVDADGVVAVPVERQAQLGADAVGARDQHGLLVVLGHFEQAAKAADTGQHPGAHGARRKRFDTVDQGVARVDVDTGVTVGQGSFGLIRHEKCRGICNNCWELGWNALHFTMLRPDPGRRPVKLASG

SEQ ID NO: 208682 - protein, 102 aa, Glycine max
  Coding DNA Sequence Number=SeqID_91904
MTHEVEDDSHQKISQIQSQMQSLGVVPPAKPKVKVGVEEVRDVDAHVPVPTEEDKHRPKGPTKPVNRPEPNDYPIYQMTLMVPQLFLKPMQVSWDATCVWGV

SEQ ID NO: 208683 - protein, 203 aa, Glycine max
  Coding DNA Sequence Number=SeqID_91905
  Gene Ontology: Mol. function=transition metal ion binding
MLEVGKDTISASICSTPNHKTTRVQCKTVGNIDVRNDDFRFTLVDVKKLAYQNELFIVAEQAKHVFDVQDPCYERWSVVLQGKTIGLNLEDDNSTLDTCDTPFSINMPSVNGEEVDDAHASPSSSSPPKSTPLLSMLKRIRKATRLKSLAARPVKVEGSVVHVDPTTEKTDGPYIKKLRTYFGVIAREKVNVTYVNWKQVPAT

SEQ ID NO: 208684 - protein, 163 aa, Glycine max
  Coding DNA Sequence Number=SeqID_91906
MDFFSNESFECIQAFENSNLIPFMSLKLSIYSELVKAFYSNLKIQESTLISEVFWIKMVIDQSLFSDLTQLSSEGVPFEGTLNDDWKFDFSVHDARRLVCTNQADMTGRLLSGSLAFESRILHYLIVRILLPRSSNLAQVFEEDPIVMWAYHTGRKIDWAHLV

SEQ ID NO: 208685 - protein, 63 aa, Glycine max
  Coding DNA Sequence Number=SeqID_91907
MPEYARMQFCFCSQNTLSMRICKFSKGNACELGSEYAFEVHICDLGNGSEKASCKEIQEGQSG

SEQ ID NO: 208686 - protein, 72 aa, Glycine max
  Coding DNA Sequence Number=SeqID_91908
MGMSTPPLETSRTLKISFKALQDGFLFKLMPVTLAQLGGEDGALSDLCSLNASIQLILLPELSLRLAIRWCA

SEQ ID NO: 208687 - protein, 71 aa, Glycine max
  Coding DNA Sequence Number=SeqID_91909
MAHPPPRERTLRELAAGEDPHKHLKEFHIVCSTTKPPDVQEDHIFLKAFPHSLEGVEKDWLYYLAPRSIMS

SEQ ID NO: 208688 - protein, 42 aa, Glycine max
  Coding DNA Sequence Number=SeqID_91910
MVGAFLHNSMTLTGLLMILPGESDLTYQCSTRFFTNTVPHCI

SEQ ID NO: 208689 - protein, 241 aa, Glycine max
  Coding DNA Sequence Number=SeqID_91911
  Gene Ontology: Mol. function=DNA binding; Cellular component=nucleus; Biological process=regulation of transcription, DNA-dependent
  Homolog annotation: Hit_ID=Q6T804; Match level="QueryCoverage=45%, HitCoverage=24%, E-value=5e-21, Identity=50%"; Hit description =ANTHER INDEHISCENCE1
  Pfam annotation: Domain name=Myb_DNA-binding; Domain location=191 -241; Score=26.6; E_value=8.8e-05; Accession=PF00249.21; Description =Myb-like DNA-binding domain
MEAWTDLGPSFLELAALAQINKNALAVNYLEDSQQPERACPTEIEKCTAAPAEEVHTSTDAEVQKVGECGSVELQKLAEDSLLNSLEVNEEAPIESRDADVPCPLVINNNNNEADLMEKDQTSIPHNHDHKSSLMERNSTARIYEWDDSIDGLEDGTSDHATRFNLPSPKGREVSPLDKYKPASITKRRKVKKWSQLEEETLRTAVDKFGRGNWKLILDSHKDIFEERTEVDLKDKWRNMT

SEQ ID NO: 208690 - protein, 227 aa, Glycine max
  Coding DNA Sequence Number=SeqID_91912
  Homolog annotation: Hit_ID=Q6Z1V9; Match level="QueryCoverage=25%, HitCoverage=42%, E-value=1e-08, Identity=56%"; Hit description =Chloroplast ORF133; ORF within trnI intron
STLEDPTSSLVGSGRSGGDHHGSSLLENSYIPYQYMDSYLSSTGLGLASMEKNGAPNNVSSQTKNYEIAPFILGILECLGVVPGGSLNAFLFLLIGVISQRLAMESIDSLPIGWTVGAMIYFTGEVSAQLVELRSCNWVVAITGWMSNCPGGNDSILRAVKNVEEGFLIWDPGEEDQAGPCEQLDALSPFNPLSEMWQKEKESMDRPHRLHPVGTTRSPQGRLRHPG

SEQ ID NO: 208691 - protein, 81 aa, Glycine max
  Coding DNA Sequence Number=SeqID_91913
MKSSNDFSSNGFGMHSRLALLQNYQSEDLVYKKINANGFNWAGFSKFISGANIENILEEKSFLLKKVLTGLLQGKSQRQRM

SEQ ID NO: 208692 - protein, 79 aa, Glycine max
  Coding DNA Sequence Number=SeqID_91914
NNPPTHLSFVINISHTQGQVFVSVIGGRAIMSIIVIVKAYTFNNTEVHKIVVLKKASKWRTQDCFNSMPTSNAAQDFSL

SEQ ID NO: 208693 - protein, 157 aa, Glycine max
  Coding DNA Sequence Number=SeqID_91915
  Pfam annotation: Domain name=DUF581; Domain location=122-157; Score =12.4; E_value=0.00049; Accession=PF04570.5; Description=Protein of unknown function (DUF581)
GMRKKIEEEQDMLLGKRPRAPIMKRTTSMSGGLAVETKTTNEEVVVMSDSQHDEVAANNKLVDPHVVVAMGTPNNNEFVPDHTKHVSEAKGSYVYADRLMGINMSMPLSPTTSNNHRHTHIHNHTTNTNNIHTTSHFLRTCGLCNCHLAPGRDIYMY

SEQ ID NO: 208694 - protein, 88 aa, Glycine max
  Coding DNA Sequence Number=SeqID_91916
  Subcellular localization annotation: CTP_CleavageSite=46; ConfidenceScore=5.03e-01
MVVVAAPGLFNYVNSMPNLMGHDLRLLPCHRIFNAGGCRKFCSNVSESPVQSCWSEFWQFESLKLEFGGSNGKGSEEHARSLVQVSYS

SEQ ID NO: 208695 - protein, 68 aa, Glycine max
  Coding DNA Sequence Number=SeqID_91917
MRGGGCTAARLASCLLPPEVTFSPRGHIAYDCPTRRTMIMKADGAITSEYEISEEEKEVEEELEEEAM

SEQ ID NO: 208696 - protein, 286 aa, Glycine max
  Coding DNA Sequence Number=SeqID_91918
  Gene Ontology: Mol. function=protein serine/threonine kinase activity; Cellular component=cytoplasm; Biological process=protein amino acid phosphorylation
  Homolog annotation: Hit_ID=Q8SAE5; Match level="QueryCoverage=99%, HitCoverage=57%, E-value=1e-126, Identity=77%"; Hit description =Ankyrin-kinase
  Pfam annotation: Domain name=Pkinase; Domain location=3-265; Score =104.9; E_value=2.4e-28; Accession=PF00069.15; Description=Protein kinase domain
  Pfam annotation: Domain name=Pkinase_Tyr; Domain location=6-265; Score=28.3; E_value=3.3e-14; Accession=PF07714.7; Description =Protein tyrosine kinase
  Pfam module annotation: Pfam domain module=Pkinase::Pkinase_Tyr; Domain location=3-265::6-265
GTYQVAKWNGTKVAVKILDKDSYSDPDTINAFKHELTLLERVRHPNVVQFVGAVTQNIPMMIVREYHSKVGLPSLFLCIFAKVTWQAIFKRKGVCLHQKFYALLLILPGKGMNYLHECKPDPVIHCDLKPKNILLDNGGQLKIAGFGTVRFSLISPDEAKLVQPEPNIDLSSLYVAPEIYKDEVFDRSVDAYSFGLIIYEMIEGTHPFHPKSSEEAVRLMCLEGKRPAFKIKTKHYPPELKELIEECWDPTPVVRPTFSQVIARLDKIVANCSKQGWWKDTFKLPW

SEQ ID NO: 208697 - protein, 609 aa, Glycine max
  Coding DNA Sequence Number=SeqID_91919
  Gene Ontology: Mol. function=calcium ion binding; Cellular component =integral to membrane; Biological process=multicellular organismal development
  Homolog annotation: Hit_ID=Q6K1Y0; Match level="QueryCoverage=100%, HitCoverage=81%, E-value=0.0, Identity=57%"; Hit description =Putative leucine zipper-EF-hand containing transmembrane protein 1
  Pfam annotation: Domain name=LETM1; Domain location=210-480; Score =521.0; E_value=1.3e-153; Accession=PF07766.3; Description=LETM1-like protein
  Subcellular localization annotation: CTP_CleavageSite=21; ConfidenceScore=5.22e-01
MASPAILRRRSLIHQYLNNCFASSPSPSNRSLERAIATTSSLFPCKHGTTPYRDDLFNPFGLGQVVRGFGSAVPWDAFSRLNAPIGVRWLSQSSAAAAKRHQPDKNDETVAKKRKEASPEECDQAVEGLTTAKAKAMAKRAQEEAQKDLQSVLRRVWTAFLGIGPALRAVASMSSVVAAIAICCCRLKFETVKCLFVGDLAFREDWAKKLVHWKGEFVSTLQHYWLGSKLLWADVRISSRLLLKLAGGKNLSRRERQQLTRTTADIFRLVPFAVFIIVPFMEFLLPVFLKLFPNMLPSTFQDKMKEQEALKRRLKARIEYARFLQDTVKEMAKEVQNSRSGELKKTAEDLDEFLNTIRRGATVSNEEILGFAKLFNDELTLDNISRPRLVNMCKYMGISPFGTDAYLRYMLRKHLRRIKEDDKLIQAEGVDSLSEDELREDCRERGMLGLLSVEEMRQQLRDWLDLSLNHSVPSSLLILSRSFTVSGRLKPEEAVQATLSSLPDEVVDTIQVTSLPSEDSVSERRRKLEFLEMQEELIKARMENSSSQDDKALKEMNISTAKEAHQLARDRAFENKEQLCELSRALAVLASASSVSSEREDFLRLVNKE

SEQ ID NO: 208698 - protein, 60 aa, Glycine max
  Coding DNA Sequence Number=SeqID_91920
MAAGPRATPLRQQCLIKKNVNFLVNLSYLIWEKKFKEDTSDSNPVKLSRCNPAGVEEGIV

SEQ ID NO: 208699 - protein, 274 aa, Glycine max
  Coding DNA Sequence Number=SeqID_91921
  Gene Ontology: Mol. function=RNA-directed DNA polymerase activity; Cellular component=membrane; Biological process=RNA-dependent DNA replication
MGTCQRGMMDGSIREFNDWIAELEVEEVPWVGKRFTWFKPNGTTKSKLDRIFVSPEWISKWPGSFQHTLHRNFSDHCPVLLTSKSVDWGPKPFRILDCWLSDNSFKKLVQDSWTSNHLSGWGGYVLKQKIKTLKDKIKVWNREQFGNTFKKYKKIEDDLNKLEEESNDRQLDHNELIVRKQLQQALWEAAQAHESLLRQKARSKWIKEGDCNSRYFHLMINSRRRVNCLNGVMIDGLWKDEPAIVKEEIRSFSEGIERIFYSPNSEASGSPSAE

SEQ ID NO: 208700 - protein, 605 aa, Glycine max
  Coding DNA Sequence Number=SeqID_91922
  Gene Ontology: Mol. function=nucleic acid binding
  Homolog annotation: Hit_ID=Q1RVN3; Match level="QueryCoverage=50%, HitCoverage=48%, E-value=7e-13, Identity=22%"; Hit description =Nucleotide-binding, alpha-beta plait
  Pfam annotation: Domain name=RRM_1; Domain location=26-87; Score =24.6; E_value=0.00034; Accession=PF00076.12; Description=RNA recognition motif. (a.k.a. RRM, R
MVGGRELGVEESEERAAERKRRRAHATEKDLWIHFKQVGDVREIFISRKRNRNGKRYGFVRFKGLRDVHQVEKKLDSMIFGGLKMYVNTPKFGRAKWDKSPPTARGRADSKQRKEVNRDTYLRMQPKENIGAQQGSYAEVVRRHIPVTGQKRTPDKEKYIGYSSRSSVILDTPLRGQQWLQEAWVGRLKNLAMFDRIEDEMLWDIGENISPKYIGDDLVLILGLTEEKALRVMEEGDTGWGDLFTSLEKWNPKLRPGYRLTWVHCWGIPLMAWDIPHIKQIVSSIGDMVEADDDVEDLRKLDRARILVKTPWKPLIQHDVNVQIEGETFVVHIVEESGVSCARCQCRRQNEFSSSEEIYSDESELGTPLETSSKTWRKMMRTQGIAANFGAASGGSTKSGEGEEGEPRSAGANKPPNDDMQRSSETPTAVCTATKGGADSQKRWNDGMQEVAENPIGGFAQGKIGEDSKRTTAAMHGSPEKMAEGTSTGRVRAVSQNGTNGYSDGLDPKDKDEVQLHAQSDTVQTTSIALQMHGRLEEETNQTSLHLDGGSWYKEVCVNSDDLEQFHENGNKEAQVNVEHLGRFKTAADRSRDKEVEGLTDLGYD

SEQ ID NO: 208701 - protein, 615 aa, Glycine max
  Coding DNA Sequence Number=SeqID_91923
  Gene Ontology: Mol. function=cysteine-type endopeptidase activity; Cellular component=intracellular; Biological process=proteolysis
  Homolog annotation: Hit_ID=Q6SSJ2; Match level="QueryCoverage=94%, HitCoverage=27%, E-value=0.0, Identity=79%"; Hit description =Phytocalpain
  Pfam annotation: Domain name=Peptidase_C2; Domain location=308-591; Score=209.5; E_value=7.5e-60; Accession=PF00648.11; Description =Calpain family cysteine protease
MTGVAGAICVLDDEPTASGKHCGPIDSSLCQSQKVSFSIALMIQPESGPVCLLGTEFQKKICWEILVAGSEQGIEAGQVGLRLITKGDRQTTVAKEWSISTTSIADGRWHIVTMSIDADLGEATCYLDGGYDGYQSGLPLCVGSSIWEQGTEVWVGVRPPTDIDAFGRSDSEGVESKMHIMDAFLWGRCLTDDEVSSLYNSMASADFSALDSPEDNWQWADSPTRVDGWDSDPADVDLYDRDDVDWDGQYSSGRKRRSERDGMMVDIDSFSRKYRKPRIETQEEINQRMLSVELAIKEALYARGERRFTDQEFPPNDHSLFVDPANPPAKLQVVSEWLRPGEIGRQNHLDCRPCLFSEAPNPSDVCQGRLGDCWFLSAVAVLAEVSRISEVIITPDYNEEGIYTVCFCVQGEWIPVVVDDWIPCELPGKPAFATSKKGYELWVSILEKAYAKLHGSYEALEGGLVQDALVDLTGGAGEEIDMRSGEAQIDLASGRLWSQLLRFKQEGFLLGAGSPSGSDVHISSSGIVQGHAYSILQVRDVDGHKLVQIRNPWANEVEWNGPWSDSSPEWTDRIKHKLKHVPQHLFMIELTIFSYLKLIDTVDLEGGPGTSFCSL

SEQ ID NO: 208702 - protein, 541 aa, Glycine max
  Coding DNA Sequence Number=SeqID_91924
  Gene Ontology: Mol. function=cysteine-type endopeptidase activity; Cellular component=intracellular; Biological process=proteolysis
  Homolog annotation: Hit_ID=Q6SSJ2; Match level="QueryCoverage=99%, HitCoverage=25%, E-value=0.0, Identity=65%"; Hit description =Phytocalpain
ILVAFCGVSYLEVIKTRDDQVPTNGDFLAALLPLVCIPAVLSLCCGLLKWKDDDWKLSRGVYIFVIIGLLLLLGAISALIVVVKPWTIGVAFLLVLLLMVLAIGAIHHWASNNFYLSRTQMVFVCFLAFLLALAAFLVGWFEGKPFVGASVGYFSFLFLLAGRALTVLLSNPIVVYSPRVLPVYVYDAHADCGKNVSVAFLMLYGIALATEGWGVVASLKIYPPFAGAAVSAITLVVSFGFAVSRPCLTLKMMEDAVHFLGKETVIQAIARSATKTRNALSGTYSAPQRSASSAALLIGDPTIMRDRAGNFVLPRADVMKLRDRLRNEELVAGSFFSRLRYHRTFRHEPTSDVDHRRVMCAHARILALEEAIDTEWVYMWDKFGGYLLLLLGLTSKAEQAQDEVRLRLFLDSIGFSDLSAKKIKKWMPEDRRQFEIIQESYIREKEMEEEVFMQRREEEGRGKERRKALLEKEERKWKEIEASLLSSIPNASSREAAAMAAAVRAVGGDSVLDDSFARERVSSIARRIRASQLSQRALQVY

SEQ ID NO: 208703 - protein, 168 aa, Glycine max
  Coding DNA Sequence Number=SeqID_91925
  Homolog annotation: Hit_ID=Q6SSJ2; Match level="QueryCoverage=98%, HitCoverage=7%, E-value=2e-54, Identity=66%"; Hit description =Phytocalpain
MAPYGFIAWLLSTCVGLLLSFLSKSSVLLGISLTVPLMVACLSVAIPIWICNGYQFWVPRLNCNGSAGNDRIPRTKEGIVLLISMSVFVGSVLALGAIVSAKPLDDLRYKGWNGDPKILGSPYTSSVFLGWAMASAIGLVVTSVLPIISWFATYRFSLSSAIFIGLFA

SEQ ID NO: 208704 - protein, 96 aa, Glycine max; identical to SEQ ID NO: 131977
  Coding DNA Sequence Number=SeqID_91926
  Homolog annotation: Hit_ID=Q8TGM5; Match level="QueryCoverage=40%, HitCoverage=58%, E-value=6e-08, Identity=74%"; Hit description =Uncharacterized protein ART3

SEQ ID NO: 208705 - protein, 88 aa, Glycine max
  Coding DNA Sequence Number=SeqID_91927
MGLHSSSSVNGEASTPKDPLYKILDELRTLKFWKEKQARKEKGKTRVEEISLDEKEKIREEERRKILKELRKEKHASYSSHNPCKSLS

SEQ ID NO: 208706 - protein, 641 aa, Glycine max
  Coding DNA Sequence Number=SeqID_91928
  Gene Ontology: Mol. function=cysteine-type endopeptidase activity; Cellular component=intracellular; Biological process=proteolysis
  Homolog annotation: Hit_ID=Q6SSJ2; Match level="QueryCoverage=88%, HitCoverage=25%, E-value=0.0, Identity=67%"; Hit description =Phytocalpain
MANICIFLLTGAVAILLLLAVALLCAYELCAVYVTTGSRASDRYSPSGFFFGVSAIALAINMLFICRMVFNGNGLDVDEYVRRAYKFAYSDCIEVGPVACLPEPPDPNELYPRQSRRASHLVLLYLGSLCVLLVYSILYGLTAKEENWLGAITSVAVIILDWNLGACLYGFQLLDSRVAALFIAGTSRVFLICFGVQYWYLGHCISYAVMASVLLGAAVSRHLSATNPLAARRDALQSTVVRLREGFRRKEHNSSSSFSEGCGSSMKRSSSVEAGNLGNVIEVGRAMAAGDGSNWNNVLSQTTSLPDGINSDKSIDSGRSSLALHSSSCRSAVHEPEVGTSSDDRNLDHNNSLVVCSSSGLDSQGNESSASNSANQQTLDLNLALAFQERLNDPRIVTMLKRTRQGDQELSSLLQDKGLDPNFAMMLKEKSLELDPTILALLQRSSMDADRDHNENTDNTSVDNAMPNQISLSEELRLHGLEKWLQLCRLVLHHITGTPERAWVLFSFIFILETIIVAIFRPKTIKIINATHQQFEFGLAVLLLSPVICSIMAFLRSLTAEEMSMTSKPRKEVLLLPYNVFGFDAAVCLLSFIHSYSAHVLVLAEKANFTGGIMIPFSCLYKLLGWDYWETLWKSGIVLVC

SEQ ID NO: 208707 - protein, 111 aa, Glycine max
  Coding DNA Sequence Number=SeqID_91929
  Homolog annotation: Hit_ID=Q9C8A6; Match level="QueryCoverage=68%, HitCoverage=3%, E-value=3e-26, Identity=70%"; Hit description=N -calpain-1 large subunit, putative; 13921-23959
MAKYLARSSTPFALWYPESFCMGSCYFSNSGAYHLGLLVDCNIGSRPDWFGCNNGWHCSSIGILFNYAVVENSVAKLKLYWIQCKPGSQKKKVKKVAGLVGDSIALVSEKK

SEQ ID NO: 208708 - protein, 105 aa, Glycine max
  Coding DNA Sequence Number=SeqID_91930
MLQLNKHGQAKRIKQRAEVEREDEVGPLGILSPISGKVQGQWVGLRMVPQLKREETCGHICDRCLMGKVWSGLGLSVSAKGGAFGTNVWMAKATNVPFGVPKLGL

SEQ ID NO: 208709 - protein, 92 aa, Glycine max
  Coding DNA Sequence Number=SeqID_91931
MGWIKGKGQYIGGVGKDRKSSERGETVEKEVGEVDEFWGGSLGRRSRIPNRVLAGVSCQASWTAWGQQKANFVGNRGEGVIEVFVGLGERHG

SEQ ID NO: 208710 - protein, 93 aa, Glycine max
  Coding DNA Sequence Number=SeqID_91932
MTFMGLQKEVERIGEQLYAITSRGSRLVGGGCMNSARQWHSWGSEKKARLENCTKQSLRVAPNSYRYTITSRGSRLVGGGCMNSARQWHSWGS

SEQ ID NO: 208711 - protein, 136 aa, Glycine max
  Coding DNA Sequence Number=SeqID_91933
  Gene Ontology: Mol. function=unspecific monooxygenase activity
  Homolog annotation: Hit_ID=O04892; Match level="QueryCoverage=90%, HitCoverage=34%, E-value=2e-32, Identity=81%"; Hit description =Cytochrome P450 like_TBP
  Subcellular localization annotation: CTP_CleavageSite=14; ConfidenceScore=5.11e-01
GPAAGRAPHVAWCPVSKVNSLWSMEQCRQGKSVKWIRNLGKRIGSEGWARGSQSRTRRLSVDCSSCFRGESGSSRAGRGTDWERALRGLFSGRLTVNSELKFNQARVNGGSNYDSLKRNHSQGTGLAESAGKEDPV

SEQ ID NO: 208712 - protein, 206 aa, Glycine max
  Coding DNA Sequence Number=SeqID_91934
  Homolog annotation: Hit_ID=Q6T4Q2; Match level="QueryCoverage=41%, HitCoverage=91%, E-value=1e-42, Identity=98%"; Hit description =Putative senescence-associated protein
  Subcellular localization annotation: CTP_CleavageSite=52; ConfidenceScore=5.21e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDMSSARIDRASDSRNNRIPLVRTSSELTVRRPEKRPRRARSQSVPRPARDDPLSPRKQLEQSTDSRRVRDWDPRAQPSEPILFPRLRIHFTDFPCLHCSIDQRLFTLET

SEQ ID NO: 208713 - protein, 188 aa, Glycine max
  Coding DNA Sequence Number=SeqID_91935
  Homolog annotation: Hit_ID=Q1T1F7; Match level="QueryCoverage=80%, HitCoverage=32%, E-value=2e-16, Identity=36%"; Hit description=IMP dehydrogenase/GMP reductase
  Pfam annotation: Domain name=DUF1723; Domain location=105-154; Score =38.3; E_value=2.6e-08; Accession=PF08330.1; Description=Protein of unknown function (DUF1723)
MIEDVPAPGAEGLVGDGAEGLAGDGAKGVAGDDAEGFPGGPRDPSVLTSFADHVAHSIWNGEERPKLKLAFHGRKVEKFGSPALEIEGLVVAIELTPLIACSVDTGDRGDISAFFEKWHKETSSFHPPVGELTITLDDVASLLHLSIIGTFHSFEPLHVDEAVIMLVELLEVSGEEARAETAQCHGAY

SEQ ID NO: 208714 - protein, 243 aa, Glycine max
  Coding DNA Sequence Number=SeqID_91936
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=Q7CH90; Match level="QueryCoverage=82%, HitCoverage=31%, E-value=2e-95, Identity=88%"; Hit description =Probably ATP-dependent helicase
MSGLSEKAGDRFETLSSPFNHVEQGKIVIPQMRFEPALANEAEHLEEMARYFPQLRDRSAADAAGAGRPAALPAGRRAPQAGGEGRRQRAGGAAIVRRRAGSERRAADPGTHSQNCVPADRQPGDHYRRRVAEIAEALSVRSTEPAERLVQPDPAGRPPDPQQPMLRRDRDLRSPAVDQKLRFAAVGVAAGVPDRTARGAGGRQGASGGVEIRRRRGQKREEARQPVCPQAAALIRAAAAGGA

SEQ ID NO: 208715 - protein, 78 aa, Glycine max
  Coding DNA Sequence Number=SeqID_91937
  Gene Ontology: Mol. function=sequence-specific DNA binding; Cellular component=intracellular; Biological process=regulation of transcription, DNA-dependent
  Homolog annotation: Hit_ID=Q1MMG8; Match level="QueryCoverage=99%, HitCoverage=51%, E-value=8e-21, Identity=58%"; Hit description =Putative AsnC family transcriptional regulatory protein
RARVVEDAERAGGAVIAEHVGKAAAAGGKRRDPGLYPERQPTGGGLRLRVAGAHQAAAGHAEEGRAADSGDTGSGRMR

SEQ ID NO: 208716 - protein, 210 aa, Glycine max
  Coding DNA Sequence Number=SeqID_91938
  Gene Ontology: Mol. function=oxidoreductase activity; Cellular component=chloroplast; Biological process=electron transport
  Homolog annotation: Hit_ID=Q1B2Z0; Match level="QueryCoverage=89%, HitCoverage=48%, E-value=2e-88, Identity=75%"; Hit description =Rieske (2Fe-2S) region
MLPNPGFARRCTARNGPAARRGDRRCVEVDVVEVGHVGDVVHDLAAVGPLDEDGVPVPGGPAIVGVLRNFRDLDVIGGAVAFGVVPNEQQTALDVGDPAACAGQLRGALGVRNQLALAVAAPAPIMERARDVVALDGALRQIATHVAAIAVEHLDVALGVGEYHQLGAERVDGVGLTVPERLCDAQAVPTACVAGGELTDVDLANADSCG

SEQ ID NO: 208717 - protein, 836 aa, Glycine max
  Coding DNA Sequence Number=SeqID_91939
  Gene Ontology: Mol. function=microtubule motor activity; Cellular component=microtubule associated complex; Biological process =microtubule-based movement
  Homolog annotation: Hit_ID=Q1RV39; Match level="QueryCoverage=99%, HitCoverage=87%, E-value=0.0, Identity=72%"; Hit description =Calponin-like actin-binding; Kinesin, motor region
  Pfam annotation: Domain name=Kinesin; Domain location=279-549; Score =406.2; E_value=4.7e-119; Accession=PF00225.13; Description=Kinesin motor domain
EIGVPTFEASDLEQGGKSARIVNSVLGLKSYSEWKQTGGNGVWKFGGTIKPAISSKSFVRKTSEPFTNSLSRNSSINEKSMTVLTSDVESNKMVGKLSGSHSLSMLVRAILLDKKPEEVPLLVESVLNKVVEEFEQRIASQGEQIKISRGAVSQGNGSVSKFVMADKKMDSKIPMVTKKEGFFHKNHVDDVESKRQLLKQQMLFDNQQRDIQELKHTIHTTKAGMQFLQMKFHEEFSNLGRHVHSLAHAASGYHKVLEENRKLYNQVQDLKGSIRVYCRVRPFLSAQPNYSSTVDNIEDGTITISIPSKNGKGRRSFNFNKVFGPSASQAEVFSDMQPLIRSVLDGYNVCIFAYGQTGSGKTHTMTGPKEITEKSREIRSNSHRGLSVPDACQVPVSSTKDVIELMNLGQRNRAVGATALNDRSSRSHSCLTVHVQGRDLTSGTILRGCMHLVDLAGSERVDKSEATGDRLKEAQHINRSLSALGDVIASLAQKNQHVPYRNSKLTQLLQDSLGGQAKTLMFVHISPEVDAIGETISTLKFAERVATVELGAARVNKDGAADVKELKEQIASLKAALARKEGESEHSLSGSSEKYRTRAGEVSPYHANQRGADIVSLGCRQPMLDVGNIELHSNTPLRQKTQSYDFDEMSTNSPPWPPLNNLGLNYGDDDRETGSGEWVDKVMVNKLDATNKTENILGCWEADSGNLSEVFYQKYLQDPSKMDPERSHNMFMGGNNQFNVAGSDDMDDLDDTTTDSSEPDLLWQFNHSKLASIANGNGSKARRPVSKPTNSPILSKNNVHSSLGPSPSRKQQSNGVNRTARHPAPVDMKRKTGSRK

SEQ ID NO: 208718 - protein, 68 aa, Glycine max
  Coding DNA Sequence Number=SeqID_91940
MVVRNQSNEVREHGKGPRHASKAGRDPHAGLHVMVTEWEKSFGRGAFLLLHHNRRQRATHYPLRVPNA

SEQ ID NO: 208719 - protein, 51 aa, Glycine max
  Coding DNA Sequence Number=SeqID_91941
DVRKKAQAIQKQNTIPHVLSCGGYEYLEDKLMDEKTKKNWRKLLNPEALRQ

SEQ ID NO: 208720 - protein, 825 aa, Glycine max
  Coding DNA Sequence Number=SeqID_91942
  Gene Ontology: Mol. function=nucleic acid binding; Cellular component= intracellular
  Homolog annotation: Hit_ID=Q6ZAQ9; Match level="QueryCoverage=19%, HitCoverage=16%, E-value=5e-20, Identity=35%"; Hit description =Putative S-locus protein 4
MKSKGVVNDMTGAVLNSNEDSERPDRALSAARPWLDPRINMLNNQHTHRDVFNDSVPEKSMDGSSYGGSEYSSVISSNLVSGAGRTGSKLIDLGHDKTWFKTDGGDPDTTSGQRNGFNLKRSYSNREAPKLTNLDAHRQPRQSTTDIRNNLMSGNWKTSEEEEFMWGEMNIGLTDHGANVSSNLSTDTWMADDENLEGEDHLQITRPFGAKVDREISTAKKQPPGFGGHPPSSWQLQKHHSIDKLNLKPGYSEGFVSTLSGLPANPSSLAVKKGNQSFTSNAVVGMAKFVGQQFDSGETESPSGQSPLRQQSPSLPGAVHHTHSMQNFADQELPQNLKTSRFLGGPISQHIRDRSPTGHPIVQVGNLRRSQERDMHGPLSSMTSFRPKLQQKQLNPSQTEVTAKTKLPQSKVSLTRETSEQLSTNNLSAVPVKSGIIPKKSISSNLDSREDPSQTGVQPTQSGRPTTLISSGSAVASPSSLDPLHNDSSTLPKKPQGKAGQPPQRLSTQPPASSSVSSSSAPTLNAAKNNKLNPIANLLSSLVAKGLISAETESPTTVPSEAPKGSKDQTEIITTSCSLPVTSISGSAAIPVSSSGDKVDAATKISHASPQSTSTEIRNLIGFDFRPNVIREFHPSVIRELWDDFPHNCKVCGIKLKQELFNRHLEWHAAREHGPIKASRSWYAKSIDWIAGRTEYSSESEFTDSVDLQDKKIDSSQLDTMVLADENQCLCVLCGELFEDVCCHDRNEWMFKGAVYMNFSDVNCEMESRNVGPIIHAKCLSENSVITNSNGVLKGMLKNAKLEAMLNLCHWHVVHHGRQREQQII

SEQ ID NO: 208721 - protein, 170 aa, Glycine max
  Coding DNA Sequence Number=SeqID_91943
MDGEHTTGTLLAFSLLSLYTESVAPNSNTAEDIAAPNGIVIVEDKEAPNDVVAASKIEEPVVQNAGAGEEEEAKEKGIEEEEAKEKERRWITRCKDGRVCGKEGQQGELGILKGKEGLGVKDLERFNTTMLGKWAWWLLTGEECLWRKVVVEKYGPLELEGSISVSEGRG

SEQ ID NO: 208722 - protein, 159 aa, Glycine max
  Coding DNA Sequence Number=SeqID_91944
  Gene Ontology: Mol. function=protein serine/threonine kinase activity; Cellular component=integral to membrane; Biological process=protein amino acid phosphorylation
  Homolog annotation: Hit_ID=Q49SB1; Match level="QueryCoverage=80%, HitCoverage=27%, E-value=5e-29, Identity=53%"; Hit description =Somatic embryogenesis receptor-like kinase
MEMGAEYKPDWNSDCTLLMINIGPQISKDSRLNDTSLTGLIPMPLSNITTLQMLDLSNNQLSGVVPDSGSFSLFTPISFNNNLDLCGPVTGHPCPGSPPFSPPPPFVPPSPISTPEGNSATSAIAGGVAAGVALLFAAPAIVFAWWRRRKPQEFFFDVP

SEQ ID NO: 208723 - protein, 96 aa, Glycine max
  Coding DNA Sequence Number=SeqID_91945
  Gene Ontology: Mol. function=ATPase activity, coupled to transmembrane movement of substances; Cellular component=integral to membrane; Biological process=transport
  Homolog annotation: Hit_ID=Q9FID4; Match level="QueryCoverage=83%, HitCoverage=14%, E-value=8e-13, Identity=45%"; Hit description=ABC transporter-like protein
MSIQAKNVGFYRVLSLAKPEAGKLMIGIVALLIAATSSILLQKFGGKIIDIVSREMQTPEEKDEALNAVKNTILEIFLIVVFGYDPCLSTFQINQT

SEQ ID NO: 208724 - protein, 353 aa, Glycine max
  Coding DNA Sequence Number=SeqID_91946
  Gene Ontology: Mol. function=acyltransferase activity; Cellular component=nucleus; Biological process=cell cycle
  Homolog annotation: Hit_ID=UPI0000E4987F; Match level="QueryCoverage =70%, HitCoverage=26%, E-value=1e-30, Identity=33%"; Hit description =PREDICTED: similar to N-acetyltransferase ESCO1 (Establishment of cohesion 1 ...
  Homolog annotation: Hit description=homolog 1) (ECO1 homolog 1)
MVLVSIVEGDYEVALSNYRLISTEYKIDKAWKRYAGVQMQSKISAFFKSTTSDSSSVSADNDDDLSIWEKQQHHIINTYTRRPPNPNAVIPSVVKNKKRSYAQFHLDFGQSDFLLRACSTCGINFTPGDPDDEKSHNHFHKSYTQGIQFRGWTKENVIPLPTLEAGRIILVSEIDLTSHRRIVEQVVSMMEIELGCGWILHDLFKVYLFVSLHRVVGCLVAEPIEKAFKVVSGSPDSVKKREVRTRSTTFRFGNVIFQREVEKKVASLSDSERMEGAIFCDSKPTIAACGIRAIWVAPSNRRKGIASKLLDAVRKSFCKDLELERSQLAFSQPTSAGKALATSYTGTGSFLAY

SEQ ID NO: 208725 - protein, 265 aa, Glycine max
  Coding DNA Sequence Number=SeqID_91947
  Pfam annotation: Domain name=Hin1; Domain location=89-230; Score =15.4; E_value=7.6e-05; Accession=PF07320.4; Description=Harpin -induced protein 1 (Hin1)
MASSTRFSPLPQSEPDRDNHEDQLPLSISVESTNTRSGISSEHYYAEEIFSISARTCEMIQDLLGLTLLMMLILLPLYKRLGTPKENPIPPLFVLNSMYLSNFTTTGSTGGISATWDAKFTVTNTNVSCIYFRSIDFTIFYKHNPEDALSVASSYPFYLDKGEYVKLHLKFTKGGEGWEDNQPSVENRLVEEMGKDKAKNGALSFGMQMKVQAIYYGETWVSDVVMNPHCEDLRVQFLPHEDSGRMANPNRNFSVPLHWKPFSFF

SEQ ID NO: 208726 - protein, 135 aa, Glycine max
  Coding DNA Sequence Number=SeqID_91948
  Gene Ontology: Cellular component=intracellular
  Homolog annotation: Hit_ID=Q5VQ75; Match level="QueryCoverage=58%, HitCoverage=22%, E-value=5e-13, Identity=47%"; Hit description=DNA repair protein XRCC1-like
MKRILKYTLGSLRGSHYDNCKFQQILSTIRTFLEGAEKKPSVPKKSSKHIEREQPSTSTASIKSKGKDTDVARKCFEPSEVKKWAIDDLNKIIQWLQSQEEKLDPRELTKIATEGILTCLQDAICYLEEKQVMYT

SEQ ID NO: 208727 - protein, 156 aa, Glycine max
  Coding DNA Sequence Number=SeqID_91949
  Homolog annotation: Hit_ID=Q6F3B5; Match level="QueryCoverage=91%, HitCoverage=11%, E-value=4e-42, Identity=55%"; Hit description =Expressed protein
MCDVKFLNKELVRVASFSDHEAFDHPVICLVAVSSKDEQPISRFVDLFNTNKLPSLLNDGAMDPKVSKHYLLVHDNQDGPADRASKRLTDMRSTFGASDCSLLCINSSLDAPIKNQDNPWASYITDASPTPSQDLGCFLNIDDINEVSATRKGFKN

SEQ ID NO: 208728 - protein, 265 aa, Glycine max
  Coding DNA Sequence Number=SeqID_91950
  Pfam annotation: Domain name=Hin1; Domain location=73-225; Score= -1.2; E_value=0.0019; Accession=PF07320.4; Description=Harpin-induced protein 1 (Hin1)
MPLSTAQVESRTQFSPLPQDVEQGHNQIQVNDRHIVLEPYEERVDWDALVIMLRLVMIGMLLVGFSLRQRELYEPTFDPVAPKFFLDSFHIPHLKVSEGEVSSTWDVALTISNVMNYSNVNILKLEAKVSYEENETLAVITLSMPKYTLESDVLLLDEEETKRVHLKLSTTGWEENQPIVDDNVVQAIAKDVQRGVTRFSLHMMVTGEVGLGDGLVAIFAMYPKCSNLEVKFVAGDQLGEAAYMIDRKPRECVGLIEWGPVKESI

SEQ ID NO: 208729 - protein, 281 aa, Glycine max
  Coding DNA Sequence Number=SeqID_91951
  Homolog annotation: Hit_ID=Q9XIN3; Match level="QueryCoverage=80%, HitCoverage=96%, E-value=1e-08, Identity=25%"; Hit description =Expressed protein
  Pfam annotation: Domain name=Hin1; Domain location=118-252; Score =54.4; E_value=3.8e-13; Accession=PF07320.4; Description=Harpin -induced protein 1 (Hin1)
MDPSHDERGPPNESLTHQSSSRRHGDAPPPTVAPPQMMYYYPQGYAPQPMPHQGYPPGYAPYPNEYHQQPYHYPAGPYFSTPPTYHNGGGSKAFIRGFIMCSCLIFTCLFVATLIMALVLHPQLPVYTINSLSVANFNTTQLLTANWNTSIMIHNINNRLIGLFSDFKVDLLHKNYIVAVSYVPNFELNKNEVKRIDATPLSNGFSFPKSNLDDMAKEQAGGSVTFALRMTSMVTFMSSTMSTRNTLILALCSGLKVVFQNNTGNGVLDNAGKPISCQLYM

SEQ ID NO: 208730 - protein, 50 aa, Glycine max
  Coding DNA Sequence Number=SeqID_91952
MVASGWLCGKDDMERGGSTGGVGCSGWSWFMFEVQVFTDMLKKYDGYKSN

SEQ ID NO: 208731 - protein, 171 aa, Glycine max
  Coding DNA Sequence Number=SeqID_91953
  Gene Ontology: Mol. function=fructose-bisphosphate aldolase activity; Cellular component=mitochondrial envelope; Biological process =metabolic process
  Homolog annotation: Hit_ID=P29356; Match level="QueryCoverage=83%, HitCoverage=94%, E-value=9e-29, Identity=67%"; Hit description =Fructose-bisphosphate aldolase, cytoplasmic isozyme
  Pfam annotation: Domain name=Glycolytic; Domain location=25-169; Score=-70.5; E_value=2.1e-09; Accession=PF00274.9; Description =Fructose-bisphosphate aldolase class-I
MELERQCWGLGGGVAAQWWHGVWGMGPGKAILVADESSANRRALRELLFTTPGAFECLNGVILFEETLYQKTASGRPFVELLKEGGVLAGMKVDKGTVEIAGTNGETTTQVQQSTLKAWGGKDENIKKAQGAFIARCKANSRATLGELTRVMLPLLRVPPSLSMSRTTNTN

SEQ ID NO: 208732 - protein, 68 aa, Glycine max
  Coding DNA Sequence Number=SeqID_91954
  Subcellular localization annotation: CTP_CleavageSite=31; ConfidenceScore=5.16e-01
MTASMPSQPLHFGFPLAGNFFTLSQVRILPVQELVAVVVPVPHSLKMQQNTWTADKAQCHATVTHSLL

SEQ ID NO: 208733 - protein, 232 aa, Glycine max
  Coding DNA Sequence Number=SeqID_91955
  Gene Ontology: Mol. function=DNA binding; Cellular component=nucleus
  Homolog annotation: Hit_ID=Q6Q6T0; Match level="QueryCoverage=75%, HitCoverage=32%, E-value=6e-27, Identity=40%"; Hit description =Trihelix transcription factor
MVTGIQNHSENQNEDGSEILNSTTARGAESWTESEIARLQQLRAEMETRYMQSGCSEEVMWEEIATKMACFGYERSAVVFKEKWESISNYARSVKDGSKKRKEDSRSCFYFDNSDQSSLYNQGGAYCDINDQRHKTGRLQTNDGSSPSNSNVGNTVAVDNCFPFLMTESGNLWENYSLKPFISDDLTLCKQELTDEGRLCIETDDDKGDYTLANITELLGCEYDTNSGEFLH

SEQ ID NO: 208734 - protein, 55 aa, Glycine max
  Coding DNA Sequence Number=SeqID_91956
MARRWWTRPQWRQWKWRMAATRRQTENKGRTWAVGTNERTHKMEGVELEKLKGYG

SEQ ID NO: 208735 - protein, 164 aa, Glycine max
  Coding DNA Sequence Number=SeqID_91957
  Gene Ontology: Mol. function=hydrolase activity; Cellular component =chloroplast thylakoid membrane; Biological process=aromatic compound metabolic process
  Homolog annotation: Hit_ID=UPI0000382EC6; Match level="QueryCoverage =86%, HitCoverage=47%, E-value=2e-16, Identity=37%"; Hit description =COG0596: Predicted hydrolases or acyltransferases (alpha/beta hydrolase superfamily)
MVYISPCSWYGLLRGTLKAPAVGWMMYNMLVSNENAIQSQYKSHVYANPDNVTPGIVESRYALTKRKGARYLPAAFLTGQLDPVTSREEFLELFAALEGKTPVLVVSTKGSPKRSKAEMEALKGAKGVSKFVEVPGALLPQEEYPALVAEELYQFLQEYFGTVA

SEQ ID NO: 208736 - protein, 103 aa, Glycine max
  Coding DNA Sequence Number=SeqID_91958
NNKLGGKRAEMNYAPFIIQEQQAGFRKSSDKRAETDSAPFVIWGQLDRVQQNTETKYGHSASCINQEEQIRQYQDDVSGQLSYPNFIRGPSVVGMRPSFDHFE

SEQ ID NO: 208737 - protein, 103 aa, Glycine max
  Coding DNA Sequence Number=SeqID_91959
MILDDHEGEEHCCGIGTNARSVSFLPRSQEKIRDSTKVVIKQDMKGGEHKYGFNNNRREKPEKVRVVDHETGDKHELYEVLRMSSRCVKTNASSFLLRAGRVL

SEQ ID NO: 208738 - protein, 76 aa, Glycine max
  Coding DNA Sequence Number=SeqID_91960
  Subcellular localization annotation: CTP_CleavageSite=25; ConfidenceScore=5.58e-01
MTRITTTRLAQQSSTTTMTTTTTTRVAQRESFWVVSSLNKIFINSWTQSRLASLPKLVQVYAKSDESTPVSILLPI

SEQ ID NO: 208739 - protein, 213 aa, Glycine max
  Coding DNA Sequence Number=SeqID_91961
  Homolog annotation: Hit_ID=Q9LJR1; Match level="QueryCoverage=67%, HitCoverage=87%, E-value=2e-52, Identity=68%"; Hit description =Arabidopsis thaliana genomic DNA, chromosome 3, TAC clone: K7L4
MDENMKQFQKKLTELEVEAEHLLLARHQPTPPSGKKAELLFKDFMLVENDRLRNGNREALTALRKRARTTKSSVPSPFESIMKGVAGSSSRPLVQEVCTTCGKHDSSEQTWMMFPGTDLFARIPFHAAHTILETDQTQLDFESKRLQSIVKEKSYIISEAGVLADKISPGVLKSLVSLNDKPNINWVENGKCFLEVFHEAFRLRFIYSVAVIV

SEQ ID NO: 208740 - protein, 88 aa, Glycine max
  Coding DNA Sequence Number=SeqID_91962
MMQMELVLVLMLMEIFNVGEWIGEYDYDVLACQNSVRLRKLEHSHIGCVIYLQHFASTFIGEAKKGSTRLAILFSVEKFLSNFQLLCL

SEQ ID NO: 208741 - protein, 91 aa, Glycine max
  Coding DNA Sequence Number=SeqID_91963
  Homolog annotation: Hit_ID=Q1S9P8; Match level="QueryCoverage=66%, HitCoverage=15%, E-value=5e-07, Identity=45%"; Hit description =Endonuclease/exonuclease/phosphatase
MNVIGLQDNVNLVWDKMFKKTRKVAKRELDELKGFGLRDKESCWWDEEVQDKLSCIKRQLLKQNSLKENQQIIEGVLLNWFFNMPLQKKIP

SEQ ID NO: 208742 - protein, 111 aa, Glycine max
  Coding DNA Sequence Number=SeqID_91964
MQTLQNNDRAFESHVAHPGEYAASTSTNGYNFSSNIPYLFKQSKGNLYNSSHNCTPYPTTKKRLILTKRAYSTRTRGRSGPLQSLARKLGRFKVRAVIVDDIAREESNRKR

SEQ ID NO: 208743 - protein, 89 aa, Glycine max
  Coding DNA Sequence Number=SeqID_91965
  Homolog annotation: Hit_ID=Q1T035; Match level="QueryCoverage=72%, HitCoverage=8%, E-value=2e-09, Identity=47%"; Hit description =Integrase, catalytic region
MSLSRSLKYSIKDQLAKFYSKVDKGIFLRYFDTSKAYKVFNSRTLVVEESIHVKFNDGLTTDRKLSDLEDDFVDTHIGLSVAPKVDEVK

SEQ ID NO: 208744 - protein, 573 aa, Glycine max
  Coding DNA Sequence Number=SeqID_91966
MAQRYLHQLLEEDQEPFLLNKYISDRRSQMKRPSPMTSLQVKKRKSTNPNANFPRNLCKSACLFSLTDTPDLRKSPLFEFASPVKSPYKSPNPIFLHIPSRTAALLLEAALRIQKHTSKPKTKAQSFGLFGSLYKRLTQRSHKRREIECGGGGVKVSVKDVLKWDSSVGRRKASKANGKCKETGNVNTNASEVGFACSYNIGRPSSSAVWSESNEDKSLDIETSSSGYSEKIHFVTNIHKHYSTCFCESPFRFVLQTSTPSSGHHTPELPSPSRHPTEPECCFSVTIIAAQSFRKLLKNRACGTVGREKESNEGESLKKFESGEEEEEDKEQCSPVSVLDPPFEDDEEGHGNGDEEEEEEEEGGFDLECSYAIVQRAKQQLLYKLRRFEKLAELDPVELEKRMQDQEEDEDDTFMEEEDGHDEKNQASCKENDFRKLIFQALCQSSVHDRQQIPEDFKKLVSDLILEEERALDSLEDKDMVISRICKRLELWKEVESNTIDMMIEDDFAREDSEWKRNIEHIRNMAGELELAIFGFLVEEFSEELLAVGMLKGWDTDKIQGIPLTLMLMCHNS

SEQ ID NO: 208745 - protein, 97 aa, Glycine max
  Coding DNA Sequence Number=SeqID_91967
MTHQRKSQKKHNINFMGELCPCGASATKLPWQKKKREKGKWPVLVIVNRVLDKGEKLPVSFRDHINLEEMLAKKRKRRAETQNTTSRGSSASYLREA

SEQ ID NO: 208746 - protein, 137 aa, Glycine max
  Coding DNA Sequence Number=SeqID_91968
MSNIWATFHDFISIILRCQSTPLKFETDVLFCLVFDQAEDVTFILSRSLKTAKEETLEGRDPPSSNPLLVHGGSTTTTPDLCQLLSRTREIDNRSVVENEGSANLNSFAQLPSTRNIESEPPSSKPYYERGRSATSS

SEQ ID NO: 208747 - protein, 148 aa, Glycine max
  Coding DNA Sequence Number=SeqID_91969
  Homolog annotation: Hit_ID=Q00M75; Match level="QueryCoverage=24%, HitCoverage=6%, E-value=1e-09, Identity=83%"; Hit description=PPR -repeat containing protein
MREGCCTQPYPCICKEAVSGFEPMTNKSPRHNFTTAPGLALRRLSTHIPTKLKWRLTLNSMSREWYHKPPMNMWAERVLGCSGPWTPRQKSTQKTKGSDGFNSTVVIRGEDMESEMPIEQGIFKWGPLLMVDAQTKYQSPAAWDFFFS

SEQ ID NO: 208748 - protein, 1480 aa, Glycine max
  Coding DNA Sequence Number=SeqID_91970
  Gene Ontology: Mol. function=nucleoside-triphosphatase activity; Cellular component=integral to membrane; Biological process=transport
  Homolog annotation: Hit_ID=Q7PC87; Match level="QueryCoverage=97%, HitCoverage=97%, E-value=0.0, Identity=69%"; Hit description =Pleiotropic drug resistance protein 6
  Pfam annotation: Domain name=ABC2_membrane; Domain location=1204 -1418; Score=233.4; E_value=5e-67; Accession=PF01061.14; Description =ABC-2 type transporter
  Pfam annotation: Domain name=ABC2_membrane; Domain location=543-756; Score=204.3; E_value=2.8e-58; Accession=PF01061.14; Description=ABC -2 type transporter
  Pfam annotation: Domain name=ABC_tran; Domain location=191-441; Score= 17.2; E_value=5.1e-09; Accession=PF00005.17; Description=ABC transporter
  Pfam annotation: Domain name=ABC_tran; Domain location=917-1107; Score=110.1; E_value=6.4e-30; Accession=PF00005.17; Description=ABC transporter
  Pfam annotation: Domain name=PDR_assoc; Domain location=761-828; Score=135.6; E_value=1.3e-37; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1204 -1418::543-756::191-441::917-1107::761-828
MASALAGDDLAVSTSSRRSWTTASFRDAWTAAPDVFNVSGRHVYEDDEEELKWAAIDRLPTFERMRKGVLKHVLDDGHVMLDEVDVSNLCLHDKKLLIDSILKIVEEDNEKFLRRLRNRVDRVGIEIPKIEVRCENLSVEGDVHVGSRALPTLLNATLNAFESVLGMFHLAPSKKREIQILKDVSGIVKPSRMTLLLGPPSSGKTTLLLALAGKLDRDLRFTSIVSPHHHMSILFNHKVSFMLRCDQVSGRITYCGHELNEFVPQKTCAYISQHDIHYGEMTVRETLDFSGRCLGVGTRYEALVELSRREREAGIKPDPEIDAFMKAIALSGQKTNLVTDYVLKILGLDICADIVVGDEMRRGISGGQKKRVTTGEMLVGPAKALFMDEISTGLDSSTTFQICKFMRQMVHVMDVTMVISLLQPAPETFELFDDIILLSEGQIVYQGPRENGLEFFEHMGFKCPERKGVTDFLQEVTSKKDQQQYWSRKDEPYRYVSVSEFVQAFSSFDIGEQLATELGVPYDKRQAHPAALVKDKYGITNWELFKACFSREWLLMKRSSFVYIFKTTQITIMSIITFTVFLRTEMSVGTVEDGQKFFGALFFSLINVMFNGMAELSMTVFRLPVFYKQRDFRFYPAWAFGLPIWLLRIPLSIMESGIWIALTYYTIGFAPSASRFIRQFLALFAIHQMALSLFRFLAAAGRTLVVANTLGTLSLQLVFVLGGFVIAKDDIEPWMMWGYYLSPMMYGQNAIVMNEFLDKRWSKPNTDPRINAPTVGKVLLKSRGFYTEEYWFWICIGALLGFSLLFNLLFIVALTYLNPLGYSKAVIADEGDKKNNKSSSSQHILEGTDMAVKESSEMASSLNQEPRRGMVLPFQPLSLAFNHISYYVDMPAEMRSRGINKDRLQLLQDVSGAFRPGILTALVGVSGAGKTTLMDVLAGRKTGGYIEGSISISGYPKNQATFARISGYCEQNDIHSPHVTVYESLLFSAWLRLPSDVNAQKRKMFVEEVMELVELNQIRDALVGLPGVDGLSTEQRKRLTIAVELVANPSIIFMDEPTSGLDARAAAIVMRTVRNTVDTGRTVVCTIHQPSIDIFEAFDEILLMKRGGQVIYAGPLGRHSHKLIEYFEGIPGVPKIKDGYNPASWMLDISSTTMEANLEVDFAEIYAKSTLYRRNQELIEELSTPVPDSKDLHFPTKYSQSFFVQCKANFWKQYWSYWRYPQYNAVRFFMTIVVGVMFGVIFWNKAKKTHKQQDLMNLLGGMYAAMLFLGAMNASSVQPVVAIERTIFYRERAAGMYSALPYAFGQVAIEAIYNAIQTAVYSLILYSMIGFDWKATSFFWFYYYILMCFMYFTLYGMMIVALTPGHQVAAICMSFFLSFWNLFSGFIIPRTQIPVWWRWYYWASPVSWTLYGLITSQLGDKNAELEIPGAGSMGLKEFLKQNLGFDYDFLPVVAAAHVGWVILFMFVFAYGIKFLNFQRR

SEQ ID NO: 208749 - protein, 115 aa, Glycine max
  Coding DNA Sequence Number=SeqID_91971
  Homolog annotation: Hit_ID=Q6YSC5; Match level="QueryCoverage=41%, HitCoverage=13%, E-value=2e-12, Identity=81%"; Hit description =Putative IAA-alanine resistance protein
  Subcellular localization annotation: CTP_CleavageSite=33; ConfidenceScore=5.09e-01
MSSSSSSSSNRMQFPYNIYKKLRTPLPGGSSLCEGMGEGCCTQPYPCIFKEAVSGVSGFEPMTNKPLVECIGLFISGEHGFSCLSDYPACNFWQELCWGMHFFTNYHMLLVWKAS

SEQ ID NO: 208750 - protein, 359 aa, Glycine max
  Coding DNA Sequence Number=SeqID_91972
  Gene Ontology: Mol. function=oxidoreductase activity; Cellular component=cytoplasm; Biological process=flavonoid biosynthetic process
  Homolog annotation: Hit_ID=Q39224; Match level="QueryCoverage=96%, HitCoverage=97%, E-value=1e-108, Identity=55%"; Hit description=SRG1 protein
  Pfam annotation: Domain name=2OG-FeII_Oxy; Domain location=202-302; Score=168.1; E_value=2.3e-47; Accession=PF03171.10; Description=2OG -Fe(II) oxygenase superfamily
MEPTSLTVPFVQEIAKDALTRVPERYVRPLHERPILLSATTTPLPQVPVIDLSKLLSQDLKEPELEKLHYACKEWGFFQLINHGVSTSLVEKVKRGAQDFFNLPIEEKKKLGQREGEGVEGYGQAFVVSEEQKLEWADMFFMLTLPPHIRKPYLFPNIPLPFRDDLETYSAGLKKLAIQIVELMANALNVDSKEIRELFGEGVQSMRMNYYPPCPQPELVMGLNPHTDGGSLTILLQLNEVEGLQIKIDGSWIPIKPLPNAFIVNLGDMMEIMTNGIYRSIEHRATVNLEKERLSIATFYNPGMEVKLGPAPSLVTPTTPAVFKTISVPEYYRGYLSRELRGRSYLDSMKIQNEDENSS

SEQ ID NO: 208751 - protein, 821 aa, Glycine max
  Coding DNA Sequence Number=SeqID_91973
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS5; Match level="QueryCoverage=96%, HitCoverage=64%, E-value=0.0, Identity=86%"; Hit description=Starch branching enzyme
  Pfam annotation: Domain name=Alpha-amylase; Domain location=288-576; Score=-95.3; E_value=0.02; Accession=PF00128.14; Description=Alpha amylase, catalytic domain
  Pfam annotation: Domain name=Alpha-amylase_C; Domain location=683 -797; Score=93.5; E_value=6.5e-25; Accession=PF02806.8; Description =Alpha amylase, C-terminal all-beta do
  Pfam module annotation: Pfam domain module=Alpha-amylase::Alpha -amylase_C; Domain location=288-576::683-797
MDTPSGIKDSIPAWIKFSVQAPGEIPYSGIYYDPPEEEKYVFKHPQPKRPKSLRIYESHIGMSSPSGWGRMENAALYLKEVTNNYGLQPRSWEFTIPEPKILNWLMEMWVLDCDEKGWRNRDSSEEVRVADGIIELCEAVENNSYFTKPIANVSGQAARTCGGFNVVENMLWSPPMLILATAPPLPNPLNLTIVAMFYKITEIRIIQRLITPLPSPDTSSHTEASGLLPAEPPWVCTREICIAGLEETERRSRMAFCKMGLILDLMGQAQPCLSIWVCEERGSLFGPQADGDTYRPASHLRTGPHLWYHVTNFFAPSSRFGTPEELKSLIDRAHELGLLVLMDIVHSHASNNTLDGLNMFDGTDGHYFHPGSRGYHWMWDSRLFNYGSWEVLRYLLSNARWWLDEYKFDGFRFDGVTSMMYTHHGLEVAFTGNYNEYFGFATDVDAVVYLMLTNDVIHGLFPEAVTIGEDVSGMPTFCLPTQDGGIGFDYRLHMAIADKWIEILKKNDEDWKMGDIIHTLTNRRWLEKCVAYAESHDQALVGDKTIAFWLMDKDMYDFMALDRPSTPIIDRGIALHKMIRLITMGLGGEGYLNFMGNEFGHPVKFSIAHSLLLTSEWIDFPRGDQHLPNGVVVPGNNNSFDKCRRRFDLGDADYLRYQGMQEFDQAMQHLEEKFGFMTAEHQYISRKNEGDKIIVFERGNLIFVFNFHWTNSYSDYRVGCSTPGKYKIVLDSDDALFGGFSRLNHAAEYFTSVWNFSKLVSECAPCSGMDTPRWYDDRPRSFLIYAPSRTAVVYALADEAEPALADATEPEPVDLDDKLLG

SEQ ID NO: 208752 - protein, 283 aa, Glycine max
  Coding DNA Sequence Number=SeqID_91974
  Homolog annotation: Hit_ID=Q9XIS5; Match level="QueryCoverage=30%, HitCoverage=9%, E-value=3e-29, Identity=79%"; Hit description=Starch branching enzyme
MEDEDKYNISEAASSYRHIEDGQGSVVSSLVDVNIPAKKASVSVGRKSKIVSDEVKPKIIPPPATGQKIYEIDPSLLAPRDHLDFRQHVVPTSKHTRNTGWKDSNDQHMVVHMWSNSCKLPATGQNEDGEQGGGDQLVRNIHLQDRDCSHERREKVNESVNYTSSVKFLILSNVSTGITYREWAPGAKGEAVSGKEGKDKVVFLGGVEICRKEEDEIVPPGTSNGSFVSLPLLTSIQKVAGLTEGGEDCANDEDCGAAALRCGFLQGGDGEETEVDSGGFGVR

SEQ ID NO: 208753 - protein, 86 aa, Glycine max
  Coding DNA Sequence Number=SeqID_91975
MKKANNNYNNSNNIKINNNNNNDDDDDNCNNNKNKSNREIASTIHITHSTIEECNGIGLVSERLRFKKRMLSLRSRRTDPEFRRVC

SEQ ID NO: 208754 - protein, 312 aa, Glycine max
  Coding DNA Sequence Number=SeqID_91976
  Gene Ontology: Mol. function=oxidoreductase activity; Cellular component=cellulose and pectin-containing cell wall; Biological process=lignin catabolic process
  Homolog annotation: Hit_ID=O65449; Match level="QueryCoverage=63%, HitCoverage=49%, E-value=9e-47, Identity=42%"; Hit description =Pectinesterase like protein
  Pfam annotation: Domain name=Cu-oxidase; Domain location=169-235; Score=-6.3; E_value=0.00067; Accession=PF00394.12; Description =Multicopper oxidase
  Pfam annotation: Domain name=Cu-oxidase_3; Domain location=61-159; Score=36.0; E_value=6.8e-09; Accession=PF07732.5; Description =Multicopper oxidase
  Pfam module annotation: Pfam domain module=Cu-oxidase::Cu-oxidase_3; Domain location=169-235::61-159
MGYLKNKVYPAFVRERRATKRDYEEFKVRINSLVATTQKVPEDGWTMQDGTPWSGNNVRDHPSMIQPLCICKGKAAYNIPPPYLRIAKSFWAMGNGIKQWKNSWQDGVLGTNCPIPPNSNYTYKFQAKDQIGTYTYFPSTQLHKAAGGFRALNVYHRSVIPIPYPNPDGDFTLLVGDWYKTNHKNLYDSLDVHVGQSVAVLVTLNQPPKDYYIIASTRFTEKPLTTTVVLHYANSISSVFGPVPAPPVDKYDFDWSMKQARTYRWNLTANAARPNPQGHSIMGRFLLNSAGVRRVTRLGAGPKIESKPGCKT

SEQ ID NO: 208755 - protein, 388 aa, Glycine max
  Coding DNA Sequence Number=SeqID_91977
  Homolog annotation: Hit_ID=Q8L8A7; Match level="QueryCoverage=92%, HitCoverage=94%, E-value=9e-73, Identity=46%"; Hit description =Transcription activator
  Pfam annotation: Domain name=QLQ; Domain location=82-118; Score=57.1; E_value=5.9e-14; Accession=PF08880.1; Description=QLQ
  Pfam annotation: Domain name=WRC; Domain location=152-197; Score =103.8; E_value=5e-28; Accession=PF08879.1; Description=WRC
  Pfam module annotation: Pfam domain module=QLQ::WRC; Domain location =82-118::152-197
MDFHLKEWRNQHESEEQQHSTKMPKLLPESHHQQPSATALPLFVPEPNSSSKVSTLSDSTLAAETETMTTTTTNRLFPRMGSYFSLSQWQELELQALIFRYMLAGAAVPPELLQPIKKSLLHSPHYFLHHPLQHYQPAALLQSGYWGRGAMDPEPGRCRRTDGKKWRCSRDVVAGQKYCERHMHRGRNRSRKPVELPTPTSANNCDGGSLGLGASSSSISSPPLASASLKSPFDLLRLNERSSGTKNEDEDHVGGDGRSGGGGGHMLRHFFDDWPRSLQDSDNVENNAAGPSLSISMPGNAAAASSDVSLKLSTGYGEDPGPRNENVGLVAEQLQLNWAGGWASSNQVASMGGPLAEALRSSISTSSPTSVLHHLPRGSGSETSIIST

SEQ ID NO: 208756 - protein, 109 aa, Glycine max
  Coding DNA Sequence Number=SeqID_91978
MAATLRVSFKFLYNKPNSTTEVADCLLSMEVSDDDDELVILLCTNTDPIETTETLNDEILVSNTDILAWDLPMILTFPAIKVQAHRNRLIEQSLYFRGLLSGSFLYKIC

SEQ ID NO: 208757 - protein, 872 aa, Glycine max
  Coding DNA Sequence Number=SeqID_91979
  Gene Ontology: Mol. function=protein serine/threonine kinase activity; Biological process=protein amino acid phosphorylation
  Homolog annotation: Hit_ID=Q9LFA2; Match level="QueryCoverage=99%, HitCoverage=100%, E-value=0.0, Identity=49%"; Hit description =Protein kinase-like
  Pfam annotation: Domain name=Pkinase; Domain location=490-821; Score =236.6; E_value=5.3e-68; Accession=PF00069.15; Description=Protein kinase domain
  Pfam annotation: Domain name=Pkinase_Tyr; Domain location=490-821; Score=-19.6; E_value=2.9e-11; Accession=PF07714.7; Description =Protein tyrosine kinase
  Pfam module annotation: Pfam domain module=Pkinase::Pkinase_Tyr; Domain location=490-821::490-821
VCLVMGSFSGTCEIVEAREEELNTRKAPGVYQSSSECSTSEKNQKFSVLKLGYKDDLDDDINKLFESIALKSSSRDLSLFQDGTSPRLKSALKKPITMGIPRSPRVGTSEPANLKQALRDLCISKASEMAAMKRLSKSTTASPRLSEVGKIQTLYNSVVAETSRSGSSFVESNGRQIEISLVPEKGKSLSLEKTSQSSQIALLSRNIHSSREIAVATTKYDAGTSLIQSDLAGSSSKVGIQSQRVVPVETEEQASASSPSLYNTSGCKSEVPKNASSPKKLGNKTSVSNTGKKGRLQTVSSSNAVNGNRVNKPPRHAPWTVKSVIKNKNLSKKKQKEDSCSTLCGPTPNEVNKPVPGTPRLICERCRCALENTSEEKNQDIVALDSTSPENGVNLSNVHSGSNKPGLVSSSVNKSKTVAKVKNTKLKEQIEFSQSSKSSQGEYSSSTSTSDESNVSGSSRSTRPHMSKDVRWAAIRHAQVQHGVLGLRHFNLLKKLGCGDIGTVYLAELIGTSCLFAIKVMDNEFLERRKKMPRAQTEREILRILDHPFLPTMYAQFTSDNLSCLVMEYCPGGDLHVLRQKQLGRYFSEPAARFYVAEVLLALEYLHMLGVVYRDLKPENILVREDGHIMLTDFDLSLRCAVNPMLLKSSDVDPAKISGLSAQASCIEPFCIEPSCQVPCFSPRLLPTAAKARKLKVDLAAQVRSLPQLVAEPTDARSNSFVGTHEYLAPEIIKEEGHGAAVDWWTFGVFLYELLYGRTPFKGSNNEETLANVVLLGLRFPEHPNVSFQAKDLIRGLLVKEPENRLGSEKGAAEIKQHPFFEGLNWALIRCAMPPELPDFYDFGVSDMMNSQCKGAKYLECKVGEHVEFELF

SEQ ID NO: 208758 - protein, 58 aa, Glycine max
  Coding DNA Sequence Number=SeqID_91980
MALRILVRLNSKAQNAQPSALFEEEYTKQAFAKRDTQCLSARKYPEEDELSGSLSAPL

SEQ ID NO: 208759 - protein, 318 aa, Glycine max
  Coding DNA Sequence Number=SeqID_91981
LDEFKVELERRNYHKRLTNLADSSIDLALVKEFYANLYSPEGLSPKQVRIRGHLIKIDADSLNAFLETHVVLAEGESLPAYSRYCRMPTNIREIEDALCIPGRGFILNAEGHPGKILRKDLTTLAQVWSVLSYSNLAPTSHTSDLTVDRARLIFGLVTQLDMNVRALISGQITSMAQSNSSRLGFPALITTLCRSRGVASDSLVFERLSPVINLAYIRKNCWNPDDPTVIIRGARRPRARPIEAASTLVAPHPASTSSAPPPARMIAAPSTLPLADFQCFEAMLRSIHQGKIILLQSLQLVAPPDSIPTVEQFNEWVA

SEQ ID NO: 208760 - protein, 75 aa, Glycine max
  Coding DNA Sequence Number=SeqID_91982
VDSRGSHPLSSPECEVVPPSPPLIIIFNASSDEAVAPPDSSAGEIADLPTSPVGGIFDLSDSSSGEVVALTDSPV

SEQ ID NO: 208761 - protein, 170 aa, Glycine max
  Coding DNA Sequence Number=SeqID_91983
  Homolog annotation: Hit_ID=Q47522; Match level="QueryCoverage=25%, HitCoverage=53%, E-value=2e-18, Identity=97%"; Hit description=LacZ protein
ASRYQQGHQDLCILRSDLPSQWLLFLSAVPPVQLLTGWCVTAKAPPDISAGKCSGRVPFAIQAAQLLGRAIGAGLFAITPAGERGMCCKAIKLGNASVFPEFDYPAATLSAAPPIKGIPESRKHARKLRPFVEAKYSNVYVQLENGDWEFSHCNASGQVVAVYHIKKHLI

SEQ ID NO: 208762 - protein, 64 aa, Glycine max
  Coding DNA Sequence Number=SeqID_91984
MVRDKGTNADGGEGCGWGRGGIREGGWRFISTVPMVEISVLKFDVKSSSEVSNFFMLQNYLLMK

SEQ ID NO: 208763 - protein, 80 aa, Glycine max
  Coding DNA Sequence Number=SeqID_91985
MDDASQGFFYQPDLLYGAKSNDIGLGNDNDENVGGDDTDLQAQPSYPDFSSYFMTDELFQECGDLLSWHNMLEMSMGLWL

SEQ ID NO: 208764 - protein, 86 aa, Glycine max
  Coding DNA Sequence Number=SeqID_91986
MIWWHHLGTTKEDEGDVKCVVARPQRVSYKVKENGTKMYPGRKRKIEHDTGTRDETILGSTLVSSKGFLMGWDVSKVVMEREKDRG

SEQ ID NO: 208765 - protein, 302 aa, Glycine max
  Coding DNA Sequence Number=SeqID_91987
  Gene Ontology: Mol. function=nucleic acid binding; Cellular component= intracellular; Biological process=regulation of transcription
  Homolog annotation: Hit_ID=Q9LEU3; Match level="QueryCoverage=72%, HitCoverage=74%, E-value=2e-18, Identity=35%"; Hit description=Zinc finger-like protein
  Pfam annotation: Domain name=zf-C2H2; Domain location=118-140; Score =22.2; E_value=0.0018; Accession=PF00096.16; Description=Zinc finger, C2H2 type
MASSHVLEGCPSEASSISATSEGISHKPSAEEENNHDEVAKMKEKGVKSEQYQASNSNSRMVLDFVKLSQDESIRGSKVELDFFNPMNLGGSPSSRVKNTEGRDENNNEEKSSEAKTFSCNFCKKEFSSSQALGGHQNAHKQERALAKRRQGIDVGAFRNPHFLYYPYHPAHSFYGTYNRALGVRMESMIHKPSYPSSSLGFRFGQGWSRSQEMLNPSLDRLRIEGLHANSGIRILGSDTSLRTKDDCGTIGHNIPFLGESSTNVATKSNPAPLSTVGGDHLKQEACSSPDSSDEIDLSLKL

SEQ ID NO: 208766 - protein, 96 aa, Glycine max
  Coding DNA Sequence Number=SeqID_91988
MEVGWELPNCKRHSNIEMSSFLTHVSGQQGSFTLHWHSSNQKTQKLQTLETSKSPLEFIWFLFLLERGSWVWLSNSQVVCTLAFKAKSITIPFAVS

SEQ ID NO: 208767 - protein, 399 aa, Glycine max
  Coding DNA Sequence Number=SeqID_91989
  Gene Ontology: Mol. function=phospholipid binding; Cellular component= coated pit; Biological process=endocytosis
  Homolog annotation: Hit_ID=Q9FRH3; Match level="QueryCoverage=99%, HitCoverage=100%, E-value=2e-85, Identity=42%"; Hit description =Putative clathrin assembly protein At1g25240
  Pfam annotation: Domain name=ANTH; Domain location=30-295; Score =178.3; E_value=1.8e-50; Accession=PF07651.6; Description=ANTH domain
MRVFKRASGAIKDRNSIWVAKFSPKGPFHNPDLETVIIKATSHDDKHIDSKNVQRVFQWLRTSPLYLKPLVWILSMRMQKTRSWVVALKGLMLIHGVFCIDIPVVQRMGRLPFDLSNFSDGHLSPAKAWSFNAFVRAYFAYLDKRSAFASSETKQKNVSNKMKEVDETLMEELEKLQKLQGMIDMLLQIRPKNENLNVGLILEAMDCVIVEVFGVYSKFCNKIAKVLLRIYEVGGKMEASIGLKVLQKASIQVEEMSLFFDFCKDIGVLNASQCPKIDRISREDIQDLERIISGASSKKGCGVVGNDEDNNKAIVVRDCSSTASVSQQKGSENGLMTVITQQWEVFDDDHIMVGAKGMDNVSNGDKVIIGTTTNPFEESYGIVPYVPAHYQSLPDLISW

SEQ ID NO: 208768 - protein, 59 aa, Glycine max
  Coding DNA Sequence Number=SeqID_91990
MTVHSHLSDLQVKEVMLKDSWVLQADIVAVDIEGRTITAMFKLFLKLLDACLLTRLEAD

SEQ ID NO: 208769 - protein, 293 aa, Glycine max
  Coding DNA Sequence Number=SeqID_91991
  Gene Ontology: Mol. function=nucleic acid binding; Biological process= metabolic process
  Homolog annotation: Hit_ID=Q2QXN6; Match level="QueryCoverage=90%, HitCoverage=55%, E-value=2e-93, Identity=61%"; Hit description =Calmodulin-binding family protein, putative, expressed
  Subcellular localization annotation: CTP_CleavageSite=57; ConfidenceScore=5.17e-01
MEVQTHSLSPTFHFHLLSQSTTDTNQPSLGHATAALKLQKVYRSYRTRRRLADSAVVAEELWWQAIDYVRLNHSTISFFNLPETAASRWSRVKLNAAKVGKGLSKDAKAQKLAFQHWIEAIDPRHRYGHNLQYYYKEWCKTDAGQPFFYWLDLGNGKNLDLEQCSRSKLQKQCIKYLGPQEREQFEYTVRAGKIINKQYGDLLHTNEDSEDAKWIFVMSTSKKLYAGKKKKGLFHHSSFLAGGATLAAGRLVAENGILKSISAYSGHYRPTDDTLDGFLSYLKENGVKLDEVE

SEQ ID NO: 208770 - protein, 198 aa, Glycine max
  Coding DNA Sequence Number=SeqID_91992
MDAESDKRSASTFSPSSSSSYSSSSCLRLDRLVDSEEIEAAETLAQLANCNTHSSDKWCTKQDTTRVMRESPTLLHSDLSLGPGGQAIAGQQPDEKISTTSVETEMFQQDDCSRHMKVEQDADVLPNTSYSLVRTTKSRRNLTEEEKEARRIRRILANRESARQTIRRRQLGSQNKNLVINNLTPPSCPKIQKLTNSQ

SEQ ID NO: 208771 - protein, 128 aa, Glycine max
  Coding DNA Sequence Number=SeqID_91993
  Gene Ontology: Mol. function=transcription factor activity; Cellular component=nucleus; Biological process=regulation of transcription, DNA-dependent
  Homolog annotation: Hit_ID=Q2PQS1; Match level="QueryCoverage=82%, HitCoverage=38%, E-value=3e-53, Identity=84%"; Hit description=GAGA -binding transcriptional activator
  Pfam annotation: Domain name=DUF1004; Domain location=1-108; Score =309.0; E_value=8.7e-90; Accession=PF06217.3; Description=Protein of unknown function (DUF1004)
MELVINGIDMDISGLPTPVCSCTGAPQQCYRWGCGGWQSACCTTNVSIYPLPMSMKRRGARIAGRKMSQGAFKKVLEKLAAEGYNFANPIDLKTHWARHGTNKFVTISCSSSKLWFNLTSPSKDLEVA

SEQ ID NO: 208772 - protein, 306 aa, Glycine max
  Coding DNA Sequence Number=SeqID_91994
  Homolog annotation: Hit_ID=Q0GPE0; Match level="QueryCoverage=61%, HitCoverage=99%, E-value=1e-100, Identity=92%"; Hit description=BZIP transcription factor bZIP39
EKELALKEYESLETTNKNLKTQIAKSINTEVEKTPVEPVSSVAEITPSSGNGPWFLYNHFPVSQIFWPSILQSSNPVHLQNTSFNSIAIPPNANVPCSSESESRHKQNNLINDNRTQNPFYMFPCPWLFPLPQFGNGQSSPSNSLKDEQDNLSLCKPCSSSSSLNTLANVDYQAALPIKLKTEACGWTEAIPINNPGCATPRSSLDGGEKKTGCYIIEKYHGPALGCNGHASAVKQEHDFQLLSAPNNKVSSIAYISTSSLEKKQEKFICQEKNLVDAVAAAEARKRRKELTKQKSIHNRQSRMHC

SEQ ID NO: 208773 - protein, 95 aa, Glycine max
  Coding DNA Sequence Number=SeqID_91995
  Gene Ontology: Mol. function=dihydrodipicolinate reductase activity; Biological process=lysine biosynthetic process via diaminopimelate
  Homolog annotation: Hit_ID=Q8H053; Match level="QueryCoverage=52%, HitCoverage=10%, E-value=5e-18, Identity=78%"; Hit description =Putative dihydrodipicolinate reductase-like protein
  Pfam annotation: Domain name=LysM; Domain location=48-90; Score=32.5; E_value=1.5e-06; Accession=PF01476.10; Description=LysM domain
MAEKIYWCCVVVFVELVLVLSGCESSTNEFSVPMLMQMNINKACDEIYVVREGETLQTISNKCGDPYIVEENPHIQDPDDVFPGLVIKINPFTNR

SEQ ID NO: 208774 - protein, 177 aa, Glycine max
  Coding DNA Sequence Number=SeqID_91996
  Gene Ontology: Mol. function=hydrolase activity; Cellular component =integral to membrane; Biological process=metabolic process
  Homolog annotation: Hit_ID=Q9SJM7; Match level="QueryCoverage=99%, HitCoverage=44%, E-value=1e-60, Identity=63%"; Hit description =Expressed protein
IHGDPEAADIVFTSGADVVVVGINITTQVQFTDADLLDLKESKGKYAPFLSDICKFYRDFHVKSDRVHGNFSFYFNVTSYASTKKVAMGMMIWLLSGIFLHDPVSFVAVVRPDLFTYKKGVVRVETQGICVGHTLLDQGLKKWNTSNPWTGYSPVAVAWTVNVKGVLDYIRELLMKP

SEQ ID NO: 208775 - protein, 95 aa, Glycine max
  Coding DNA Sequence Number=SeqID_91997
  Gene Ontology: Mol. function=hydrolase activity, acting on ester bonds; Biological process=lipid metabolic process
MMNSHKQLFPLFSLFLVLYLLGQRVVLQAEASPQHGPTKLFVFGDSYADTGNIQRTVSNSWKDPYGITFPGKPAGRFSDGRVLTDYIGKCNSNTS

SEQ ID NO: 208776 - protein, 64 aa, Glycine max
  Coding DNA Sequence Number=SeqID_91998
  Subcellular localization annotation: CTP_CleavageSite=45; ConfidenceScore=5.50e-01
MPSSVQTLSRSCTVDKSFSAVRSRWNGMLGGLKLQRKIPPAQSRRCFSVVSIRTTTQSHNKWKF

SEQ ID NO: 208777 - protein, 200 aa, Glycine max
  Coding DNA Sequence Number=SeqID_91999
  Gene Ontology: Mol. function=hydrolase activity; Cellular component =cytosol; Biological process=metabolic process
  Homolog annotation: Hit_ID=Q9SJM7; Match level="QueryCoverage=86%, HitCoverage=52%, E-value=8e-74, Identity=80%"; Hit description =Expressed protein
  Pfam annotation: Domain name=IU_nuc_hydro; Domain location=15-200; Score=3.6; E_value=6.7e-11; Accession=PF01156.9; Description=Inosine- uridine preferring nucleoside hydrolase
MASLFNNANGVLGKSEKLIIDTDPGIDDSMAIFMAFQSPDVEVLGLTTIFGNTTTEVSTRNALLLCEIAGREDIPVAQGSHEPLKGGKPRVADFVHGKDGLGNTFLPPPKGEKIEKSASEFLVEKVSEYPGEVSVLALGPLTNLALAIKRDSSFASKVKRIVILGGAFFALGNVNPAAEANEKECRLIFFGPFHLYFVYL

SEQ ID NO: 208778 - protein, 82 aa, Glycine max
  Coding DNA Sequence Number=SeqID_92000
MEGSQQNTHYPKEILPKIITHKWKFGNLLETPNTLPMKGLFVTKLESNKVLLSPIALKVVDPLLLDSNSSRDDTNPPLQFPI

SEQ ID NO: 208779 - protein, 183 aa, Glycine max
  Coding DNA Sequence Number=SeqID_92001
  Gene Ontology: Mol. function=nucleic acid binding; Biological process= proteolysis
  Homolog annotation: Hit_ID=Q8H6Q8; Match level="QueryCoverage=75%, HitCoverage=43%, E-value=1e-19, Identity=43%"; Hit description=CTV.20
MPSKLYFQRPTAPNLLLDEKGKCNFKIFSANNIYEWNIDAQMEYNIMNTLQHMTMVAMAYQTSHECSEETIIDILVAGFSGQLKGCTVKMDLNGKVITNDDNKEIPDAINTYIFTIAQHFIGDPSLWKDRSIELLSNLKCRTLVDFRWYRDTFLTRVYTREDSQQPIWKEKFLAGLPRSLGDK

SEQ ID NO: 208780 - protein, 111 aa, Glycine max
  Coding DNA Sequence Number=SeqID_92002
  Gene Ontology: Mol. function=hydrolase activity
  Homolog annotation: Hit_ID=Q8S340; Match level="QueryCoverage=77%, HitCoverage=20%, E-value=6e-30, Identity=68%"; Hit description =Purple acid phosphatase
MRVSWITEDKHAESVVEYGTKAGEYSAKATGVYTSYQYFFYNSGKIHNVVIGPLQPGSTYFYRCGGSGPEFSFKTPPPRCPIEFVIVVSELMSSSSQRNDTVGQDKVAFKD

SEQ ID NO: 208781 - protein, 59 aa, Glycine max
  Coding DNA Sequence Number=SeqID_92003
MDPNITQLVGDSANKNTLAFALLPASTDRWQCGDEHGNMHESLCVKGCTIHPSSLMNHI

SEQ ID NO: 208782 - protein, 109 aa, Glycine max
  Coding DNA Sequence Number=SeqID_92004
  Gene Ontology: Mol. function=DNA binding; Cellular component=integral to membrane; Biological process=transport
  Homolog annotation: Hit_ID=Q69TX8; Match level="QueryCoverage=50%, HitCoverage=26%, E-value=5e-18, Identity=80%"; Hit description =Putative transmembrane protein Tmp21
MDTYGVELELRKLEGEVKAIHENLLYLKGREAEMRTVSEKTNGRVAWFSIISLAMCIAVSEEDEKLLRHITKYGHGHGHGAEFPKQEGLQRCGKICRLMWIIYLRPDLK

SEQ ID NO: 208783 - protein, 76 aa, Glycine max
  Coding DNA Sequence Number=SeqID_92005
MERLNSELYYQNCHIMKENERLRKKAQLLNQENQQLLSELKKKLSKGNAKTNAAPNTIHDLNLGSSTSQSPSGSSN

SEQ ID NO: 208784 - protein, 58 aa, Glycine max
  Coding DNA Sequence Number=SeqID_92006
MANDDGACGTIRTSRRSEGGDDEACGSVRRFPENAFTMSRELGRTLSDMRILKKQLKN

SEQ ID NO: 208785 - protein, 359 aa, Glycine max
  Coding DNA Sequence Number=SeqID_92007
  Gene Ontology: Cellular component=peroxisomal membrane; Biological process=peroxisome organization and biogenesis
  Homolog annotation: Hit_ID=Q45TX7; Match level="QueryCoverage=99%, HitCoverage=98%, E-value=1e-100, Identity=52%"; Hit description =Putative shrunken seed protein
  Pfam annotation: Domain name=Pex16; Domain location=1-352; Score =238.3; E_value=1.7e-68; Accession=PF08610.1; Description=Peroxisomal membrane protein (Pex16)
MGEAEQRVCALHGVFGQCKGLTWLLPERFSESEIGPEAVTTILGIITALNEHIIDTAPKQNITGSVEPYSFPYPLCLSALKDLETLVEVVAQQYYGDDKKWNFLAITEATKVLVRLSLFRKSGYKMLLQGGETPNDEEYSDSFTSQHHMGLKPDVHHRPGYMKNNLGAKPMNQEGRALSALVRFGEKAKGSDPVWLRRVEHQQATMEPTTSRVDRPTLLTILSERGLCGALFFIGEVLLISRPLIYVLFIRKYGIRSWTPWFLSLAIDCIGNSILSLITSSVAGGKDRMFHLSALEKDEVKRRKLLFVLYLMRDPFFSKQRLESTEKVLEPIPVIGFLTAKLVELIIGAQTRYTYMSGS

SEQ ID NO: 208786 - protein, 110 aa, Glycine max
  Coding DNA Sequence Number=SeqID_92008
  Gene Ontology: Mol. function=protein binding; Cellular component =cytoplasm; Biological process=ubiquitin cycle
  Homolog annotation: Hit_ID=Q8S938; Match level="QueryCoverage=81%, HitCoverage=92%, E-value=2e-31, Identity=68%"; Hit description=Rurm1 protein
  Pfam annotation: Domain name=Urm1; Domain location=20-110; Score =165.2; E_value=1.7e-46; Accession=PF09138.1; Description=Urm1 (Ubiquitin related modifier)
MAAFVVEVVGDEEIIQRSRGGLELLCDSKKIHNVNIEQHNGEDKLIMKDLLSWVQTNLIKERPEMFMKGDTVRPGVLVLVNDCDWELSGQLNTSLEDKDVVVFISTLHGG

SEQ ID NO: 208787 - protein, 72 aa, Glycine max
  Coding DNA Sequence Number=SeqID_92009
MDSTMSTRTFHTLTNPPCPGMIHLGDGVDEVFYSVPKAYDLLHMLAGQRKQELELNFIEQMENIIRYKFRIK

SEQ ID NO: 208788 - protein, 148 aa, Glycine max
  Coding DNA Sequence Number=SeqID_92010
  Gene Ontology: Mol. function=ribonuclease H activity
  Homolog annotation: Hit_ID=Q1SZM6; Match level="QueryCoverage=78%, HitCoverage=38%, E-value=2e-10, Identity=33%"; Hit description =Ribonuclease H
  Pfam annotation: Domain name=RnaseH; Domain location=2-118; Score= -12.0; E_value=0.00075; Accession=PF00075.14; Description=RNase H
MDPNITQQNGGRFLRIRTPLPLPCYLPLQCCTALEAELLAIKIGVQTAVSRGYGNLIVESDSHASIQLINLGVQQSHIFYDLVSSILEIGSKANHIVWNHVFREANSAADGLAKHGLSLSGRVELFEFPPPFIWAPMCADEMGVIYTR

SEQ ID NO: 208789 - protein, 83 aa, Glycine max
  Coding DNA Sequence Number=SeqID_92011
MRNRWIYGWVGPTGTVYGGQGVAHGPWLASQRAHRCLLAPPPHTRVGPSTPLFNPAWPPKGAWPNMDPPITFYIMDTCILHYI

SEQ ID NO: 208790 - protein, 155 aa, Glycine max
  Coding DNA Sequence Number=SeqID_92012
  Gene Ontology: Mol. function=protein binding; Cellular component =nucleus; Biological process=multicellular organismal development
  Homolog annotation: Hit_ID=Q6VG98; Match level="QueryCoverage=98%, HitCoverage=100%, E-value=1e-74, Identity=78%"; Hit description=TFL1a
  Pfam annotation: Domain name=PBP; Domain location=20-145; Score =187.2; E_value=4e-53; Accession=PF01161.10; Description =Phosphatidylethanolamine-binding protein
MAKMPLEPLIVGRVIGEVLDSFTTSTKMTVSYNKKQVYNGHELFPSTVNTKPKVEIEGGDMRSFFTLIMTDPDVPGPSDPYLREHLHWIVTDIPGTTDATFGKELVSYEVPKPNIGIHRDHFNTRKFAAENDLGLPVAAVYFNAQRETAARRRYL

SEQ ID NO: 208791 - protein, 258 aa, Glycine max
  Coding DNA Sequence Number=SeqID_92013
  Gene Ontology: Mol. function=phosphoenolpyruvate carboxykinase (ATP) activity; Cellular component=cytosol; Biological process =gluconeogenesis
  Homolog annotation: Hit_ID=Q9T074; Match level="QueryCoverage=99%, HitCoverage=35%, E-value=1e-115, Identity=77%"; Hit description =Phosphoenolpyruvate carboxykinase [ATP]
  Pfam annotation: Domain name=PEPCK_ATP; Domain location=1-258; Score =225.8; E_value=9.7e-65; Accession=PF01293.11; Description =Phosphoenolpyruvate carboxykinase
MDEHSFMVNRERAVDYLNSLDKVFVNDQFLNWDPENKIKVRIVSARAYHSLFMHNILIRCTTMRSSSISSAISGYATCRCIRPTPEELENFGTPDFTIYNAGQFPCNRYTHYMTSSTSIDLSLARKEMVILGTQYAGEMKKGLFSLMHYLMPKRQILSLHSGCNMGKGGDVALFFGLSGTGKTTLSTDHNRYLIGDDEHCWSESGVSNIEGGCYAKCIDLSRENEPDIWNAIKFGTVLENVVFDEHFREVDYTDKSVT

SEQ ID NO: 208792 - protein, 126 aa, Glycine max
  Coding DNA Sequence Number=SeqID_92014
  Gene Ontology: Mol. function=hydrolase activity; Cellular component =cellulose and pectin-containing cell wall
  Homolog annotation: Hit_ID=Q6ESF3; Match level="QueryCoverage=92%, HitCoverage=30%, E-value=2e-39, Identity=65%"; Hit description =Hydrolase, alpha/beta fold protein-like
MDTTWGYQAIQPPASKICGSPNGSTITAPRIKLRDGRNLAYKEHGVPKDVAKHKIIFVHGFDACRHDAYVSKTLSPDVAEKLGVYIVSFDRPGYGESDPDPIQTLKSLALDIEELADKLGLGPNST

SEQ ID NO: 208793 - protein, 280 aa, Glycine max
  Coding DNA Sequence Number=SeqID_92015
  Gene Ontology: Mol. function=phosphoenolpyruvate carboxykinase (ATP) activity; Cellular component=cytosol; Biological process =gluconeogenesis
  Homolog annotation: Hit_ID=UPI000016293F; Match level="QueryCoverage =97%, HitCoverage=41%, E-value=1e-136, Identity=85%"; Hit description= ATP binding / GTP binding / phosphoenolpyruvate carboxykinase (ATP)/ phosphoenolpyruvate carboxykinase
  Pfam annotation: Domain name=PEPCK_ATP; Domain location=1-227; Score =129.0; E_value=1.3e-35; Accession=PF01293.11; Description =Phosphoenolpyruvate carboxykinase
MMSTVGVRVVSQTLKGVAMPNALISLGRMNLTSGMPSNLGQNVVFDEHFREVDYTDKSVTENTRAAYPIEYIPNVKLPCVGPHPKNVILLACDAFGVLPPVSRLNLSQTMYHFISGYTALVAGTEEGIKEPKATFSACFGAAFIMLHPTKYAAMLAEKMQNHGANGWLVNTGWSGGSYGCGNRIKLSYTRKIIDAIHSGSLLDAEYKKTEIFGLEIPNKVEGVPSEILEPENTWSDKQAYKDTLLKLAGLFNKNFETFTIGENNQVTEEILAAGPIIGDA

SEQ ID NO: 208794 - protein, 50 aa, Glycine max
  Coding DNA Sequence Number=SeqID_92016
  Gene Ontology: Mol. function=phospholipase C activity; Cellular component=membrane; Biological process=intracellular signaling cascade
  Homolog annotation: Hit_ID=Q75PK4; Match level="QueryCoverage=92%, HitCoverage=13%, E-value=1e-12, Identity=68%"; Hit description =Hypothetical protein LjNUF
MPKYGGDWPTVKEIIRGNHRLVVFTSNATKEVREGIPYVWNYAVENQCVS

SEQ ID NO: 208795 - protein, 85 aa, Glycine max
  Coding DNA Sequence Number=SeqID_92017
MVLHRELDHLFSSPFVDPPKDDAKSSGMSIENKIKFLESLTGKAKYLSMFMWMKWRSLPSISRIQCYMPNNGEHVSSFINICLFQ

SEQ ID NO: 208796 - protein, 168 aa, Glycine max
  Coding DNA Sequence Number=SeqID_92018
MDSGEGFVKGATLVLHLWVNNFERKRLLRVHRFLTVGAHIYSGSQNDTFREKDCRSEGLRRRRGIRNNMLRTIATSSLVSLGFEQRYLARYVNSRGEEGMRCEIALFCISVPLAQPTRFHFHACSSPVCLLSCSHISLLWPHFRATAVEEEKLLCNIECNESTSEAMR

SEQ ID NO: 208797 - protein, 121 aa, Glycine max
  Coding DNA Sequence Number=SeqID_92019
  Pfam annotation: Domain name=WD40; Domain location=46-82; Score=21.3; E_value=0.0035; Accession=PF00400.22; Description=WD domain, G-beta repeat
MVSKSGSSSCGSENCEVKTRGREDSAKAEVHRDDATVKFWEGNKNYAHEGVFKGHKLAVLCLATTGTFVFRGSSDNTLCMWKHKGLIHMCMTVLMGHDGPLKCLATEENHEYIARGDQDKH

SEQ ID NO: 208798 - protein, 206 aa, Glycine max
  Coding DNA Sequence Number=SeqID_92020
  Gene Ontology: Mol. function=transferase activity; Biological process= biosynthetic process
  Homolog annotation: Hit_ID=Q9LSB5; Match level="QueryCoverage=72%, HitCoverage=21%, E-value=8e-24, Identity=43%"; Hit description =Glycosyl transferases-like protein
  Pfam annotation: Domain name=Glycos_transf_1; Domain location=7-179; Score=52.7; E_value=1.3e-12; Accession=PF00534.10; Description =Glycosyl transferases group 1
MRKGRLPPLEDGKEGEGVSRGKGQDLFLRSFYESLQLIQEKKLQLPFLHAVIVGSDMNAQTKFEMELRKFVVEKKIQNRVHFVNKTLAVAPYLAAIDVLVQNSQARGECFGRITIEAMAFRLPVLGTAAGGTMEIVVNGTTGLLHPVGKEGVTPLAKNIVKLASHVEKRLTMGKKGYERVKERFLEHHMSQRIALVLKEVLQKAKQ

SEQ ID NO: 208799 - protein, 187 aa, Glycine max
  Coding DNA Sequence Number=SeqID_92021
  Gene Ontology: Mol. function=sequence-specific DNA binding; Cellular component=nucleus; Biological process=regulation of transcription, DNA-dependent
  Homolog annotation: Hit_ID=Q7Y0Z8; Match level="QueryCoverage=99%, HitCoverage=46%, E-value=6e-75, Identity=74%"; Hit description=Bell -like homeodomain protein 1
  Pfam annotation: Domain name=Homeobox; Domain location=92-150; Score =6.0; E_value=0.0012; Accession=PF00046.19; Description=Homeobox domain
  Pfam annotation: Domain name=POX; Domain location=1-41; Score=-15.2; E_value=1.1e-05; Accession=PF07526.2; Description=Associated with HOX
  Pfam module annotation: Pfam domain module=Homeobox::POX; Domain location=92-150::1-41
MEEVVSSFEMIAGLGAAKSYTALALQAMSRHFCSLRDAILSHINAEKRKLFQDLPKISSGLSQLSLFDRDSRQSRMSLQQLGVIQSQRQVWRPIRGLPETSVAILRSWLFEHFLHPYPNDSEKLMLASQTGLTKNQVSNWFINARVRLWKPMIEEMYKEEFGESSEDSNPAGNNYLTREDTTDCVED

SEQ ID NO: 208800 - protein, 135 aa, Glycine max
  Coding DNA Sequence Number=SeqID_92022
  Gene Ontology: Mol. function=aminoacyl-tRNA hydrolase activity; Cellular component=ribonucleoprotein complex; Biological process =mRNA processing
  Homolog annotation: Hit_ID=Q10LI6; Match level="QueryCoverage=83%, HitCoverage=60%, E-value=4e-43, Identity=73%"; Hit description =Peptidyl-tRNA hydrolase, putative, expressed
  Pfam annotation: Domain name=Pept_tRNA_hydro; Domain location=21-134; Score=57.2; E_value=5.3e-14; Accession=PF01195.10; Description =Peptidyl-tRNA hydrolase
MHILLRLSRRCFCTFTPRPWLFVGLGNPGDKFKGTRHNVGFEMIDAFAESQGIPMDTVHSKAIFGKGFVGEVPVFLAKPQTYMNLSGESTGPLAAYYKLPLNQVLVFHDDMNLPCGVLRLHDKGGHGSHKGYNTT

SEQ ID NO: 208801 - protein, 312 aa, Glycine max
  Coding DNA Sequence Number=SeqID_92023
  Gene Ontology: Mol. function=transferase activity; Biological process= biosynthetic process
  Homolog annotation: Hit_ID=Q9LSB5; Match level="QueryCoverage=65%, HitCoverage=30%, E-value=1e-10, Identity=27%"; Hit description =Glycosyl transferases-like protein
  Subcellular localization annotation: CTP_CleavageSite=66; ConfidenceScore=5.57e-01
MAKHSVAMAKKRWPIMLAAFLSVSTVTVLLMRSNNSDSCNTNHFTVAQDNQIRSPVQLTNAASSPLIFMKSKLVLMVSHELSLSGGPLLLMELAFLLRGVGSDVVWISNQKPSEHDRVVYSLESKMLDRGVQVLSAKGENAIDTALKADMVILNTAVAGKWLDAILKEKVAHVLPKVLWWIHEMRGHYFKVEYVKHLPFVAGAMIDSHTTAEYWKNRTRERLGIEMPETYVVHLGNSKELMEVAEDSVAKRVLREHVRESLGCCQARDMLVSSAPSWAYSPFGLYCYHYPPLENQPCPQGWAIKTSKYRGWV

SEQ ID NO: 208802 - protein, 255 aa, Glycine max
  Coding DNA Sequence Number=SeqID_92024
  Gene Ontology: Mol. function=transcription factor activity; Cellular component=nucleus; Biological process=regulation of transcription, DNA-dependent
  Homolog annotation: Hit_ID=O23112; Match level="QueryCoverage=39%, HitCoverage=38%, E-value=6e-21, Identity=54%"; Hit description=AP2 domain containing protein RAP2.11
  Pfam annotation: Domain name=AP2; Domain location=22-86; Score=136.7; E_value=6.2e-38; Accession=PF00847.10; Description=AP2 domain
MEYQNQNAKEGRFCEKLKIKNKPKFVGVRQRASGKWAAEIKDTSKKIRLWLGTYQTAEEAARAYDEAACLLRGSNTRTNFSTHKYGIATNSPISLKLRNLLDRKAMSNQSQIQIQRQSSSTISSTFEGAAATSASPNVSAINKIMVMENYSTCSSEGNSMFLVQNHQVSDNTYGLDTNLINCSMGITPNTSQFDCSRALAQQRINELPMPKDGLNVERQFSDSVYATNECHVEDTFEYKYEYDFNYPLSHFFCFT

SEQ ID NO: 208803 - protein, 71 aa, Glycine max
  Coding DNA Sequence Number=SeqID_92025
  Subcellular localization annotation: CTP_CleavageSite=24; ConfidenceScore=5.05e-01
MTTRPSCMTQWLTPVREGQGRAARCRARRCGRGRRGGGRRFQAAIVTMMFDLVCAPNYYHCLKRAEKIVVN

SEQ ID NO: 208804 - protein, 174 aa, Glycine max
  Coding DNA Sequence Number=SeqID_92026
  Gene Ontology: Mol. function=nucleoside-triphosphatase activity; Cellular component=protein complex; Biological process=protein catabolic process
  Homolog annotation: Hit_ID=Q9SEI3; Match level="QueryCoverage=99%, HitCoverage=47%, E-value=3e-88, Identity=98%"; Hit description=26S proteasome AAA-ATPase subunit RPT4a
IVKASSGPRYVVGCRSKVDKEKLTSGTRVVLDMTTLTIMRALPREVDPVVYNMLHEDPGNISYSAVGGLSDQIRELRESIELPLMNPELFLRVGIKPPKGVLLYGPPGTGKTLLARAIASNIDANFLKVVSSAIIDKYIGESASRASFLWMRSMPLEVAVSVREQVQIVRFRER

SEQ ID NO: 208805 - protein, 150 aa, Glycine max
  Coding DNA Sequence Number=SeqID_92027
KDYRWHPEEERAIRAVFETKGSRILKSAMNKIRNGQDKEKWITTNVRAALDKHWGSIDFLNKSSIAKSKEFQRPPTTWEVMEKTKKLKSGEWVNDKSREFAEKYQHRRDEILQHSIEEDTSTQDSPNTHTSVNDNEIYLNVVGGPNYKAN

SEQ ID NO: 208806 - protein, 389 aa, Glycine max
  Coding DNA Sequence Number=SeqID_92028
  Gene Ontology: Mol. function=transposase activity; Biological process= transposition, DNA-mediated
  Homolog annotation: Hit_ID=Q1QKN3; Match level="QueryCoverage=63%, HitCoverage=62%, E-value=1e-105, Identity=68%"; Hit description =Transposase, IS4
  Pfam annotation: Domain name=Transposase_11; Domain location=1-122; Score=15.2; E_value=0.00058; Accession=PF01609.11; Description =Transposase DDE domain
IHALVDVVSRPAVLLLTPGNASDVRTAPDVLAEAPGRIRRLIADKGYDANWLRKDLRASNTTPIIPGTRARKRKIRLDKKRYRERWRVEATFCRLKDFRRIATRYDKLARNFASALALAAVIAFWDGSGFVGASRPLGLTRTGGGEGEANPAGGLADAGAELQEAQPERGELGRGEAVRLRDGLTHAQHQPVGRRVQDEPHLVGGGMPARGTVGGELALVQLDQVLGLSAGTVQVGIEPFRRAGRDVCDDIADVEAEPGRLDTGDDAPLLPPGFGRVPGLGKAAHRVLVVDGSHNSDVIGRLFHLGRQRFGAAQAEDVADPMVLAPVHGLGPPVMAIAPDGDRGDHRDRAAGGGVVDVDRQKAALIVMSVEQRQLLLAVHHVARVVDVQ

SEQ ID NO: 208807 - protein, 117 aa, Glycine max
  Coding DNA Sequence Number=SeqID_92029
MAASWRFFEKTPPNSGGVAGLGWRRHGRRGGYGGVAENGVPPAPHTRTQPHAHAAATTSGSDAPAQTAATSSGSDASVTNGGLQRGVLAEKTKLLSRRRRRRREEEEGVGFSFIFAV

SEQ ID NO: 208808 - protein, 153 aa, Glycine max
  Coding DNA Sequence Number=SeqID_92030
  Gene Ontology: Mol. function=oxidoreductase activity; Biological process=metabolic process
MEVHSDTHGLCNHISKVKEILNELEGLLGDVTNAIQTTDGNLLALSDLDFNVELNEQNNNYTFTQEEKDALSHSQSPDVTITKKKKSADVAYLAMLMAFIYSMVNQDYLMQEKIVSALDIKMPSEELESYCQMWSLRPFINDEIMHQAWEHIH

SEQ ID NO: 208809 - protein, 135 aa, Glycine max
  Coding DNA Sequence Number=SeqID_92031
MRQIEKLLLKFKKEKIPSDGGENLVNRSKKSEEENNDNNRSSDENEEEEPNSCGEERMEEEHPSEIKIKKTIAGIKEIKQMLQFMIKKKGIVLEFEKEDKQPMQTVPTLQLGSCVKDKDSRTIEAEVVEEIRVEE

SEQ ID NO: 208810 - protein, 103 aa, Glycine max
  Coding DNA Sequence Number=SeqID_92032
  Gene Ontology: Mol. function=oxidoreductase activity; Biological process=metabolic process
MIPTPRGWRITKIDELGIAGSRLLSGFQQALDFIRRPPIDTNSKLVHKIIVANETERVKAYINSGCRKLNESIQSVTNFYGDGRLYHSNIGACLKTQQGLSDT

SEQ ID NO: 208811 - protein, 109 aa, Glycine max
  Coding DNA Sequence Number=SeqID_92033
MIERRYSIKGSQSAQRSNQIKASFPSPTFMLIESDNQLPGQQARESREVISHHQIEELKGRIELEILILYALMVPDEGVPMAMVFKSNPSNLVESKVEAQGIDNLTLTN

SEQ ID NO: 208812 - protein, 228 aa, Glycine max
  Coding DNA Sequence Number=SeqID_92034
  Homolog annotation: Hit_ID=Q2QQS4; Match level="QueryCoverage=44%, HitCoverage=77%, E-value=1e-28, Identity=63%"; Hit description =HesB/YadR/YfhF family protein, putative, expressed
  Pfam annotation: Domain name=Fe-S_biosyn; Domain location=22-115; Score=75.5; E_value=1.6e-19; Accession=PF01521.11; Description=Iron -sulphur cluster biosynthesis
MASKAMSVAAEKIGTAARRQAVSLTDAAASRIRQLLQQRQRAFLKLGVKTRGCNGLSYTLNYADEKGKFDELVEDKGVMILIDPKALMHVIGTKMDFVDDKLRCICVLIIYFRRTWNYKLCVQVGEFSLYKIFILVIRCRDTDALLYSSKRDMQENFLLKLLHFDKILFIRIALILTPTLFASPVRSEFIFVNPNSKVLALLGGNMCARLTLGPREGSYKHEVLVFRI

SEQ ID NO: 208813 - protein, 138 aa, Glycine max
  Coding DNA Sequence Number=SeqID_92035
  Pfam annotation: Domain name=SnoaL; Domain location=6-135; Score =24.6; E_value=4.5e-06; Accession=PF07366.3; Description=SnoaL-like polyketide cyclase
MSTITSVAEAFFEACETGGGWAACERYCAPEAGFSAQADALAGITTLRDYAEWMKGLLTVLPDGRYEVKSFATDEERRNVAAYGVFRGTHTGEGGPCPPTGKSTSTDYVYVMQFDGERIAHMTKIWNDARAVKELGWA

SEQ ID NO: 208814 - protein, 215 aa, Glycine max
  Coding DNA Sequence Number=SeqID_92036
  Gene Ontology: Mol. function=catalytic activity; Biological process =polyamine biosynthetic process
  Homolog annotation: Hit_ID=UPI0000382E99; Match level="QueryCoverage =81%, HitCoverage=87%, E-value=2e-67, Identity=77%"; Hit description =COG0019: Diaminopimelate decarboxylase
  Pfam annotation: Domain name=Orn_DAP_Arg_deC; Domain location=90-203; Score=106.3; E_value=8.7e-29; Accession=PF00278.12; Description =Pyridoxal-dependent decarboxylase, C-terminal sheet domain
GLKAETLLGQWAYGLGLAARIAQRTGRALETIDLGGGLGIPYFSGEAALDLGAIRAGLPDLIATLRADPRLAGARVVLEPGRYLAGSAGLYVARVLAVKDSRGSRFVITDGGMHHHLAASGNLGQIVKRDFPLAAVVEDPEAPRAATAVVGPLCTPLDMLARAAPLPPLAEGDLVAVLQSGAYGLTASPTGFLSHPTPAEVLVEGGRAEMIRARG

SEQ ID NO: 208815 - protein, 35 aa, Glycine max
  Coding DNA Sequence Number=SeqID_92037
MEIVYYCNYPLAKAVQMPPYGHSKCKIETTAENVK

SEQ ID NO: 208816 - protein, 618 aa, Glycine max
  Coding DNA Sequence Number=SeqID_92038
  Homolog annotation: Hit_ID=Q6ZJ04; Match level="QueryCoverage=25%, HitCoverage=71%, E-value=4e-52, Identity=69%"; Hit description =Putative 60S ribosomal protein L10A
  Pfam annotation: Domain name=Ribosomal_L1; Domain location=129-332; Score=46.1; E_value=5.8e-12; Accession=PF00687.11; Description =Ribosomal protein L1pL10e family
  Pfam annotation: Domain name=UCR_UQCRX_QCR9; Domain location=13-65; Score=76.3; E_value=9.7e-20; Accession=PF05365.2; Description =Ubiquinol-cytochrome C reductase, UQCRXQCR9 like
  Pfam module annotation: Pfam domain module=Ribosomal_L1::UCR_UQCRX _QCR9; Domain location=129-332::13-65
MEAVSRRRGGGIFESLYKVVMRRNSVYVTFVIAGAFLGERAVDYGVHKLWEANNVGAVVISREEGGDNAVMMMVLFAHHVRIVVVCLALQYVIWWWGSLFGGGSGAWRGYKKEKEELAKMIKLQSDALREAISQVVSNSKEKNRKFTETIELQIGLKNYDPQKDKRFSGSVKLPHIPRPKMKICMLGDAQHVEEAEKIGLDYMDVEALKKLNKNKKLVKKLAKKYHVFLASEAVIKQIPRLLGPGLNKAGKLIALLFALGKLVLEMEEAQIWAKKVELPAFIGTYPIGWIARTEKFFEVQEIPSFHKLQYAFMSMKGAATHWFYIWSQNNPDSDWESFSTPLIKRFGDRHGNHIFERLSILKQEKPTETETHIKKWETSTKFLKGRTNISEWKHMLCKILNEEVDSHASQQDKNSMEGSGSEFSEAKASSWARKVELPSFDRSIEGGTDLKGSSFECDNDPLQFWKSGNKSKEEEVDPLIKREKHKENGVTNVGCEDDFLDNPITDLIKKEVETGDSTKPHCFQDSDFHKKIVIVKQKSFMKVVGTTMVLESWNVNLLDEPLALNFVASMADSLAMELRQKECTKPVKLIKVIWSPPLFLPPPKPPDLSLHAGAVGRS

SEQ ID NO: 208817 - protein, 118 aa, Glycine max
  Coding DNA Sequence Number=SeqID_92039
  Homolog annotation: Hit_ID=Q1S6L0; Match level="QueryCoverage=89%, HitCoverage=28%, E-value=3e-35, Identity=83%"; Hit description=WD40 -like
MAVMASKLAVANSLPDGDQAQDRTVRVCVSSKNRLHFIYIIKFKMMEIDLAGPEARGEILLPDSDGFVAAARSEDEWDTGVTGGRVSIQAPNPIGGAFESLNLFQLHRQSILLSIHRV

SEQ ID NO: 208818 - protein, 349 aa, Glycine max
  Coding DNA Sequence Number=SeqID_92040
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-29, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSLPSEDYTSSSSEGNTPSHSEDCTSSPSEGFRSSPLEECTSSPSEGCTSSPLVDYTSSPSEGYMPSPLEGYMPSPSEGYMPSPLEECTSLPSEDWTSLPLEGYTPSPSEGFTSSPLHILAFWGIHFLTFIRVHTLTFRGVHVLNFRGLHVLTFRRLHVLAFRGLHALTFRGLHVLAFRGVHVLAFRGLHTLAFKGLHTLAFRVLHVLAFSGVHVVAFRGLHVLAFWGLHALTFRGLHAFTFRGLHALAFKGLHVLAFIGLHALAFRGLHVLTFDGVYVLTFKGLHVLIIRGLHVLTVRGLHVLTFRGLHVLNLDGYTRSPLEDFTSSPSEDCKSSPSEGYTPLPSEDC

SEQ ID NO: 208819 - protein, 95 aa, Glycine max
  Coding DNA Sequence Number=SeqID_92041
MELHVHRSMRCGRTTSHYVYKNLAPERVASILSSHDLLIVLAKVDASEEKNTSMGNSEMDKTPKEKESKTLPPPPSSQATEIWMTPLPVKEDKSG

SEQ ID NO: 208820 - protein, 111 aa, Glycine max
  Coding DNA Sequence Number=SeqID_92042
  Gene Ontology: Mol. function=structural constituent of ribosome; Cellular component=ribonucleoprotein complex; Biological process =translation
  Homolog annotation: Hit_ID=Q9FUL4; Match level="QueryCoverage=76%, HitCoverage=46%, E-value=1e-33, Identity=82%"; Hit description=60S ribosomal protein L24
  Pfam annotation: Domain name=Ribosomal_L24e; Domain location=1-44; Score=56.4; E_value=9.7e-14; Accession=PF01246.10; Description =Ribosomal protein L24e
VFLFANSKCKRYFHNRLKPSKLTWTVVYRKQHKKDIAQEVVKKRRRAAKKPYSRSIVGATLEVIQKKRVEKPEVRDAVREAALREIKKRIQKTKDEKKTKKPNTDMRIFVS

SEQ ID NO: 208821 - protein, 131 aa, Glycine max
  Coding DNA Sequence Number=SeqID_92043
MVLTSHVHYLVRQRVARVLSNASFIQKLNRKSKIRLHYDNFMNPSVMKNLQTMDAPSPFPPTQRSPLDLPQSILSCPLNHSAYRLHSFFPVSAVEEICISHSLHAVIHFSEGHINDKRRWRRFVHNHHNNK

SEQ ID NO: 208822 - protein, 398 aa, Glycine max
  Coding DNA Sequence Number=SeqID_92044
  Gene Ontology: Mol. function=protein disulfide oxidoreductase activity; Biological process=cell redox homeostasis
  Homolog annotation: Hit_ID=Q8H558; Match level="QueryCoverage=39%, HitCoverage=63%, E-value=8e-30, Identity=43%"; Hit description =Peptide transporter-like
  Pfam annotation: Domain name=Glutaredoxin; Domain location=256-322; Score=54.7; E_value=3e-13; Accession=PF00462.14; Description =Glutaredoxin
MGCVSSKHIKKDLKQEEVIATNGGSYVNHVVSLTSSTYGALMLDKEKEQHQLQLPVEESKTSPPRIREEPEVINAWELMEGLEEGVPISNNPMKIPKSTPFLRGFISTDPKPKTKTTPFKFLNQLGSPKSLRKFTGKENKIEVQVHHNAGVRRLDYNFSPKGILKPSNFCSPLNGSPIRARRNSFGSDTKRRSPSPLFDPELLASYEKELSQEEEQIKRMVWATPKTRRVRKSLDSQTFIKTFEEKLPPGGENCVVIYTTTLRGIRKTFEECNKVRSIIESYCVHVLERDVSMDSRFKEELRKLMGTEQVKVPVVFVKGRFVGGAEEVVKLEEEGKLGVLFEGIPPKALGECEGCGGVRFVMCVECNGSCKVLDEDRKKTLRCGQCNENGLIQCPMCR

SEQ ID NO: 208823 - protein, 92 aa, Glycine max
  Coding DNA Sequence Number=SeqID_92045
MHPIGVGKKGNIFFRKNDGELVSFDLSSLKIEELGIKGKLHCCQTLWESNEILLELNFILCSKQHAHLQMESSCSKTALDKRKLKLPVGKIS

SEQ ID NO: 208824 - protein, 445 aa, Glycine max
  Coding DNA Sequence Number=SeqID_92046
  Gene Ontology: Mol. function=metal ion binding
  Homolog annotation: Hit_ID=Q5NAS8; Match level="QueryCoverage=99%, HitCoverage=100%, E-value=5e-70, Identity=40%"; Hit description =C3H2C3 RING-finger protein-like
  Pfam annotation: Domain name=zf-C3HC4; Domain location=284-342; Score= 7.3; E_value=0.028; Accession=PF00097.15; Description=Zinc finger, C3HC4 type (RING finger)
MGSACCVAAKDHTIPSTSRTGGESLNRNAVCSPTWSFQWDSWGRVAGEIEDPSFHTSHRVSRNVSMELKGSLSSERGNLSDWGSTLDNSVTPMSLKSPVREHLVTSQMTPSLEIAMARLVTVISASACQGGEVRINVKNLIESPEIAESSIPSVFPTPMSDPMTNHNYHNLTNSTPSRWAHRSPGHPLLRQISDSRILGLKSPDTSISEGRPSFVLSNCSNDMATGSQCGSSDGWSMRTFSEMVASSQKERWSFDSEYTGSGRHKISGTSSRFSYSPSMDLQSCGACSKLLTDRSAWGSQKFIASSDLSVVAVLVCGHVYHAECLETITPEADSYDPACPICMVGEKYMSKLSKKGLWTESETKTKNYKISRNRVVDSYVDGGNDVFDRLKDIVSKMEPSSSSTRSSFGKPFLRRHFSLGSKWSRSLLENDSARKKGFWARCRRD

SEQ ID NO: 208825 - protein, 191 aa, Glycine max
  Coding DNA Sequence Number=SeqID_92047
  Gene Ontology: Mol. function=nucleoside-triphosphatase activity; Cellular component=protein complex; Biological process=protein catabolic process
  Homolog annotation: Hit_ID=Q1SKI7; Match level="QueryCoverage=59%, HitCoverage=28%, E-value=8e-57, Identity=95%"; Hit description=AAA ATPase; 26S proteasome subunit P45; Nucleic acid-binding, OB- fold
  Pfam annotation: Domain name=AAA; Domain location=1-80; Score=-10.6; E_value=0.0013; Accession=PF00004.19; Description=ATPase family associated with various cellular activities (AAA)
MATNRPDVLDPALLRPGRLDRKIEIPLPNEQSRMEILKIHAAGIAKHGEIDYEAVVKLAEGFNGADLRNVCTEAGMAAIRAERDYVIHEDFMKAVRKLNEAKKLESSAHYSADFEPWISRQCILSWKYLRQVTQFVGLSVMFPLGCSGLCFPNSKFGRRRYTATKVTRNQKVIGTGVAAIRIDRVRAAFDC

SEQ ID NO: 208826 - protein, 209 aa, Glycine max
  Coding DNA Sequence Number=SeqID_92048
  Homolog annotation: Hit_ID=Q9JKS4-3; Match level="QueryCoverage=28%, HitCoverage=9%, E-value=2e-07, Identity=46%"; Hit description =Isoform 3 of Q9JKS4
GGPLVTSTLTFRGLHVLTFRGLHALAFRGLHILTFRGLHVLAFRGLHALAFRGLPSEGCTPSPSEGYMPSPPEDYMAARPRLRRAAHSLALRGLCILAFRGLHICTLREFKLLCILGQDFTRAVAKRQVRIVRTNMTTLTQICMTLLRSTIMPSDCNVDLPLQKGRAHKTPSGPEEVQQGPGVSSFGYGPLLVLQGARTPRQGHAIATY

SEQ ID NO: 208827 - protein, 62 aa, Glycine max
  Coding DNA Sequence Number=SeqID_92049
MICGSLKPLEYPFPEVIVNNDKEKALRDTQAIKCLKVSSYKYTMLMNEKSTSSNPIPITLFC

SEQ ID NO: 208828 - protein, 41 aa, Glycine max
  Coding DNA Sequence Number=SeqID_92050
MRPCFKEANALRIKEGVGGCYCVNGVVVEGVMNLPFSTKDE

SEQ ID NO: 208829 - protein, 298 aa, Glycine max
  Coding DNA Sequence Number=SeqID_92051
  Gene Ontology: Mol. function=transporter activity; Cellular component= coated vesicle membrane; Biological process=intracellular protein transport
  Homolog annotation: Hit_ID=Q9SB50; Match level="QueryCoverage=99%, HitCoverage=76%, E-value=1e-129, Identity=71%"; Hit description =Clathrin coat assembly like protein
  Pfam annotation: Domain name=Adap_comp_sub; Domain location=167-298; Score=22.1; E_value=5.8e-07; Accession=PF00928.11; Description =Adaptor complexes medium subunit family
  Pfam annotation: Domain name=Clat_adaptor_s; Domain location=1-138; Score=-62.1; E_value=0.044; Accession=PF01217.10; Description =Clathrin adaptor complex small chain
  Pfam module annotation: Pfam domain module=Adap_comp_sub::Clat _adaptor_s; Domain location=167-298::1-138
MILQFFVLSQRGDNIVYRDSQKGSAETFFRKVKFWKENAEGDAPPVFNIDGVNYFHVKAAGLLFVATTRVNVSPSLVLELLQRIARVIKDYLGVLNEDSFRKNFVLVYELLDEVIDFGYVQTTSTEVLKSYVFNEPIVIDAARMPPLGPASIFMQGTKRMPGTAITKSVVTNEPGGRKRDEIFVDVIEKISVTFNSSGYILTSEIDGTIQMKSYLTGNPEIRLALNEDLSIGTSDYRGSGAVILDDCNFHESVHLDSFDVDRTLSLAEVTIKVRAEFNSSINANTVLVEMPLPSFTAR

SEQ ID NO: 208830 - protein, 394 aa, Glycine max
  Coding DNA Sequence Number=SeqID_92052
  Gene Ontology: Mol. function=protein serine/threonine kinase activity; Cellular component=nucleus; Biological process=protein amino acid phosphorylation
  Homolog annotation: Hit_ID=Q9M6R8; Match level="QueryCoverage=93%, HitCoverage=99%, E-value=0.0, Identity=85%"; Hit description=MAP kinase PsMAPK2
  Pfam annotation: Domain name=Kdo; Domain location=51-216; Score= -87.1; E_value=0.088; Accession=PF06293.4; Description=Lipopolysacchar ide kinase (Kdo)
  Pfam annotation: Domain name=Pkinase; Domain location=55-342; Score =339.3; E_value=6.4e-99; Accession=PF00069.15; Description=Protein kinase domain
  Pfam annotation: Domain name=Pkinase_Tyr; Domain location=55-342; Score=5.0; E_value=8.8e-13; Accession=PF07714.7; Description=Protein tyrosine kinase
  Pfam module annotation: Pfam domain module=Kdo::Pkinase::Pkinase_Tyr; Domain location=51-216::55-342::55-342
MDDGRNKEKGNIRRCEYRSQTRGMATPVEPPNGIRTEGKHYYSMWQTLFEIDSKYVPIKPIGRGAYGIVCSSVNREINEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGTPLSQLYPNAHPLAIDLLAKMLVFDPTKRISVTQALQHPYMAPLYDPNCDPPAVIPIDLDIDEDLGEEMIRDMMWKEMLHYHPESAMESAGLC

SEQ ID NO: 208831 - protein, 448 aa, Glycine max
  Coding DNA Sequence Number=SeqID_92053
  Gene Ontology: Mol. function=transferase activity; Cellular component= nucleus; Biological process=paclitaxel biosynthetic process
  Homolog annotation: Hit_ID=Q94CD1; Match level="QueryCoverage=92%, HitCoverage=91%, E-value=2e-51, Identity=31%"; Hit description =Putative N-hydroxycinnamoyl/benzoyltransferase
  Pfam annotation: Domain name=Transferase; Domain location=7-426; Score=241.2; E_value=2.2e-69; Accession=PF02458.6; Description =Transferase family
MEVPDCIYRGQPLIIPPSAPTPKHSLYLSNLDDQKFLRFSIKYLYLFKKSLSLNILKSSLARVLVDYYPLAGRLRSVDDHTHKLEVDCNGEGAVFAEAFMDTTVHELLESSKTPNKSWKKFLYRIEAQSFIDVPPLIIQVTTLGCGGMILCTAINHCLCDGIGTSQFLHAWAELTRKPESELSTMPFHWRHVLKPREPAQVKFHHAGYTGPNPTPQVDLLKFIQSQPVVPVSFAFTPSHVLRLKKHCVPSLKCTSFETVAAHTWRSWIRSLNQSLPSKLIVKLLFSVNVRAIVDLPQGYYGNGFLLACADSTVEELVEGNLRHGVKLVQEAKVRLKDKEYIRSMVDLLEDKTVKTDLSTSLVISQWSKLGLEEVDFGEGKPLHMGPLTSDIYCLFLPVTGDANAVRVLVSVPESMVERFQYHMNESWQGKEENGNHHDVQHHNENGFF

SEQ ID NO: 208832 - protein, 279 aa, Glycine max
  Coding DNA Sequence Number=SeqID_92054
  Gene Ontology: Mol. function=inositol pentakisphosphate 2-kinase activity; Cellular component=nucleus; Biological process=phytate biosynthetic process
  Homolog annotation: Hit_ID=Q93YN9; Match level="QueryCoverage=84%, HitCoverage=55%, E-value=2e-57, Identity=49%"; Hit description =Inositol-pentakisphosphate 2-kinase (EC 2.7.1.158) (Inositol- 1,3,4 ,5,6-pentakisphosphate ...
  Homolog annotation: Hit description=2-kinase) (Ins(1,3,4,5,6)P5 2 -kinase)
  Pfam annotation: Domain name=DUF941; Domain location=1-255; Score =84.0; E_value=4.5e-22; Accession=PF06090.3; Description=Domain of unknown function (DUF941)
MTHLQNISKFCFKLPCFISGNLGSSPCISVEIKPKCGFIPLSRFISEGTAIKRRITRFQMHQALKLHQGEISLLSKYNPLDLFSGSKERIYKAIKDLFTTPQNNFRVFMNGSLIFGGLGGGAEDTNFGIAKAFENALKSVIQADNGLCTENLLTLVAEAVKKSGVLDRLLDVQKLDNVDIEGAIHAYYDITRQQCIICRELSEEQLKRYTSLHSASLDESLRIQRKAGDSGSGSICSNIYLESTKQTFDFKVDSALHDSFGSASAGAVKKLLQKVIQEC

SEQ ID NO: 208833 - protein, 260 aa, Glycine max
  Coding DNA Sequence Number=SeqID_92055
  Gene Ontology: Mol. function=inositol pentakisphosphate 2-kinase activity; Cellular component=nucleus; Biological process=phytate biosynthetic process
  Homolog annotation: Hit_ID=Q93YN9; Match level="QueryCoverage=59%, HitCoverage=34%, E-value=2e-40, Identity=54%"; Hit description =Inositol-pentakisphosphate 2-kinase (EC 2.7.1.158) (Inositol- 1,3,4 ,5,6-pentakisphosphate ...
  Homolog annotation: Hit description=2-kinase) (Ins(1,3,4,5,6)P5 2 -kinase)
  Pfam annotation: Domain name=DUF941; Domain location=100-259; Score= -166.1; E_value=2.8e-05; Accession=PF06090.3; Description=Domain of unknown function (DUF941)
MVNEEKDKTNNEKKELNRSSVGHLIKLLGVRGNLHLRKSQKIMKLLENDKAQHSPKKIYNKVQQTQADEGSEPQLLELDTVVFFQCILAVRQKSCRMEMILREKDANEWVYRGEGAANLVLAYTGSSPTFIGKVMRIRKCPRNGAEGMCMRSPSALTALERLLWKDVDELISSSDNEIACQLFAHHVMKPLLGPKYVDAGMLVEVPREFLELVEKNVIRQRPAWRVDNARVDMHRGSVLLMSDHSVFTHGIEMPLRAFFY

SEQ ID NO: 208834 - protein, 221 aa, Glycine max
  Coding DNA Sequence Number=SeqID_92056
  Gene Ontology: Mol. function=monooxygenase activity; Cellular component=endoplasmic reticulum; Biological process=electron transport
  Homolog annotation: Hit_ID=Q75LK7; Match level="QueryCoverage=47%, HitCoverage=19%, E-value=7e-21, Identity=42%"; Hit description =Putative cytochrome P450
MAMTKAGEDTTNNNDEDERRMKEGRSWRKEQEHEYKRWYEKCFKTKLFGETHVFISSTESAKVIVNKENEGGKFSKRYIKSIAELILCLPSFNSLIHSFLKLTPTRTCGSVVVIQDETLKIVKEALRKASVVQWLPRVALEDCEIEGFKIKKGWNINIDARSIHHDPTLQNDPDVFNPSRFPVESKLYSFLAFGMGGRTCLGKNMAKAMMLVFLHRFITNY

SEQ ID NO: 208835 - protein, 101 aa, Glycine max
  Coding DNA Sequence Number=SeqID_92057
MYEIELQSHFSRDCQTHPIPCKETKDINSKFQPDVDNDDPTHGEWLVVKRKSRKNGGAQNKKGNAQLEDQSLAKGKEDNIGTKFTWLLLGAPNKIAGAPSN

SEQ ID NO: 208836 - protein, 137 aa, Glycine max
  Coding DNA Sequence Number=SeqID_92058
  Gene Ontology: Mol. function=nucleic acid binding
  Homolog annotation: Hit_ID=Q1SKZ9; Match level="QueryCoverage=86%, HitCoverage=23%, E-value=2e-37, Identity=56%"; Hit description=Zinc finger, CCHC-type
MVYIEDSVFEGLCKPWQDALVVKLLDKHIGYNIMKDKLSRIWKLKVGFDMIDIGNDFFVVKLNLDEDRKKIIENGPWMIFDHYLIIQTWTLAFVSPSTMIDPTMVWIRFPGLNLYFYDENTTCETQFHTFPPLEFTK

SEQ ID NO: 208837 - protein, 167 aa, Glycine max
  Coding DNA Sequence Number=SeqID_92059
  Gene Ontology: Mol. function=protein serine/threonine kinase activity; Biological process=protein amino acid phosphorylation
  Homolog annotation: Hit_ID=Q2HT01; Match level="QueryCoverage=100%, HitCoverage=30%, E-value=2e-47, Identity=56%"; Hit description =Protein kinase
MGICHGKPIETQQSQRETNNPSEFPSDHPTPTKPPKASSKFPFYSPSPLPNWFKNSPSSNSNPSSVSSTPLRIFKRPFPPPSPAKHIRALLARRHGSVKPNEAAIPEGSECEVGLDKSFGFAKQFSAHYELSDEVGRGHFGYTCSAKGKKGAFKGVDVAVKVIPKAK

SEQ ID NO: 208838 - protein, 84 aa, Glycine max
  Coding DNA Sequence Number=SeqID_92060
MMGGTKGRTLERKSEGKERCLLSRSRKEKKTKLPFSAFSVSASLVNSFCVEIHFVTEREYSLYCFLSDNNGEWGSLWILPACTY

SEQ ID NO: 208839 - protein, 164 aa, Glycine max
  Coding DNA Sequence Number=SeqID_92061
  Gene Ontology: Mol. function=isomerase activity; Biological process =carbohydrate metabolic process
  Homolog annotation: Hit_ID=Q9LVC5; Match level="QueryCoverage=62%, HitCoverage=33%, E-value=3e-40, Identity=72%"; Hit description =Apospory-associated protein C
  Pfam annotation: Domain name=Aldose_epim; Domain location=1-164; Score=-83.4; E_value=0.036; Accession=PF01263.10; Description=Aldose 1-epimerase
MEYPYSFFETTVELQQLLVCTEASQSFSPPKAVRGGIPICFPQPSIRDNLLLTLDSEVRVEGLETLDYLDNLYQRERFTEQGDSLTFESEVDRVYFDSSNIVIVLDHEKKRTFVIRKEGLPDVVVWNPWERKSKSILDLGDEEYKQMLCVDGAAVEKPNHLVAR

SEQ ID NO: 208840 - protein, 589 aa, Glycine max
  Coding DNA Sequence Number=SeqID_92062
  Gene Ontology: Mol. function=protein kinase activity; Cellular component=integral to membrane; Biological process=protein amino acid phosphorylation
  Homolog annotation: Hit_ID=Q9SUQ3; Match level="QueryCoverage=93%, HitCoverage=92%, E-value=0.0, Identity=59%"; Hit description =Putative receptor kinase
  Pfam annotation: Domain name=LRRNT_2; Domain location=22-60; Score =43.5; E_value=7.2e-10; Accession=PF08263.3; Description=Leucine rich repeat N-terminal domain
  Pfam annotation: Domain name=LRR_1; Domain location=114-135; Score =13.2; E_value=0.94; Accession=PF00560.23; Description=Leucine Rich Repeat
  Pfam annotation: Domain name=LRR_1; Domain location=137-159; Score =17.1; E_value=0.063; Accession=PF00560.23; Description=Leucine Rich Repeat
  Pfam annotation: Domain name=LRR_1; Domain location=161-183; Score =15.9; E_value=0.15; Accession=PF00560.23; Description=Leucine Rich Repeat
  Pfam annotation: Domain name=LRR_1; Domain location=90-112; Score =13.8; E_value=0.63; Accession=PF00560.23; Description=Leucine Rich Repeat
  Pfam annotation: Domain name=Pkinase; Domain location=290-558; Score =70.0; E_value=7.7e-18; Accession=PF00069.15; Description=Protein kinase domain
  Pfam annotation: Domain name=Pkinase_Tyr; Domain location=289-558; Score=62.8; E_value=2.5e-16; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=22-60::114-135::137 -159::161-183::90-112::290-558::289-558
MELILCFVYLVSLMLFQAQANAISDKQALLDFVEKLAPSRSLNWNASSSPCTSWTGVTCNGDKSRVIAIHLPAFGFHGTIPPNTISRVTGLRTLSLRSNFINGHFPCDFSNLKNLSFLYLQFNNFTGPLPDFSAWRNLSVVNLSNNFFTGTIPLSLSNLTQLTSMNLSNNSLSGEIPLSLQRFPKSAFVGNNVSLQTSSPVAPFSKSAKHSETTVFCVIVAASLIGLAAFVAFIFLCWSRKKKNGDSFARKLQKGDMSPEKVVSRDLDANNKIVFFEGCSYAFDLEDLLRASAEVLGKGTFGAAYKAALEDATTVVVKRLKEVAVGKKDFEQLMEVVGNLKHENVVELKGYYYSKDEKLMVYDYYTQGSLSAFLHGKRGEDRVPLDWDTRMKIALGAARGLACIHCENGGKLVHGNIRSSNIFLNSKQYGCVSDLGLATIMSSVAIPISRAAGYRAPEVTDTRKATQPSDVYSFGVVLLELLTGKSPVYTTGADEIVHLVRWVHSVVREEWTAEVFDLELIRYPNIEEEMVEMLQIAMSCVVRLPDQRPKMLELVKMIESVRQIEIVVNQPSISSENQVESSTQIPLTT

SEQ ID NO: 208841 - protein, 116 aa, Glycine max
  Coding DNA Sequence Number=SeqID_92063
  Gene Ontology: Mol. function=pyruvate kinase activity; Biological process=glycolysis
  Homolog annotation: Hit_ID=Q1S8N3; Match level="QueryCoverage=48%, HitCoverage=10%, E-value=2e-17, Identity=75%"; Hit description =Pyruvate kinase
MQADGQVVLTPDRGQEASSQILPINFDGLAKSIKKGDTNFIGQYLLTGSETTSVLLEQLPVGDFVLKTSLVALDKVNRAGYKEAQFVIGILDVWNTRGQLEQTYYSNDYRIMYCRR

SEQ ID NO: 208842 - protein, 132 aa, Glycine max
  Coding DNA Sequence Number=SeqID_92064
MWNTLMKQSFAAPPGGPQVTGLLGWKWGQFAQQYDDFPLTIKVTEGSIAYRNPLLPPSSFLSQVIFRYDNFNQQLILPLECRELLVRSYASLTIDTYMLLRMFKGVEKFASWLSDFEKLFLPHLNHHFYHME

SEQ ID NO: 208843 - protein, 376 aa, Glycine max
  Coding DNA Sequence Number=SeqID_92065
  Homolog annotation: Hit_ID=Q6ZLE2; Match level="QueryCoverage=88%, HitCoverage=47%, E-value=2e-34, Identity=29%"; Hit description=F-box protein family-like
  Pfam annotation: Domain name=DUF295; Domain location=292-341; Score =10.2; E_value=0.046; Accession=PF03478.8; Description=Protein of unknown function (DUF295)
  Pfam annotation: Domain name=F-box; Domain location=34-81; Score =33.4; E_value=7.9e-07; Accession=PF00646.23; Description=F-box domain
  Pfam module annotation: Pfam domain module=DUF295::F-box; Domain location=292-341::34-81
MSGKRKRKLKLLSDAITDNRRTVAEVKSENLEMQSWADLPAELLESILSRLILADNIRASAVCRRWHSVASDVRVVNQSPWLMYFPKFGDCYEFYDPVQRKTHTFELPELNGSRVCYTKDGWLLLYRPRTHRVFFFNPFTRELIKLPRFEMTYQIVAFSCAPTSPGCVLFTVKHVSPTVVAISTCYPGATEWTTVNYQNRLPFVSSIWNKLVFCNGLFYCLSLTGWLGVFDPVECTWSVLAVPPPKCPENFFAKNWWKGKFMTEHEGDILVIYTCCSENPIIFKLDQTLMKWEEMTTLDGVTLFASFLSSHSRTDLIGIMRNSVYFSKVRFYGKRCISFSLDDYRYYPRKQCHDWGEQDPFENIWIEPPKDFSACM

SEQ ID NO: 208844 - protein, 286 aa, Glycine max
  Coding DNA Sequence Number=SeqID_92066
  Gene Ontology: Mol. function=galactosyltransferase activity; Cellular component=membrane; Biological process=protein amino acid glycosylation
  Homolog annotation: Hit_ID=Q8RW34; Match level="QueryCoverage=99%, HitCoverage=80%, E-value=2e-95, Identity=60%"; Hit description=Beta 1,3-glycosyltransferase-like protein I
  Pfam annotation: Domain name=Galactosyl_T; Domain location=128-283; Score=-40.3; E_value=0.00057; Accession=PF01762.12; Description =Galactosyltransferase
MRSRGSQNRLSGDSFGSRVSALMLAMIATMATVYVAGRLWQDAESRAYFIEELEKRTGQGQSAVSVDDTLKVTACREQQKKLSVLEMELAAARQEGFVPKRLPGNHGKHPTKKELLVVGVMTTFGRKKNQEAIRKAWMPTETLSELIDTLFVGTPMRKLVDKKGIIVRFVIGRSANRGDSLDKEIETESSLTNDFIILDNQVEAPEEKANKIKSFFIYAVSNWDAEFYAKVNDDVYVNLDALGGVLTSHLDKPRVYIGCMKSGQVFSEPTHKWHEPDWWKFGDGKS

SEQ ID NO: 208845 - protein, 94 aa, Glycine max
  Coding DNA Sequence Number=SeqID_92067
MGSPPVSSDISFPPADVDGELNPGHNVRVEVDPESSEIAATKKSKEHAEAKQKKRERKKKDALQTLKSAVIVSGIIVAVAGVAFAITKKLIREK

SEQ ID NO: 208846 - protein, 133 aa, Glycine max
  Coding DNA Sequence Number=SeqID_92068
  Gene Ontology: Mol. function=protein binding
  Homolog annotation: Hit_ID=O49527; Match level="QueryCoverage=69%, HitCoverage=12%, E-value=2e-15, Identity=47%"; Hit description =Pollen-specific protein - like
  Pfam annotation: Domain name=Rep_fac-A_3; Domain location=1-96; Score= 67.0; E_value=6.1e-17; Accession=PF08661.1; Description=Replication factor A protein 3
MDISNPAALVNAELLHFYVGSRVRVVMQVVRSDGVVIGKSTDEKQLVVKGSPPPAPHTTYVEVYGAEIWTNFGDAIDMDSYNKLCQLANGEFKHLFLSQGYPAKCCSDSILHQILAFHASHAAFTHAHATHLH

SEQ ID NO: 208847 - protein, 1021 aa, Glycine max
  Coding DNA Sequence Number=SeqID_92069
  Gene Ontology: Mol. function=microtubule motor activity; Cellular component=microtubule associated complex; Biological process =microtubule-based movement
  Homolog annotation: Hit_ID=Q2HTE3; Match level="QueryCoverage=99%, HitCoverage=100%, E-value=0.0, Identity=82%"; Hit description =Kinesin, motor region
  Pfam annotation: Domain name=DHC_N1; Domain location=166-691; Score= -258.9; E_value=0.027; Accession=PF08385.2; Description=Dynein heavy chain, N-terminal region
  Pfam annotation: Domain name=Kinesin; Domain location=15-357; Score =575.4; E_value=5.7e-170; Accession=PF00225.13; Description=Kinesin motor domain
  Pfam module annotation: Pfam domain module=DHC_N1::Kinesin; Domain location=166-691::15-357
MSSKEKGVNVQVLLRCRPFSDEELRSNAPQVVTCNEYNREVAVSQSIAGKHIDRVFTFDKVFGPSAQQRDLYDQAVTPIVNEVLEGFNCTIFAYGQTGTGKTYTMEGECKKAKSGPNGELPPGAGVIPRAVKQIFDTLESQNAEYSVKVTFLELYNEEITDLLAPEELLKASLEEKQKKQLPLMEDGKGGVLVRGLEEEIVTSASEIFTLLERGSSKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKHIKNKPEVNQKMMKSTLIKDLYGEIERLKAEVYATREKNGVYIPKERYYQEESEKKAMSDQIEQMGVTIETQQKQLEDLQNKYVDQIRQCSDLSNKLDSTEKNLNKTSKLLANTEEELKKCQYTLKEKDFIIAGQRKAENALAHQACVLRADLEKAHQDNASLFLKIGREDKLNSDNKAVVNNFQAELAQQVGSLCNTVATSLSEQNEHLEGVKKLCHSFLDVHDKAVVDLKRKVTSLRALYISHFEAVENVVRLHKAGSDANLEELSSVISSNGHSIEEFLASEATEAGSIFDNLQSTLSTQQGELALFARELRNRFNLSLEQIKDISDRSQEFVDKLFEESKKLEDYASQADQMQLKSIDEFKKAYEEQSKSDTEKLIANMTSLVSDHIRRQMDLVDAKLVDLRESGIKNKSFLDGHVSSVGDIVTNGKRKWQAFCEHAEKDAKDTADYSAAKHCRMEVLMQQSVNTAQSAFEHTKRTHEAIIEMGTKHISATEPIVSPSLHVEWGGSVVPIWNATDNNVQHVVEVDSARVAAEEDVAKNSEDLLEQLDVTSAQERESISGVLNVVRTHANTLETLREDHAGQATSIEHTTSETFQRQYRDYEPSGTTPIRCEPDVPTKGTIESLRSLPMEALLEEFRENNPYESNDVKELKPSLIPRSPLTQLN

SEQ ID NO: 208848 - protein, 154 aa, Glycine max
  Coding DNA Sequence Number=SeqID_92070
  Gene Ontology: Mol. function=DNA binding; Biological process=DNA integration
  Homolog annotation: Hit_ID=Q1S3I6; Match level="QueryCoverage=91%, HitCoverage=12%, E-value=1e-14, Identity=30%"; Hit description =Integrase, catalytic region
  Pfam annotation: Domain name=zf-CCHC; Domain location=108-125; Score =6.2; E_value=0.094; Accession=PF00098.13; Description=Zinc knuckle
MSISSYYSKLRSIWESISELKPAHSSTCNGICPWHNYAQMEYVMHFLMGLNESYGSIRVVQEEKQREIGAFVFAFNSTNDASQSHTFVVKDSKYQSDHKFNANSKNRPLCAHCGRLSHTQDKCFKLHGFPPNYKKNKPSSSNTDNNLDKDLILS

SEQ ID NO: 208849 - protein, 94 aa, Glycine max
  Coding DNA Sequence Number=SeqID_92071
  Gene Ontology: Mol. function=RNA binding; Cellular component =ribonucleoprotein complex; Biological process=mRNA metabolic process
  Homolog annotation: Hit_ID=Q2HTF4; Match level="QueryCoverage=98%, HitCoverage=98%, E-value=6e-34, Identity=80%"; Hit description=TonB box, N-terminal; Like-Sm ribonucleoprotein-related, core
  Pfam annotation: Domain name=LSM; Domain location=28-87; Score=66.8; E_value=7.1e-17; Accession=PF01423.12; Description=LSM domain
MSRSGQPPDLKKYMDKKLQIEWSGACLSLVVDSTVKLNANRMVVGTLRGFDQFMNLVVDNTVEVNGNEKNDIGMVVIRGNSVVTVEALEPVNRT

SEQ ID NO: 208850 - protein, 103 aa, Glycine max
  Coding DNA Sequence Number=SeqID_92072
MTSITHKETNLKSKTQDDESMIMTSTVPPVAGSSHNQPHIVILINTASTTLHWLRKPPHTAPPFAGSSSRNTTTVCWRRFPTMACGGWLRMKVEQIWTQSERS

SEQ ID NO: 208851 - protein, 323 aa, Glycine max
  Coding DNA Sequence Number=SeqID_92073
  Gene Ontology: Mol. function=GTPase activator activity; Cellular component=intracellular; Biological process=signal transduction
  Homolog annotation: Hit_ID=Q2HTG0; Match level="QueryCoverage=79%, HitCoverage=53%, E-value=1e-104, Identity=76%"; Hit description =RhoGAP; Wiscott-Aldrich syndrome, C-terminal
  Pfam annotation: Domain name=PBD; Domain location=94-140; Score=50.2; E_value=6.9e-12; Accession=PF00786.18; Description=P21-Rho-binding domain
  Pfam annotation: Domain name=RhoGAP; Domain location=157-297; Score =119.8; E_value=7.9e-33; Accession=PF00620.17; Description=RhoGAP domain
  Pfam module annotation: Pfam domain module=PBD::RhoGAP; Domain location=94-140::157-297
MTEVLQLPSSSSCSRRPCGSLTPNDGSHPISLINAPPTVEDQRVEIEEEEEKERERERDQLSILTLLIATFRKSLIGCSTTTTSSSSSSSSSMEIGWPSNVRHVAHVTFDRFHGFLGLPVEFEPEVPRRPPSASANVFGVSTESMQLSFDARGNSVPTILLLMQRHLYAQGGLQAEGIFRINAENGQEEFVREQLNRGVVPDGIDVHCLAGLIKAWFRELPTGVLDPLLPEQVMQSQSEEECAQLVRLLPPTEAALLDWAINLMADVAQMENLNKMNARNIAMVFAPNMTQYTVLLLAPIFVIEFIPVKLILLDITSMSETTF

SEQ ID NO: 208852 - protein, 319 aa, Glycine max
  Coding DNA Sequence Number=SeqID_92074
  Gene Ontology: Mol. function=nucleic acid binding; Cellular component= oxygen evolving complex; Biological process=DNA integration
MTVEIKALESNNTWTLVPLPAEKQCIGCRWVYKASINFSDTFSPVAKLTSIRVLLAVVATKNWSILQLDLDNAFLNGDLFEEVYMELPKGYNSVDKTLVCRLKKSLYGLRQAFRQWFCKFSTTLIGNGFSQLKNDYYLFTIDKGASLVILLVYVDDILLAGLSVACVHSIQAKLQALFKLKIHGPLKYFLGLEIANSSKGIVLTQQKYAFSLLEDTGFLGCKPSSLPMDPNLKLNMLNGELLTDPSMYRRLLGRLMYLTISRPDITFVVNKLSQYIQNPRTPHLDVVHHLLQYIKGTLGQGLHFQPNNYFNLSAYADAN

SEQ ID NO: 208853 - protein, 110 aa, Glycine max
  Coding DNA Sequence Number=SeqID_92075
  Gene Ontology: Mol. function=nucleic acid binding; Biological process= DNA integration
MGAMDDSNHFLIQPSDSPELSLVTHPLSGENYNSWKKAVKMTLLGKNKFGFVDGSILEPPLEQSSHALWQRNDSIVASWLLNSLTKKIQISILHCSTAQAIWNDLKERFK

SEQ ID NO: 208854 - protein, 199 aa, Glycine max
  Coding DNA Sequence Number=SeqID_92076
  Gene Ontology: Mol. function=two-component response regulator activity; Cellular component=intracellular; Biological process=two -component signal transduction system (phosphorelay)
  Homolog annotation: Hit_ID=Q2KYU1; Match level="QueryCoverage=99%, HitCoverage=42%, E-value=1e-77, Identity=71%"; Hit description=Two component response regulator for C4-dicarboxylate transport
MGLEAFHLFRQGAWRGFRGWRDCGRRVEHAQHEALGEVGEFPHVAGPVVRQQVTLDVGRHIGNVALEAARGVTQIMGQQQRNVLAAFAQRRDTDGDDVEPVEEIFTKFGADRGIAQVFLGGGDDTQIQVADFVAAQRRDLAGFQYPQQLDLHGERHAFDFVQEQRAAAGMLDTPDAALLCAGEGAGLMAEQLTFDHAFG

SEQ ID NO: 208855 - protein, 211 aa, Glycine max
  Coding DNA Sequence Number=SeqID_92077
  Gene Ontology: Mol. function=two-component response regulator activity; Cellular component=intracellular; Biological process=two -component signal transduction system (phosphorelay)
  Homolog annotation: Hit_ID=Q2KYU1; Match level="QueryCoverage=87%, HitCoverage=39%, E-value=9e-66, Identity=69%"; Hit description=Two component response regulator for C4-dicarboxylate transport
MQGGGDHFLARAGLALHQDIDVRIGDVAQGLLDALHGRCGADKGHFIGFDGERRFAQAAVFKHQVALFGGVGDGGDEAVGRIGLGQEIIGAVAHALHRHGDIAMAGNEDDGNFRIDGAQALEQLQAVDIGHADVGDHHAIEITIQGGKRAARAGVGLHVDTAQLECLHVGAAQFVVVIDESHQGRRPVAGSRFEHCGHGRLGLGVFLVSGV

SEQ ID NO: 208856 - protein, 805 aa, Glycine max
  Coding DNA Sequence Number=SeqID_92078
  Gene Ontology: Mol. function=solute:hydrogen antiporter activity; Cellular component=integral to membrane; Biological process =regulation of pH
  Homolog annotation: Hit_ID=Q1SKA0; Match level="QueryCoverage=99%, HitCoverage=100%, E-value=0.0, Identity=75%"; Hit description=Na+/H+ antiporter-like protein
  Pfam annotation: Domain name=MFS_1; Domain location=35-431; Score= -51.0; E_value=0.068; Accession=PF07690.6; Description=Major Facilitator Superfamily
  Pfam annotation: Domain name=Na_H_Exchanger; Domain location=40-427; Score=298.0; E_value=1.7e-86; Accession=PF00999.11; Description =Sodiumhydrogen exchanger family
  Pfam module annotation: Pfam domain module=MFS_1::Na_H_Exchanger; Domain location=35-431::40-427
MASNATSGNACPQPMKATSNGAFQGDNPLDFALPLAILQICLVLVVSRGLAYLLKPLRQPRVIAEIIGGIILGPSVLGRNKSYMQKVFPPRSLPVLDTLANIGLIFFLFLAGLELDLKSLRQSGNRVLAIAMAGISLPFVIGIGTSFVLKQTIAKGSDNAAFLVFMGVALSITAFPVLARILAELKLLTTNVGKTAMSAAAINDIAAWILLALAVALSGHDRSPLVSLWVFLAGCGFVICAILIVPPIFKWMSQRCHEGEPVEEVYICATLAAVLAAGFVTDAIGIHAMFGAFVVGILVPNDGPFASALVEKVEDLVSGLFLPLYFVSSGLKTNVATIKGAQSWGLLAFVIFTASFGKILGTLFVSLFCKVPFNEALVLGFLMNCKGLVELIVLNIGKDRKVLNDQTFAIMVLMAVFTTFITTPLVTAVYKPARKGKITNYKYRTIGRKNANSQLRILACFHGARNIPSMINLIEASRGIQKRDALCVYAMHLKEFSERSSSMLMVHKARRNGLPFWNKGHHADSNHVIVAFEAYRQLSQVSIRPMIAISSMNNIHEDICATAERKGAAVIILPFHKHQRLDGSLNITRNDFRWVNKRVLEHAPCSVGIFVDRGLGGTSHVSASNVSYRVTVLFFGGGDDHEALAYGARMAEHPGIRLLVIRFVGEPMNGEIVRVDVGDSTSTKLISQDEEFLDEIKTKIANDDSIIYEEKVVKDGAETVAIIRELKSCNLFLVGSRPASEVASAMKRSECPELGPVGGLLASQDYPTTASVLVMQQFQNGAPINFTISDSEMEEHVPDRDSESA

SEQ ID NO: 208857 - protein, 109 aa, Glycine max
  Coding DNA Sequence Number=SeqID_92079
  Gene Ontology: Biological process=response to biotic stimulus
  Homolog annotation: Hit_ID=Q27J94; Match level="QueryCoverage=83%, HitCoverage=54%, E-value=6e-21, Identity=60%"; Hit description =Dirigent protein pDIR18
MVTTQRMQLRPLWVHPHGPIEQSWLGRTILVTRPKLDALRDFTCTTRKTFSNCLAWFFLGVQFHHAQGDISVIGGTGDFFMARGVATLSTDAFSWHGAYPRQEQRKEVP

SEQ ID NO: 208858 - protein, 669 aa, Glycine max
  Coding DNA Sequence Number=SeqID_92080
  Homolog annotation: Hit_ID=Q9BMQ6; Match level="QueryCoverage=58%, HitCoverage=61%, E-value=8e-07, Identity=23%"; Hit description =Paramyosin
MKSEEGEAEKEEKLGEKLRRGVLVGKSRGPFTPVPSWSWAHNNHSSSVLSLSARKLAAALWEFNHSFPLFQMHHHRSANNAAACGGVGADPRLRRHHHYILHKHRAPDISNFLADASPSSPDQPASASSLRRHVAAPLMQHHRAIERNNHALQPLSPASYGSSMEMTPYNPGATPTSSLEFKGRIGEPHYSLKTSTELLKVLNRIWSLEEQHASNISLIKALKSELDHARIRIKELLRDRQAGRHEIDDLMKQIAEDKLVRKRKEQDQLHAAIQSVRDELEDERKLRKRSESIHRKLARDLSEVKSSLTSAIKELNQERTRRKLLEDLCDEFARGINEYEQEVHTVKHKSDKEWVQGADHDRLILHISELWLDERMQMQLEAVHNGFMDKSIVDKLSLEIETFLKAKQNSRSTENIAVRNCRNSLESVPLNDAVSAPQEVGDDDDSVGSDSNCFELNKPSNKGSKVHEEEPVGKIFEETSKTNQPKKKPIPREGLKHRSPCSLQVEFEEQIAWAMSSDSHKKSQSIDADQGKTTDTRPVEGIVSEKSEHFEIYENDDSERKNIPTELHSSSKNHIIDNLLRGQLLASEGGNMHAENNYGEASCSNAGWRNQASPVKQWMAKLASQDLDISEASKVPSGSKESNNTLKAKLLEARSKGQRSRLKALKGSF

SEQ ID NO: 208859 - protein, 72 aa, Glycine max
  Coding DNA Sequence Number=SeqID_92081
  Subcellular localization annotation: CTP_CleavageSite=28; ConfidenceScore=5.03e-01
MSCQRTASAHPLSERNTLSQKSLTYAKRTSTNKATYLSLKSDLQGVLEFFLKKPLYARESGPGLKLLHVRKF

SEQ ID NO: 208860 - protein, 56 aa, Glycine max
  Coding DNA Sequence Number=SeqID_92082
MAEDDKIADVSMGWALEVGSKLEIKGVFFWSSSAIIRAASTYSLVLGKFYVESIII

SEQ ID NO: 208861 - protein, 169 aa, Glycine max
  Coding DNA Sequence Number=SeqID_92083
  Homolog annotation: Hit_ID=Q5N8H1; Match level="QueryCoverage=62%, HitCoverage=24%, E-value=6e-08, Identity=34%"; Hit description =Hydrolase-like protein
MAVSLRCRNSSSHLLLTRFLHSVSLPRRRWLQTVAYEELRAHPDKPYTSTAVFIHGFLGSSRNWRSFSRNLLASLSNSSPSSNWRTVMLDLRNHGQSTERELNPPHNMENAAKDLADLVKAEGWSWPEVVVGHSMGGKVALQFAESCSRGDYGHFASLPKQVSLLYCNG

SEQ ID NO: 208862 - protein, 60 aa, Glycine max
  Coding DNA Sequence Number=SeqID_92084
MAWSEELKSHLLNLKRAKAQLAYRDTNSSDLDREGDLKGSADIFQKTTDLTTLSETKEEG

SEQ ID NO: 208863 - protein, 99 aa, Glycine max
  Coding DNA Sequence Number=SeqID_92085
  Homolog annotation: Hit_ID=Q75HC2; Match level="QueryCoverage=70%, HitCoverage=6%, E-value=4e-18, Identity=65%"; Hit description =Putative piwi domain containing protein
MSPKLEPDPKESGGAGLIDPCIFVFGWKHWLTTPTLVSAIHFKSAYPLCFLSIIQIRSWRLFEAILRILLSDDSKKVTLSRIWIDSNWGLIDVFLLKMK

SEQ ID NO: 208864 - protein, 144 aa, Glycine max
  Coding DNA Sequence Number=SeqID_92086
MGEVKEVQEQIKADMETMKEKMDIMMEANISMKEIMEVNAAALLRASSSWYTLANTLEGPHFRPQPQPLHFAVGRAPPAMAENGKLDQIEERLKVIEGSGDYAFANLEELFLVPDIITPPKFKVPDFDKYKGTTCPKNHLKMYC

SEQ ID NO: 208865 - protein, 160 aa, Glycine max
  Coding DNA Sequence Number=SeqID_92087
MEKTVKVGEDDPSYSKWVIEDAVAQGWLSKTMEPHLIGARNYAWKEGFCSRIIHAMVSKTASGMRPRSLRDLDEAKKDKIRCSHCNATRHKRETCFELHGYPEWFLEKRRQMRAKGKRSGPAKLIDYVAGIAAVATSQGSSVNSSKVQDTNLLFFSTRLM

SEQ ID NO: 208866 - protein, 222 aa, Glycine max
  Coding DNA Sequence Number=SeqID_92088
MESSNVKNKSSGKRKMSSEDTRSYFEWNLEMERVLADVLRDQRNLGNKGDGNWKAVAYSTTAQILSKRFGVHLMADNVKNHFKLWRTWYGISHEEAKRFRFKVIPNWDDIVDLCAKDRAIGLGAENALDADDIMSKETNEEEAIHSVSFDLEGSSSATRKNIRPSKSGEKEGMISSMKEVDESLKKFVEVTKKKMENKKKMEIKEAQEVVHEDYKSSLSLRL

SEQ ID NO: 208867 - protein, 238 aa, Glycine max
  Coding DNA Sequence Number=SeqID_92089
  Gene Ontology: Mol. function=transcription factor activity; Cellular component=intracellular; Biological process=regulation of transcription, DNA-dependent
  Homolog annotation: Hit_ID=Q8UCX8; Match level="QueryCoverage=65%, HitCoverage=94%, E-value=2e-73, Identity=89%"; Hit description =Transcriptional regulator, MarR family
  Pfam annotation: Domain name=MarR; Domain location=132-201; Score =65.1; E_value=2.3e-16; Accession=PF01047.13; Description=MarR family
  Pfam annotation: Domain name=TrmB; Domain location=127-195; Score= -0.9; E_value=0.005; Accession=PF01978.9; Description=Sugar-specific transcriptional regulat
  Pfam module annotation: Pfam domain module=MarR::TrmB; Domain location=132-201::127-195
  Subcellular localization annotation: CTP_CleavageSite=17; ConfidenceScore=5.24e-01
ATLESRAAVGSYPSFLSASMTKNPRFAKPCQFSRPQGEEGRKWGRAVACHGSRMQFQHVHPSWTGVPVCLPDKGCHAVPAPQNWRVESGSAQTTHLTAIDYGLLTTAISYHLRHSQLAVANGFSDVLAEQGLRPADFSVLVIVGGNPGLKQSDVAEALGIQRANFVAIVDSMEEKGLLVRRRSEEDRRVHFLDMTAEGSRLLERLSDVWRDREEKLIDRIGGKKARDQLLALLGRLRD

SEQ ID NO: 208868 - protein, 347 aa, Glycine max
  Coding DNA Sequence Number=SeqID_92090
  Gene Ontology: Mol. function=carboxyl- and carbamoyltransferase activity; Cellular component=ornithine carbamoyltransferase complex; Biological process=amino acid metabolic process
  Homolog annotation: Hit_ID=Q9SEX4; Match level="QueryCoverage=85%, HitCoverage=83%, E-value=1e-149, Identity=87%"; Hit description =Ornithine carbamoyltransferase OOCT1
  Pfam annotation: Domain name=OTCace; Domain location=202-325; Score =51.8; E_value=2.3e-12; Accession=PF00185.14; Description =Aspartateornithine carbamoyltransferase, AspOrn binding domain
  Pfam annotation: Domain name=OTCace_N; Domain location=56-198; Score =188.6; E_value=1.5e-53; Accession=PF02729.11; Description =Aspartateornithine carbamoyltransferase, carbamoyl-P binding domain
  Pfam module annotation: Pfam domain module=OTCace::OTCace_N; Domain location=202-325::56-198
  Subcellular localization annotation: CTP_CleavageSite=44; ConfidenceScore=5.39e-01
MAVIPCHCYRSVGSDKPYLSGQSLRRCAPSPAVSVSFRRRISCVASSAVAQKVGLKDFLHLDDFDKDTILKMLDRALEVKALLKSGDRSFRPFEGKTMAMIFTKPSMRTRVSFETGFTLLGGHAIYLGPDDIQMGKREETRDIARVLSRYNDIIMARVFAHKDILDLAKYATVPVINGLTDYNHPCQIMADALTMVEHIGRFEGTKVVYIGDGNNIVHSWLLMASVIPFHFVCACPKGFEPDAKTVEKARKAGISKIEITNDPKEAVKGADVVYSDVWASMGQKEEAEYRRQVFKGFQNRLVAQLALAEVIKDVLFRDYMGIDSLYNYVVRIGLDVNRLEVYQFYHK

SEQ ID NO: 208869 - protein, 173 aa, Glycine max
  Coding DNA Sequence Number=SeqID_92091
MAFIFRNGTVIHNECGVYFQSSSLVPMRVPNLCDFSTLKSRIHSSVRLNNNEVVDEIHYWRPMEDTANNIYFERCSIDQLKDLIKQVAPKGNPPHGIHESQVVRRLFYRQPSHLEYYEKVLEFKIVELKCDNDVLKVLVESNYWKQFVPIEILALFSKLVMENEDDVVTSLRD

SEQ ID NO: 208870 - protein, 165 aa, Glycine max
  Coding DNA Sequence Number=SeqID_92092
GKVYGKLGFWLKACRTAGHDICQSVGLASGSGIKGMYFAIYMRVQGILIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 208871 - protein, 59 aa, Glycine max
  Coding DNA Sequence Number=SeqID_92093
MSSTLRGGELGETNLDGKNATTTANRKWQQEGAIVGKKKEQKKKRSKAEWSSGSSLRFF

SEQ ID NO: 208872 - protein, 85 aa, Glycine max
  Coding DNA Sequence Number=SeqID_92094
  Gene Ontology: Mol. function=transcriptional repressor activity; Biological process=regulation of nitrogen utilization
  Homolog annotation: Hit_ID=O81355; Match level="QueryCoverage=51%, HitCoverage=14%, E-value=2e-12, Identity=77%"; Hit description =Isoflavone reductase related protein
MGLAIRHWVFVKGDHTNFEIEPSFGIEASALYPDVKYTTVKNTLTRSFENLESKDSHDEVGNGSGAGAEASSSSDLASGDAVFML

SEQ ID NO: 208873 - protein, 74 aa, Glycine max
  Coding DNA Sequence Number=SeqID_92095
MGAITGIPFILGPVQIEELEYILREIKSKSQHAIKINMTFSAVDLSRLLVGVEICGTQLGGMEVIQVLRYFHWW

SEQ ID NO: 208874 - protein, 88 aa, Glycine max
  Coding DNA Sequence Number=SeqID_92096
  Subcellular localization annotation: CTP_CleavageSite=52; ConfidenceScore=5.17e-01
MGKTRRTWNDFFQKNLFRKLPERTTSSVTSRRSCSGNFPEEPLPEELIPDVSLEEVVLPEMTEDVPDMTEDVPHMAEDAPEMTADVQN

SEQ ID NO: 208875 - protein, 97 aa, Glycine max
  Coding DNA Sequence Number=SeqID_92097
  Gene Ontology: Mol. function=acyltransferase activity; Cellular component=mitochondrial membrane; Biological process=photorespiration
  Homolog annotation: Hit_ID=Q2QX46; Match level="QueryCoverage=95%, HitCoverage=36%, E-value=2e-33, Identity=73%"; Hit description =Expressed protein
MSNILSSKVWAGNPAKFLRKLADEQKAFISQSATNYTNLAQVHAAENSKPFDEIDFEKVLRKKFARIDEEYDSMLGVVREIPPELILPDKAEKALQK

SEQ ID NO: 208876 - protein, 121 aa, Glycine max
  Coding DNA Sequence Number=SeqID_92098
  Gene Ontology: Mol. function=transcriptional repressor activity; Biological process=regulation of nitrogen utilization
  Homolog annotation: Hit_ID=Q9SDZ7; Match level="QueryCoverage=86%, HitCoverage=34%, E-value=4e-42, Identity=81%"; Hit description =Isoflavone reductase-like NAD(P)H-dependent oxidoreductase
  Pfam annotation: Domain name=DapB_N; Domain location=5-113; Score= -25.7; E_value=0.0054; Accession=PF01113.11; Description =Dihydrodipicolinate reductase, N-terminus
  Pfam annotation: Domain name=NmrA; Domain location=7-121; Score=-5.2; E_value=8.2e-08; Accession=PF05368.3; Description=NmrA-like family
  Pfam annotation: Domain name=TrkA_N; Domain location=7-117; Score= -8.5; E_value=0.067; Accession=PF02254.8; Description=TrkA-N domain
  Pfam module annotation: Pfam domain module=DapB_N::NmrA::TrkA_N; Domain location=5-113::7-121::7-117
MGEKSKILIIGGTGYIGKHIVEASAKAGNPTFALVRESTLSDPSKAQLIHNFEALGVNLVRGDLYDHEKLVKAIKQVDVVISTLGHLQLADQLKIIAAIKEAGNVKVVPSPNFILYDLFVL

SEQ ID NO: 208877 - protein, 421 aa, Glycine max
  Coding DNA Sequence Number=SeqID_92099
MVQKKDEELRGSNNGPISGYRRWLKAYMQGLDWLLSLRTTKGVEVEAPEEDEEVQALRVELEKAQTIKEKFKSAALKIRKENAELRDVNIATTKALEQDTKRALREEYGRNKFRGALWGSNSELKLRRDERDQSRVDSLILKDELRICLRSKRSLSQRLCETETNMLAIISKYQEELNLATAHEHKVADKYARVYAEKEARGRAKAMADTYSAPKEIHGLLGYCQHMMGDQEETHEQMKADMSALKEQMASIMEAMLAMRQLMEKNMATAAAVSSAAEVDPTLLATAHHPPPNAVGREGSTLGHNSNPHLGYNRVAYPYGLPPNYTPPVMHDDAGHVSSPILEGEPPRQPDEVHEDHREYAQGDVDFYPLILVEGPTPNTLPQHNLTAQPIFLSTEGPPPVVEERWKLDLIEERLRAVEGF

SEQ ID NO: 208878 - protein, 93 aa, Glycine max
  Coding DNA Sequence Number=SeqID_92100
MEGSAEIADLDESMNDHYEICYSQDYVSTKKDILFLSNSNCRSDNQHCKWNNDIEAQIWHLEMDLTAEQSWSIDLRERIENLIMKWPWREEDP

SEQ ID NO: 208879 - protein, 210 aa, Glycine max
  Coding DNA Sequence Number=SeqID_92101
  Pfam annotation: Domain name=PT; Domain location=117-153; Score=12.8; E_value=0.025; Accession=PF04886.3; Description=PT repeat
MAKISFVLVFAFVLLALPLCSVLGQEDWKDLLDQGGFSQDSLKKAQMAFGAASAQAAVNDYFGGDDSPQEADDGEASSLADFLDADEITNNNPIDSPVGAPEDLPVDDIDDPDDSFSPAGAPLNSPNEAPSNAPVVAPASGAPIEAPELAPTTNAPGQAPTDEEDEEDELTPTNAPTEEPDDEDEFDDSPSEPPTETPEAEPADESDDES

SEQ ID NO: 208880 - protein, 270 aa, Glycine max
  Coding DNA Sequence Number=SeqID_92102
  Subcellular localization annotation: CTP_CleavageSite=21; ConfidenceScore=5.31e-01
MLRKKQQCGFRIPWISGPSTTESHSPPPKQKSKSLSTHRPPFRPHGIASTPQQPPPLPPNGTSKTKPQQVSNSLPSHSPAPSVIIDSPVSFQPESPSTPTEPNVKELELDSTPTQNSNGNNMERKMMFATSTPSGKDIKVVPPASASATISLSTNDDISALNPTLNVDDKTVSVVTLAGDNRGVTMHVAGSHSTRPKPEGKKSASTEKDEAGKTYVNSNIQSINNSIMSNGSINGRDPGVRVILPQQPCLEKPKAEVSINRAEMVPYRPV

SEQ ID NO: 208881 - protein, 281 aa, Glycine max
  Coding DNA Sequence Number=SeqID_92103
  Gene Ontology: Mol. function=catalytic activity; Biological process =metabolic process
  Homolog annotation: Hit_ID=Q1EPL2; Match level="QueryCoverage=97%, HitCoverage=44%, E-value=2e-57, Identity=46%"; Hit description=AMP -dependent synthetase and ligase family protein, 5' partial
PSSISPSYGLAENCTFVSTAWRSVNSDHNDSVGAYYSSSFPDFPTHNKLLPVARLENVEEEDVEIMVVDEETLEPAEDGVEGEIWVASPSNASGYLGHPSLTREVFHGRLRNMISKCFLRTGDRGIVKGEKRYLFVTGRCQDVMELRNGRKVHPHYIETAAYNSCPKLLRGGCLAAFKVSSTVVVVAEMQRIEKGIEKGVLKRICEGVKEAVWKKEKVEVGWVVLVESECVPKTTSGKLIRGKAKEKLLAGEMVILMKMRFGKDVTVFKRAKKGGVIPEKC

SEQ ID NO: 208882 - protein, 102 aa, Glycine max
  Coding DNA Sequence Number=SeqID_92104
  Gene Ontology: Mol. function=DNA binding; Cellular component=nucleus; Biological process=regulation of transcription
  Homolog annotation: Hit_ID=Q0NZY5; Match level="QueryCoverage=73%, HitCoverage=88%, E-value=3e-16, Identity=43%"; Hit description=Myb -like protein RL3
  Pfam annotation: Domain name=Myb_DNA-binding; Domain location=1-49; Score=17.9; E_value=0.036; Accession=PF00249.21; Description=Myb -like DNA-binding domain
MGWTREENRRFEDALAVHGPDDPNRWQHVANAVGGKSVQEVKMHYEILQEDVIRIERDQIPLPSYRGNERQIHNEQSFRAFTMMTTSCPPIYMLFLITLQSN

SEQ ID NO: 208883 - protein, 456 aa, Glycine max
  Coding DNA Sequence Number=SeqID_92105
  Gene Ontology: Mol. function=hydrolase activity, acting on glycosyl bonds; Cellular component=intracellular; Biological process=base -excision repair
  Homolog annotation: Hit_ID=Q9FRL4; Match level="QueryCoverage=70%, HitCoverage=76%, E-value=1e-115, Identity=64%"; Hit description=3 -methyladenine DNA glycosylase, putative; 31680-30045
  Pfam annotation: Domain name=HhH-GPD; Domain location=191-336; Score =85.5; E_value=1.7e-22; Accession=PF00730.15; Description=HhH-GPD superfamily base excision DNA repair protein
MAKDVANPSNLSRKKSFVRLDLSPPSGGFGGEGFWMSSEEDERKALEQSEASSESESHMGEQTLGQAQPLPAPDAATAHSELNNVPQPTTSPATKIPLRPRKIRKVSPDPSTSEAPIKPAKPVGRNTTSKAAPPRALTVVPRIVARSLSCDGEVEISLRYLRNADPLLSPLIDIHQPPTFDNFHTPFLALTRSILYQQLAFKAGTSIYTRFIGLCGGENGVVPETVLALTPQQLRQIGVSGRKASYLHDLARKYQNGILSDSAIVNMDDKSLFTMLTMVNGIGSWSVHMFMIFSLHRPDVLPINDLGVRKGVQLLYNLEDLPRPSQMDQLCDKWRPYRSVASWYMWRFVEAKGTPSSAVTVATGAGLQQQRHHQHQQQEQQQQQHAPQPQLLDPINSMFNLGGSSLCEGMGEGCCTQPYPYICKEAVSGFEPMTNKSPRHNFTAAPGLALIKKGIL

SEQ ID NO: 208884 - protein, 109 aa, Glycine max
  Coding DNA Sequence Number=SeqID_92106
MDARIANESRGKLVIVCVEIDLERADVGKIWFKNHWFYVEYKGLQTLHLLYKKHNNDNRSGHSHGVDGLGKMHEQYQHETLVENKGRLLVVMHKENQSKSCFEAAILEG

SEQ ID NO: 208885 - protein, 257 aa, Glycine max
  Coding DNA Sequence Number=SeqID_92107
  Gene Ontology: Mol. function=catalytic activity; Cellular component =integral to membrane; Biological process=metabolic process
  Homolog annotation: Hit_ID=Q5VNP6; Match level="QueryCoverage=97%, HitCoverage=41%, E-value=5e-70, Identity=53%"; Hit description=Acyl -CoA ligase-like
MPYKYENYDPSFPDQPVVDLYLPVWARLPAFKSKPAFIWAQDLHTFTALTYQQLNATVDVISSRLLAPLQRGDTVLLLCSPGLDLVELIFACQRAGLLSVPIIPPHPSFAKENYHHLIRAISQTKPKAALAHPHYISSIRQYVSSPHNNKKLAHMLHSIHWISVDELKHHHGVVTLNNLDSLTYSGCKANEVYLVQYTSGATGVPKPVLVTAGSAAHNVRTARKAYDLHPNSTIVSWLPQYHDCGLMFLLLTLVSGA

SEQ ID NO: 208886 - protein, 90 aa, Glycine max
  Coding DNA Sequence Number=SeqID_92108
MRMRRHSMFPFACMPGIVGCGSFSGVKSCEREDPFHPGLFVGDAGGFQSPTREPLNVGGLVPPHCSLKSVVSDDACPGACFVQRDATTLS

SEQ ID NO: 208887 - protein, 54 aa, Glycine max
  Coding DNA Sequence Number=SeqID_92109
MSQNFTDYATIPSLTSGMLRDFTDYAIMLAFDSRHVVELHGLPNDGCQEFRPIV

SEQ ID NO: 208888 - protein, 64 aa, Glycine max
  Coding DNA Sequence Number=SeqID_92110
MKKQCLTCLAFWFLQAYTNELELEVEHLKEENARLKRQQQQLYEAAVSEQKKKGTLCRASTAPF

SEQ ID NO: 208889 - protein, 136 aa, Glycine max
  Coding DNA Sequence Number=SeqID_92111
MEEVWKDINLATLNEQSTISTRPNVEGVMFQDFLARPFTTIDPPNTTLLSSASSETAANSLFSPASPGPPLVTLSLSSLPHHHHFRFEHPSSIPPPPSNKRFAQPADHCSTIGDRRNKRMIKNRESAARSRARKQE

SEQ ID NO: 208890 - protein, 120 aa, Glycine max
  Coding DNA Sequence Number=SeqID_92112
MENCYQKNGFPSNFSSNREGGGSQGSFGRGTTSGRGNKVCTHYGITSHTVEECYKKIGYPPDHKFYRPQGNSINNAVANTRSSVDNGNVTTRTITKHDSVAWILDFGATDHVASSLSLHS

SEQ ID NO: 208891 - protein, 237 aa, Glycine max
  Coding DNA Sequence Number=SeqID_92113
  Gene Ontology: Mol. function=nucleic acid binding; Cellular component= intracellular; Biological process=DNA integration
MVMNEEMQSLQKNQTWDLVEPPNDRRVVGCKWIFKKKFGLSTEEVAHYKARLVAKGYSQKEEQLYVKIAFLHGRLLEDIMMQQPKGFDVEGGWFPYLSATLCGQHAHNISKFVGNSKVEVTTQLESKKEYMPHVPCVGVEDFDGTRSMTGYTFTIGNSLQLKDNTLAHNVLVHYREKVIIFYGSMSTICLDKDQVHLEKTEHIDIKYHLICSEKWVKVKKVDTRENPTDMFTKAVPR

SEQ ID NO: 208892 - protein, 579 aa, Glycine max
  Coding DNA Sequence Number=SeqID_92114
  Gene Ontology: Mol. function=methyltransferase activity; Cellular component=intracellular; Biological process=protein kinase C activation
  Homolog annotation: Hit_ID=Q1T411; Match level="QueryCoverage=98%, HitCoverage=97%, E-value=0.0, Identity=68%"; Hit description =Pentatricopeptide repeat
  Pfam annotation: Domain name=PPR; Domain location=105-139; Score =13.3; E_value=0.2; Accession=PF01535.11; Description=PPR repeat
  Pfam annotation: Domain name=PPR; Domain location=175-209; Score=2.6; E_value=3.6; Accession=PF01535.11; Description=PPR repeat
  Pfam annotation: Domain name=PPR; Domain location=237-271; Score =37.4; E_value=4.9e-08; Accession=PF01535.11; Description=PPR repeat
  Pfam annotation: Domain name=PPR; Domain location=272-306; Score=8.3; E_value=0.77; Accession=PF01535.11; Description=PPR repeat
  Pfam annotation: Domain name=PPR; Domain location=338-371; Score =24.8; E_value=0.0003; Accession=PF01535.11; Description=PPR repeat
  Pfam annotation: Domain name=PPR; Domain location=386-420; Score=6.7; E_value=1.2; Accession=PF01535.11; Description=PPR repeat
  Pfam annotation: Domain name=PPR; Domain location=422-456; Score=5.9; E_value=1.5; Accession=PF01535.11; Description=PPR repeat
  Pfam module annotation: Pfam domain module=PPR::PPR::PPR::PPR::PPR::PP R::PPR; Domain location=105-139::175-209::237-271::272-306::338 -371::386-420::422-456
  Subcellular localization annotation: CTP_CleavageSite=35; ConfidenceScore=5.05e-01
MARVSKLQRLPIQNTFLTRPIAITTNTSPPEGKRRLSSLFSHFEALLQNSCQNARHLLQIQALLVTSSLFRNPYLARTILSRASHLCDVAYTRVIFRSINSLDTFCVNIVIQAYSNSHAPREAIVFYFRSLMRGFFPNSYTFVPLVASCAKMGCIGSGKECHAQATKNGVDSVLPVQNSLIHMYVCCGGVQLARVLFDGMLSRDLVSWNSIINGHMMVGELNAAHRLFDKMPERNLVTWNVMISGYLKGRNPGYAMKLFREMGRLGLRGNARTMVCVATACGRSGRLKEAKSVHGSIVRMSLRSSLILDTALIGMYCKCRKVEVAQIVFERMRERNLVSWNMMILGHCIRGSPEDGLDLFEVMISMGKMKHGVESDETLRLLPNEVTFIGVLCACARAEMLDEGRSYFKQMTDVFGVKPNYAHFWCMANLLASVKLVGEAEEFLRSMAEFDGDMSCESLVWASLLGLCHFKRDVYLGERIAKLLVDMDPKNLTCYQFLLIIYAVSAQWENVSEVQKLVKERRLEIIPGSSLVDLKNIVHNFKVTNKGQEGIEAVNLMMDELAHRFSLPSSDLGQKQSTS

SEQ ID NO: 208893 - protein, 128 aa, Glycine max
  Coding DNA Sequence Number=SeqID_92115
  Gene Ontology: Mol. function=DNA binding; Cellular component=oxygen evolving complex; Biological process=DNA integration
  Homolog annotation: Hit_ID=Q1SKN1; Match level="QueryCoverage=78%, HitCoverage=9%, E-value=6e-12, Identity=42%"; Hit description =Integrase, catalytic region
MYVRIYSNFKSKKILQITKILDFENIIKQLCNWEISVKSMPVRTTSSAYTNDVVKEEFKCLVKRGSLELANLTWFKKLRSKGHNHVNFLVEITMQKNIVDIKLLKLKAARARRILTVIILVTGEKVSK

SEQ ID NO: 208894 - protein, 208 aa, Glycine max
  Coding DNA Sequence Number=SeqID_92116
  Gene Ontology: Mol. function=transferase activity, transferring glycosyl groups; Cellular component=nucleus; Biological process =multicellular organismal development
  Homolog annotation: Hit_ID=Q96301; Match level="QueryCoverage=66%, HitCoverage=34%, E-value=3e-60, Identity=52%"; Hit description =Probable UDP-N-acetylglucosamine--peptide N- acetylglucosaminyltransf erase SPINDLY
  Pfam annotation: Domain name=TPR_1; Domain location=116-149; Score =43.3; E_value=8.2e-10; Accession=PF00515.18; Description =Tetratricopeptide repeat
  Pfam annotation: Domain name=TPR_1; Domain location=82-115; Score =28.5; E_value=2.3e-05; Accession=PF00515.18; Description =Tetratricopeptide repeat
  Pfam annotation: Domain name=TPR_2; Domain location=116-149; Score =31.8; E_value=2.4e-06; Accession=PF07719.7; Description =Tetratricopeptide repeat
  Pfam annotation: Domain name=TPR_2; Domain location=82-115; Score =14.3; E_value=0.45; Accession=PF07719.7; Description=Tetratricopeptid e repeat
  Pfam module annotation: Pfam domain module=TPR_1::TPR_1::TPR_2::TPR _2; Domain location=116-149::82-115::116-149::82-115
MTQNYTDSSMYLMIQKVEISVEFITVNQVIYLEQSYQKALQVDPSYKAAAECLAIVLTDIGTNIKLAGNTQDGIQKYFEALKPAYYNLGVVYSEMMQYDTALSFYEKAASERPVYAEAYCNMGVIFKNRGDLESAITCYERCLTVSPNFEIAKNNMAIALTDLGTKGWKQWVCCLKTDTFNLCQLNFKGALRKCKYFPCSLGIEKQFW

SEQ ID NO: 208895 - protein, 72 aa, Glycine max
  Coding DNA Sequence Number=SeqID_92117
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9FIU7; Match level="QueryCoverage=91%, HitCoverage=12%, E-value=6e-23, Identity=76%"; Hit description=Beta -glucosidase
MTKLLVGAESISRADFPEGFVFGTASSAHQFEGATDEGNKGDSIWDTFSRIPGRIVDFSNADKAVDQYHRFQ

SEQ ID NO: 208896 - protein, 410 aa, Glycine max
  Coding DNA Sequence Number=SeqID_92118
  Homolog annotation: Hit_ID=Q9FFZ3; Match level="QueryCoverage=34%, HitCoverage=86%, E-value=2e-47, Identity=67%"; Hit description =Arabidopsis thaliana genomic DNA, chromosome 5, P1 clone:MBL20
MKVRVVCRKIYDYIRYDLKEIAFPSSLPDPPHIKKRRKLTWDQRIWRAARLYAASWVRDIGPDLRPDDYKKDGDMTDETNGEKKTTIGKEPSTLEDLAVAARGGMETLRPALQRVYMTRASAYRDALKSFIEGYQEGVQQGDFVGVDADLNTVIYSSRRNQIPICVLYSTASPKGGASHPHPCGGTLTGGQRSPLLPHLPLLLHLLWQGKPLPKSTIPLRSAAAASAATWVIGLGGTNLYCVSVYIAFEGLRLSSFHKFQPMMPLITILQSTDNFSEASKLGERGFGPVYKGILPDRRQIAVKRLSKVFGQGSAEFNNEVTFIAKLQHRNLETANHRKSHHKNGETSADCPMPLQPPKPKVKIYKMMARGDVWEGGVKKDASWFGAREGGDGSGWVSEGKRWKGFSKGQN

SEQ ID NO: 208897 - protein, 170 aa, Glycine max
  Coding DNA Sequence Number=SeqID_92119
  Gene Ontology: Mol. function=peptidyl-prolyl cis-trans isomerase activity; Cellular component=cytosol; Biological process=protein folding
  Homolog annotation: Hit_ID=Q93VG0; Match level="QueryCoverage=71%, HitCoverage=73%, E-value=2e-50, Identity=80%"; Hit description =Cyclophilin
  Pfam annotation: Domain name=Pro_isomerase; Domain location=12-142; Score=143.9; E_value=4.5e-40; Accession=PF00160.11; Description =Cyclophilin type peptidyl-prolyl cis-
MWASAAEGGAPEVTLETSMGSFTFELYYKHAPRTCRNFIELSRRGYYDNVKFHRIIKDFIVQGGDPTGTGRGGESIYGAKFEDEIKRELKHTGAGILSMANAGPNTNGSQFFITLAPCPSLDEIDPHNHNHIMQIILSVWLLYYYTMKSEGTGGCDDTDRHWLFAINTVI

SEQ ID NO: 208898 - protein, 251 aa, Glycine max
  Coding DNA Sequence Number=SeqID_92120
  Homolog annotation: Hit_ID=Q9FMR7; Match level="QueryCoverage=96%, HitCoverage=51%, E-value=9e-66, Identity=48%"; Hit description =Arabidopsis thaliana genomic DNA, chromosome 5, P1 clone:MWD9
  Pfam annotation: Domain name=DUF1022; Domain location=1-249; Score =242.0; E_value=1.3e-69; Accession=PF06258.2; Description=Protein of unknown function (DUF1022)
MQNLFIRRDGPMLVVASGRDISVASSIKRLAPENVFLVQLTSLVMCLVAWWVTPWEPPGCNVVLTVGALHQADSAALRVAASAWHDELATLPKPLLVVNVGGPTGNCPCGVDLVKKLVVMLQNVLWSCGSIRISFSRRTPEKFWLLIMSMLLFGHLTALISKILVEEFASNPKVQIWDGEGSNPHMGHLAWADAFVITADSVSMLSEACSTGKPVYIIGAERCTWKFADFQNSLQEQGIARPFTGNENMSC

SEQ ID NO: 208899 - protein, 415 aa, Glycine max
  Coding DNA Sequence Number=SeqID_92121
  Gene Ontology: Mol. function=binding; Cellular component=membrane; Biological process=multicellular organismal development
  Homolog annotation: Hit_ID=Q96301; Match level="QueryCoverage=81%, HitCoverage=36%, E-value=1e-162, Identity=80%"; Hit description =Probable UDP-N-acetylglucosamine--peptide N- acetylglucosaminyltransf erase SPINDLY
MFPCRDWGRRFMRLYSQYTSWDNSKDPERPLVIGYVSPDYFTHSVSYFIEAPLVYHDYSNFKVIVYSAVVKADSKTIRFREKVVNKGGIWKDIYGIDEKMVANMVREDQVDILVELTGHTANNKLGMMACRPAPIQVTWIGYPNTTGLPTIDYRITDSLADPPETKQKHVEELVRLPECFLCYTPSLEAGPVCPTPALSNGFVTFGSFNNLAKITPKVLQVWVRILCAIPNSRLVVKCKPFCSDSVRQIFLSTLEQLGLEPLRVDLLPLILLNHDHMQAYSLMDISLDTFPYAGTTTTCESLYMGVPCVTMAGSVHAHNVGVSLLSKVENRDQIGQQVQEYSFWQGTVLIKLKYYSSKTESFDSNSNYFFNRKSILFNSQKPVKLKRVDLKKCRKRGESGARREREEIKRNQLFF

SEQ ID NO: 208900 - protein, 440 aa, Glycine max
  Coding DNA Sequence Number=SeqID_92122
  Gene Ontology: Mol. function=hydrolase activity
  Homolog annotation: Hit_ID=Q53QH1; Match level="QueryCoverage=81%, HitCoverage=93%, E-value=8e-63, Identity=42%"; Hit description=Dcp1 -like decapping family, putative
  Pfam annotation: Domain name=DCP1; Domain location=12-142; Score =201.5; E_value=1.9e-57; Accession=PF06058.4; Description=Dcp1-like decapping family
MSQTKKLTPNLDQQSTKVLNLTVLQRIDPFIEEILFTAAHVSFYDFNIESNQWSRKDVEGSLFVVKRNSQPRFQFIVMNRRNTAIFLIFVLTDNLVENLLDFEYELKKPYLLYRNAAQEVNGIWFYNPDECEEVANLFNRILNAYPKTAPTTVLPVNISESEELQPVSIIPESPLESSSATASAIDAVEDPANTNFLSTLKVTGNYASNMENFRQHSATVTSAPSGLFSTAPAVQIPSASHSTSSISGFPLDSLETAKSGNQIINLVKPSTFFASTSSSSLLVPPISSSVQPSAAVQHSLNLPRQYGTPVLQPFPPPNPPLSLTPISSSTPNRPVFSRDNVRDALLSLVQEDQFIDMMFQALLKLHTVTSNRRNSRLYLHNDKSVSMSVSPYYPLLSVLCGFKYNHGSVDCVFALSWTSPLSTNEDAYNLMLSMQLDINK

SEQ ID NO: 208901 - protein, 69 aa, Glycine max
  Coding DNA Sequence Number=SeqID_92123
MAIEHLICHVAIKKLNVTHSHVDIEYSEMAIEHLICHDDRSINNNTATCKLFFHYLADAFRAGLQSHRN

SEQ ID NO: 208902 - protein, 297 aa, Glycine max
  Coding DNA Sequence Number=SeqID_92124
  Homolog annotation: Hit_ID=Q9FIV0; Match level="QueryCoverage=98%, HitCoverage=99%, E-value=3e-23, Identity=30%"; Hit description =Arabidopsis thaliana genomic DNA, chromosome 5, P1 clone:MRB17
  Subcellular localization annotation: CTP_CleavageSite=47; ConfidenceScore=5.51e-01
MGGGGAMRSAAKIAGIGVSKAALRPSALPTEQTVRNASRPTAVSGVSSQSAKSAEVAPLHTAAAWDDWDFAEDGELVVPRMVFGSVPTLDEAKEATAELKDAIDQVYLCPETSQYSSPGGQVSALSPTLYGPVNRSCVIDAISDPTAPKHAIQAFHLLSTSREAQAVVASLACDPNVWNAVMENSAVSSFFQSQQSVAGFGAAENSEEVDKLSSCASETVESPEKLEGSAESHPGNMFDDFMGLLQNVKLTVIELHGRNLHRFGSAGDNGDRDKESLDSNKQNYNLSTFLIVLKPCY

SEQ ID NO: 208903 - protein, 417 aa, Glycine max
  Coding DNA Sequence Number=SeqID_92125
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9FIU7; Match level="QueryCoverage=97%, HitCoverage=76%, E-value=1e-171, Identity=69%"; Hit description=Beta- glucosidase
  Pfam annotation: Domain name=Glyco_hydro_1; Domain location=1-413; Score=489.2; E_value=4.7e-144; Accession=PF00232.9; Description =Glycosyl hydrolase family 1
MKDLGMDSYRFSISWPRIFPNGTGEPNKEGIKYYNSLIDSLLVKGIQPFVTLYHWDLPQMLEDKYEGWLSSQIIKDYEHYANTCFKAFGDRVKHWITFNEPHNFALHGYDLGIQAPGRCSLLGHLLCKKGKSSTEPYIVAHNILLSHAAAYRSYQLHFKEQQGGQIGIALDVIWYEPITELDEDKDAAARAMDFSLGWFLDPLFFGKYPLSMEKLVAKRLPEISDTASKFLVGSLDFIGINHYTSVYTRNDRTRIRKLVMQDAATDAAVITTAYRRGSAIGEKAASSWLHIVPWGIRKLVKHVKDKYGDTPVIITENGMDDPSGPFRTLEKALNDDKRIRYHRDYLSNLSAAIREDGCNVRGYFVWSLLDNWEWNMGYTVRFGLYYVDFRNNLTRIPKDSVQWFKNMLRIETEHSEI

SEQ ID NO: 208904 - protein, 61 aa, Glycine max
  Coding DNA Sequence Number=SeqID_92126
MGCDVNPFAQGLKMDLQREKVTSLWRVECKVFGSMFECVWVENEDDNNGVQVGLKTEGLER

SEQ ID NO: 208905 - protein, 418 aa, Glycine max
  Coding DNA Sequence Number=SeqID_92127
  Gene Ontology: Mol. function=mRNA (guanine-N7-)-methyltransferase activity; Cellular component=nucleus; Biological process=mRNA processing
  Homolog annotation: Hit_ID=Q9LHQ7; Match level="QueryCoverage=92%, HitCoverage=100%, E-value=1e-171, Identity=74%"; Hit description =mRNA cap guanine-N7 methyltransferase 1 (EC 2.1.1.56) (mRNA (guanine- N(7)-)-methyltransferase 1)
  Pfam annotation: Domain name=Methyltransf_11; Domain location=116 -250; Score=30.8; E_value=4.7e-06; Accession=PF08241.2; Description =Methyltransferase domain
  Pfam annotation: Domain name=Methyltransf_12; Domain location=116 -248; Score=26.7; E_value=8.3e-05; Accession=PF08242.2; Description =Methyltransferase domain
  Pfam annotation: Domain name=Pox_MCEL; Domain location=57-388; Score =491.7; E_value=8.5e-145; Accession=PF03291.7; Description=mRNA capping enzyme
  Pfam module annotation: Pfam domain module=Methyltransf _11::Methyltransf_12::Pox_MCEL; Domain location=116-250::116-248::57 -388
  Subcellular localization annotation: CTP_CleavageSite=46; ConfidenceScore=5.33e-01
MSRRPQFPRASFHTQSQCRSSSNSSLPMKRGYQESPSSSLGPPHSRARHDPQGGAHFVEDESTKIFARKVADHYSARSNQTLEEREASPIIHLKKLNNWIKSVLIQLYARRGDAVLDLACGKGGDLIKWDKAKIGYYVGIDIAEGSATIKGTLVANEASILHFLHIKDCRTRYNGDADHHQRRKKFTFPARLICGDCYEVRLDKVLADDAPFDICSCQFALHYSWSTEARARQALANVSALLRPGGIFIGTMPDANVIIKKLREAEGLTFGNRVYWVRFDEEFSDKKFKSSSPFGIKYTFHLEDAVDCPEWIVPFHVFKSLAEENDFELVFAKNSHEFVHEYMKKPEFVELMRRLGALGDGNQDQSTLSADEWEAAYLYMSFVLRKRGQPDKTQQSGRRNRGSMHISEEDIMYISTDD

SEQ ID NO: 208906 - protein, 63 aa, Glycine max
  Coding DNA Sequence Number=SeqID_92128
MDDDMLCKGPPMLMDDNYGSQIFLDDHNHFREGVPIRNFLACDKFKAILILALLMPSTQKGLS

SEQ ID NO: 208907 - protein, 163 aa, Glycine max
  Coding DNA Sequence Number=SeqID_92129
  Gene Ontology: Mol. function=serine-type peptidase activity; Cellular component=lysosome; Biological process=proteolysis
  Homolog annotation: Hit_ID=Q67WZ5; Match level="QueryCoverage=82%, HitCoverage=24%, E-value=2e-42, Identity=58%"; Hit description =Putative prolylcarboxypeptidase isoform 1
MVEKKLLEHEQNLVIPLQNLAPAYACTEMIMPVGGSNKESIFPEYEWSYEARASWCDFFYNVQPRPHWITTEFGGHAIERVLKRSASNIIFFNGLRDPWSAGGVLKTISKTIVAIVAKKGAHHVDLRYSSKEDPQWLKDVRKQEVNIIASWISQYHQDLQSNS

SEQ ID NO: 208908 - protein, 155 aa, Glycine max
  Coding DNA Sequence Number=SeqID_92130
MGRQRTRTHGPGNSFSGSEFLLGPDAGRRNLVHLPERGGELPGGDRSLEGLVSRLRRRVFGGGQCPERRSRAHELPRGHGRTRSAPLSDENSPLEAVVVEHGGRGGGGGGTASFSDLPRNHVHGASVLAQHQNTEFWCRDIARRGGKCGGTRVGL

SEQ ID NO: 208909 - protein, 214 aa, Glycine max
  Coding DNA Sequence Number=SeqID_92131
  Homolog annotation: Hit_ID=Q1SMF9; Match level="QueryCoverage=34%, HitCoverage=15%, E-value=1e-13, Identity=52%"; Hit description =Transposase, IS4
MWNKRMLTPHSLLGKVLKSMRNPLSMCSFGIILDKKHPDAETVKTGGCSIFKELCTIFSEPSTNGKHEYFAASKGEHTYTTPCPEPLNTHQEESSSESQDEEDANDLQTVQPTTPTAISTRKRGRKGIDDAIADAIFEMASASKMRAAAIEQQIARFSMADCIRDLDLMQGVDQQLYFAALELFDKPNAREIFLSLKKDKRLTWLRRKCAVASN

SEQ ID NO: 208910 - protein, 506 aa, Glycine max
  Coding DNA Sequence Number=SeqID_92132
  Homolog annotation: Hit_ID=Q4WLL3; Match level="QueryCoverage=46%, HitCoverage=12%, E-value=1e-06, Identity=22%"; Hit description =Filament-forming protein (Tpr/p270), putative
MDRSGTGSRQKRTPSISHRARITEHHVGPLDSLSNASLMEIETRSRAQTPASSAVGVKGHRPSSSMSLISALHTELERARLQVNQLIQEQRSDQNEINYLMKCFAEEKAAWKNKEQEIVEVAIESIAGELDVERKLRRQLESLNKKLGRELADTKASLLKVVKELESEKRAREIIEQVCDELARDADEDKSEIEKQKRVSTKVCEEVEKEKEIMQLTDRLREERAQKKLSDAKYQLEEKNAAVDKLRNQLEVFLGGKQVREKSRSSTHLNDEEIAAYLSRSRLGSHLVEDKEDDGGEVDNGVECEEESAESDLHSIELNMDNNKSYKWTYPPESRFDTRRYPIEEEVKGSRRSTSGKTSRKSTSLQRSISDGMEWGVQADKLQNSGDGIDWESFYELEKQAQGKGYGDEMQGYKSVKGLRDQILAGSRLASYRGYASPTRQFSQPWSSRDLTNNFQERPATAQGNGLKSRLGEARGEGQNLRKSKRPYPFASATMMAGKNAGQRFS

SEQ ID NO: 208911 - protein, 388 aa, Glycine max
  Coding DNA Sequence Number=SeqID_92133
  Gene Ontology: Mol. function=serine-type peptidase activity; Cellular component=lysosome; Biological process=proteolysis
  Homolog annotation: Hit_ID=Q67WZ5; Match level="QueryCoverage=92%, HitCoverage=70%, E-value=3e-99, Identity=49%"; Hit description =Putative prolylcarboxypeptidase isoform 1
  Pfam annotation: Domain name=Peptidase_S28; Domain location=59-388; Score=87.0; E_value=6e-23; Accession=PF05577.2; Description=Serine carboxypeptidase S28
  Subcellular localization annotation: CTP_CleavageSite=69; ConfidenceScore=5.59e-01
MAIGFQFILTLFSLFSVPSLTFAFAPILPRFPSSAVSAELKQRSHSSQNGLYRTKFFTQILDHFNFNPQSNHTFQQRYLINDTFWGGAKNNAPIFVYTGNEGNIEWFTQNTGFMFENAPSFQALLVFIEHRFYGKSIPFGGNKTVAYANTSTLGYLSSTQALADYAALIIDLKKNLSATDSPVVVFGGSYGGMLAAWFRMKYPHVAIGALASSAPILHFMGMVSPDIFISIITQDFRSESENCYKVIKGSWDLIDDTANKPGGMELLRKTFRICKSDDFGPDSLEGWLRAAWIYTAMTDYPTPSNFLNPLPAYPVKKMCEAIDSSVTGNNRLAKLYAAANVYYNYTGKATCFDLDDNSDPHDLGGWQWQDEYRNEYRMMDSDILPNPD

SEQ ID NO: 208912 - protein, 107 aa, Glycine max
  Coding DNA Sequence Number=SeqID_92134
MEKMSKKEIEEKQNNENCVFCGNGKVWVVGFMVVGFVSRLGWRPGGRAPLVVVRLRTADGGDSDSAVICHPLVVVWHHVLWGSTINTCLIFDMLVEGCYGCEGDVIG

SEQ ID NO: 208913 - protein, 625 aa, Glycine max
  Coding DNA Sequence Number=SeqID_92135
  Homolog annotation: Hit_ID=Q56W45; Match level="QueryCoverage=97%, HitCoverage=99%, E-value=3e-75, Identity=41%"; Hit description=BZIP -like protein
  Pfam annotation: Domain name=DUF630; Domain location=1-60; Score =112.9; E_value=9e-31; Accession=PF04783.3; Description=Protein of unknown function (DUF630)
  Pfam annotation: Domain name=DUF632; Domain location=178-502; Score =415.5; E_value=7.3e-122; Accession=PF04782.3; Description=Protein of unknown function (DUF632)
  Pfam module annotation: Pfam domain module=DUF630::DUF632; Domain location=1-60::178-502
MGCCHSKIEREETVSRCKARKRYMKQFVQARHAFSAAHVMYIRSLRATGSALFQFANAETTVLHHHLPSRPHPILPPPPPRTPTPMPPPPPPPMSPSSYTWTSDTTSSPALPQPPPPPPPPVASSAWDFWDPFMPVVASRLATEEEWEATTTTGSEVVVMAAASVTAPPSVVSGFSKETPSELAMVVSRNSTKDLVEVIKELDDYFLKAADAGSHVSLLLEVPNSGFSDNSKACKVHSYGWSLSPSLWAWGSSPKLNGGAFGVNGVGSVGHCSTVERLYAWEKKLYQEVKNAKTIKMEHEKKLALLRKVEMKRADYVKTEKTKKGVEKLESQMMVASQAIDSTSAEIIKLREVELYPQLIELVKGLMCMWRSMYECHQVQKHIVQQLEYLNTIPSNNPTSEIHRQSTLQLELEVKQWHQSFCNLFKAHRDYIQSLTGWLRFTLFQFSKNPLSRTPEESKIYSLCEEWHLAVDRIPDKVASEGIKSLLTVIHAIVVQQAEEQKQKKRSDSAFKELEKKVVQLRSLECKYGPYSMPESYGSMRTKDPVTEKRAKVDALRAKAEEEKSKYEKSVSVTRAMTLNNLQMGCPHVFQGIVGFSSVCMEVFESVYNKAKAAEQEHDVKRILP

SEQ ID NO: 208914 - protein, 132 aa, Glycine max
  Coding DNA Sequence Number=SeqID_92136
  Gene Ontology: Mol. function=oxidoreductase activity; Cellular component=integral to membrane; Biological process=response to oxidative stress
  Homolog annotation: Hit_ID=Q5QIA9; Match level="QueryCoverage=54%, HitCoverage=25%, E-value=2e-12, Identity=50%"; Hit description =Peroxisomal ascorbate peroxidase
  Pfam annotation: Domain name=peroxidase; Domain location=3-124; Score= -85.6; E_value=0.01; Accession=PF00141.13; Description=Peroxidase
MSHKFYCDEYLILTALVLVSLERIEEVKAKYPKVSYADLYQLAGVVPVEVTGGPTMDFVPGRKDSLESPVEGCLPDAEQALSNNTVFYKVNVKNSLHRLALLFIVTILQELEFRNPLVDRINSHFITLNVVH

SEQ ID NO: 208915 - protein, 535 aa, Glycine max
  Coding DNA Sequence Number=SeqID_92137
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=97%, HitCoverage=41%, E-value=2e-96, Identity=34%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLSTNGGNVPAQLLVLDGKNWERWHIQMKALFEFQDMMEVVKNGVAAEPAEPATEAVRNAYKDSKKKDVKAIFFLHQSVDDANFNLISKSTSAKQAWDKLEKCYAGGDRIKKVKLQVLQRQFDSMTMEENEKIVDFFARVKVVTNQMATQGETLTNGKICEKIARSLLEKYDYIVCAIEESKEVSEMSLEELQSSLEARELRLLERNKKKIVEQALLAQSSNKNSGDSNRGRSGFREEVMVGTIEEEVAMFLVVEEARIMLKINLISRREAGAEATIEVVAMVEEKVVDECYAKKDSQGDKANLAKGDDEENELVMLMVTTADEMCTIDEWYLDTGCSTHMTGHKEWLVNFDASKKNRIKFADGRAMLAEGVGNVMIKMSNGTQYCISGGKNSLIFDVSMSRNRTFRANLEALCHKCLVAEVSEDYWVWHHRYGHLNFRDLRDLNTHNMVRGLPLINVPKELCKNCVESKQHRESFKKFVETKAREKLEVIYSDVCDPMQCQSLGESRYFVSFLDDFTRKMWVYILKRKSEVLG

SEQ ID NO: 208916 - protein, 359 aa, Glycine max
  Coding DNA Sequence Number=SeqID_92138
  Gene Ontology: Mol. function=hydroxyacylglutathione hydrolase activity
  Homolog annotation: Hit_ID=P0AC84; Match level="QueryCoverage=50%, HitCoverage=71%, E-value=3e-75, Identity=71%"; Hit description =Probable hydroxyacylglutathione hydrolase
  Pfam annotation: Domain name=Lactamase_B; Domain location=87-241; Score=119.7; E_value=8.4e-33; Accession=PF00753.17; Description =Metallo-beta-lactamase superfamily
  Pfam annotation: Domain name=MLTD_N; Domain location=270-359; Score =9.4; E_value=0.00028; Accession=PF06474.2; Description=MLTD_N
  Pfam module annotation: Pfam domain module=Lactamase_B::MLTD_N; Domain location=87-241::270-359
AFTDAQQAERIEAADNHPAVINQYTIHFAQDAVRILAPGQRPIALIAHINLMRYGTLAGIDFCAEAANFKHMKAVQLAEIRIPALQDNYIWTLNDEQGRCLIVDPGEARPVLEKIHANHWQPQAILLTHHHHDHVGGVSELLEHYPQLEVYGPQETADKGARTILSDGDEFTLLGLNFRVIATPGHTLGHISYFSSPYLFCGDTMFSGGCGRLFEGTAQQMFESFQALNQLPADTLICCAHEYTLSNMKFAAAILPQDPKILARLLPIYARRKTVFDISGCVVPVANASRNDASIPVQHAQSLSSAGQGENGKYGDRLLSPRWQDDGTSLAEDTDLWNHISDELKMGIPENPRIREQKT

SEQ ID NO: 208917 - protein, 76 aa, Glycine max
  Coding DNA Sequence Number=SeqID_92139
  Gene Ontology: Mol. function=transcription factor activity; Biological process=regulation of transcription, DNA-dependent
  Homolog annotation: Hit_ID=Q4ZSX0; Match level="QueryCoverage=80%, HitCoverage=20%, E-value=1e-13, Identity=67%"; Hit description =Regulatory protein, LysR:LysR, substrate-binding
  Pfam annotation: Domain name=HTH_1; Domain location=15-74; Score =74.6; E_value=3.1e-19; Accession=PF00126.17; Description=Bacterial regulatory helix-turn-helix protein, lysR family
MATAEHLISNHLPSVKQLQCFLAVAHELNFRRAAERLRMTQPPLTRQIKRLEAVLEQPLFSRSTHDVSLTDAGRAL

SEQ ID NO: 208918 - protein, 332 aa, Glycine max
  Coding DNA Sequence Number=SeqID_92140
  Gene Ontology: Mol. function=oxidoreductase activity; Cellular component=intracellular; Biological process=regulation of transcription, DNA-dependent
  Homolog annotation: Hit_ID=Q5LKN6; Match level="QueryCoverage=99%, HitCoverage=100%, E-value=4e-90, Identity=51%"; Hit description =Oxidoreductase, aldo/keto reductase family
  Pfam annotation: Domain name=Aldo_ket_red; Domain location=6-313; Score=190.1; E_value=5.3e-54; Accession=PF00248.11; Description =Aldoketo reductase family
MHTRLLSQTLTVSSIGYGAMGLSEFYGQTDDTASLQLLHALIDLNITFIDTADMYGRGHNERLIGHFLAGLDNTTREQFNIATKCGIDRPADQAYARTINNQPDYITRCCNESLKRLGVERIDLFYLHRVSQVTPIEESMECLSRLVKAGKINHIGLCEVSASTLRRAHAIHPLTALQTEYSLWTRDIEAEILPVVKELGIGLVPYSPLGRGFLTGKYRHNSDFAEGDFRKNNARFSQSSLDHNAQLLDAVHPLAEKYSCTPGQIALAWLLAQYDKLIPIPGTKQTRYLAENAQAADIALEQADIALLNAIHQHIEIRGERYSQEGMKSINA

SEQ ID NO: 208919 - protein, 100 aa, Glycine max
  Coding DNA Sequence Number=SeqID_92141
MSWGLLHTARCNLCTLAMEEMEKLDLIEDRLRAIEGIGDYPFADMAELCLVLDVVIPPKFKVPDFDKYKGTTCPKNHLKMYCRKMGSYSRDEKLLMHFLQ

SEQ ID NO: 208920 - protein, 101 aa, Glycine max
  Coding DNA Sequence Number=SeqID_92142
MESNAAMVSATNAAAEADPTHSSGINQTSRPVPNMVGQGEKVLGNTGGPHMVQNKNFFPPYGLPPNYTPPNAVHMPNENTNHSIPIPLEGQQPQLGHASFA

SEQ ID NO: 208921 - protein, 647 aa, Glycine max
  Coding DNA Sequence Number=SeqID_92143
  Gene Ontology: Mol. function=hydrolase activity; Cellular component =cytosol; Biological process=metabolic process
  Homolog annotation: Hit_ID=Q8RWN4; Match level="QueryCoverage=93%, HitCoverage=94%, E-value=0.0, Identity=64%"; Hit description =Cytosolic IMP-GMP specific 5-nucleotidase, putative
  Pfam annotation: Domain name=5_nucleotid; Domain location=247-642; Score=606.0; E_value=3.3e-179; Accession=PF05761.4; Description=5' nucleotidase family
MLVKLHFQFEVVNAIALWFAPVQWPHPQHLIPSQCPPRLFNRCTMRIPKRHLSFSLSNFSPQLPPLFSPRLRFASGICTKPPRSLANSTSPGVNPLHAQYSMDGNHEIDVHDSRLGDLPGRDGSKQPFVWSSPEHGFKTEIGKQIFCNRSLNMKNIVAVGFDMDYTLAQYKPETFESLAYQGTIKKLVYDLGYPREVFLCRFTNFRMVHFVKGFCLFAYSFQLLNWSFNWKYMVRGLVLDKKRGNILKMDRHKYVKVAYHGFRELSKEDKVGTYGNTLVRDSFDEPDYALIDTLFSLAEAYLFAQLVDYKDYNPGKIQEGVDYACMYKDVRAAVDLCHRDGTLKQMVAMEPKRYINEDPSIVPMLEMLRDSGRAMFLVTNSLWDYTNIVMNFLCGSSMADVSNNFGWLQLFDVVITGSAKPGFFHEENRANLFEVVPETGMLLNTDNGSPMPQVGNTSARLFTEAKNYACPVFQGGNVAHLHKLLSIESSSQVLYVGDHIYGDILRSKKVLGWRTMLVIPELEKEVKLLWESRDTRKELQFLRSERDRIEDEIHHLKWSLKFKNPDADSKQKLSSELEKLEFHEPWGQLMKTGYQNSRFAHQVERFACLYTSQVSNLALYSPDKYYRPSEDFMQHEFGIMACEAPGS

SEQ ID NO: 208922 - protein, 296 aa, Glycine max
  Coding DNA Sequence Number=SeqID_92144
  Homolog annotation: Hit_ID=Q1PEY6; Match level="QueryCoverage=17%, HitCoverage=32%, E-value=9e-16, Identity=72%"; Hit description =Allergen-like
MEVSSMGWHKRLLGGPGSLPPWCTSKCGKCTPCRPVHVPVLLGTLVTAEYYPEAWRCNGGGNDKSIVNHAAQIAQIPNQNATPQQQFQTQQRQMRMLGGNLELERLRNINVQPLAQVMVNESTGAKNVVSSLGTQIQIVEPSNQEFGATQLPFPEMDTSFDPYNFQDNTLNQIPHENLNFSLSDSFQNPSSKPNNNCSQRETSTCQIDLDMKDYVNRSYIVENDFACDFDMFGAMNGDRQGLYKKDDEVVTSIGDEKEAEDFCVMAREEEKMKLLLQIEAGIGEDRKGTINIIFYI

SEQ ID NO: 208923 - protein, 109 aa, Glycine max
  Coding DNA Sequence Number=SeqID_92145
MWGLSALPVAGSMWTTGLSALSGLVDKDRRCEALCVRFTADGKADASEGGGGGGGEGGGEASGEAMILYTRTYNNIQNPWEDQKELFYDPMLEARRSLGAATYIGVFRI

SEQ ID NO: 208924 - protein, 78 aa, Glycine max
  Coding DNA Sequence Number=SeqID_92146
  Gene Ontology: Mol. function=nucleoside diphosphate kinase activity; Cellular component=flagellum; Biological process=pyrimidine ribonucleoside triphosphate biosynthetic process
  Homolog annotation: Hit_ID=Q6Z7E5; Match level="QueryCoverage=89%, HitCoverage=39%, E-value=4e-22, Identity=67%"; Hit description =Putative outer arm dynein intermediate chain 1
  Pfam annotation: Domain name=NDK; Domain location=2-74; Score=-6.6; E_ value=4.3e-07; Accession=PF00334.9; Description=Nucleoside diphosphate kinase
MIISGPVLVMVLEKDNAIADWRALMGPTNASKAKITHPHSIRAKCGLDVENNCVHGSDSPKSAQREIPFFFKELSASQ

SEQ ID NO: 208925 - protein, 50 aa, Glycine max
  Coding DNA Sequence Number=SeqID_92147
MTKETWIQKMMIGVSYLRNLYLTFVGITQTRMPAILKLRSYLKRLHILML

SEQ ID NO: 208926 - protein, 133 aa, Glycine max
  Coding DNA Sequence Number=SeqID_92148
  Homolog annotation: Hit_ID=Q9FFZ1; Match level="QueryCoverage=29%, HitCoverage=8%, E-value=6e-10, Identity=77%"; Hit description =Arabidopsis thaliana genomic DNA, chromosome 5, P1 clone:MAC12
  Subcellular localization annotation: CTP_CleavageSite=54; ConfidenceScore=5.65e-01
MASRRRRASLLSQAAVPTWSTTTTSWVARRAGMTGCGWQSTSSLESWSSWTRTRAAHQRVDKPSYVINSLQHVLREGRYYPYLEGYLFQSPIAEVLSQVYADHSTNVDNAFSRIVETTRHPAAAVSFASIMQY

SEQ ID NO: 208927 - protein, 120 aa, Glycine max
  Coding DNA Sequence Number=SeqID_92149
MVPVELLWRGMSLVVMLAALVPFRPSTVVHVIETPHLARFLVGRQASYLTRKQDRPPRPQHCSNWSSELEQSCFGSPDRPQASRSSATAGRGLAEPRQRDWPPRLYAKILQQEGVWSLPP

SEQ ID NO: 208928 - protein, 191 aa, Glycine max
  Coding DNA Sequence Number=SeqID_92150
  Gene Ontology: Mol. function=transporter activity; Cellular component= intracellular; Biological process=transport
  Homolog annotation: Hit_ID=Q2PYY3; Match level="QueryCoverage=99%, HitCoverage=66%, E-value=7e-71, Identity=62%"; Hit description =Transporter-like protein
  Pfam annotation: Domain name=CRAL_TRIO_N; Domain location=3-79; Score= 30.9; E_value=4.6e-06; Accession=PF03765.5; Description=CRALTRIO, N -terminus
MFQRRSNLQPSQESEEHYSESKIKEVKDAIEPLSGRSLKYCTDNCLRRYLEARNWNADKSKKMLEDTLKWRSTYKPEDIRWDEVAMEGATGKLYRASFHDREGRIVLVLRPGMQNTSSIENQMRHLVYMLENAMLNLPQGQEQMSWLIDFTGWSFRNSVPIKSAKETINILQNHYPERLAIAFSLQPPSCF

SEQ ID NO: 208929 - protein, 443 aa, Glycine max
  Coding DNA Sequence Number=SeqID_92151
  Gene Ontology: Mol. function=protein dimerization activity; Cellular component=nucleus; Biological process=regulation of transcription, DNA-dependent
  Homolog annotation: Hit_ID=Q1S6L7; Match level="QueryCoverage=95%, HitCoverage=96%, E-value=1e-100, Identity=53%"; Hit description=CAMP response element binding (CREB) protein
  Pfam annotation: Domain name=bZIP_1; Domain location=357-419; Score =41.8; E_value=2.4e-09; Accession=PF00170.11; Description=bZIP transcription factor
  Pfam annotation: Domain name=bZIP_2; Domain location=357-411; Score =42.8; E_value=1.2e-09; Accession=PF07716.5; Description=Basic region leucine zipper
  Pfam module annotation: Pfam domain module=bZIP_1::bZIP_2; Domain location=357-419::357-411
MVVPESQMNSQNEVESPLQLEEQQQQQNNNNNKNHPFSSLGRQSSSIYSLTLDEFQHTLWENGKNFGSMNMDEFLSSIWSAEENQVLNNSVSNHNNLSLEASTEKGVIRKEPSLPRQGSLTLPAPLCRKTVDEVWSEIHKGQQSQQQQQQNNNTNNNCGSNNNNNVQNTESAPRQPTFGEMTLEDFLVKAGVVREQGGMAAMPVQASAHQHVQQYGMYPNNNPTMGASFVGRPVMGMAGGVRVGSGGRNVVAPPYQAVPQGGVGVGVGGAIAESSGYAGNGKRDVGYPPGAPGVCFGGRVVNGGGGYAAVSNMGVVAPVSPVSPEGIGTGENSGGQFGMDMSMLRGRKRVLDGPVEKVVERRQRRMIKNRESAARSRARKQAYTVELEAELNQLKEENGQLKLALADLERRRKQQEVNGRVQTNAQKAKKKLRSLRKTLSCPL

SEQ ID NO: 208930 - protein, 196 aa, Glycine max
  Coding DNA Sequence Number=SeqID_92152
MDSDESGGHVIVSGVRLWVVGKLVGKCLGAFGGPWVKEYLEKGEEKDSREAEAPDLGMGGLYWAGSLLATKNYCGLGRQVKETSYVILNKIVLTPAVDKDDDFVTLDGTCDAQGGRYGMSGHDMQNGFIWEGFVRSDEKEEFGSTPVVCGGAKSRGGGGGTKVMGGATKEELGCQGHDGHLASLILSSCSFASAAA

SEQ ID NO: 208931 - protein, 279 aa, Glycine max
  Coding DNA Sequence Number=SeqID_92153
  Gene Ontology: Mol. function=hydrolase activity; Cellular component =cellulose and pectin-containing cell wall
  Homolog annotation: Hit_ID=Q6ESF3; Match level="QueryCoverage=79%, HitCoverage=62%, E-value=6e-75, Identity=54%"; Hit description =Hydrolase, alpha/beta fold protein-like
  Pfam annotation: Domain name=Abhydrolase_1; Domain location=95-279; Score=-9.7; E_value=0.045; Accession=PF00561.10; Description =alphabeta hydrolase fold
MVLTNCLLWGIYGILGTALAVLFIGFLAWAYQVIQPPAPKICGTSDGPPITAPRIKLRDGRHLAYKEHGVPKDAAKHDTVVANTLSPDVVEELGLYIVSFDRPGYGESDPDPNRTLKSLALDIEELADHLGLGSKFYVVGVSMGGQVVWNCLKYIPNRLAGAVLISPVVNYWWPGLPANLTTEAFSKKKLEDRWALRVAHYIPWLTYWWNTQRWFPASTAIAHSPDNLSHQDKELVPKMSNRKSYVPSPRIGKEAISRLEPMTSQLPRHNFTVAAGLAL

SEQ ID NO: 208932 - protein, 95 aa, Glycine max
  Coding DNA Sequence Number=SeqID_92154
  Gene Ontology: Mol. function=glucose-6-phosphate isomerase activity; Cellular component=cytosol; Biological process=gluconeogenesis
  Homolog annotation: Hit_ID=P34795; Match level="QueryCoverage=91%, HitCoverage=15%, E-value=3e-43, Identity=93%"; Hit description =Glucose-6-phosphate isomerase, cytosolic
MKLLASMESNGKGVSIDGVPLPFEAGEIDFGEPGTNGQHSFYQLIHQGRVIPCDFIGVVKSQQPVFLKGEVVSNHDELMSNYFAQSDALAYGKIK

SEQ ID NO: 208933 - protein, 279 aa, Glycine max
  Coding DNA Sequence Number=SeqID_92155
  Gene Ontology: Mol. function=solute:hydrogen antiporter activity; Cellular component=integral to membrane; Biological process =regulation of pH
  Homolog annotation: Hit_ID=Q9FLI8; Match level="QueryCoverage=98%, HitCoverage=49%, E-value=6e-96, Identity=66%"; Hit description =Potassium/proton antiporter-like protein
  Pfam annotation: Domain name=Na_H_Exchanger; Domain location=1-279; Score=80.5; E_value=5.1e-21; Accession=PF00999.11; Description =Sodiumhydrogen exchanger family
MVETVAQFGVVFLLFALGLEFSLAKLKAVGPVAVLGGLLQIIIFMFMCGILSMLFGAKLSEGVFVGSFLSMSSTAVVVKFLVERNSNNALHVQVTIGTLIFQDCAVGLLFALLPVLGGNSGLLQGIMSMGKLLLVLSLYITATSVLSWTFVPRFLKLMMRLSSQTNELYQLAAVAFCLLSAWCSDKLGLSLELGSFMAGVMISTTDFAQHTLDQVEPIRNLFAALFLSSIGMLIHVHFLWNHVDILLASVILVVVVKTAVAVLVTKAFGYSLKTSFIVS

SEQ ID NO: 208934 - protein, 84 aa, Glycine max
  Coding DNA Sequence Number=SeqID_92156
MYLLLLGTTALSLVTTPLLFKLIPAVMNLGVLMHWFPSESSSQIETILIAYANPITSYTGLPIIGIRVLQMKLEKNSQCNFFED

SEQ ID NO: 208935 - protein, 158 aa, Glycine max
  Coding DNA Sequence Number=SeqID_92157
  Homolog annotation: Hit_ID=Q9FLI8; Match level="QueryCoverage=30%, HitCoverage=8%, E-value=9e-08, Identity=60%"; Hit description =Potassium/proton antiporter-like protein
MSGEGGVFPALTTCEKILGLLKSGGLGGPQASEKMMALKFGCIVEGAFRKKKVWSVRTLLVALIVEGVLDLELRMEMICWIYKARLSAILTGFFPSLTEPDKNSFNSSVADQQAVLETVAKITHDKAKRNDTHEGKYGYTYMFPDVVSQLHLIMDYWI

SEQ ID NO: 208936 - protein, 55 aa, Glycine max
  Coding DNA Sequence Number=SeqID_92158
MSVPEAPYSASHSNIFRPDQCRWVEESCEEGKRFLRGPEIKRYDNCQSKGSNLGL

SEQ ID NO: 208937 - protein, 344 aa, Glycine max
  Coding DNA Sequence Number=SeqID_92159
  Gene Ontology: Mol. function=structural constituent of ribosome; Cellular component=ribonucleoprotein complex; Biological process =translation
  Homolog annotation: Hit_ID=Q8VZT8; Match level="QueryCoverage=64%, HitCoverage=83%, E-value=7e-37, Identity=41%"; Hit description =Putative 30S ribosomal protein S11
  Pfam annotation: Domain name=Ribosomal_S11; Domain location=245-340; Score=-18.1; E_value=0.00033; Accession=PF00411.9; Description =Ribosomal protein S11
MAVDLPSHLFSRRNLHFHSTPLYDLAVYLKTTPVTVIFGHIAKVFGGSVIAIVAAPVQKLISTVFIRGLVQSSETAGHVRGFSSSNLDWRRLIVNQNVNADANAHPDSMQDIEKRNSEKWNNMRQNMNPDANAPPNFVQNRGNINSRSWNNMRQNVNAPPNFMGNRDNINSRSQNNMDQNVDANADALPDFMQDKENINIGNKNYAETGWNSRPMDFVRGIIDEDNFGRGSPYHQYQYEQDADFVHIKMLRNNTFVTVTDSKGNIKLSGSAGPLKDLKSGQKLSRYAAEATAEVVGRKARGLGLKSVVMKGIEIQLYTLKIPLENPIMAADSQRNDEFRCYDTE

SEQ ID NO: 208938 - protein, 91 aa, Glycine max
  Coding DNA Sequence Number=SeqID_92160
MAMKLQVLLLLLLCIASELTTHSVSNSLERCDAETEYNSYGYIDERKKALNDSSCTYQVVIGASCSSPNFTMGDIIIRFGDPLRNQGFQED

SEQ ID NO: 208939 - protein, 63 aa, Glycine max
  Coding DNA Sequence Number=SeqID_92161
  Gene Ontology: Mol. function=metal ion binding; Cellular component =mitochondrion
  Homolog annotation: Hit_ID=Q9FLI7; Match level="QueryCoverage=51%, HitCoverage=30%, E-value=5e-13, Identity=96%"; Hit description =Arabidopsis thaliana genomic DNA, chromosome 5, P1 clone:MIO24
MKMNCSGIKCPSQENAQHLMHKKQVSCGKPRCWRSGTFPLCDGSHVKHNKATGDNVGPLLLKK

SEQ ID NO: 208940 - protein, 84 aa, Glycine max
  Coding DNA Sequence Number=SeqID_92162
MGPVKVTLEMHVAGGIYIGPKVNCTFLQAFSFSHHSASDLLPLLSQEAEPGGETQLREHPSSVQGDHHGQGLGSEEDGGGGGQG

SEQ ID NO: 208941 - protein, 105 aa, Glycine max
  Coding DNA Sequence Number=SeqID_92163
MWFNLLSLVIARCWGWSAKRDGFQRSKGLGHNKSIKDNFVQSQKLKGRMKKDKSNELKVVLQSELGLTHGSDKVLLGGFFVGQYGCKKGHNLRSFENLVFKEGTA

SEQ ID NO: 208942 - protein, 91 aa, Glycine max
  Coding DNA Sequence Number=SeqID_92164
  Homolog annotation: Hit_ID=Q1S104; Match level="QueryCoverage=85%, HitCoverage=41%, E-value=4e-19, Identity=58%"; Hit description =Embryo-specific 3
  Pfam annotation: Domain name=ATS3; Domain location=30-90; Score= -45.6; E_value=0.00048; Accession=PF06232.2; Description=Embryo -specific protein 3, (ATS3)
  Subcellular localization annotation: CTP_CleavageSite=47; ConfidenceScore=5.19e-01
MIKFVLFLFCFASALTLSVSESKSASVQPHAAESFSVGYIQMKTAANCSYLVVISTSCSSPKFTTDKIGITFGDANGNQEILMNILFLEEL

SEQ ID NO: 208943 - protein, 91 aa, Glycine max
  Coding DNA Sequence Number=SeqID_92165
MGCWGAGVVHDTKVLAGLCRSRQRKHCAYLVLDPNSVSDLEKECWGYRFVGRDEEEKDVASSASPDLRTRSLAAESPQQLSMGAEEAAQPS

SEQ ID NO: 208944 - protein, 448 aa, Glycine max
  Coding DNA Sequence Number=SeqID_92166
  Gene Ontology: Mol. function=metalloendopeptidase activity; Cellular component=membrane; Biological process=proteolysis
  Homolog annotation: Hit_ID=Q9FLI5; Match level="QueryCoverage=99%, HitCoverage=91%, E-value=1e-154, Identity=62%"; Hit description =Similarity to peptidase
  Pfam annotation: Domain name=Peptidase_M48; Domain location=262-427; Score=122.8; E_value=1e-33; Accession=PF01435.8; Description =Peptidase family M48
  Subcellular localization annotation: CTP_CleavageSite=65; ConfidenceScore=5.22e-01
MGWYRRGKLALDHFRRLASRVTPQNPIFQRGARICSSGYLDSGSKVASFNGFSSFCSTSQRLGTRGVVGVNRNFHNSVLFGAKRFYYVDPRNVRHFKPRGPWHWFENPRHVFIVVMVGSGVLITVYFGNIETVPYTKRTHLILLSKAMERKLGESEFEQIKTGFKGKILPPIHPESVRVTMIAKDIIDALQRGLRKEEQVWSDLGYASEHAMLVEGDGRETLNALAGSEEKIEGNWAKEDEILDDKWIQQSRKKGQERGSQAATSHLDGLNWEILVVNEPVVNAFCLPGGKIVVFTGLLEHFKSDAEIATIIGHEVGHAVARHGAEGITKNLWFTILQLILYQFVTPDIVHTMSSLFLRLPFSRRMEIEADYIGLLLIASAGYDPRVAPKVYEKLGKITGGNSAIGDYLSTHPSGKKRAELLAQANIMEEAVTIYRDVRAGRGVEGFL

SEQ ID NO: 208945 - protein, 275 aa, Glycine max
  Coding DNA Sequence Number=SeqID_92167
  Subcellular localization annotation: CTP_CleavageSite=48; ConfidenceScore=5.78e-01
MATPLSSPPSPTKSAAPSSPSSSKKTKKATQLKSLPTRPARVERPVVYVDLVTKKANDLTSKWALAHGKEESRDPSGEKKKLMEEKQTKRLEEAIQSGSTKIIVDPPSPIRRHVKWKMVRTKKTNQMTSKVVKEITGRIDSFEEKGSQDSFVAHGYQDVLTAAIRRPEHPSRVCAARAGVTIKHYFGQASKGSRTSSSMVAEDLELLTKKIRDQLEESITQKVTQQLIMFFSQMKSQGLTLPPESEVGPFAAHGSTTVHNVPLGNDQVKVGVEDV

SEQ ID NO: 208946 - protein, 149 aa, Glycine max
  Coding DNA Sequence Number=SeqID_92168
  Homolog annotation: Hit_ID=Q1SNL3; Match level="QueryCoverage=74%, HitCoverage=31%, E-value=6e-07, Identity=27%"; Hit description =Immunoglobulin/major histocompatibility complex
MLDVREQVRDGWRWKTSDSGLYSISEGYKVLQHQSFAGEMDNCSDSIWKMATPSNVKAFTWKALLDRIQSKANYAEELINGWWKAIWQASSGVESIWLHRNSIIFKEEESNIRKVIELIRLSSKDKRLLNLHGKHGCCCRGRAPLPERS

SEQ ID NO: 208947 - protein, 111 aa, Glycine max
  Coding DNA Sequence Number=SeqID_92169
  Gene Ontology: Cellular component=chloroplast envelope
  Homolog annotation: Hit_ID=Q9SJX7; Match level="QueryCoverage=88%, HitCoverage=26%, E-value=4e-26, Identity=58%"; Hit description =Expressed protein
PVLPLSLSASRDVGKLICSNLGVAKFSSCGTMISFTFVAADALYDIGTGLEGMAVVVARATRLPIYSSFAKEGNFSDLFAKGEAFSTLFDVIGIGVGIQLASTICVSMQGE

SEQ ID NO: 208948 - protein, 157 aa, Glycine max
  Coding DNA Sequence Number=SeqID_92170
MTSEAYVPKRYESLENPFAHKPRKRSHQGSGLCGCLRKENKVYSDVVIVVKADNQNEDIGLDYLDNEVGIMYLGSQLSSGQIPPFLQPGKNTTKKWKAEEIRVGVAYLALVIGYGGVDEEKFAEAVKARVMSNAISFEVYMDSNTGETSFRQKKIVR

SEQ ID NO: 208949 - protein, 529 aa, Glycine max
  Coding DNA Sequence Number=SeqID_92171
  Gene Ontology: Mol. function=sugar porter activity; Cellular component=integral to membrane; Biological process=carbohydrate transport
  Homolog annotation: Hit_ID=Q1T0Z1; Match level="QueryCoverage=99%, HitCoverage=100%, E-value=0.0, Identity=78%"; Hit description=Sugar transporter superfamily; Major facilitator superfamily MFS_1
  Pfam annotation: Domain name=MFS_1; Domain location=59-458; Score =102.7; E_value=1.1e-27; Accession=PF07690.6; Description=Major Facilitator Superfamily
  Pfam annotation: Domain name=Sugar_tr; Domain location=55-499; Score =419.2; E_value=5.6e-123; Accession=PF00083.14; Description=Sugar (and other) transporter
  Pfam module annotation: Pfam domain module=MFS_1::Sugar_tr; Domain location=59-458::55-499
MGFQQHGNMEVGLSGITLGTKNKYKRMNSELPEGYDDVLHQEARRNSTRKYVIACAFFASLNNVLLGYDVGVMSGAVIFIKEDLKISEVKEEFLIGILSIVSLLGSLGGGRTSDIIGRKWTMAIAAVIFQIGSLIMTLAPSFSILMVGRLLAGVGIGFGGLIAPIYIAEISPNTTRGFLTTFPEIFINLGILLGYVSNYTFSGFSPHINWRIMLAVGILPSVFIGFALFIIPESPRWLVMQNRIEEARSVLLKTNESDREVEERLAEIQQAAGLANCEKYEEKPVWYELLFPSPSLRRMMITGIGIQCFQQISGIDATVYYSPEIFKAAGIEDNAKLLAATVVVGVTKTLFILVAIFLIDKKGRRPLLFVSTIGMTICLFSIGASLSLFPQGSFVIALAILFVCGNVAFFSVGLGPVCWVLTSEIFPLRVRAQASSLGAVGNRVCSGLVAMSFLSVSRAISVAGAFFVFAAISSLAIVFVYMLVPETKGKSLEQIEIMFKNEHERQGSEMELGDVEIEQFVQDKTVLTN

SEQ ID NO: 208950 - protein, 158 aa, Glycine max
  Coding DNA Sequence Number=SeqID_92172
  Gene Ontology: Mol. function=hydrolase activity; Biological process =aromatic compound metabolic process
  Homolog annotation: Hit_ID=Q9ZP87; Match level="QueryCoverage=98%, HitCoverage=61%, E-value=1e-36, Identity=46%"; Hit description =Epoxide hydrolase
MVWRHQMIAAASAGYQAIAFDFRGYGLSEHPAEPEKAKLLDLVDDVVGLLDSLSITKVVLVGKDFGAVPAYILAALHPDKEPGRAEADCCHFDVKSVIRNIYTLFSGSEILAGDNQEIMDLYNPSTPLPPWFSEEDLATYVSLYEKPGFRFALQVPYR

SEQ ID NO: 208951 - protein, 422 aa, Glycine max
  Coding DNA Sequence Number=SeqID_92173
  Gene Ontology: Mol. function=transcription factor activity; Cellular component=cytoplasm; Biological process=regulation of transcription, DNA-dependent
  Homolog annotation: Hit_ID=Q9SKT1; Match level="QueryCoverage=91%, HitCoverage=91%, E-value=1e-51, Identity=36%"; Hit description=AP2 domain transcription factor
  Pfam annotation: Domain name=AP2; Domain location=221-285; Score =145.8; E_value=1.2e-40; Accession=PF00847.10; Description=AP2 domain
MAAANSGKFDVGDETHKNSRKGSESQDWEIEKGKCVDCSSSQRRQWKPVFDDVSISYNRPFKKIRSPDRQNTNQSSSSSSSSSSSSSIPFQPSPLSNPPSRIVFPFAFDGSQQHPMQFPHQFGTTNPPFPHPSLQNQQHQMISFGSSQQHNNLAYPPIIASDSSSLLHQHHHHQQQHQQHQQQLLQYWSDALNLSPRGMLTRLGPDGRPLFRLPTQPINTTKLYRGVRQRHWGKWVAEIRLPRNRTRLWLGTFDTAEDAAMAYDREAFKLRGENARLNFPELFLNKDKKEEQQQQEQEASSPVLSAIAKQHEPSSEHRDVPIEESNENDSGDATVSDDQVHATTESSEGVSQEMVWGEMSAWFNAIPAAWGPGSPMWDDLDATNNLLCQSHIPFSNPNQQELNDAERQEQNTGPGYLWKDQD

SEQ ID NO: 208952 - protein, 685 aa, Glycine max
  Coding DNA Sequence Number=SeqID_92174
  Homolog annotation: Hit_ID=Q3LHL2; Match level="QueryCoverage=23%, HitCoverage=26%, E-value=2e-20, Identity=34%"; Hit description =Hypothetical protein PPS5
  Pfam annotation: Domain name=DUF292; Domain location=21-141; Score =198.3; E_value=1.8e-56; Accession=PF03398.5; Description=Eukaryotic protein of unknown function, DUF292
MFDIFFGWSKASKCKKAIKRARCRLRLLKNKRQAIARQLRKDLAELIQSGHEETAFNRVEQLMGDESLAAAYELLDHFCEFILTELSYIRRHKDCPNDINEAVSSLIFASARCGDLPELGVIRKLFGQRYGERFATTAVELSPGNLQSVISLLYEISYLLMMDTYSWNFKTKLKENLSAKSVPDDMKYRMVDEIARDNCLQQQVLAIQYYPDWQQVQEKENKGYQLVESDAKIIDTIGGSKVQPSEIKRDVRCVTISKPSDSCSLPESSLADTSAMVSAVQQYPPYFLRYPMEKKVVEIDFPDLLSSINFDLQNKGERMALISSAQRVSFPPCSEEMVDYVDDIKEFSVPNNAACQDQMLFKFRSSGLSRREKTQFDFDDSEMGQDGSESENSSTRTSTKSKRRPEKKSRRRSSSMENLGLMDIGYVIYYHKPCKSPLAQKHRSRKHHKPSLEGISPSSYGQKRLMLHGFSEEGNVLQSSHSQDGTRRKLFNFKMSGCSLDQPCYFCVYDDEDYLEAQSMKQKRGIRATHVQQGVLHDECCCCQPFWDDELNQGIELVTIPQRPNRRNYSASAEYHVFNYTDCQAGNGNNETKEEISASPKVSNPRTGGSSPIIETEATYSRAMTMPQERHRNNKDKMLRTYSCPSPHPSHVHPKLPDYDDIAAKFTALKRERMENMDCSKDQNK

SEQ ID NO: 208953 - protein, 320 aa, Glycine max
  Coding DNA Sequence Number=SeqID_92175
  Gene Ontology: Mol. function=calcium ion binding; Biological process =cell wall catabolic process
  Homolog annotation: Hit_ID=Q2QXG8; Match level="QueryCoverage=99%, HitCoverage=66%, E-value=3e-96, Identity=54%"; Hit description=TLD family protein, expressed
  Pfam annotation: Domain name=TLD; Domain location=140-284; Score =223.4; E_value=4.9e-64; Accession=PF07534.6; Description=TLD
MSHQDIFNIFLNAANFSKHDEGGTEETMSFEDFRSWCTHLPSVRKLLGSLLLSPDSGEVVDTIIRRINFMCLQKLMWDDKNATELGTLGFQLWCTGRPGYQIPKLLTSKAIDSNIILLRKEYAWHIGGALSHQDLEDWNLLYHSSLNGLSFNTFLGNISNHAGPTVLIIKDKEGYIYGGYASQPWERHADFYGDLKCFLFQLNPVASIFRPTGANNNLQWCAINFSSEDIPNGIGFGGRVNHLGLFISANFDQGHTFSCTTFGSPCLSKTNRILPEVIECWGVTQDATQDKNDAVKGTILERFKEDRNMLKMVGLANSSE

SEQ ID NO: 208954 - protein, 1041 aa, Glycine max
  Coding DNA Sequence Number=SeqID_92176
  Gene Ontology: Mol. function=binding; Cellular component =intracellular; Biological process=nuclear mRNA splicing, via spliceosome
  Homolog annotation: Hit_ID=Q8W3F7; Match level="QueryCoverage=99%, HitCoverage=99%, E-value=0.0, Identity=73%"; Hit description =Putative pre-mRNA splicing factor
  Pfam annotation: Domain name=HAT; Domain location=431-463; Score=1.1; E_value=18; Accession=PF02184.7; Description=HAT (Half-A-TPR) repeat
  Pfam annotation: Domain name=HAT; Domain location=492-524; Score=4.2; E_value=5.2; Accession=PF02184.7; Description=HAT (Half-A-TPR) repeat
  Pfam annotation: Domain name=HAT; Domain location=632-664; Score =11.9; E_value=0.22; Accession=PF02184.7; Description=HAT (Half-A -TPR) repeat
  Pfam annotation: Domain name=HAT; Domain location=815-847; Score=3.2; E_value=7.6; Accession=PF02184.7; Description=HAT (Half-A-TPR) repeat
  Pfam annotation: Domain name=HAT; Domain location=947-979; Score=0.7; E_value=21; Accession=PF02184.7; Description=HAT (Half-A-TPR) repeat
  Pfam annotation: Domain name=PRP1_N; Domain location=102-266; Score =288.6; E_value=1.2e-83; Accession=PF06424.3; Description=PRP1 splicing factor, N-terminal
  Pfam annotation: Domain name=TPR_2; Domain location=387-420; Score =14.9; E_value=0.3; Accession=PF07719.7; Description=Tetratricopeptide repeat
  Pfam annotation: Domain name=TPR_2; Domain location=753-786; Score =4.5; E_value=9.9; Accession=PF07719.7; Description=Tetratricopeptide repeat
  Pfam annotation: Domain name=TPR_2; Domain location=835-868; Score =7.0; E_value=5.1; Accession=PF07719.7; Description=Tetratricopeptide repeat
  Pfam annotation: Domain name=TPR_2; Domain location=869-902; Score =8.6; E_value=3.3; Accession=PF07719.7; Description=Tetratricopeptide repeat
  Pfam annotation: Domain name=TPR_2; Domain location=933-966; Score =11.2; E_value=1.7; Accession=PF07719.7; Description=Tetratricopeptide repeat
  Pfam module annotation: Pfam domain module=HAT::HAT::HAT::HAT::HAT::PR P1_N::TPR_2::TPR_2::TPR_2::TPR_2::TPR_2; Domain location=431-463::492- 524::632-664::815-847::947-979::102-266::387-420::753-786::835 -868::869-902::933-966
MVFIVSPNHKTFSIDLNPNTTTLHLLKLAIQQTLTLPISHQRLFLSHSRRLTADNDGSDDSLLISDLGVGPYSTLTLHVPFLGGTNPPAVPKPRFDFLNSKPPPNYVAGLGRGATGFTTRSDIGPARAAPDLPDRSATTIGGTSGAGRGRGKPGEDEDDDEGEDKGYDENQKFDEFEGNDVGLFASAEYDEDDKEADAVWEAIDKRMDSRRKDRREARLKQEIEKYRASNPKITEQFADLKRRLYTLSPDDWQSLEKFESGGYSSRNKKKRFESFVPVPDTLLEKARQEQEHVTALDPKSRAANGTETPWAQTPVTDLTAVGEGRGTVLSLKLDRLSDSVSGMTNVDPKGYLTVLNSMKITSDAEISDFKKARLLLKSVTQTNPKHPPGWIAAARLEELAGKLQVARQLIQKGCEECPKNEDVWLEACRLANPDEAKAVIARGVKSIPNSVKLWMQASKLENDDANRSRVLRKGLEHIPDSVRLWKAVVELANEEDARLLLHRAVECCPLHVELWLALARLETYDNAKKVLNRARERLSKEPAIWITAAKLEEANGNTSMVGKIIERGIRALQREGVVIDREAWMKEAEAAERAGSVVTCQAIIHNTIGVGVEEEDRKRTWVADAEECKKRGSIETARAIYAHALTVFLTKKSIWIKAAQLEKSHGTRESLDALLRKAVTYRPQAEVLWLMGAKEKWLAGDVPAARAILQEAYAAIPNSEEIWLAAFKLEFENHEPERARMLLAKARERGGTERVWMKSAIVERELGNIEEERRLLDEGLKQFPSFFKLWLMLGQLEEQLAENAKRLDQPEKWLDHMNAAKKVYESGLRNCPNCVPLWLSLANLEEEMNGLSKARAVLTMARKKNPQNPELWLAAVRAELKHGYKKEADILMAKALQECPNSGILWAASIEMVPRPQRKTKSADAIKKCDHDPHVIAAVAKLFWLDRKVDKARTWLSRAVTLAPDIGDFWALLYKFELQHGTEENQKDVLKRCIAAEPKHGEKWQAISKAVENSHQPTESILKKVVVALGKEENAAENNKH

SEQ ID NO: 208955 - protein, 294 aa, Glycine max
  Coding DNA Sequence Number=SeqID_92177
  Gene Ontology: Mol. function=oxidoreductase activity; Cellular component=membrane; Biological process=metabolic process
  Homolog annotation: Hit_ID=O50038; Match level="QueryCoverage=91%, HitCoverage=92%, E-value=3e-76, Identity=55%"; Hit description=Short chain alcohol dehydrogenase
  Pfam annotation: Domain name=3Beta_HSD; Domain location=28-257; Score= -147.1; E_value=0.04; Accession=PF01073.9; Description=3-beta hydroxysteroid dehydrogenaseisomerase family
  Pfam annotation: Domain name=Epimerase; Domain location=27-273; Score= -35.8; E_value=0.00079; Accession=PF01370.11; Description=NAD dependent epimerasedehydratase family
  Pfam annotation: Domain name=KR; Domain location=26-195; Score=-82.9; E_value=0.015; Accession=PF08659.1; Description=KR domain
  Pfam annotation: Domain name=adh_short; Domain location=25-200; Score= 74.4; E_value=3.5e-19; Accession=PF00106.15; Description=short chain dehydrogenase
  Pfam module annotation: Pfam domain module=3Beta_HSD::Epimerase::KR::a dh_short; Domain location=28-257::27-273::26-195::25-200
MFLLRRSTLQEYLPFQACTCRLDGKVALITGGASGIGEATAKLFLRHGAKVVIADIQDNLGHSLCQSLNSSDKNNNDDISYVHCDVTNDKDVETAVNAAVSRHGKLDILFSNAGITGRSDCSNSITAIDSGDLKRVFEVNVFGAFYAAKHAAKVMIPRKKGSIVFTASIASVSNAGWAHPYAASKNAVVGLMKNLCVELGKHGIRVNCVSPYAVGTPMLTRAMRMEKEKAEEIYLEAANLKGVVLKEKDVAEATLFLASDESKYVSGVNLVVDGGYTTTNSSSKQAFTKFSFNV

SEQ ID NO: 208956 - protein, 101 aa, Glycine max
  Coding DNA Sequence Number=SeqID_92178
  Homolog annotation: Hit_ID=Q5JKX2; Match level="QueryCoverage=35%, HitCoverage=18%, E-value=2e-07, Identity=77%"; Hit description =Alanine racemase-like
MNIEDNGGLRVLAINILGRFLSNRDNNIRECFGNPWHPGGVLNLAMVESVDNQKVANHLDRMVSTLGRNPLKVLVQVNTSGEESKSGIDPSKCEEHYFYIL

SEQ ID NO: 208957 - protein, 69 aa, Glycine max
  Coding DNA Sequence Number=SeqID_92179
MDSAFSHPYMHIHEAPKDTRPPLIHLLSAYIRCKIIIGTNHTCNNTRVMAYLGKACKDLNISRSLASIL

SEQ ID NO: 208958 - protein, 84 aa, Glycine max
  Coding DNA Sequence Number=SeqID_92180
MESVLTASGLSSFCCASPPCPSIWSFERVWGVVKLEISALVCYLSTKKKLLSQLKISIAEEGSLVNSCGRTSFARLHGRRFFHN

SEQ ID NO: 208959 - protein, 323 aa, Glycine max
  Coding DNA Sequence Number=SeqID_92181
  Gene Ontology: Cellular component=clathrin vesicle coat; Biological process=intracellular protein transport
  Homolog annotation: Hit_ID=Q9SKU1; Match level="QueryCoverage=73%, HitCoverage=70%, E-value=1e-49, Identity=45%"; Hit description =Expressed protein
MASFEEQSHQSPTRGPFDDDNSYTDTDMGMGYESHQHYDYDDQHPQLNVDPNNNNFTDNSHSPSVYGFGVSTPNPDHVSPFEPATADDTTFTSDGPMLPDPSQMQEEGHARREWRRLNAIHLEEKEKREKEMRNQIIKEAEEYKEAFYEKRKVNCEKNKENNREREKIYLANQEKFHKEAHNHYWKAIAEIIPREVPNIEKRRGKKEAENKPSVHVIQGPKPGKPTDLARMRQMILKLKQNPPSHMMPPPPKEEKDSKEGKDNKNAKEGKDDKGGKSSTPTATTGVVGNKPTSPAKDVAPEGEAQDPAIVEGEQVASSEPKAA

SEQ ID NO: 208960 - protein, 95 aa, Glycine max
  Coding DNA Sequence Number=SeqID_92182
MAEEARRKEKKWTPEERKEARGRRNLNSCWGYERKNKTGKVTRLLTPLERMIVNAIEKLDEVKKDEIEECLLYPGAQKLKAIVNEKMEEWKGDTT

SEQ ID NO: 208961 - protein, 99 aa, Glycine max
  Coding DNA Sequence Number=SeqID_92183
MAMKHDAIVHFASCLRKNGAIDDSDRMVRGSRLLSVVQDRAPDVMVLEGVGRCPRRVRRGAKELKRTVSTTCDATRRMVGFDEVVLEVGCGGGVVVRTR

SEQ ID NO: 208962 - protein, 212 aa, Glycine max
  Coding DNA Sequence Number=SeqID_92184
ALPDCKSSLVSCIAGKYALRFLSFGLVVEEFKVTLKLVGEIGDNCLRLFWTTYGEIETKECSRSAISSSILQFNKLVPGLNCDGSKSGSIAAAGGLLRDHMGNSCGYKFLKVESDSLSTIDLLAKDCLVSHPCSSLVHDIKEFGLNKGVYTWSQTLREGNQPADLVTTYGLQLQEQLRVFEFVPSFIFFAVHVLADLNSTVFPRVLVCFFEA

SEQ ID NO: 208963 - protein, 501 aa, Glycine max
  Coding DNA Sequence Number=SeqID_92185
  Gene Ontology: Mol. function=nucleic acid binding; Cellular component= intracellular
  Homolog annotation: Hit_ID=Q337G3; Match level="QueryCoverage=98%, HitCoverage=99%, E-value=1e-99, Identity=40%"; Hit description =Expressed protein
MAGKLELGPPKSDVSNPKEQAARKILKIVRSQGHPYVELRENGKKFIYFCTLCLAPCYSDDVLFDHLKGNLHKERLSAAKVTLLGPKPWPFNDGLVFFDTSTESHKELEVADSYQNRLLKFNDNDVSLAIVKFGDGVQSNAKPRSIDGMQDDEYALVIPNLLIGDEIFDVKVREVGLGKIAARFLEKCHALNGIKRIWCEWLGKESNGERDGVEVLEHDFAVVIFAYNYDLGRSGLLDDVNTLLPSASGGQKGKSSLSDFDDVSDSVCNQYDSSAEESSDSNNSSSRLTLDQFNNHLCTRFISSKALRKELRRKQRLAAEKVCNICQQKMLPGKDVAALLNLKTRRVACSSRNRTGAFHVFHTSCLIHWIILCEFEIITNHLVCPNVRRVVKRKVASDGNKIGKEKDIGKHIRTVFCPECQGTGMIIDGDGVEQPEFSLSQMFKFKIKACDARRDWIKSPEVLKNCSTGFHFPSQSEEIFEEKVEPINLLHFYRADDQSWA

SEQ ID NO: 208964 - protein, 1853 aa, Glycine max
  Coding DNA Sequence Number=SeqID_92186
  Pfam annotation: Domain name=GYF; Domain location=587-642; Score =47.5; E_value=4.4e-11; Accession=PF02213.6; Description=GYF domain
  Subcellular localization annotation: CTP_CleavageSite=14; ConfidenceScore=5.06e-01
MADRASASTRLHISAAPPFPISKGYAFHFVSLFEFRVLLRLRVVTLLCVCLVIHWKRKSHHTFASIVKKISEAIICSFWLNVDQVFPDAYYGVCLGIFVRFGLMYPDFHGPDNPIPLSPQWLLPKPGESKPAIGTVENHVISTPPNGNRSETVKTSGNGEDVNDDHKRKDVFRPSMLDSKSGCRERWRDEERDTKSSIHKNRWRNGDKNLSDTQRMDQRTENPSTRHFGEARRGTSDRWNDSGNRDTNFEQRHESKWNTRWGPDDKAPEGLREKRSSPGKDSDRHVDKGLPNISNLVKDEKEGDHYRPWRRNSSQSRGRVEPTHHQNGMPNKQVSALPYGWGHGEDTPPVIAFGRARLGSGGSSINSTYMHSQYPGTLLDKVESEQGEARPFRYSRTNLLDDEPLEPLALCSPNSEELSVLKDIDKGEIISSSAPQLPKDGRNSTEFTHSRRMKPVNAPFQDRVEDNDSYRMADEVPSNKESTFEESHSAHHGATWRGTPLGEHAGTLMHDGRDVSSDIKSRNSDMSWSHQPKNTHAQWEHNLDYLSETRDVTKWQSSGDPIKRQLSGILDSEFESRRIQQICPEELSLFYKDPQGRIQGPFKGIDIISWFEAGYFGIDLPVRLENAASDSPWLQLGDAMPHLRAKARPPPGFSAAKLDSSEASGRPYSSTFGNMHSGLSEVEMLRNDSMHRSSTTEAENRFLESLMSGSKSSSPLSSLTLSEGLQGFLGNDSGNLGPSGVDSGINLYLLAKRMALERQRSLPNAYPYWPGRDAAPLPPKSDIFPDASPHSNMLSSLSDNSRLLQSQSSELMSIIQGLSDRSSTCLNSGIAGWPNFLLQGGLDPPIQNKIDLQGGLDPPIHDQNYVQMPFGIQQQRLQTLNQLPLNNLIAQNSDIPSSILTAEKLLSSGLSQDPEMLNMLQQQHLLQLHSQAAVAPSQQLHSQAAAPSQTMPLLDKLLLLKQQQQQEEQQLLLRQQQQLLSQVLQEHQSHQRFGNLSYQQFQGGGIPLGNLHVNLSQIQPPKEIFPMSSQTPIPSVQGELTTNSLDLPLQVSQDTSYNISSESSAQLSDQLFENIGDQKSWSATLPEQINDNYQKETLPVSASVEGSLLLEQSRAKEEPGNAQKLLPFSDYTAKTLEQMPDNTCRNDDTLVSATSESDENSQPIQCVTPAVDMSSAASCGTELPLVSQLSEDVEIKSDSLEEHHGGRESSKIDPSVVDVRSIEVREPKKTAEKKSKKQKSSKSQSSGQAKGLLKNVPLQQSKKSEPEKPNYSEANKGEPAHETFMQQTKGKDKQSATATAETDDNQEVSGLPTNIPGSNTKTVIENELKAVSSVATQNTELPSARAWKPAPGFKAKSLLEIQLEEQKKSLTEKLVSEVATPVNSMSSTTPWVGVVANPDSMKVSNDGHREAENTEYLAKAEKSQNSKSKKSPLHDLLAEDLVPKSSERDGKVPDSMLPSQNIAVHSKLVDDGDFIEAKDTKRSRKKSAKLKSSGAKVSMPVASSEVPISPIHIEKVKSSRSVQQEKEQLPSIPSGPSLGDFVLWKGEPTSPSPPPAWTTDSARIPKPTSLRDILKEQEKKSSAVLPNQLPTPQKSQTAQAARSSGSSRPISASSPSKTAPSSQINSQASLSKYRGDDDMFWGPVEQSKQENKQSNFPQLARQGSWGSKSVPMKGNSPGSLSRQKSGSGKPTEQSLSSSPASSQSLLKLKKDAMTKNSEAMDFRVWCENECARLIGTKDTSFLEFCLKQTRSEAEIFLTENLGLYDHDHEFIDKFLNYMDLLPSDVLEIAFQTVNDRKVDANTDVLELGYTDGSFSKVGKKKGGNKGKKVSSSVLGFNVVSNRIMMGEIQTVED

SEQ ID NO: 208965 - protein, 445 aa, Glycine max
  Coding DNA Sequence Number=SeqID_92187
  Gene Ontology: Mol. function=protein dimerization activity; Cellular component=nucleus; Biological process=regulation of transcription, DNA-dependent
  Homolog annotation: Hit_ID=Q1T3H7; Match level="QueryCoverage=88%, HitCoverage=89%, E-value=6e-53, Identity=40%"; Hit description=Zinc finger, BED-type predicted; HAT dimerisation
  Pfam annotation: Domain name=hATC; Domain location=343-424; Score =130.4; E_value=5e-36; Accession=PF05699.5; Description=hAT family dimerisation domain
MGDQDEASATSEHVVPIPLAVSNIANYENGTSAMHAHLKRCKDNLDKDGNKRQKSALSSTAIVEANVSSSPSYAKFDQEACHNELVKMFVVIGLPFYFVENEIFRKFLSLLQPRFSVPSRIALVRHILTLWDTERTNLKKFLSEHYQRVCLTIDMWSSSQVTSHSVEVMAKTVELCMNGWGLSGVFSATVDNALPNDEGLEDIDGSISRIRAAVKYIRWDSTYLMLEAALMNQEAFVELQNKKYDDELRKGEGVPTYEDWDNARLILPFLNIFYKATLRISSPSDVTGNIYMLESLFEEYNGPNGGSLSGSQKTSFNEDGNDDPYSWNQFLQSTGCKSNAKSELDKYLEESVETSSDLDVLNWWKLNSNRFPILANIAREMLAIPVSAVATEYVFNVGGRVLDPYRSSLTPKMLEAHVCLQNWLKGTPFSLFSNEDFEELLKIEQ

SEQ ID NO: 208966 - protein, 178 aa, Glycine max
  Coding DNA Sequence Number=SeqID_92188
  Gene Ontology: Mol. function=carbohydrate binding
  Homolog annotation: Hit_ID=Q10NJ9; Match level="QueryCoverage=87%, HitCoverage=35%, E-value=4e-45, Identity=55%"; Hit description =Lipase, putative, expressed
  Pfam annotation: Domain name=DUF620; Domain location=1-168; Score =229.6; E_value=7e-66; Accession=PF04788.3; Description=Protein of unknown function (DUF620)
MSGCYYYQGLDPRCTANLFLDAECVGENNINNEVCFMLRLQTDQHILQAQSMSNTEIVMHTMLGYFSQRTGLLVKFEDTKLVKMKAVKGKETVFWETSIESMIDDYRYIDGINIAHGGRTIATLYRYGAAHNHKHMIEETWTIEEVDFNIVGLSMDCFLPPSDGEREHEGAEQAVGMG

SEQ ID NO: 208967 - protein, 67 aa, Glycine max
  Coding DNA Sequence Number=SeqID_92189
  Gene Ontology: Mol. function=zinc ion binding
  Homolog annotation: Hit_ID=Q23NB3; Match level="QueryCoverage=76%, HitCoverage=6%, E-value=2e-11, Identity=48%"; Hit description=IBR domain containing protein
  Pfam annotation: Domain name=IBR; Domain location=4-60; Score=0.9; E _value=0.015; Accession=PF01485.11; Description=IBR domain
MDEKEMDKKFFKLAKEENWQKCPKCTMFVQSSGGCEHITCRCGRNFCYICGENWEFGHLCKKHPSTT

SEQ ID NO: 208968 - protein, 90 aa, Glycine max
  Coding DNA Sequence Number=SeqID_92190
MEIQEDQEVVHQVLNELKNILNLHDRDLPYYLGSARLVNRELWCTDIGACVISVVYVNRHLGYESFSTLILVHSPLTDLGIKVFAHHNRR

SEQ ID NO: 208969 - protein, 244 aa, Glycine max
  Coding DNA Sequence Number=SeqID_92191
  Homolog annotation: Hit_ID=Q1SDF9; Match level="QueryCoverage=18%, HitCoverage=14%, E-value=3e-09, Identity=70%"; Hit description=Zinc finger, RING-type; Zinc finger, C6HC-type
  Subcellular localization annotation: CTP_CleavageSite=34; ConfidenceScore=5.34e-01
MVLLLSIVTSKTHHGLSLRQRFTSIVSNLTSSFSAAPSSSVHELRQPLPPWGEKKSGDHQLFNRVVVEKKKNAPLIIMITMKQRRVTSPRSSFVIYVLMRNQSLICSKRPECLRAVLPREVIVRWECGMFESLTVGSVKTYGPFKDCSVLLVKDGGVVVTSAECSSCHRLFCAQFATQFAIAEYSQPVPQSQPQALANNTTTSPPLADSGDVFFDVWGSVRQGQGKLITSGGCNCFLFAKRFFN

SEQ ID NO: 208970 - protein, 296 aa, Glycine max
  Coding DNA Sequence Number=SeqID_92192
  Gene Ontology: Mol. function=zinc ion binding; Cellular component =integral to membrane; Biological process=protein modification process
  Homolog annotation: Hit_ID=Q6ERQ9; Match level="QueryCoverage=69%, HitCoverage=53%, E-value=1e-48, Identity=42%"; Hit description =Putative ubiquitin conjugating enzyme 7 interacting protein 4
  Pfam annotation: Domain name=IBR; Domain location=159-221; Score =47.0; E_value=6.5e-11; Accession=PF01485.11; Description=IBR domain
  Pfam annotation: Domain name=zf-C3HC4; Domain location=90-140; Score =4.3; E_value=0.057; Accession=PF00097.15; Description=Zinc finger, C3HC4 type (RING finger)
  Pfam module annotation: Pfam domain module=IBR::zf-C3HC4; Domain location=159-221::90-140
MTSKTQHCVIRGHHKSTHFNGICASCLRERLAAIASSSSATPELDLTIKSSFPFDPLGLETPRCSPRRQKKKSLLDHDDSGEDQPSFFLCDICFDDKPVSDMFEEGKCNHLFCTHCMSKYVTTQIQQNILKVIMCPNANCSVELKPEYFHNILASEVIVRWETVMCESMIVELEKTYCPFKDCSVLLVNDGEKVVTSAECPSCHRLFCAQCKVPWHGSMSCEEFQEIERNKDEKVLENKFFKLAKEEKWQKCPRCTMFVQRREGCDHMTCRCGCDFCYICGKNWMLVHNCKKNPST

SEQ ID NO: 208971 - protein, 543 aa, Glycine max
  Coding DNA Sequence Number=SeqID_92193
  Gene Ontology: Mol. function=calcium ion binding; Cellular component =mitochondrion; Biological process=metabolic process
  Homolog annotation: Hit_ID=Q1SQX3; Match level="QueryCoverage=98%, HitCoverage=79%, E-value=3e-67, Identity=28%"; Hit description=IMP dehydrogenase/GMP reductase
  Pfam annotation: Domain name=PPR; Domain location=112-145; Score =13.5; E_value=0.19; Accession=PF01535.11; Description=PPR repeat
  Pfam annotation: Domain name=PPR; Domain location=146-180; Score =33.5; E_value=7.2e-07; Accession=PF01535.11; Description=PPR repeat
  Pfam annotation: Domain name=PPR; Domain location=181-215; Score =44.4; E_value=3.8e-10; Accession=PF01535.11; Description=PPR repeat
  Pfam annotation: Domain name=PPR; Domain location=216-250; Score =33.9; E_value=5.6e-07; Accession=PF01535.11; Description=PPR repeat
  Pfam annotation: Domain name=PPR; Domain location=251-285; Score =42.1; E_value=1.9e-09; Accession=PF01535.11; Description=PPR repeat
  Pfam annotation: Domain name=PPR; Domain location=286-320; Score =33.6; E_value=7e-07; Accession=PF01535.11; Description=PPR repeat
  Pfam annotation: Domain name=PPR; Domain location=321-355; Score =48.1; E_value=3e-11; Accession=PF01535.11; Description=PPR repeat
  Pfam annotation: Domain name=PPR; Domain location=356-390; Score =39.9; E_value=8.5e-09; Accession=PF01535.11; Description=PPR repeat
  Pfam annotation: Domain name=PPR; Domain location=391-425; Score =44.9; E_value=2.8e-10; Accession=PF01535.11; Description=PPR repeat
  Pfam annotation: Domain name=PPR; Domain location=426-460; Score =38.6; E_value=2.2e-08; Accession=PF01535.11; Description=PPR repeat
  Pfam annotation: Domain name=PPR; Domain location=461-495; Score =50.2; E_value=6.8e-12; Accession=PF01535.11; Description=PPR repeat
  Pfam annotation: Domain name=PPR; Domain location=496-530; Score =26.8; E_value=7.9e-05; Accession=PF01535.11; Description=PPR repeat
  Pfam annotation: Domain name=PPR; Domain location=77-111; Score=12.5; E_value=0.24; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=112-145::146 -180::181-215::216-250::251-285::286-320::321-355::356-390::391 -425::426-460::461-495::496-530::77-111
  Subcellular localization annotation: CTP_CleavageSite=83; ConfidenceScore=5.08e-01
MVKVPPTKALLLFNTATYQGLQHTSHSISFILNHLLSSGMLPQAQSLILRLISGRIPSSLMLQLTQAHFTPCLTYTPLYDTIVNAYVHSHSTDQALTFLHHMIHEGHVPLSNTFNNLMCLLIRSNYFDKAWWIFNELKSKVVLDAYSFGIMIKGCCEAGYFVKGFRLLAMLEEFGLSPNVVIYTTLIDGCCKYGNVMLAKNLFCKMDRLGLVPNPHTYSVLMNGFFKQGLQREGFQMYENMKRSGIVPNAYAYNCLISEYCNGGMVDKAFKVFAEMREKGIACGVMTYNILIGGLCRGKKFGEAVKLVHKVNKVGLSPNIVTYNILINGFCDVGKMDTAVRLFNQLKSSGLSPTLVTYNTLIAGYSKVENLAGALDLVKEMEERCIAPSKVTYTILIDAFARLNYTEKACEMHSLMEKSGLVPDVYTYSVLIHGLCVHGNMKEASKLFKSLGEMHLQPNSVIYNTMIHGYCKEGSSYRALRLLNEMVHSGMVPNVASFCSTIGLLCRDEKWKEAELLLGQMINSGLKPSVSLYKMVHKVKGDV

SEQ ID NO: 208972 - protein, 418 aa, Glycine max
  Coding DNA Sequence Number=SeqID_92194
  Gene Ontology: Mol. function=nucleic acid binding; Cellular component= intracellular; Biological process=regulation of transcription
  Homolog annotation: Hit_ID=Q9SCQ6; Match level="QueryCoverage=94%, HitCoverage=81%, E-value=6e-73, Identity=46%"; Hit description=Zinc finger protein
  Pfam annotation: Domain name=RS4NT; Domain location=68-105; Score =13.5; E_value=0.049; Accession=PF08071.2; Description=RS4NT (NUC023) domain
  Pfam annotation: Domain name=zf-C2H2; Domain location=110-131; Score =15.8; E_value=0.16; Accession=PF00096.16; Description=Zinc finger, C2H2 type
  Pfam annotation: Domain name=zf-C2H2; Domain location=83-105; Score =22.2; E_value=0.0018; Accession=PF00096.16; Description=Zinc finger, C2H2 type
  Pfam module annotation: Pfam domain module=RS4NT::zf-C2H2::zf-C2H2; Domain location=68-105::110-131::83-105
AVGDEPCRVRDLQQRLQRDQNLQLHRRGHNLPWKLRQRGSKEPQKKAYVCPEPSCVHHNPARALGDLTGIKKHFCRKHGEKKWQCERCSKKYAVHSDWKAHMKTCGTREYRCDCGTLFSRRDSFITHRAFCDVLAQESARAQDQAQGGSSNSYVVVVSSSPPTPPLTPSASVVSPTLSIQSSEIPENPSTKVSPTSPNASCFVTSSSSTPSSTTSVFASVLAPSTTPTTPSQSPSNSTCSFSNLMSNLARSENSNALMREPTSLSLSTPPYHSNNDPLHYTALPQPALSATALLQKAAQMGASNASLLRGLGLARTSSSFGKDEGVNINATTTLQWNGQVKQENHPVVDNLGLGLPCGSGSVPDVMMGPTTPFVGQPMTRDLLGLSVGGGATSRGGLSALLTSFGGNFDSPSEGGVHR

SEQ ID NO: 208973 - protein, 730 aa, Glycine max
  Coding DNA Sequence Number=SeqID_92195
  Gene Ontology: Mol. function=heat shock protein binding; Cellular component=integral to membrane; Biological process=chloroplast accumulation movement
  Homolog annotation: Hit_ID=Q10QF7; Match level="QueryCoverage=91%, HitCoverage=98%, E-value=2e-36, Identity=27%"; Hit description =Expressed protein
MERFYSSQRESLLLGYNNDYINSLIPRSSSSDSNSEVDFTDVFGGPPRRSSVNEARQTVGELSEEEGERGWCRWPPEREKPVFGEDSGNRRRHPTNKNSDFFDDIFGGEASGSVCSTPKKRVGDAFALSRVSSPLPLPPAADPVVGSLPATFSLPAKLTNGVDLPTFGSSTRNRNLSNINDGIVASNGLKPYRQSLLSQEFSNSSTSDKADKGSIMKQNISISEGSPGASNGQFHFSIYKWASKGVPMVMPLRTERNSRNKDKAKLERCSSAKEWIVSEITTQNPIEYNGSPLMNNRKQDVPTTSTPTENGSDSNQIVEQIVSAKTQSDKSSSPQTITKDVPTSSISHDAREVESSTRSTGEIGFSGKTEAAKETQKREPKPLQFLFKESDKKQDNDETITREREENRMKSSKKLSAVFDVTVNPIKQEEKTVPLRDVGRSKAISQGSVSLGENMGKGLVKGKVKEFARIFNQEAVTKPKFDSNSRSQGSTYKKREALRAKNEVEGGPEQSKKYNSATETTNISANILSHEEDISEPEIPDISFTVIGDKDESFHGSFMIQVLAQDEDEVLQNQENQEIQTIDNKIKQWSKGKEGNIRSLLSTLQYDSSVAVMHSKYMIKVGIMGVLGSLDKVLWPECGWKYVPLVDIIEGNAVKRSYQRALLCLHPDKLQQKGASSDQKYIAEKHYKILSLSGSMFTFLKIGHTFHCITFFYFELETGRHFWNFLKQEQ

SEQ ID NO: 208974 - protein, 279 aa, Glycine max
  Coding DNA Sequence Number=SeqID_92196
  Homolog annotation: Hit_ID=Q1SDG1; Match level="QueryCoverage=30%, HitCoverage=7%, E-value=7e-17, Identity=46%"; Hit description =Integrase, catalytic region; Zinc finger, CCHC-type
MDKSLKVGEDEWREKERRSTKYYASNELWFSLLIQDQVQDSPLSVFRCHEASHGPKIYPKAHENPRGVRLHKASTQQEVQAEVRKPTRHIMRRNNPKIHIIGDPADYVQTGLSLRTQGHIALISKMEPKHIDDAMQDDNWVKVMQEEKHQHREKKNKGSLKKKSKAYVTWDDNETKTSNDNSEEEEPNLCFMANNNVESEVNLATDKQLWYLDNGCSRHMIGDKSKFMSLKAKEGGFVIYGDNNKGRILGVAILAIPMLNVKSASHSNMACLISNVDPS

SEQ ID NO: 208975 - protein, 84 aa, Glycine max
  Coding DNA Sequence Number=SeqID_92197
MVWLLQSFFFLLHSAAIDVQKEKDSIDEEDPRPTSSTWSYINATISRSYLDEVVAIELSSSRKSAKDPSSSDRSLSDLFSSNLT

SEQ ID NO: 208976 - protein, 146 aa, Glycine max
  Coding DNA Sequence Number=SeqID_92198
MEKGQVTADIGRGQKRGVARHNGNKEGKRIVEESNDKIQNPSQHGSEVCTKAQSLLIRSWGRVMHGLIDYVLSVSFEEPRRILITQGKKKIKKAKRIYDDGTKIGISYKECEGETVWQIEAMEKRGQQQLKKATNAQRRENDLSDQ

SEQ ID NO: 208977 - protein, 134 aa, Glycine max
  Coding DNA Sequence Number=SeqID_92199
MVGNMGVWIEDEWKWEFKWRRGWFEWEGVMVENFMNEVRGITLRKMEKDEWENYAGHQVFCLVMVKEYGRWVELLIEVVPESNKHENAGELPGNHITRETSKRVGLRPQKETTPENLAFHGFKQKTQLKHEAET

SEQ ID NO: 208978 - protein, 177 aa, Glycine max
  Coding DNA Sequence Number=SeqID_92200
  Gene Ontology: Mol. function=RNA-directed DNA polymerase activity; Biological process=RNA-dependent DNA replication
MEDVLMVGRRFTWYRPNGSAKTRINRVLVTRERISQKGGSTQYVLDRNISYHCSIVLKDTTIDWGFKPFRALDCWWDDKGVVKFVVEFWSSMEVEGWGEYVLKEKLKRLKMKLKVWYKEHFGFVQNRGQIVQNEINDLEMRKVNLFYPHLFDYLPLMLHDDKPILPTYLPNSFAKIQ

SEQ ID NO: 208979 - protein, 84 aa, Glycine max
  Coding DNA Sequence Number=SeqID_92201
  Homolog annotation: Hit_ID=Q4W5U8; Match level="QueryCoverage=55%, HitCoverage=6%, E-value=9e-14, Identity=82%"; Hit description=FtsH protease
  Pfam annotation: Domain name=Peptidase_M41; Domain location=3-84; Score=-137.8; E_value=0.022; Accession=PF01434.8; Description =Peptidase family M41
MSNWNHRGCSSETEITTGAAVDLQQITQIARQMVTKFGMSEIGPWALTDPAVQGHHVLYYKHYTKLIIFDLDRLKESYSVVVRI

SEQ ID NO: 208980 - protein, 440 aa, Glycine max
  Coding DNA Sequence Number=SeqID_92202
  Gene Ontology: Mol. function=nucleic acid binding; Cellular component= intracellular; Biological process=DNA integration
  Homolog annotation: Hit_ID=Q1RWN2; Match level="QueryCoverage=94%, HitCoverage=51%, E-value=7e-78, Identity=40%"; Hit description =Peptidase S8 and S53, subtilisin, kexin, sedolisin; Integrase, catalytic region; Zinc finger, CCHC-type
  Pfam annotation: Domain name=rve; Domain location=105-249; Score =44.7; E_value=3.2e-10; Accession=PF00665.16; Description=Integrase core domain
  Pfam module annotation: Pfam domain module=RVT_2::rve; Domain location=353-440::105-249
MKIGEEEDEEEEEEEEKADQEDELLLMTYLDFKQGTTEEWFLNSGCSNHMSGNKDWFSELDENSRHAVKLGNDTRIVVMGKGSVWLNVNGVIHHRKPMPRKSLWRASNKHQLVHADICGPINPISSSNKRLKVLVEKEDGVSIGCLRTDRGGEFTSNEFGEFCKNHGIHRQLTATHTPQHNGVVERKNRIVMNMVSPTTIVQNKTPEEAWSGVKPIINYFRVFGCLAHVYIPDQHRVKLDDKSKKCVHLGNAEEQSVENVVESTGAQEIEDQKEDAENNSTGTDSYPNDSHIINYEALVEGWVRRNRREPVWMKDYERGEGLSDDNGLNVMMVTEDDPISFEEAIKSEKWRNAMMKEMEAIEKNMAWELTDLPRGVKPIGVNWIFKTKFKETGDINKLDTIRLILAIATRYSWNVFQLDVKSVPFFTVNLKRRSMCSNQK

SEQ ID NO: 208981 - protein, 499 aa, Glycine max
  Coding DNA Sequence Number=SeqID_92203
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=92%, HitCoverage=35%, E-value=6e-35, Identity=34%"; Hit description =Receptor protein kinase-like protein
  Pfam annotation: Domain name=DUF26; Domain location=209-263; Score =92.9; E_value=1e-24; Accession=PF01657.8; Description=Domain of unknown function DUF26
  Pfam annotation: Domain name=DUF26; Domain location=339-395; Score =58.4; E_value=2.4e-14; Accession=PF01657.8; Description=Domain of unknown function DUF26
  Pfam annotation: Domain name=DUF26; Domain location=453-499; Score =18.8; E_value=2.7e-05; Accession=PF01657.8; Description=Domain of unknown function DUF26
  Pfam annotation: Domain name=DUF26; Domain location=90-144; Score =64.0; E_value=4.8e-16; Accession=PF01657.8; Description=Domain of unknown function DUF26
  Pfam module annotation: Pfam domain module=DUF26::DUF26::DUF26::DUF26; Domain location=209-263::339-395::453-499::90-144
MVELSKSNTIMPSSKTLLLITNLTLLSFATTEAQNDPFYLYKDCSSDKTSPNTSFQFNLKNLLSSLSSNATRNTPFYNTTINGENPSDSIYGLFMCRADVSSHLCQLCVLNATQQLSSECSLSKQAVIWYEECMVWYSTSSIFSSVATTPSSPMKNSGKVPKPERFMRLVFRTINQTADEASFQSSIGNNKFATKEATNVSGISQTQTLYCLAQCTPNLSPHDCRTCLDDAIRKIQECCEGRIGGRVLFPSCNVRYEMYPFYNVRSATPVPKLIPETKTSHADSNLSEFPIYLSHNCTNKTFNANNSAFQTHLTTLLFNLASNATTGNKFYTADVANTVFGLFLCRDQEDLPSGLCGECVKNATHEISSKCGSFHEAIIWYSQCMLRYSYRNFFNEMETGPVFSELNTTNKDDEQNFFTMKLAKALDQAAIQAGDSDEKYGKRTTKLNDLQTLYALAQCTQNLSIEDCKGCLGIVIGTSIPWSRLGSIGGRVLYPSCNI

SEQ ID NO: 208982 - protein, 117 aa, Glycine max
  Coding DNA Sequence Number=SeqID_92204
  Gene Ontology: Mol. function=protein serine/threonine kinase activity; Cellular component=membrane; Biological process=protein amino acid phosphorylation
  Homolog annotation: Hit_ID=O81833; Match level="QueryCoverage=78%, HitCoverage=11%, E-value=7e-20, Identity=51%"; Hit description =Putative receptor protein kinase
MEIICGKRNRGRYSGKRYNLIDHVWTHWKLSRTSEIIDSNIEDSCIESEIIRCIHVGLLCVQQYPEDRPTMTSVVLMLGSEMELDEPKKPGVFTKKESIEAISSSSTNTLTITLSAR

SEQ ID NO: 208983 - protein, 200 aa, Glycine max
  Coding DNA Sequence Number=SeqID_92205
  Homolog annotation: Hit_ID=Q2R300; Match level="QueryCoverage=41%, HitCoverage=8%, E-value=3e-14, Identity=46%"; Hit description =Importin, putative, expressed
MNGGGDVWINENRFGIVRQLGEGGFAYVYLVKEAPNDSATASLAKKLKGSSHLSGHLPSLTYFDSPHCFSYLSSKIDLVDQDISLSLKQNPASYTQVLNASSRGLHRMGTVFSYLPISMATEPAADDSILSLLRVFWPILEKFFGSEHMENGNLSVAACRALSLAVRSSASIVIEEFGHLEEYGPLFVTSDDIPDIDKKK

SEQ ID NO: 208984 - protein, 460 aa, Glycine max
  Coding DNA Sequence Number=SeqID_92206
  Gene Ontology: Mol. function=protein serine/threonine kinase activity; Cellular component=anchored to membrane; Biological process=protein amino acid phosphorylation
  Homolog annotation: Hit_ID=O65482; Match level="QueryCoverage=92%, HitCoverage=41%, E-value=8e-32, Identity=29%"; Hit description =Serine/threonine kinase-like protein
  Pfam annotation: Domain name=DUF26; Domain location=164-218; Score =94.9; E_value=2.4e-25; Accession=PF01657.8; Description=Domain of unknown function DUF26
  Pfam annotation: Domain name=DUF26; Domain location=279-333; Score =72.9; E_value=1e-18; Accession=PF01657.8; Description=Domain of unknown function DUF26
  Pfam annotation: Domain name=DUF26; Domain location=394-447; Score =55.6; E_value=1.7e-13; Accession=PF01657.8; Description=Domain of unknown function DUF26
  Pfam module annotation: Pfam domain module=DUF26::DUF26::DUF26; Domain location=164-218::279-333::394-447
MASYKILFLFTLVSFLNFATIQAQEEESSTPVYLFHNCSGGNTTAYSTFQLNLWTLLSSLTSNAVSSTGFYNTTVIEANPSNSVFGLFMCRGDCTVHYSNRSFFSTVDTKPRVGLLNTANISNQESFMRLLFDAMNETADEAARPTTGNKFATRQTNISGFQRLYCLAQCTPDLSPNDCRTCLRTVIGDLPWCCEGKQGGRVLYPSCNVRYELYPFYRSEGEWVPSDSQFSEDSNYLYHNCKTNVTGSAFKMNLETLLSYMSSNAMNRMDYYEGVEDIVYGLFMFRRDLPSRLCQQCILNATQKISTECNSFQEAVIWYNHCMLRYSNRHFFSQVEKNPTFEILNLITTSDPASDQDFFTYTLTKTLVNVTEAARDRNERYVTKSTKLNDLQTLYTLAQCTQDLSTDNCVGCLDDINGKIPWSRVGIGGRVLYPSCNLRFELFQFYRDRDGAQQPSPELE

SEQ ID NO: 208985 - protein, 127 aa, Glycine max
  Coding DNA Sequence Number=SeqID_92207
  Gene Ontology: Mol. function=DNA binding; Cellular component=nucleus
  Homolog annotation: Hit_ID=Q1SCD0; Match level="QueryCoverage=60%, HitCoverage=39%, E-value=3e-25, Identity=67%"; Hit description =Homeodomain-related
MAHSRKSRSINKRFSTVRVATSSKDKITENASKNRLKVSPGIQKKRKLIDMLGPQWNKKELEHFYEAYSKYGKDWKKIDDLVDFGASEGGTIKMKRWLEATTSVERINTVKGQRNRDSGCNREEQHW

SEQ ID NO: 208986 - protein, 101 aa, Glycine max
  Coding DNA Sequence Number=SeqID_92208
  Subcellular localization annotation: CTP_CleavageSite=42; ConfidenceScore=5.04e-01
MSLFHSFPRLSRRSLHHRNQTHYATTCSPPPPCSSHHPHHVLQSVDSSFLPLFFWMEPMNIIGKAKEDASLPKVGAKVCCPLWFIMVHALSTEGKSSWTSI

SEQ ID NO: 208987 - protein, 188 aa, Glycine max
  Coding DNA Sequence Number=SeqID_92209
  Gene Ontology: Mol. function=sugar binding; Cellular component =membrane; Biological process=protein amino acid phosphorylation
  Homolog annotation: Hit_ID=Q40100; Match level="QueryCoverage=93%, HitCoverage=39%, E-value=6e-41, Identity=46%"; Hit description =Secreted glycoprotein 3
  Pfam annotation: Domain name=B_lectin; Domain location=37-149; Score =112.1; E_value=1.6e-30; Accession=PF01453.15; Description=D-mannose binding lectin
MSQRHCYIHCGVFELGFFSSGNSTKRYLGILYKNIPTGRVAWVANQNNPISDSSGILTFTSRGNLELKQNNSVVLVTTYQNRVWDPVAELLDNGNLVIRNVGDANSATYLWQSFDYLSDTLLPKMKLGWDLRTGLEPKITSWKSPDDPSPRNFSWDLMLHDYPEFYAMIGTCKYFCTGPWNGVHFSGL

SEQ ID NO: 208988 - protein, 254 aa, Glycine max
  Coding DNA Sequence Number=SeqID_92210
  Gene Ontology: Mol. function=chromatin binding; Cellular component =chromatin; Biological process=chromatin assembly or disassembly
  Homolog annotation: Hit_ID=Q1SAV4; Match level="QueryCoverage=80%, HitCoverage=56%, E-value=6e-46, Identity=44%"; Hit description =Integrase, catalytic region
  Pfam annotation: Domain name=Chromo; Domain location=150-198; Score =20.1; E_value=0.0042; Accession=PF00385.14; Description='chromo' (CHRromatin Organisation MOdifier
  Subcellular localization annotation: CTP_CleavageSite=70; ConfidenceScore=5.07e-01
MAKLKYSTGPWNNIYGASFMILLPSATYGMPPPSIATYLASSSTVEAVDTLLSSRHDLWKSLSTRLRKVQLAMKTQADRKRHEFNRLSKCYYGHFRIIETIGVIAYHPALPEHSKIHNVFHCSLLKPHHGPIQEVSAPLPPQATDNHPLIEPLAILDTKWNHTTNPSSLLALVQWHGLALEETSWENWDDLHATYHLEDKVVFPGTTLSLKLKGTTAYTNVMLAGAPKPKVLQLVESYPLCGWIKCNMDGAACD

SEQ ID NO: 208989 - protein, 115 aa, Glycine max
  Coding DNA Sequence Number=SeqID_92211
  Subcellular localization annotation: CTP_CleavageSite=31; ConfidenceScore=5.32e-01
MSRRNESGPKLDLKLNLSPPRADRRLESPTRSATASPTSPPSSCVSSELNQEDKSYSNSPEATSMVLVGCPRCLIAMCAPLLPSFPTILSKQGMQRLQRQKETEWSVNSTIFNHP

SEQ ID NO: 208990 - protein, 521 aa, Glycine max
  Coding DNA Sequence Number=SeqID_92212
  Gene Ontology: Mol. function=DNA binding; Cellular component=nucleus; Biological process=regulation of transcription
  Homolog annotation: Hit_ID=Q8LAH6; Match level="QueryCoverage=99%, HitCoverage=85%, E-value=1e-77, Identity=37%"; Hit description=NAC, putative
  Pfam annotation: Domain name=NAM; Domain location=6-132; Score=250.0; E_value=4.9e-72; Accession=PF02365.6; Description=No apical meristem (NAM) protein
MARMGPGFRFHPTDEELVVFYLKRKMTGNLSRYDHIAVVDVYKLEPWDLPPLSKLKTKDLEWYFFSALDRKYGNGSRTNRATDRGYWKTTGKDRPVTHGDRTVGMKKTLVYHSGRAPHGRRTNWVMHEYKMLDEELARAGTVPDVFVVCRIFEKSGSGPKNGAKYGAPLDEKEWDVEDEQEEEEEENEQKDVAPLLVPHNAVAPPPPLSVVADNAEAHPPLTATVDNKYMVAPPPSFQANFDDEVFNAGAYVETNDLDMELNWNDIIGSDTFPSLNFHHGECSSHAEYSKVFIKDQEPSAGTFGISRPENDWPLDMTEQHGVDTNSVNNRDNGELINIGNHLNFNDASNDMNLDLFWDANENLPTDGSFLEYNDIAIGNGSRSTEADPPANDILDEYLTLPDDDIYKYISFDSPQIQESENFIPNQGSPFTRQNVEGETADKAVVSNHNSESQTRNEASSVQNTHEAKFAPGSTNPLVKQAYGWLAGIPAAPAHAMEFPAKEIALGLHPVAQSSHPAHITT

SEQ ID NO: 208991 - protein, 117 aa, Glycine max
  Coding DNA Sequence Number=SeqID_92213
  Homolog annotation: Hit_ID=O64735; Match level="QueryCoverage=83%, HitCoverage=64%, E-value=2e-09, Identity=35%"; Hit description =Expressed protein
MSGNDCEKTLLLLALLTDNQRLARIHVAFKQDLVATQEELCCLSATVVEVKAERDAEVRGIAAMSSELDRVRADILELVAERKELTTQLHAVESELAKASTKAQFVPTIKADIEAMP

SEQ ID NO: 208992 - protein, 93 aa, Glycine max
  Coding DNA Sequence Number=SeqID_92214
  Gene Ontology: Mol. function=small conjugating protein ligase activity; Biological process=protein modification process
  Homolog annotation: Hit_ID=Q6PQ37; Match level="QueryCoverage=50%, HitCoverage=32%, E-value=8e-13, Identity=72%"; Hit description =Ubiquitin-conjugating enzyme family protein
MRAQLCPLLFLNVLKLKPTCGWIQCQYECVVRQLHFNAVPRNFRLLEELEKGEKGIGDGTVSYGMDDGDDIYMRSWTGTIIGPYNVNIYLTLP

SEQ ID NO: 208993 - protein, 423 aa, Glycine max
  Coding DNA Sequence Number=SeqID_92215
  Gene Ontology: Mol. function=acyl-CoA binding; Cellular component =intracellular; Biological process=lipid transport
  Homolog annotation: Hit_ID=Q6K9X9; Match level="QueryCoverage=99%, HitCoverage=70%, E-value=6e-78, Identity=40%"; Hit description=Acyl -CoA binding protein-like
  Pfam annotation: Domain name=Kelch_1; Domain location=149-194; Score =4.1; E_value=1.3; Accession=PF01344.15; Description=Kelch motif
  Pfam annotation: Domain name=Kelch_1; Domain location=2-48; Score =22.2; E_value=0.0019; Accession=PF01344.15; Description=Kelch motif
  Pfam annotation: Domain name=Kelch_2; Domain location=149-194; Score =8.5; E_value=2.9; Accession=PF07646.5; Description=Kelch motif
  Pfam annotation: Domain name=Kelch_2; Domain location=2-48; Score =25.6; E_value=0.00018; Accession=PF07646.5; Description=Kelch motif
  Pfam annotation: Domain name=M; Domain location=302-322; Score=4.8; E_ value=29; Accession=PF02370.7; Description=M protein repeat
  Pfam annotation: Domain name=M; Domain location=323-343; Score=5.3; E_ value=25; Accession=PF02370.7; Description=M protein repeat
  Pfam annotation: Domain name=M; Domain location=379-399; Score=8.3; E_ value=10; Accession=PF02370.7; Description=M protein repeat
  Pfam module annotation: Pfam domain module=Kelch_1::Kelch_1::Kelch _2::Kelch_2::M::M::M; Domain location=149-194::2-48::149-194::2 -48::302-322::323-343::379-399
VARVGQSASLFGSRVILFGGEEMSRKLLNDVHVLDLESMTWEMIKTTQTPPAPRYDHSAAIQGERVRPPITQVYTRKEKKNCRDLRHVCIDGGLEIVGIILTVIAESEESEIVGIISLLYIFTTHARFASYAWQMEWSQPQTQGDLVSPRAGHTGITIDESWLIVGGGDNRSGCPETLVLDMSKLVWSVLTVVKQKDPLSSEGLSVCSATIGGEKYLLAFGGYNGRYSNEVFVMRPKAKDTMRPKIFQSPAAAAAAASVTSAYALSKSEKLDFMQLDDINSKLSVNGHHKDDVVDKVEAIKEEKRLLELSIAEVRAENSKLGGEIEEINNTHAELTKELQSVQGQLVAERSRCFNLEVEYTNSNVRFQAKIAELQKLLESMQSVEEEVQALREKKSALDQEMELAATAESKSSGWRWFGGSEK

SEQ ID NO: 208994 - protein, 104 aa, Glycine max
  Coding DNA Sequence Number=SeqID_92216
MEVIKSRIIISLESLVEFLKKGSEKAVIRDMLGAPSNIAFRKNLLPGRTICVLPEEPFSRKLSGRTFFRKKVLPDEQFVLPKEPSSGEVTRRTSSGNFSRRRFF

SEQ ID NO: 208995 - protein, 131 aa, Glycine max
  Coding DNA Sequence Number=SeqID_92217
MSIARRAFIVNLLSRQSMNTENSSQPPDAAASIVATEGKENRAHRRKSTRISNPNGQVIFNTIAWKFEIGAIEQIETNGLELNGKRSETCYEREMSDLETPSSDAEEEEEEIGRRRMESHRRDLNGYVVVA

SEQ ID NO: 208996 - protein, 244 aa, Glycine max
  Coding DNA Sequence Number=SeqID_92218
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=63%, HitCoverage=18%, E-value=2e-48, Identity=55%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=PAN_2; Domain location=164-232; Score =102.3; E_value=1.4e-27; Accession=PF08276.2; Description=PAN-like domain
  Pfam annotation: Domain name=S_locus_glycop; Domain location=61-152; Score=5.3; E_value=1.5e-05; Accession=PF00954.11; Description=S -locus glycoprotein family
  Pfam module annotation: Pfam domain module=PAN_2::S_locus_glycop; Domain location=164-232::61-152
MKNGNHGEEIQTGENSEVTMQMEIRKMQRREHCRANANLKRQNNKCSVGGNEKMREANAPNEQTITSARGHPLPAKRKFKHEKDLPVAYQTLLCRQRNIWIPENGTWRLFQTAPRDICDTYSPCGSYANCMVDSSPVCQCLEGFKPKSLDTMEQGCVRSEPWSCKVEGRDGFRKFVGLKFPDTTHSWINKSMTLEECKVKCWENCSCTAYANLDIRGAGSGCSIWFADLIDLKVVSQSGQYLNI

SEQ ID NO: 208997 - protein, 67 aa, Glycine max
  Coding DNA Sequence Number=SeqID_92219
MGSDGVFCGLKKRRCEKLLMNSLSEADWLSEPHSLSEATSSLSVCKTLEDDKSEISALSGQPARPAR

SEQ ID NO: 208998 - protein, 203 aa, Glycine max
  Coding DNA Sequence Number=SeqID_92220
  Gene Ontology: Mol. function=peroxidase activity; Cellular component =vacuole; Biological process=response to oxidative stress
  Homolog annotation: Hit_ID=Q1SAT8; Match level="QueryCoverage=91%, HitCoverage=56%, E-value=1e-60, Identity=57%"; Hit description=Haem peroxidase, plant/fungal/bacterial
  Pfam annotation: Domain name=peroxidase; Domain location=1-156; Score= 93.2; E_value=7.6e-25; Accession=PF00141.13; Description=Peroxidase
MVGGPFYPVRLGRKDSTESDAARVSASLPTPSMTMDQIIEKFTSKGFTVKEMVALTGAHTIGFTHCKEFIHRIYNFSKTSDADPMMHPKLVQGLRSVCQNYTKDSSMAAFNDVRSPGKFDNAYYQNVIKGLGLLTSDSILAVDPRTKPLVELYANDQQAFFKDFADAMEKLSVFRVKTGDKGEVRNRGEKHKTCDGEDPVLPI

SEQ ID NO: 208999 - protein, 120 aa, Glycine max
  Coding DNA Sequence Number=SeqID_92221
  Homolog annotation: Hit_ID=Q2QXG3; Match level="QueryCoverage=37%, HitCoverage=13%, E-value=8e-10, Identity=66%"; Hit description =Uncharacterized plant-specific domain TIGR01568 family protein, expressed
  Pfam annotation: Domain name=DUF623; Domain location=1-49; Score =41.9; E_value=2.2e-09; Accession=PF04844.4; Description=Protein of unknown function, DUF623
MEEMVEAQCVKGWEGLQELLSWYLKVNGKTNHGYIVGAFVDLLFASSSSLVSSSDNNSHSPSSPLSFYSSSSCSTRCVSCLEAEVEVHNNDIATTSSFLLEQVREDQASSSSSTSTSSLN

SEQ ID NO: 209000 - protein, 64 aa, Glycine max
  Coding DNA Sequence Number=SeqID_92222
MAIAIHPSQRFLLSVSITLTLVHRGASNSKIVCHFELLQDLSFPCIEQQRRRRVDGKEKWLDVE

SEQ ID NO: 209001 - protein, 245 aa, Glycine max
  Coding DNA Sequence Number=SeqID_92223
  Gene Ontology: Mol. function=acyltransferase activity; Biological process=metabolic process
  Homolog annotation: Hit_ID=Q1S6K6; Match level="QueryCoverage=97%, HitCoverage=67%, E-value=3e-89, Identity=60%"; Hit description =Phospholipid/glycerol acyltransferase
  Pfam annotation: Domain name=Acyltransferase; Domain location=151 -242; Score=-9.6; E_value=0.019; Accession=PF01553.11; Description =Acyltransferase
MESELKDLNSKPPNCNGNANSVCDDRPLLKPEPPASSDSIAEMEKKFAAYVRRDVYGTMGRGELPAKEKLLLGFALVTLLPIRVVLAVTILLFYYLICRVCTLFSAPTGEEEQEDYAHMSGLRRTVIVSCGRALSRVMLFIFGFYWIPESNSASQEDRSQPEELGRPSVIISNHVSYLDILYHMSSSFPSFVAKRSVAKLPLIGLISKCLGCVYVQRESKSSDFKGVSVVPPDRLIVRHKLDDLI

SEQ ID NO: 209002 - protein, 313 aa, Glycine max
  Coding DNA Sequence Number=SeqID_92224
  Gene Ontology: Mol. function=DNA-3-methyladenine glycosylase I activity; Cellular component=cytoplasm; Biological process=base -excision repair
  Homolog annotation: Hit_ID=Q94CA9; Match level="QueryCoverage=93%, HitCoverage=91%, E-value=7e-83, Identity=53%"; Hit description =Putative DNA-3-methyladenine glycosylase I
  Pfam annotation: Domain name=Adenine_glyco; Domain location=111-295; Score=290.3; E_value=3.7e-84; Accession=PF03352.4; Description =Methyladenine glycosylase
  Subcellular localization annotation: CTP_CleavageSite=14; ConfidenceScore=5.14e-01
MPVATKLRPAPQPRAILKPAGNRVTVSEEPKPKKENNVKTPQRPPQIPNTVLQSNVSLNSMCSSDSCSSTTKNATVAGRRNVKRNGFKPVRVVPDAADVATISPPLKRCEWITPNSDPFYTAFHDEEWGVPVDDDRKLFELLVFSQALAEHRWPAILKQRDIFRHAYMKLFENFEPSSVAQFTDKKLLTLKINGNSLLSEPKIRAIVENAKQLPKVQQEFGSFSNYCWRFVNHKPIRNEFRYGRQVPVKTPKAEVISKDMMRRGFQCVGPTVVYSFMQVAGLVNDHLLTCFRYHECKVTTKTEFKTEFKENND

SEQ ID NO: 209003 - protein, 334 aa, Glycine max
  Coding DNA Sequence Number=SeqID_92225
  Gene Ontology: Mol. function=intramolecular transferase activity; Cellular component=mitochondrion; Biological process=metabolic process
  Homolog annotation: Hit_ID=Q0KAC1; Match level="QueryCoverage=98%, HitCoverage=48%, E-value=6e-69, Identity=41%"; Hit description =Methylmalonyl-CoA mutase
  Pfam annotation: Domain name=B12-binding; Domain location=218-332; Score=69.0; E_value=1.5e-17; Accession=PF02310.9; Description=B12 binding domain
YSLPTEQSSKVARDTQRILQEETGICNVIDPWAGSYMMEKITAEVIYEVKAVFNQIDSAGGMLQALDDSLIQKLIQTRAAKTQANIDSGKQKVVGAGNTTHNTASLNFDSDGIRLQQTTKIKAMKLCRDDMKVRRALKNLSSVAQQGQGNLLSATIEAIKYRATIQECTDALTKAFPRHQQFPVLIEGIYKGEIDNHPEWMTAKQAVSDIADLLSRSPRVLVAKVGQDGHDRGANVVTSILCDSGCEVKQLPLFIHIEDIVSYASNFEADIIAISSLANAHNELIPQLMYELRTRNINIPVALGGIIPVEDHQALIECGVAFVMDPGVTIQKAI

SEQ ID NO: 209004 - protein, 117 aa, Glycine max
  Coding DNA Sequence Number=SeqID_92226
MPIPMVVLKLMMIWTQTYVGDKKMKKLIAGTSSKMATVINETTTIVDLEVQGKSRNDDHFLMAGPGSQAYQGNFDYLSWSKTLFVALHKLPQAQLDKFTSVLWSMWRYRNDKVWDDV

SEQ ID NO: 209005 - protein, 128 aa, Glycine max
  Coding DNA Sequence Number=SeqID_92227
MSFRPTLNVVGCACQYLGLGGEAVGGVGGVALEITRSSGRGRFSRKKETGEKGQCWKVGKSHPPVVVLKNPQIYSQPSTPTNSNMCYKPSLSNIVSHSNGIESPIGIENIQLDEGDQNSGGKESHTAF

SEQ ID NO: 209006 - protein, 52 aa, Glycine max
  Coding DNA Sequence Number=SeqID_92228
MTVMFNIFYWVELSVWRVITSEVGYSTVLMVELQRHFGVEVDKDIKTGSKNN

SEQ ID NO: 209007 - protein, 193 aa, Glycine max
  Coding DNA Sequence Number=SeqID_92229
  Gene Ontology: Mol. function=DNA-directed RNA polymerase activity; Cellular component=nucleus; Biological process=transcription
  Homolog annotation: Hit_ID=Q6ZA50; Match level="QueryCoverage=47%, HitCoverage=52%, E-value=3e-20, Identity=88%"; Hit description =Putative DNA-directed RNA polymerase II 13.6K chain
  Subcellular localization annotation: CTP_CleavageSite=55; ConfidenceScore=5.65e-01
MNAPNHYERFVVLKAPKRFLMKGTRRSSMRHPSPSRDRSTLSATSSACTPVLLPPCSHFPVSPRNPNFSLFFMFFRQLHRDPNVLFAEYKLLHPLQYKIIVRVCDMDAMLSSVFSGYCAPYSPAKFFIQWCATHVNLFSPTWTVVLDVTLTWKAQWSMSLYQREEAKIQASVNLQNAKAESRPRKLEVFHCHS

SEQ ID NO: 209008 - protein, 431 aa, Glycine max
  Coding DNA Sequence Number=SeqID_92230
  Gene Ontology: Mol. function=transcription factor activity; Cellular component=cytoplasm; Biological process=regulation of transcription, DNA-dependent
  Homolog annotation: Hit_ID=Q9SKT1; Match level="QueryCoverage=78%, HitCoverage=90%, E-value=9e-53, Identity=39%"; Hit description=AP2 domain transcription factor
  Pfam annotation: Domain name=AP2; Domain location=225-289; Score =145.5; E_value=1.4e-40; Accession=PF00847.10; Description=AP2 domain
MALLDSNSEWKKGQFLILVLVVVVVMANNSGKSNKEGVEGTQLKVIGESEGQDWEKEKGKRLDLSSGRRQWKPVFDDASVSHRPLKKIRSPEPENPNQQQQQQPSSMLSLQPPSSRIVFPFAFEGSQHPMPFPHPFGTTNLPLFRPPLHPTQQMISFLPSQNMGYPPFLAPESTMPHEHQQHHHQQLLQYWSDALNLSPRGRMMMMNRTEGRQMLRPQAQPLNATKLYRGVRQRHWGKWVAEIRLPRNRTRLWLGTFDTAEDAAMAYDREAFKLRGENAKLNFPELFLNKDKAEQSTTAPASSSNEGSTSSQNTKQPEPIPEGTTNTESEDMPPTETFAVENAVTEEGISQPQELVWGEWFNAIPAGWGPGSPVWDDLDPNNNLLLHSQLPFVNPNQQEFHDAGASSRTQQEDNNTEPGSSSPSCPMRPFF

SEQ ID NO: 209009 - protein, 219 aa, Glycine max
  Coding DNA Sequence Number=SeqID_92231
MEVNAATVVATSTAIEVDPTHPSGLNQVNPPISDIVGQGCEVLGSMGGPHFVQVHNKHSFPPYGLPAPNVAHAPDENVNNSTPILIESQQPNLFVHILPPVVVEREKFDHIEERLKAIEGSRDYAFVDMVELCLVLDFVIPPKLKVSDFNKYRGTTCPKNHLKMYNRKMGAYSKNEKLLMHFFQESLIGAAVTCYRTCARKNMNLSKNMPKGGGIWQLK

SEQ ID NO: 209010 - protein, 127 aa, Glycine max
  Coding DNA Sequence Number=SeqID_92232
AIMVLDPRMGSGIGANLLKLILKRRTSGKMFVHGIDEDEDGEGMAEELLLPFADGGGYGMELADLGVTMLSLNNTHSHAGSICLNGKWAGEIGPRNLHKDWVVKGMGQDAMASSFEGLGAIPLADTI

SEQ ID NO: 209011 - protein, 133 aa, Glycine max
  Coding DNA Sequence Number=SeqID_92233
MLSGTEASSTLQTSSQRSQWVLQSQIHLGLNWAKSEPFAKRRNGPLSERVEKPNISCYRLAIILAKRVGRKIDKGLKREENKVCYLRFSGKHDKLAKHSCCAKRVHQKCVNLCALSHQSSEKDNTRAKRVSSR

SEQ ID NO: 209012 - protein, 80 aa, Glycine max
  Coding DNA Sequence Number=SeqID_92234
MSPPPLETSQSQNLIECSSRYLPLQSLLSPAPVMLSQPGGSSGVLSKLILAERIIDNSSASRIFYALSHELLRSADGSLS

SEQ ID NO: 209013 - protein, 173 aa, Glycine max
  Coding DNA Sequence Number=SeqID_92235
MQCLENFQKNQMSGPFVQYNHDQVIGSMTTCNITHDPGERPTHPFLNLGEPLLTFGLTCRRPPWLSITHAPRRPTFWRRPFSASPRLTMTSHCALTPSKNSCNSYKFNTNTLHHYLIHNLLPLPATTSNSMSRALMARMLWDGSLRSPSSSTTTTPPTKNASPSPPFIWTALL

SEQ ID NO: 209014 - protein, 220 aa, Glycine max
  Coding DNA Sequence Number=SeqID_92236
  Subcellular localization annotation: CTP_CleavageSite=26; ConfidenceScore=5.01e-01
MILKFYDDPTVNGFEIVVFLRLVWWAAGKRKGFERRRRKTKMSSPHLFSSFLFSFLQQHHSTLNSMSTQSSFFSNAGPSNMMARTRFTAAFRVQKNIIEVPLSYHSQWRSYYPTYVLFDYNETTHFIRVRKYGTRCFFADGLKEFRRIHDINDNVIIRFFATSKDTSLEVDIMGPTLRQTCRRPVVTTRRHIFTADVTQDMIEHTNSLVLPAAALNFLFG

SEQ ID NO: 209015 - protein, 105 aa, Glycine max
  Coding DNA Sequence Number=SeqID_92237
MYGSIQLAKVGAEDGSGLHSLFDYYQHMIELVTYIIKNYSCAHLLFLVTRVKTRIISDIEQVQEQMKADMEAMKEHMTTMMEAIMSMRKMMKVNAAISLAASMTI

SEQ ID NO: 209016 - protein, 117 aa, Glycine max
  Coding DNA Sequence Number=SeqID_92238
MGNSGSHHQRLLKENVRKTKKTRNDLQLEIKDLGVVYARGGVNTLGVRHEKDSFYSIALKIKFWFCGKFCEVEQVGDLAWSAYSSKSKIQYVIHKNYSHVIEMSPRKSETQHGVHRA

SEQ ID NO: 209017 - protein, 525 aa, Glycine max
  Coding DNA Sequence Number=SeqID_92239
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=92%, HitCoverage=34%, E-value=5e-35, Identity=35%"; Hit description =Receptor protein kinase-like protein
  Pfam annotation: Domain name=DUF26; Domain location=209-263; Score =91.3; E_value=2.9e-24; Accession=PF01657.8; Description=Domain of unknown function DUF26
  Pfam annotation: Domain name=DUF26; Domain location=339-395; Score =58.2; E_value=2.6e-14; Accession=PF01657.8; Description=Domain of unknown function DUF26
  Pfam annotation: Domain name=DUF26; Domain location=453-508; Score =59.3; E_value=1.2e-14; Accession=PF01657.8; Description=Domain of unknown function DUF26
  Pfam annotation: Domain name=DUF26; Domain location=90-144; Score =60.9; E_value=4.2e-15; Accession=PF01657.8; Description=Domain of unknown function DUF26
  Pfam module annotation: Pfam domain module=DUF26::DUF26::DUF26::DUF26; Domain location=209-263::339-395::453-508::90-144
MVELPKSNTIMPSSKTLLLITNLTLLSFATTEAQNDPFYLYKDCSSDKTSPNTSFQFNLKNLLSSLSSNATGNTPFYNATINGENPSDSIYGLFMCRADVSSHLCQLCVRNATQQLSSECSLSKQAVIWYEECMVWYSTSFIFSSVATTPSNPMKNSGNVSNPESFMRLVFLTLNQTADEASSQSSIGNNKFATKEAKNVLGISQTQTLYCLAQCTPNLSPHDCRTCLDDAIRQIQGCCEGRIGGRVLFPSCNVRYEMYPFYNVPSATPIPKLIPQTKTSHADSNLSEFPIYLSHNCTNKTFNANNSAFQTHLTKLLFNLASNATTGNKFYKADVANTVFGLFLCRDQEDLPSGLCGECVKNATHEISSKCDSFHEAIIWYSQCMLRYSYRNFFNEVETGPVFSELNTTNKDDEQNFFTMKLAKTLDQAAIQAGDSDEKYGKRTTKLNDLQTLYALAQCTQDLSIEDCKGCLGIVIGTSIPWSRLGSIGGRVLYPSCNIRFELFQFYKDNDKSGTSSSPGTFQFK

SEQ ID NO: 209018 - protein, 116 aa, Glycine max
  Coding DNA Sequence Number=SeqID_92240
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=94%, HitCoverage=16%, E-value=2e-41, Identity=75%"; Hit description =Protein kinase
  Pfam annotation: Domain name=Pkinase_Tyr; Domain location=29-115; Score=-165.9; E_value=0.027; Accession=PF07714.7; Description =Protein tyrosine kinase
MFHLVGRGIATLESLQFDLATIIAATNKFSDQNKIGKGGFGEVYKGILLDGSQIAVKRLSKSSKQGSNEFKNEVLLIAKLQHRNLVTLIGFCFQEEEKILIYEYVPNKSLDYFLFG

SEQ ID NO: 209019 - protein, 116 aa, Glycine max
  Coding DNA Sequence Number=SeqID_92241
  Homolog annotation: Hit_ID=Q1SDW8; Match level="QueryCoverage=53%, HitCoverage=12%, E-value=2e-08, Identity=49%"; Hit description =Protein kinase
MVTVASYLTSHPIELPTPQEPAFFLHGRMHENPVANESSSNQSINTSTPFSNNQMSISQFLPRYLMEGVFHFEAGGFLVSAALFMFYLIFVFGGPNWGILTLCCRLYQEKLKYISC

SEQ ID NO: 209020 - protein, 112 aa, Glycine max
  Coding DNA Sequence Number=SeqID_92242
IVVVDVGVPNIVRGNWLKKGAVVINMGTNQVKVAIAPIAIIQHAILKVHYEPSKMLTILKWSRVKDRLRMLIILYRFFNERRRKLSILHRSCSCDRRRMLSILHRSLTTVVE

SEQ ID NO: 209021 - protein, 314 aa, Glycine max
  Coding DNA Sequence Number=SeqID_92243
MAEDQPQRVSLEDYSSSSTPQYLTSIAQLEVQAANITYPHSFIQLIQDNLFHGLPNEDPYAHLATYIEIYNTVKIEEFQKMSSTSIYFLFLWQLNIFIDGLRPHSSSHLKKSLRELTSQDALLAQNKLLAKPIKTLTKTLNKLPQQLHAVQLAPSSVMQIGGCNIYGGAYESGMCMTQDYASKEGSIKEGLQDTIKGEISLKAKTLDPILRITSTRIKEIHLFGLPIKGLIFTVNTKKNPKEECMTVFTRSQMRESDGKEKRAEGVLEDSKKSGDEVLLSKTKSQLAREDRKEIRSVPVKEVPYLLVPSKKEKE

SEQ ID NO: 209022 - protein, 146 aa, Glycine max
  Coding DNA Sequence Number=SeqID_92244
  Gene Ontology: Mol. function=transporter activity; Cellular component= integral to membrane; Biological process=transport
  Homolog annotation: Hit_ID=Q9LHQ6; Match level="QueryCoverage=93%, HitCoverage=25%, E-value=1e-44, Identity=61%"; Hit description =Organic anion transporter-like protein
MRATLPSESKDRGTDPSRSPLIPATEKKPAGASASEKLCIDEMLQKYCGEFGRWQLKHFILTSLAWALEAFHTMVIIFADREPEWQCLDGAAGSGCDPAAKNVCRFEPGSWKWVGDSTVAEWGLFCGDKFKVGLVQAVFFGGCMIG

SEQ ID NO: 209023 - protein, 126 aa, Glycine max
  Coding DNA Sequence Number=SeqID_92245
MRFFFEFVSCCGLPTQRSPEPVVPAKEEERSLVPATAVAVVPSRKKMRMGSAEWRPSLGSISEDVTPPAPALRDRESPRKGEVASAGRDAKKRSAGGGGTAKVSTFHADDDTNILSDAIYVLKSKH

SEQ ID NO: 209024 - protein, 131 aa, Glycine max
  Coding DNA Sequence Number=SeqID_92246
  Gene Ontology: Mol. function=transporter activity; Cellular component= integral to membrane; Biological process=transport
  Homolog annotation: Hit_ID=Q9LHQ6; Match level="QueryCoverage=95%, HitCoverage=23%, E-value=3e-37, Identity=61%"; Hit description =Organic anion transporter-like protein
MVIMNNTLWKVVTIGGGDGGHDFHGLRFSSSYEVPSRGLRDEGEDEDEEDEGGEGGDYVEIAPCGEDVGDGGEEGNAGGEEVEGGHADRTAHFGAHRLGGEDEGAEADATGAAAGEEAEEDIEGVAGRKGR

SEQ ID NO: 209025 - protein, 175 aa, Glycine max
  Coding DNA Sequence Number=SeqID_92247
  Homolog annotation: Hit_ID=Q2HRE8; Match level="QueryCoverage=79%, HitCoverage=59%, E-value=4e-16, Identity=51%"; Hit description =Lipopolysaccharide-modifying protein
  Pfam annotation: Domain name=DUF821; Domain location=3-169; Score= -197.1; E_value=5.8e-09; Accession=PF05686.3; Description=Arabidopsis thaliana protein of unknown function (DUF821)
MAYFVGRVERRHYEDTMAEQRALCLLERIGFENYKRGSTNQTCQVNALIDIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATLERKESSIQQVESWERSYWDNQTITS

SEQ ID NO: 209026 - protein, 197 aa, Glycine max
  Coding DNA Sequence Number=SeqID_92248
DPTDLLPEASLPNRSTYKSNPQETQRKDAHAKVEYVKRLYDQVNVQIAEKNESYTKQANKKRKEVVLEPDDDLGHLRANVFQEGGNDENPETGSHHLLPEASLPNRPTYNSKPQQTQHKDAQAKVEYVKRLYDQVKVQIAKKNESYANQANKKMKEVVLEPVDDPGHLRANVFQEGRNDENPETGQIQAKGPSGEGR

SEQ ID NO: 209027 - protein, 55 aa, Glycine max
  Coding DNA Sequence Number=SeqID_92249
  Homolog annotation: Hit_ID=Q2QB51; Match level="QueryCoverage=62%, HitCoverage=2%, E-value=5e-10, Identity=91%"; Hit description=Fused
MAEEDKTKANAAGALSNLVRNSDKLCEDIVCKGAVQRPHPSKNVQGSRIAVVGHD

SEQ ID NO: 209028 - protein, 159 aa, Glycine max
  Coding DNA Sequence Number=SeqID_92250
MITKDDDKGDDKKLKGQSKNEFKMFKIESRTLQDSRGKLISRIKNQDSRDQDSRLKIQESREGLIKIRYILCGTSRGYIYLGLTENKRGCISCGSVLVEGTSTRFKENKGGFLAKSHPVNEFIPCTHFEPNVKEKLSLEPKPKMLISTNYPSLGCRRVC

SEQ ID NO: 209029 - protein, 248 aa, Glycine max
  Coding DNA Sequence Number=SeqID_92251
MANTEKNPKEKCKLIFTRSQRRENAEREKREMMEYWRMKFQCYDSENFTIEIQRPRECNNLMLYWGCRIGNLKVVPTKMTLQLADHSIIRSYGVVEDVLSVFLEEDVKPIVNTTNPSIVFPGPRRVKARTTPDAPLPMIPPTTTSSKVGKPSLFSSQLEQLLLILQSLHHCQYLLIQSLHQLSLQQLVMTLEAFLSQVAWPRVQLPSVRGGDTSGTGNDDATNDGANDDYVADIPATKEAWDLGPIQD

SEQ ID NO: 209030 - protein, 47 aa, Glycine max
  Coding DNA Sequence Number=SeqID_92252
DPSWVDHPVLEGEKTLFGDGSGRANLKPFSRPLPSRMEALATLGGMT

SEQ ID NO: 209031 - protein, 235 aa, Glycine max
  Coding DNA Sequence Number=SeqID_92253
  Homolog annotation: Hit_ID=Q8H6Q8; Match level="QueryCoverage=97%, HitCoverage=7%, E-value=4e-22, Identity=29%"; Hit description=CTV.20
MQPRHYGTNFNQPKKFFAPFDPAGYIYWDYIDAWTNVFWHQNNKFKHSWLIYLKNNTVYNFPNWFLQWWTYFGPIPQIFPEEVQQGFQQFNRLFNNQESRIPADLMYGKTENNKQYPPLQRHAFVKWWTQFDTSKAAPDKVKNWFQSHPEFLKPANPETSLFLNQKSQLAAFLASSKSKESLAQNLKEVLQLLQQEEEEESSKKDAGSSEDIDDLDDDPVYQNEDDCFGISLEDD

SEQ ID NO: 209032 - protein, 1135 aa, Glycine max
  Coding DNA Sequence Number=SeqID_92254
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=98%, E-value=0.0, Identity=44%"; Hit description =Integrase, catalytic region
  Pfam annotation: Domain name=zf-CCHC; Domain location=246-263; Score =12.0; E_value=0.01; Accession=PF00098.13; Description=Zinc knuckle
  Pfam annotation: Domain name=zf-CCHC; Domain location=282-299; Score =15.4; E_value=0.0029; Accession=PF00098.13; Description=Zinc knuckle
  Pfam module annotation: Pfam domain module=RVT_2::zf-CCHC::zf-CCHC; Domain location=650-905::246-263::282-299
MNETVLNSTESYLYLHPSENPATTLVSPVLDSTNYHSWSRSMITALSAKNKLEFIDGSAPEPLKTDRMYAAWRRCNNMVVSWLVYSVATSIRQSILWMDKAEEIWRDLKSRYSQGDLLRISDLQQEASTLKQGALSVTEYFTRLRVIWDEIKNFRPDPVCTCNIRCTCSTFTVIAQRKIEDRAMQFLRDLNEQYANVRSHVLLMDPIPAISRIFSYVAQQERQLIGNSTPDLNLEPKDISINAARIICDYCGRTGHTENVCYKKHGVPLNREGRSKNTGGRKTCTHCGKTGHTIDVCYQKHGYPPGYKPYNGRSVNNVAATDGKPEDDHIQHRESQELVRFSPEQYKALLALIQRPTVGNSASDQPKQVASISSCTIDKSSSPGATDHVTSSLDNLHSYECINPVTVKLPNGHHVHANLPPGFWCYALTHAIYLVNIIPTPFLHGISPYEKIHGHPLDIANLRVFGCLCYVSTLKANRKKLDPRAHPCIFIGFKANTKGYQVYNMHSHDIISSRNVIFYENYFPQISEIQQLDSNSSAPLPVSFSTNQYDSPVEPITQEPINIDHLTEPSSSPPRRSTRTRHAPTYLQDYHRDLSINNTSTSMFVRYPLSSVLSYSRLSPTHKHFVLSISSTVEPSSYAEASRHDCWIKAMKAELQALQSNETWRLTLLPPQKTAIGCRWIYKIKYRADGSIERYKARLVAKGYTQMEGLDYLDTFSPVAKLTTVRLLLALAAVNQWHLRQLDVNNAFLHGELDEEVYMQVPPGLTVSNPQLVCRLQRSLYGLKQASRQWFTKLSGFLVSHGFQKSNSDHSLFLRFTGSITTVLLVYVDDIILTGNSINEIQDITMLLDQAFKIKDLGTLKFFLGFEIARTSTGIHLCQRKYVLDILSDSGMLGCRPNATPMDYFTKLQAMVGTPLSVESSSSYRRLIGRLMYLSNSRPDIAYAVQQLSQYMSSPTNVHQQAAYRVLRYLKGTPGSGLFFPATNTLQLRAFSDSDWAGCPDSRKSTTGFLIYFGSSLISWQSKKKSTVSRSSSEAEYRALASTTCELQWLTYLLQDFRITFIKPATLYCDNQSAIQIATNPVFHERTKHIEIDCHIIRHKVTMGLIKLLPVSSSMQLADIFTKALSPSIFQHLCT

SEQ ID NO: 209033 - protein, 712 aa, Glycine max
  Coding DNA Sequence Number=SeqID_92255
  Gene Ontology: Mol. function=protein serine/threonine kinase activity; Cellular component=integral to membrane; Biological process=protein amino acid phosphorylation
  Homolog annotation: Hit_ID=Q6XAT3; Match level="QueryCoverage=93%, HitCoverage=91%, E-value=0.0, Identity=52%"; Hit description=ERECTA -like kinase 1
  Pfam annotation: Domain name=LRR_1; Domain location=108-130; Score =8.4; E_value=7.7; Accession=PF00560.23; Description=Leucine Rich Repeat
  Pfam annotation: Domain name=LRR_1; Domain location=132-154; Score =13.7; E_value=0.65; Accession=PF00560.23; Description=Leucine Rich Repeat
  Pfam annotation: Domain name=LRR_1; Domain location=193-215; Score =7.0; E_value=14; Accession=PF00560.23; Description=Leucine Rich Repeat
  Pfam annotation: Domain name=LRR_1; Domain location=217-239; Score =14.5; E_value=0.38; Accession=PF00560.23; Description=Leucine Rich Repeat
  Pfam annotation: Domain name=LRR_1; Domain location=241-263; Score =18.9; E_value=0.018; Accession=PF00560.23; Description=Leucine Rich Repeat
  Pfam annotation: Domain name=LRR_1; Domain location=265-287; Score =9.9; E_value=4; Accession=PF00560.23; Description=Leucine Rich Repeat
  Pfam annotation: Domain name=LRR_1; Domain location=289-311; Score =14.8; E_value=0.31; Accession=PF00560.23; Description=Leucine Rich Repeat
  Pfam annotation: Domain name=LRR_1; Domain location=313-334; Score =12.1; E_value=1.6; Accession=PF00560.23; Description=Leucine Rich Repeat
  Pfam annotation: Domain name=LRR_1; Domain location=37-59; Score =12.9; E_value=1.1; Accession=PF00560.23; Description=Leucine Rich Repeat
  Pfam annotation: Domain name=LRR_1; Domain location=60-82; Score =12.0; E_value=1.6; Accession=PF00560.23; Description=Leucine Rich Repeat
  Pfam annotation: Domain name=LRR_1; Domain location=84-106; Score =12.9; E_value=1.1; Accession=PF00560.23; Description=Leucine Rich Repeat
  Pfam annotation: Domain name=Pkinase; Domain location=392-658; Score =110.7; E_value=4.2e-30; Accession=PF00069.15; Description=Protein kinase domain
  Pfam annotation: Domain name=Pkinase_Tyr; Domain location=392-658; Score=86.7; E_value=6.9e-23; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::Pkinase::Pkinase_ Tyr; Domain location=108-130::132-154::193-215::217-239::241-263::265- 287::289-311:...
  Pfam module annotation: Domain location=:313-334::37-59::60-82::84 -106::392-658::392-658
MLSGTLSSDICQLTGLCDVRGNNLTGTIPDSIGNCTNFAILDLSYNQISGEIPYNIGFLQVATLSLQGNRLTGKIPEVFGLMQALAILDLSENELIGPIPPILGNLSYTGKLYLHGNMLTGTIPPELGNMSRLSYLQLNDNQVVGQIPDELGKLKHLFEFGSGVNLLSLLSFRNLANNHLEGSIPLNISSCTAMNKLNLSANNFKGSIPVDLGHIINLDTLDLSSNNFSGYVPGSVGYLEHLLTLNLSHNSLEGPLPAEFGNLRSIQIFDMAFNYLSGSIPPEIGQLQNLASLILNNNDLSGKIPDQLTNCLSLNFLNVSYNNLSGVIPLMKNFSWFSADSFMGNPLLCGNWLGSICDPYMPKSKGPPKLVILHMGLAIHTFDDIMRVTENLNAKYIVGYGASGTVYKCALKNSRPIAIKRPYNQHPHNSREFETELETIGNIRHRNLVTLHGYALTPNGNLLFYDYMENGSLWDLLHGPLKKVKLDWEARLRIAMGAAEGLAYLHHDCNPRIIHRDIKSSNILLDENFEARLSDFGIAKCLSTTRTHVSTFVLGTIGYIDPEYARTSRLNEKSDVYSFGIVLLELLTGKKAVDNDSNLHHLILSKADNNTIMETVDPEVSITCMDLTHVKKTFQLALLCTKRNPSERPTMHEVARVLASLLPAPPSKNIFVPSSNTIDYAQFVIQKPLGNSYSMYPSFMPKPKVGVKRVET

SEQ ID NO: 209034 - protein, 286 aa, Glycine max
  Coding DNA Sequence Number=SeqID_92256
  Gene Ontology: Mol. function=nucleic acid binding; Cellular component= integral to membrane; Biological process=protein amino acid autophosphorylation
  Homolog annotation: Hit_ID=Q9FNZ2; Match level="QueryCoverage=96%, HitCoverage=64%, E-value=2e-95, Identity=58%"; Hit description=Zfwd1 protein
  Pfam annotation: Domain name=WD40; Domain location=113-149; Score =34.8; E_value=2.9e-07; Accession=PF00400.22; Description=WD domain, G-beta repeat
  Pfam annotation: Domain name=WD40; Domain location=153-189; Score =33.4; E_value=8.1e-07; Accession=PF00400.22; Description=WD domain, G-beta repeat
  Pfam annotation: Domain name=WD40; Domain location=196-236; Score =10.3; E_value=2.3; Accession=PF00400.22; Description=WD domain, G -beta repeat
  Pfam annotation: Domain name=WD40; Domain location=68-104; Score=8.9; E_value=3.3; Accession=PF00400.22; Description=WD domain, G-beta repeat
  Pfam module annotation: Pfam domain module=WD40::WD40::WD40::WD40; Domain location=113-149::153-189::196-236::68-104
VITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKADSPFELVASLTGHTKAVVCLAVGCKMMYSGSMDQSIKVWDMDTLQCTMTLNDHTDAVTSLICWDQYLLSSSSDRTIKVWACIEAGSLEVIYTHTEENGVVSVFGMPDAEGKPILFSSCRDNSVHMYELPSFSERGRLFAKKDVALIELGPGGLFFTGDESGLLMVWKWLEVPKVASS

SEQ ID NO: 209035 - protein, 146 aa, Glycine max
  Coding DNA Sequence Number=SeqID_92257
  Gene Ontology: Mol. function=protein serine/threonine kinase activity; Cellular component=integral to membrane; Biological process=protein amino acid phosphorylation
  Homolog annotation: Hit_ID=Q6XAT2; Match level="QueryCoverage=97%, HitCoverage=48%, E-value=3e-51, Identity=48%"; Hit description =ERECTA-like kinase 2
  Pfam annotation: Domain name=LRRNT_2; Domain location=4-41; Score =30.5; E_value=5.8e-06; Accession=PF08263.3; Description=Leucine rich repeat N-terminal domain
  Pfam annotation: Domain name=LRR_1; Domain location=118-137; Score =14.9; E_value=0.3; Accession=PF00560.23; Description=Leucine Rich Repeat
  Pfam annotation: Domain name=LRR_1; Domain location=46-68; Score=2.8; E_value=86; Accession=PF00560.23; Description=Leucine Rich Repeat
  Pfam annotation: Domain name=LRR_1; Domain location=70-92; Score =13.1; E_value=1; Accession=PF00560.23; Description=Leucine Rich Repeat
  Pfam annotation: Domain name=LRR_1; Domain location=94-113; Score =10.8; E_value=2.7; Accession=PF00560.23; Description=Leucine Rich Repeat
  Pfam module annotation: Pfam domain module=LRRNT_2::LRR_1::LRR_1::LRR_ 1::LRR_1; Domain location=4-41::118-137::46-68::70-92::94-113
MYIGQALMKIKASFSNVADVLHDWDDLHNDDFCSWRGVLCDNVSLTVFSLNLSSLNLGGEISPAIGDLVTLQSMDLSDNQLYGDLPFSISKLKQLVFLNLKSNQLTGPIPSTLTQIPNLKTLDLARNRLTGEIPRLLYWNEVLQYL

SEQ ID NO: 209036 - protein, 81 aa, Glycine max
  Coding DNA Sequence Number=SeqID_92258
MKAMKEQMAMMIMKKIMEASVVAVAATSTVAKVNPMPQSGLNQMNHPTSAMVGKDLGSMSGPHDVQIQNEHAFPPCGLWRP

SEQ ID NO: 209037 - protein, 283 aa, Glycine max
  Coding DNA Sequence Number=SeqID_92259
MADESLPFSFLALHFPLNACQNLRVVKVAVVTHPVITDTDPRVDFGHIAADHFRQHEGFTLAVLTAAPVHRVHQPQRIMEGVNVDFDRRGQVQHVGNLVDFLLNGWRGFQDARDSDSEFPHITGCRLAQRRFVRIALVLHEGFADAVLQVIKLAEGAFLPCVEAGCAVRVTPSFGRFFGGGFDVDVLCVHPAFPPVWWLIHLSVSSLAAKGKGATTYGGRKGAETKVFAVLRKKFWRSLFTPWMTTRRCYDQPSAGGLNVRGLTGGKGVRMNTPDTAERRGVT

SEQ ID NO: 209038 - protein, 109 aa, Glycine max
  Coding DNA Sequence Number=SeqID_92260
MLEAENAPVKKQVRIKRSDIDRDDISAEMRALGRHIAHCRKKGRAVRIPAMRGSEWGQAREAAPVTPAKPVLPAVNAQPIPHRMMTIDQARRQFISVFRDTARSLRRWE

SEQ ID NO: 209039 - protein, 72 aa, Glycine max
  Coding DNA Sequence Number=SeqID_92261
MLNGMPRNSSMIRTCCIRVISLEKWRLRNLGWAMATIELSRWCLALDVRQTDFEADLGIVRQVASDILRRGS

SEQ ID NO: 209040 - protein, 152 aa, Glycine max
  Coding DNA Sequence Number=SeqID_92262
MEDAPVSPRVALLALPSRRRMKVDMEAMKEQMATMMEAMMSMKKIMETNAVAVAATSAVAKVNPMPPFDLNQMNHPTLDMVGKDLGSTDGPMMCKFKMSAPSRHMACLPTIHHPMWHTLPIRMSITSLRYSLKANNLNPIMHMCLNPWGRHM

SEQ ID NO: 209041 - protein, 67 aa, Glycine max
  Coding DNA Sequence Number=SeqID_92263
MRMRKWRKELEYPKPWSVVGFYSKNPCTSLMVPPVETLIRNFNRLKWKRMKQDEFWALWDVIWIRNE

SEQ ID NO: 209042 - protein, 83 aa, Glycine max
  Coding DNA Sequence Number=SeqID_92264
  Subcellular localization annotation: CTP_CleavageSite=48; ConfidenceScore=5.12e-01
MSKKGCLKGERRAHTPSSLSGEANEESNSTSTIATTSSRKCLLNLPTKANTNTAFSIATTRTKNPTLVSNNKERREIEDGRDE

SEQ ID NO: 209043 - protein, 119 aa, Glycine max
  Coding DNA Sequence Number=SeqID_92265
MGAKHLTRTKERSHVTKQRSPDEIRGCNSPWVRSLIVWAECLTPWGHLTRASNSSWSAFNFLSSYSWRCSIFAMRGKFYHGPSVGTNCTYQNLEQTDVKVDVAKMGSSISQVEFIGVLH

SEQ ID NO: 209044 - protein, 76 aa, Glycine max
  Coding DNA Sequence Number=SeqID_92266
MEKSDKRNFKEKKEKKGYITWEDNVINSSSDSENKIISLGIMMKDYENGEEQSRYIDSNFSKHMACIKVYSYFSPR

SEQ ID NO: 209045 - protein, 101 aa, Glycine max
  Coding DNA Sequence Number=SeqID_92267
MLYKLLVNLRSGVFMLQIDAFTKISTAANLRHKFCSICSMWVEKGWEWKFQWRRHLFDRELEMADCFRNDVAGSCIQIHKKDDWRTLTRTLPSPTAIGRLT

SEQ ID NO: 209046 - protein, 73 aa, Glycine max
  Coding DNA Sequence Number=SeqID_92268
MCTYHLFSQNMQSDKEENKMRSNLCISSHAIKSEMYKQNQKDFLKLVVRLGYKNSLVFLGFKGLDSKRAQVLD

SEQ ID NO: 209047 - protein, 318 aa, Glycine max
  Coding DNA Sequence Number=SeqID_92269
  Gene Ontology: Mol. function=protein kinase activity; Biological process=protein amino acid phosphorylation
  Homolog annotation: Hit_ID=Q2R1R7; Match level="QueryCoverage=95%, HitCoverage=19%, E-value=1e-83, Identity=51%"; Hit description=AT hook motif-containing protein, putative
  Pfam annotation: Domain name=DUF889; Domain location=68-317; Score =429.1; E_value=6.2e-126; Accession=PF05970.5; Description=Eukaryotic protein of unknown function (DUF889)
MVPIFEDSTCNILQGSQLAELLNQTNLIIWDEAPMAHKFCFEALDQTLRDIIKEKKNPNKIFGGKVIVFGGDFRQILPVIPRGSRSDIINATINSSYLWPSCEVLTLTKNMRLQGNAQLIDDQETTKFAKWILDIGDGFIGNQNDGYATIEIPEYLLITEYNDLIDAIVKSTFPDLYQHHNNPDFFKSRAILASTNETVEEVNDYILSLIPGEQMEYLSSDYIEKSKTIDSWHFQSITIEFLNSLNTFGLPNHRIKLKIGSPIMLLRNLDQTQGLCNGTRLIVTRLAKHVIAAEIISGKNVGDNVYIPRMSMSPSQSP

SEQ ID NO: 209048 - protein, 114 aa, Glycine max
  Coding DNA Sequence Number=SeqID_92270
  Homolog annotation: Hit_ID=Q2HS28; Match level="QueryCoverage=42%, HitCoverage=13%, E-value=1e-10, Identity=67%"; Hit description =Transcription factor IIA, helical
MAEEFVKGSVHQNGVALITLDRLKDECSSFCQHFRVIDDGRKSINMQHFRVIDDGRKSINIKIQDFFTRPSGMQKRNDLTSQYNAGGYIPQQDGAGDAAHGVFEIEVLAEGPFC

SEQ ID NO: 209049 - protein, 120 aa, Glycine max
  Coding DNA Sequence Number=SeqID_92271
MEPFMKYESDNAEIKQRKTIWTLQLTQEMPDHPEPLKLPHCTEVPLRACGNHMTVLRRHGPPLQWKVETLNPAIGGKGVVQPWRQEDWEDDDSEYVVFIILLRLLAILAPCTQVAAYNLK

SEQ ID NO: 209050 - protein, 103 aa, Glycine max
  Coding DNA Sequence Number=SeqID_92272
MIYLSSDLGLFPQHDLPHFGHWSHQGFPTEASTTKLALTVETCGSNVFQGYFDDAKESRVKQIPKIQESSFKNNQDQDSRLKIQESREDSIKISTKRIFKNIE

SEQ ID NO: 209051 - protein, 116 aa, Glycine max
  Coding DNA Sequence Number=SeqID_92273
MALLLSNILPSDRNADLPLRKDHARKTPNGPEEGQQGIGVASSNYGPLLVLRSARCPQQAGAGRNTTAAWGWPTTGNRCTVATSRAPQLIHKKVRDRQVIRRPAQDVKEALLGGNL

SEQ ID NO: 209052 - protein, 133 aa, Glycine max
  Coding DNA Sequence Number=SeqID_92274
  Gene Ontology: Mol. function=nucleic acid binding; Biological process= DNA integration
  Homolog annotation: Hit_ID=Q53KJ4; Match level="QueryCoverage=81%, HitCoverage=15%, E-value=5e-18, Identity=45%"; Hit description =Transposable element protein, putative
MADEPRQVTLEDYSSTYVPQFFTSIVQPKNNLFHGLPNEDPYARLATYIEICNTVRITGVPEDAIRLIFFSFSLSREAKRWLYSFKGNSLKTWDEVVEKFLKKYFPESKTAEGKAAISSFHQFPDESLSEALE

SEQ ID NO: 209053 - protein, 106 aa, Glycine max
  Coding DNA Sequence Number=SeqID_92275
  Subcellular localization annotation: CTP_CleavageSite=65; ConfidenceScore=5.28e-01
MLEAWKLVPNVSDEVSPPPKSQSSSKENASDGHYPQVSQNSCSPRSMMANLQKKSTPFSRFTPVDSSSTSNAKNTSASSIILPSIYIYIWRGFIYSTGKFKMLLSI

SEQ ID NO: 209054 - protein, 383 aa, Glycine max
  Coding DNA Sequence Number=SeqID_92276
  Homolog annotation: Hit_ID=Q8PGK3; Match level="QueryCoverage=45%, HitCoverage=19%, E-value=2e-66, Identity=77%"; Hit description=TonB -dependent receptor
  Pfam annotation: Domain name=PTPS; Domain location=270-383; Score =155.0; E_value=2e-43; Accession=PF01242.10; Description=6-pyruvoyl tetrahydropterin synthase
ITEATDELQVLLVQAALVGTAEAAADLGAFEVLPGDDVDHAGHGVGAVHRRGAVLEHFDALDRDQRQRIEIDEGVGQAAGREAVVGQAAAVEQHQRVLLRQAAQADAGRAGGPAVVGGFVGGVAGVGRDRTQHVGHGGLAGLFQLLAADHLHRVGGLGIGALDVGTGDAHGGQGIGVANGVGGGFGGGGQRRGQSDGQGRHEQGVLGHDDVGEVVRTTKFRSSPCLAGARPITSLHTDIRETIISSSGWKESLHGRPTSAQAARRPAAYNRGMEIFKVFMLEAAHRLPNVPPGHKCARLHGHSFRVELKVEGEPGAQTGWIMDFGDVKAAFQPIYDRLDHHYLNDIPGLENPTSENLAVWIWNELKPSLPALSEITVHETCTS

SEQ ID NO: 209055 - protein, 128 aa, Glycine max
  Coding DNA Sequence Number=SeqID_92277
ITGLCQSFGVPVTLSKVIRPPITRAFIEKYCTPRQVQGDAHQAADAPPPPRQADPAGSLGIERYLQHLVRQQATNHRGQFGAKVAWLEDWPEAQVGEEPVGSVGEAEEARMDEDMTDLHSFLGGSGAT

SEQ ID NO: 209056 - protein, 149 aa, Glycine max
  Coding DNA Sequence Number=SeqID_92278
  Gene Ontology: Mol. function=transferase activity, transferring phosphorus-containing groups; Cellular component=integral to membrane; Biological process=two-component signal transduction system (phosphorelay)
  Homolog annotation: Hit_ID=P0AEC5; Match level="QueryCoverage=98%, HitCoverage=16%, E-value=1e-39, Identity=56%"; Hit description =Signal transduction histidine-protein kinase barA
  Pfam annotation: Domain name=Hpt; Domain location=60-141; Score=58.1; E_value=2.9e-14; Accession=PF01627.13; Description=Hpt domain
MNDYLAKPIDEDKLKQLLQRYAPGSVASAVRQPAIAPSLDWALALRQAANKAELARDLLQMLLDFLPEVEQRVAQCMAQNDVDGLREIIHKLHGSASYSGVPRLKQLCQQLEKSLHQESDIAALEPELLELSDEMANVAREARQVLGVA

SEQ ID NO: 209057 - protein, 152 aa, Glycine max
  Coding DNA Sequence Number=SeqID_92279
  Subcellular localization annotation: CTP_CleavageSite=23; ConfidenceScore=5.32e-01
MATPTKPTKSMAMLGVTPNQPTRSMKIFGVTLTQPTESMAAPSVTHIEPIDQSMEIPCVTHIQPIELMEMPGLIPIQPTSSMTMPGVTPTQQTLTIEMPSETPPSLEFMKQRLEMMASTMETSGHTLSPQMRAQLDSGIKNLLRRVNARLNA

SEQ ID NO: 209058 - protein, 101 aa, Glycine max
  Coding DNA Sequence Number=SeqID_92280
MGAKHLKMTKHKLHATKHRSPDEIRGEQRMQKTLSVFACYQAFRLTDSKNNVYTDNHSGISARQRDSNVSMTDLVSAEDDVNLRVSTGLSVAIDEGRRRRR

SEQ ID NO: 209059 - protein, 165 aa, Glycine max
  Coding DNA Sequence Number=SeqID_92281
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEVIRERVGVAPIVEKMVENRLRWFGHVERRPVDSVVRRVDQMERRQTIRGRGRPKKTIREVIKKDLELNDLDRSEFLQELLWAIGVENRVVERYADLLNCRILSWPFVYLGIPIEANPRKLNLWQPIFDKFSKKLDTLEAQVYVSCG

SEQ ID NO: 209060 - protein, 119 aa, Glycine max
  Coding DNA Sequence Number=SeqID_92282
  Gene Ontology: Mol. function=protein transporter activity; Cellular component=mitochondrial inner membrane; Biological process=protein transport
  Homolog annotation: Hit_ID=Q10QJ0; Match level="QueryCoverage=62%, HitCoverage=36%, E-value=9e-25, Identity=72%"; Hit description =Mitochondrial import inner membrane translocase subunit Tim17/Tim22/Tim23 family protein, putative, expressed
  Pfam annotation: Domain name=Tim17; Domain location=28-118; Score =7.7; E_value=0.0021; Accession=PF02466.9; Description=Tim17Tim22Tim23 family
  Subcellular localization annotation: CTP_CleavageSite=44; ConfidenceScore=5.74e-01
MASDVTVNSVSDVNNAPNPTKSVGPSSTPSLTASLLLPATTSTACGALTGSLFGYGAGLIKKKDFKGSFIQAGSNAKTFAILSGVDSLVVCILGRLRGKDDAINAGVAGCCAGLATSFP

SEQ ID NO: 209061 - protein, 277 aa, Glycine max
  Coding DNA Sequence Number=SeqID_92283
  Homolog annotation: Hit_ID=Q47522; Match level="QueryCoverage=18%, HitCoverage=64%, E-value=1e-23, Identity=100%"; Hit description=LacZ protein
  Pfam annotation: Domain name=zf-C3HC4; Domain location=118-157; Score= 19.8; E_value=0.0014; Accession=PF00097.15; Description=Zinc finger, C3HC4 type (RING finger)
  Subcellular localization annotation: CTP_CleavageSite=47; ConfidenceScore=5.74e-01
MKHFTDTLISANILVPGPPSRSTVSISLISSSFQFQSPLQVSIRPVFSSSVAYVFLILFTTFFFIGFVFLYFRQFASDAATFRRRHPPRREEEEDAAAAASAKKCLPVVGHRGGCAECAICLEELREGDAVKVIPYCKHVFHPHCIDTWLDKQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 209062 - protein, 72 aa, Glycine max
  Coding DNA Sequence Number=SeqID_92284
MRASGNRLPRGCNRLPGLEKGLEHCGGLWLCNSSLASGNRLPRLCNRLPEMKSLKIPLLIACSGYETHCVAA

SEQ ID NO: 209063 - protein, 222 aa, Glycine max
  Coding DNA Sequence Number=SeqID_92285
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=1e-29, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLALRGLHALAFRGLHALAIRRLHVLAFVRLHALTIKGPHALAIVGLHALTFRGLHVLAFIRLNALAFRGLHVLPFRELRVLTFKGLHVLGFRGLHVLGFRVLHAFTFRGLHVLAFRGLHVFAFRWLHALTFRGIHTLTFRGLHVLIGLHALTFRGLHVLPFKGLHALTFKGLQIAVFRGRHVLNFKGRHVLTFRGLCTFTFRGLQVVTFRGLHVLVFRGLL

SEQ ID NO: 209064 - protein, 127 aa, Glycine max
  Coding DNA Sequence Number=SeqID_92286
  Gene Ontology: Mol. function=RNA binding; Cellular component=nucleus; Biological process=RNA splicing
  Homolog annotation: Hit_ID=Q9LZ82; Match level="QueryCoverage=66%, HitCoverage=27%, E-value=3e-28, Identity=74%"; Hit description =Putative RNA-binding protein
  Pfam annotation: Domain name=KH_1; Domain location=48-113; Score =69.5; E_value=1.1e-17; Accession=PF00013.19; Description=KH domain
MAKNASVNRATEKNGDIHKFVFDLRGLEVNFGLQWSDPQSSAEERSNSLTMGVADEHIGLVVGRGGRNIMEISQVSGARIKISDRGDYISGTTDRKVTITGSQRAIRTAESMILQKVAYATERGVME

SEQ ID NO: 209065 - protein, 171 aa, Glycine max
  Coding DNA Sequence Number=SeqID_92287
MGVDSNLHAKPRRRANFRSCNVSSYTSEVLEIQSDAPTLHVLFFPGNPGVILFYKDFLEFLYELLEGTASVTAIGHVSHSRKFSEAPDWTFMREREAQKAFLFGVDDHWGPLHLLEELLHHLKISKQVPGMAISIERENHTHGFCCTEAGSLWVAQHVVNLIKNPMACSNQ

SEQ ID NO: 209066 - protein, 886 aa, Glycine max
  Coding DNA Sequence Number=SeqID_92288
  Gene Ontology: Mol. function=RNA-directed DNA polymerase activity; Cellular component=chromatin; Biological process=chromatin assembly or disassembly
  Pfam annotation: Domain name=Chromo; Domain location=801-849; Score =15.3; E_value=0.015; Accession=PF00385.14; Description='chromo' (CHRromatin Organisation MOdifier
  Pfam annotation: Domain name=rve; Domain location=495-651; Score =102.0; E_value=1.7e-27; Accession=PF00665.16; Description=Integrase core domain
  Pfam annotation: Domain name=zf-H2C2; Domain location=436-477; Score =21.6; E_value=0.00049; Accession=PF09337.1; Description=His(2) -Cys(2) zinc finger
  Pfam module annotation: Pfam domain module=Chromo::RVT_1::rve::zf -H2C2; Domain location=801-849::12-181::495-651::436-477
MLQRGIIQPSKSPFSSPVLLVKKSDNTWRFCVDYRALNALTIKDHFPIPTIDELLDELGGATCFSKLDLLQGYHQIRMQPEDIPKTAFRTHHGHFEFKVMPFGLCNAPSSFQATMNTLFRPYLRRFIIVFFDDILIYSGSFSEHLRHLQATFQILYENHFVLKLSKCLFAQSEVEYLGHLVSHRGVQPVTSKLDAIAQWPIPRSVRALRSFLGLAGFYIRFIRGYATIAAPLVKATTVEPLQWNSSTQAAFDALKQALTSTPVLSLPDFQLPFTIETDASAIGMGAVLSQRGHPIAYFSKPFSPKLLRASTYVRELFAITAAVKKWRQYLLGHSFIILTDHRSLKELMSQVVQTPEQHTYLARLMGYDYQIQYCSGKELHTQLAANSSFQHLFQEVRDTPDNHPDFSTANKLLLYKGRIWLPPDLPIIRTLLTEYHATPTGGHAGVAKTVARLTTNFYWTGLRDDVMRFVANCVDCQVTKYETKKTAGLLCPLPVPTQPWSDLSLDFICGLPSYRGNTTILVVVDRFSKGIHLGMLPQSHTALAVARLFLDLVVKIHGLPQSLVSDRDPLFISQLWQELFKSSGTQLRMSSAYHPQSDGQTEVLNRVVEQYLRAFVHRKPASWGKLLPWVEWSHNTSWMESTGTTPYEITFGQKPFNFPDYLAGSSKNAAVEEILTERDTTFQLVRKKLLKAQSKMKLYADQHRRDVQFAVGDWVLVRLRPYRQFSAKDKKPTNEKLALRYYGPFQVVAKLGPVAYRLALPEGVRLHPVFHCSKLKPFHGDPDSSSPLPLPPTFHENQPLVSPLSILDFRWATSDPQSPWQVLVQWQGLTLEETSWEDWHQLCQDYHLEDKVILQGPRDDTSIENTELRKEDVEEEDDLSKLGEEN

SEQ ID NO: 209067 - protein, 239 aa, Glycine max
  Coding DNA Sequence Number=SeqID_92289
  Gene Ontology: Mol. function=transposase activity; Cellular component= integral to membrane; Biological process=transposition, DNA-mediated
  Homolog annotation: Hit_ID=Q8GXE9; Match level="QueryCoverage=59%, HitCoverage=54%, E-value=6e-43, Identity=55%"; Hit description=HVA22- like protein j
  Pfam annotation: Domain name=TB2_DP1_HVA22; Domain location=47-143; Score=56.3; E_value=9.8e-14; Accession=PF03134.9; Description=TB2DP1, HVA22 family
MALIGGCLNCQTVNRFTFRRILCKPFLLLLPIYDSSLHVRDCCAVQRSYIILDFRLILGYAYPGFECYKTVEKNRGDNGELRFWCQYWVIVALFTVLENFTDVIIGWWFPLYGELKLALFIYLWYPKTKGTGYVYNTVLRPYVSSHENDIEKKFREWRARAWDLAIFYWKNCTELGQATTFQILDYLAAQSKKFSSKSYSEKKDKLGPTPSAPPLSSLRESLFENNQNKFPGRKNKKGD

SEQ ID NO: 209068 - protein, 148 aa, Glycine max
  Coding DNA Sequence Number=SeqID_92290
  Homolog annotation: Hit_ID=Q9FNI0; Match level="QueryCoverage=91%, HitCoverage=93%, E-value=6e-10, Identity=37%"; Hit description =Arabidopsis thaliana genomic DNA, chromosome 5, P1 clone:MHF15
MICRLSRVASAHVNPESVEHSTENPGNDGNEVVVEEAEAGGGEAAEEVGCGGAAGGGGHGLKVGPGGLLDEAVADGNLLAGVRGGGGGVHGGVGRRKHVSEGSVGGGKGGFKGYKFEACCALRRRGGEEEFGHRWGSDGVVAAEGRRL

SEQ ID NO: 209069 - protein, 330 aa, Glycine max
  Coding DNA Sequence Number=SeqID_92291
  Gene Ontology: Mol. function=signal transducer activity; Cellular component=membrane; Biological process=response to light stimulus
  Pfam annotation: Domain name=NPH3; Domain location=1-182; Score =208.6; E_value=1.5e-59; Accession=PF03000.5; Description=NPH3 family
MAFLSSLLKAAIAASASTSCRSDLEKRIGLQLDQAILEDILIATNSHQNTHGAIYDTDSILRIFSNFLNLDEEDEDDNNGHLRDESEMVYDFDSPGSPKQSSILKVSKLMDNYLAEVALDPNLLPSKFISLAELLPDHARIVSDGLYRAVDIFLKVHPNIKDSERYRLCKTIDCQKMSQEACSHAAQNERLPVQMAVQVLYFEQIRLRNAMNGGHNQLFFGGGLNGPFPQRSGSGAGSGAISPRDNYASVRRENRELKLEVARMRMRLTDLEKDHVNMKQELVRSHPANKLFKSFTKKLSKLNAMFRINSIKPGSESRFPFPKRRRHSVS

SEQ ID NO: 209070 - protein, 143 aa, Glycine max
  Coding DNA Sequence Number=SeqID_92292
  Gene Ontology: Mol. function=tyrosine decarboxylase activity; Cellular component=membrane; Biological process=metabolic process
  Homolog annotation: Hit_ID=Q9FNH8; Match level="QueryCoverage=95%, HitCoverage=63%, E-value=2e-56, Identity=80%"; Hit description =Lysine decarboxylase-like protein
  Pfam annotation: Domain name=Lysine_decarbox; Domain location=53-143; Score=85.1; E_value=2.1e-22; Accession=PF03641.4; Description=Lysine decarboxylase family
MEETNSRFKRICVFCGSSSGKKPTYQEAAVQLGRELVERRIDLVYGGGSVGLMGLVSQAVHDGGRHVLGVIPTSLMPREITGDPIGEVRAVSSMHQRKAEMARQADAFIALPGGYGTLEELLEVITWAQLGIHSKPVSSTPQF

SEQ ID NO: 209071 - protein, 65 aa, Glycine max
  Coding DNA Sequence Number=SeqID_92293
MAQWIRRWSTEPEILGSIPSGVEFLKSHNGNILKLNYCWSSLPLLVQMVGGARSVPGITVGTMDS

SEQ ID NO: 209072 - protein, 470 aa, Glycine max
  Coding DNA Sequence Number=SeqID_92294
  Gene Ontology: Mol. function=pepsin A activity; Cellular component =cellulose and pectin-containing cell wall; Biological process =proteolysis
  Homolog annotation: Hit_ID=Q6QJL5; Match level="QueryCoverage=92%, HitCoverage=94%, E-value=1e-119, Identity=52%"; Hit description =Aspartic protease
  Pfam annotation: Domain name=Asp; Domain location=87-464; Score= -100.5; E_value=1.1e-07; Accession=PF00026.14; Description=Eukaryotic aspartyl protease
  Pfam annotation: Domain name=Rubredoxin; Domain location=146-178; Score=-1.8; E_value=0.05; Accession=PF00301.10; Description =Rubredoxin
  Pfam module annotation: Pfam domain module=Asp::Rubredoxin; Domain location=87-464::146-178
  Subcellular localization annotation: CTP_CleavageSite=74; ConfidenceScore=5.37e-01
MAPPSSYYIILFLLLSLLSHTAFTFSNSITLPLSPLLTKPHSSDSDPFHSVKLAASSSLTRAHHLKHRNNNSPSVATTPAYPKSYGGYSIDLNLGTPPQTSPFVLDTGSSLVWFPCTSHYLCSHCNFPNIDPTKIPTFIPKNSSTAKLLGCRNPKCGYLFGPDVESRCPQCKKPGSQNCSLTCPSYIIQYGLGATAGFLLLDNLNFPGKTVPQFLVGCSILSIRQPSGIAGFGRGQESLPSQMNLKRFSYCLVSHRFDDTPQSSDLVLQISSTGDTKTNGLSYTPFRSNPSNNSVFREYYYVTLRKLIVGGVDVKIPYKFLEPGSDGNGGTIVDSGSTFTFMERPVYNLVAQEFLRQLGKKYSREENVEAQSGLSPCFNISGVKTISFPEFTFQFKGGAKMSQPLLNYFSFVGDAEVLCFTVVSDGGAGQPKTAGPAIILGNYQQQNFYVEYDLENERFGFGPRNCKRKA

SEQ ID NO: 209073 - protein, 205 aa, Glycine max
  Coding DNA Sequence Number=SeqID_92295
  Gene Ontology: Mol. function=ribonuclease H activity; Biological process=RNA-dependent DNA replication
  Homolog annotation: Hit_ID=Q1SZM6; Match level="QueryCoverage=72%, HitCoverage=57%, E-value=3e-19, Identity=36%"; Hit description =Ribonuclease H
  Pfam annotation: Domain name=RnaseH; Domain location=45-174; Score= -26.7; E_value=0.018; Accession=PF00075.14; Description=RNase H
MAVGANFYAYPSGVEEGDLSTHFERHCARLNHTKTAYWWLTSASSTHGATAKVFSQQPRDVRWLYPTVGYVKLNTNESSAGNQGYAGPCAMTMNTIAELKAFYHGLEIACSRGIINLICESDSMISTGVSFTHPSAALVAKIQAFKVKDWKLIFQHTLREGNFVADNLAKKGAHLDQLSIMNVCPNALHNLCFADAIGVSTVRLH

SEQ ID NO: 209074 - protein, 113 aa, Glycine max
  Coding DNA Sequence Number=SeqID_92296
  Gene Ontology: Mol. function=signal transducer activity; Cellular component=membrane; Biological process=response to light stimulus
  Pfam annotation: Domain name=BTB; Domain location=5-106; Score=14.1; E_value=0.00021; Accession=PF00651.21; Description=BTBPOZ domain
  Subcellular localization annotation: CTP_CleavageSite=60; ConfidenceScore=5.24e-01
MSTPCNNSASDLTIEVGASSFALHKFPLVSRSGRLRKMLLETKDSKVSRISLPNLPGGAEAFELAAKFCYGINVEFTLSNVAMLKCVAHFLEMTEEFAEKNLETQAEAYLKET

SEQ ID NO: 209075 - protein, 82 aa, Glycine max
  Coding DNA Sequence Number=SeqID_92297
MTSWKKEEAERALRGKSGEETASIEVRCQRLNLNLFPFGKGRERCWNLVVISFQEVNYSKNTLDKRSEQRITFIKGWNIHKN

SEQ ID NO: 209076 - protein, 353 aa, Glycine max
  Coding DNA Sequence Number=SeqID_92298
  Gene Ontology: Mol. function=nucleic acid binding; Cellular component= nucleus
  Homolog annotation: Hit_ID=Q84W91; Match level="QueryCoverage=91%, HitCoverage=90%, E-value=1e-105, Identity=55%"; Hit description=Zinc finger CCCH domain-containing protein ZFN-like 1
  Pfam annotation: Domain name=zf-CCCH; Domain location=178-204; Score =43.5; E_value=7.3e-10; Accession=PF00642.15; Description=Zinc finger C-x8-C-x5-C-x3-H type (and similar)
  Pfam annotation: Domain name=zf-CCCH; Domain location=21-47; Score =43.4; E_value=7.9e-10; Accession=PF00642.15; Description=Zinc finger C-x8-C-x5-C-x3-H type (and similar)
  Pfam annotation: Domain name=zf-CCCH; Domain location=222-248; Score =41.5; E_value=2.9e-09; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=178-204::21-47::222-248
VAAAVRVTGDYPERVGEPPCQGEKECSYYLKTGQCKFGISCKFHHPQPAGTSLPTSAPQFYQQVQSPTVPLPEQYGGASTSLRVARPPVLPGSYVQGAYGPVLLSPGVVQFPGWSHYSAPVSPVLSPGAQPTVGATSLYGVTQLSSPTSAFARPYTPLSSTTGPSGSNLKDQFFPERPGEPECQYYLRTGDCKFGLACRYHHPRDHIVARPLLSPVGLPLRPGVQPCAFYLQNGHCKFGSTCKFDHPLGSTRYTPWVSSFIDVPVTPYPVGSLLSQLAPSTTSSELRPELMSGSKKESLAARISSSGNSSVAEAPDKAARYGNANLKITHYLLDVISQASITSVYSPQYFEGN

SEQ ID NO: 209077 - protein, 293 aa, Glycine max
  Coding DNA Sequence Number=SeqID_92299
  Homolog annotation: Hit_ID=Q8S8Z8; Match level="QueryCoverage=64%, HitCoverage=92%, E-value=3e-79, Identity=77%"; Hit description =Syringolide-induced protein B13-1-9
  Pfam annotation: Domain name=Hin1; Domain location=60-203; Score =176.7; E_value=5.8e-50; Accession=PF07320.4; Description=Harpin -induced protein 1 (Hin1)
MADKQPHLNGAYYGPAIPPAEQPRYRPHRGRSCCCCLFGILWKILVALIVLVGLAILIFWLVVQPRYFKFHVTKADLTQFDYYSNNNTLHYNMVLNFTARNPNKKLSIYYDKVEALAFYEDVRFANYDVITHMNSFRQYKKSSSPMSAVFTGQQVLMLNNEQVSELNQDKNAGVYDIYVKLYFRIRFRLGDVISNDYKPKVKCHLKEQGLFFSDSETSALTTENVESAFLKFLEDIGMVVSKTALECGTGYGKENGVTSDNNATTLSEIMVDIISAGPELENRDEEMVFVRYW

SEQ ID NO: 209078 - protein, 277 aa, Glycine max
  Coding DNA Sequence Number=SeqID_92300
  Gene Ontology: Cellular component=cellulose and pectin-containing cell wall; Biological process=protein transport
  Homolog annotation: Hit_ID=Q8H1B5; Match level="QueryCoverage=77%, HitCoverage=99%, E-value=1e-60, Identity=52%"; Hit description=Hin1 -like protein
  Pfam annotation: Domain name=Hin1; Domain location=118-256; Score =219.9; E_value=5.6e-63; Accession=PF07320.4; Description=Harpin -induced protein 1 (Hin1)
  Subcellular localization annotation: CTP_CleavageSite=66; ConfidenceScore=5.16e-01
MFGGRLSLLFVDYMTRFFQLPYPTVGYITKPQTQGTSSLPLIPSLTSFPTPAFPLSYSYSAMSQLNGAYYGPSIPPPKTSYHRPGRGGGCCCGCLFSLIFKLILTVIIIVGIAGFVFWLIVRPNVVKFHVTDATLTQFNYTANNTLHYDLALNITVRNPNKRLGIYYDRIEARAMFHDARFDSQFPEPFYQGHKSTKVLNPVFKGQQVVPLNAEQSAELKKENATGVYEIDVKMYLRVRFKLGVLKTKTLKPKVSCDLRVPFKGSAAFETTKCHWDR

SEQ ID NO: 209079 - protein, 49 aa, Glycine max
  Coding DNA Sequence Number=SeqID_92301
MDRTFSGLKQGKCDQEFMKGNERRRGVEEKLVINCECERMDKELILLNA

SEQ ID NO: 209080 - protein, 70 aa, Glycine max
  Coding DNA Sequence Number=SeqID_92302
MKREHIKKIEENSLEAILKKNQRRKGPWSPGGVVVGGKAMVDGVGNDTPVGRKTREIDTHFLAVFNLPYF

SEQ ID NO: 209081 - protein, 134 aa, Glycine max
  Coding DNA Sequence Number=SeqID_92303
  Gene Ontology: Mol. function=transporter activity; Cellular component= 1-2nm peptidoglycan-based cell wall; Biological process=transport
  Homolog annotation: Hit_ID=Q6MXU3; Match level="QueryCoverage=99%, HitCoverage=61%, E-value=2e-44, Identity=70%"; Hit description =Membrane transport system permease protein
MNFDSKYIWESLPLLLQGLQLTLIISLSGLLGGFIIGLLAGTCRALGGKIAKTLSLIFVELIRGTPIMVQVMFIYFALPMVLPIRIDPVTAAIVTIVINSGAYIAEITRGAILSINKGFKEASLAMGLSQRSTL

SEQ ID NO: 209082 - protein, 179 aa, Glycine max
  Coding DNA Sequence Number=SeqID_92304
  Gene Ontology: Mol. function=transporter activity; Cellular component= outer membrane-bounded periplasmic space; Biological process=transport
  Homolog annotation: Hit_ID=Q6MXU4; Match level="QueryCoverage=99%, HitCoverage=71%, E-value=3e-88, Identity=89%"; Hit description =Exported solute-binding protein
  Pfam annotation: Domain name=Lig_chan; Domain location=17-179; Score=- 135.6; E_value=0.05; Accession=PF00060.17; Description=Ligand-gated ion channel
  Pfam annotation: Domain name=SBP_bac_3; Domain location=1-176; Score =133.1; E_value=7.8e-37; Accession=PF00497.10; Description=Bacterial extracellular solute-binding proteins, family 3
  Pfam module annotation: Pfam domain module=Lig_chan::SBP_bac_3; Domain location=17-179::1-176
MDFGGLIPGLQSRNLDVAMAGITITDARKQVVDFSNGYYDADLLMAVKSDDNSIKKFSDLTGKKVGLKQGTAAASFMKSKYKANYVEFPNIDNAYLDLQAGNLDAVVHDSPNVLYYVKTAGDGKVKASGENDTILPQQYGFAMQKNSSLTPKINAALQALRADGTYSKIYVKWFAKQPK

SEQ ID NO: 209083 - protein, 216 aa, Glycine max
  Coding DNA Sequence Number=SeqID_92305
  Gene Ontology: Mol. function=isomerase activity; Biological process =aromatic compound metabolic process
  Homolog annotation: Hit_ID=Q1MBY6; Match level="QueryCoverage=55%, HitCoverage=87%, E-value=9e-21, Identity=42%"; Hit description =Putative decarboxylase
  Pfam annotation: Domain name=Tautomerase; Domain location=151-206; Score=15.1; E_value=0.016; Accession=PF01361.11; Description =Tautomerase enzyme
  Pfam annotation: Domain name=Tautomerase; Domain location=87-145; Score=3.4; E_value=0.23; Accession=PF01361.11; Description =Tautomerase enzyme
  Pfam module annotation: Pfam domain module=Tautomerase::Tautomerase; Domain location=151-206::87-145
MAKTLDSKTLARIAPKLAELSQQPDYAGRTDGAGASATATVAYRIRATKWPGTRRDRRSVHPSGLLCRLAGGSVSAKLSGRGVTLMPFTRIILRQGYSDAQLTQISDILQQSLEDEFAVPPGDRFQVFEELPARLRVFDRHYKSRGRSENFVQFMMTAGKPRSREQKHKLCRKLCQQLSQSLDIDPQDVMVIIQFNTVDDWSFSDGCLMSEEARFH

SEQ ID NO: 209084 - protein, 134 aa, Glycine max
  Coding DNA Sequence Number=SeqID_92306
LLVIIPKVVISLLMVSRGIIPFDKHIAAVGTTSNNMLSKRKTLDEGSVLSSKSKTRHEHRFTSTPYVPLDPGIGPLFNSTPNSLKTVPSGVANCRNLPFGGRATRGLTGASSMGGKCAESPPTFIRGKCQKNRK

SEQ ID NO: 209085 - protein, 183 aa, Glycine max
  Coding DNA Sequence Number=SeqID_92307
  Gene Ontology: Mol. function=nucleotidyltransferase activity
  Homolog annotation: Hit_ID=Q9ZUY4; Match level="QueryCoverage=84%, HitCoverage=78%, E-value=6e-26, Identity=41%"; Hit description =Expressed protein
  Subcellular localization annotation: CTP_CleavageSite=78; ConfidenceScore=5.49e-01
MTSASPGHRRKFSGKDPPRKLQPEKHSVRRFAPAPLTLKLPLQSSNDSFLRPSKLLLNVTIESCLGAVQVLLSPEDTVADLIKAALAFYEKEKRRPFLKNTDPKCYDLHFSSFTLESLKADDKLVSLGSRNFFLCSKPPSATCFEKKNMAIDSAFPWMSPHQQKDLTTPDVAPCYLDFTQESG

SEQ ID NO: 209086 - protein, 401 aa, Glycine max
  Coding DNA Sequence Number=SeqID_92308
  Gene Ontology: Mol. function=endopeptidase Clp activity; Cellular component=chloroplast; Biological process=proteolysis
  Homolog annotation: Hit_ID=Q1RVC7; Match level="QueryCoverage=57%, HitCoverage=81%, E-value=1e-103, Identity=76%"; Hit description =Peptidase S14, ClpP
  Pfam annotation: Domain name=CLP_protease; Domain location=202-385; Score=302.0; E_value=1.1e-87; Accession=PF00574.13; Description=Clp protease
MTNVTEHMLLEEKFEGLKAKIDACMEEKIGCMEISMTEMLLRKVLGKHPKDEHESSNCNERDSSGNGSNLDYHHSFGEISCASKKGGRIKKTQLDGPQRLKPILKFRASEVVKIKLEKPSMEESTIHWFNLLREFEAPLTSGKFMAALVAGFEKQRPAPCNTPRLTEMKSKGLCFRYANHNPSMARIRMMPIGTPKVPYRTPGEGTWQWVDVWNALYRERVIFIGQEIDEEFSNQILATMLYLDSIDNSKKLYMYINGPGGDLTPSMAIYDTMQSLQSPVATHCVGYAYSLAAFLLAAGEKSNRSAMPLSRVALTSPAGAARGQADDIQNEANELLRIRDYLFNELSKKTGQPLEKITKDLSRMKRFNAQEALEYGLIDRIVRPPRIKADAPRKEAGTGLG

SEQ ID NO: 209087 - protein, 76 aa, Glycine max
  Coding DNA Sequence Number=SeqID_92309
  Gene Ontology: Mol. function=endopeptidase Clp activity; Biological process=proteolysis
  Homolog annotation: Hit_ID=Q1RVC7; Match level="QueryCoverage=77%, HitCoverage=21%, E-value=2e-09, Identity=56%"; Hit description =Peptidase S14, ClpP
  Subcellular localization annotation: CTP_CleavageSite=31; ConfidenceScore=5.62e-01
MAVAPYTTGSAPRFSPPPTSSVATKLYSGLKLQAASSFRAARPNVTAEFYGKVHNTLHCRIGAFFAALNLARLFLT

SEQ ID NO: 209088 - protein, 94 aa, Glycine max
  Coding DNA Sequence Number=SeqID_92310
MASPLLPSFFEVAGEAQGGFLENATYDKVDESNDGYHKSLFNIEDESVDNVDEITTQEQEESDDNLKTRIESFIVKVYKGWIEESYWDKYGIDM

SEQ ID NO: 209089 - protein, 254 aa, Glycine max
  Coding DNA Sequence Number=SeqID_92311
  Gene Ontology: Mol. function=DNA binding; Cellular component =mitochondrion; Biological process=chromosome organization and biogenesis (sensu Eukaryota)
  Homolog annotation: Hit_ID=Q1RVC8; Match level="QueryCoverage=77%, HitCoverage=56%, E-value=2e-70, Identity=70%"; Hit description=HMG-I and HMG-Y, DNA-binding
  Pfam annotation: Domain name=DUF296; Domain location=30-150; Score =231.6; E_value=1.7e-66; Accession=PF03479.5; Description=Domain of unknown function (DUF296)
MEDLNFYENSWLKLAIGMGEWVACSVGANFTPHIITVNSGEDVTMKVISFSQQGPRAICILSANGVISSVTLRQPDSSGGTLTYEGRFEILSLSGSFMPSESGGTRSRSGGMSVSLASPDGRVVGGGVAGLLVAASPVQVVVGSFLAGNQHEQKPRKQRHEVITSVIPAAVVPISTLDPVPILSAASSIRNDNWSAMPAEAKNKPADINVSLPAGCWLCFPLFVVSVIVDFLPGPALFSEVYQLPVLVEFELAD

SEQ ID NO: 209090 - protein, 273 aa, Glycine max
  Coding DNA Sequence Number=SeqID_92312
  Homolog annotation: Hit_ID=O21999; Match level="QueryCoverage=21%, HitCoverage=38%, E-value=4e-19, Identity=78%"; Hit description=LacZ -alpha
DLPSQWLLFLSAVPPVQLLTGWCVTAKAPPDISAGKCSGRVPFAIQAAQLLGRAIGAGLFAITPAGERGMCCKAIKLGNARVFPEFDHVGRGKTGAFRGAHAAEHGVVVHAADDEIFRPARQLHQRRVGGVHDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 209091 - protein, 187 aa, Glycine max
  Coding DNA Sequence Number=SeqID_92313
  Gene Ontology: Mol. function=zinc ion binding; Cellular component =cytoplasm; Biological process=signal transduction
  Homolog annotation: Hit_ID=Q9FK90; Match level="QueryCoverage=59%, HitCoverage=26%, E-value=3e-24, Identity=56%"; Hit description=Zinc finger protein-like
  Pfam annotation: Domain name=zf-ZPR1; Domain location=8-134; Score =15.0; E_value=6e-11; Accession=PF03367.4; Description=ZPR1 zinc -finger domain
MTFYDIVSTTVIKGTALESGSVAILKSSEIEGMNISYIPLMLNRQVVKVEYATIKIPELDFEIPPEAQRGSLSTILLIHIPIYFVLFSFLSLTVAPKTAKAIHQFLVKLRAYAKGKSAFTFILDDPAGNSFIENPPPKRPKSEAVPKSEALLTALGGTPSNRLPFPFSSFITSHHIVGSSACTNVPI

SEQ ID NO: 209092 - protein, 251 aa, Glycine max
  Coding DNA Sequence Number=SeqID_92314
MTKKFHQTVGERWRQLKLDLTSKWDLAEGKNDDDDKVCENYSINKDKWNQFCQSRRDPSWEMTCEVEAGLHKKLGQMTSEETCQIVDKIGIIHLDELDVAFSGAHVSTKGSYVYPSRQDPDIDAFDRHGLYVDENPPRLVSFMMKVGVEEIRDANALTSIPTKKVQLVGHVLNTFIAWPKHLVKPFSEMLVVICPKDNIVVWLCSLHNKSNNYLKGMNFTYPRALESEKIKEINIEWEKCLLRFRNEELNV

SEQ ID NO: 209093 - protein, 83 aa, Glycine max
  Coding DNA Sequence Number=SeqID_92315
  Gene Ontology: Mol. function=transition metal ion binding
MHKCPNCGVSQYKVKDDECSSDESTKKGPLTKVLRYLPIIPRFKGNGINVYPSPLIEDLRKLWDEGVDVFDGNQKEIFKLHAM

SEQ ID NO: 209094 - protein, 66 aa, Glycine max
  Coding DNA Sequence Number=SeqID_92316
  Homolog annotation: Hit_ID=Q9C6U0; Match level="QueryCoverage=91%, HitCoverage=4%, E-value=9e-23, Identity=85%"; Hit description =Clathrin heavy chain, putative
MQTVDNDLALKIFIKARATPKVVAAFVERREFDKIMIHSKQVGYTPDYMFLLQTILRADAQVSGFF

SEQ ID NO: 209095 - protein, 89 aa, Glycine max
  Coding DNA Sequence Number=SeqID_92317
MLQSLYQGQQVIIQDLHRLSLHLKMDPPLTTPDAYIQQVAWSGVQPSTDRRGKPSRVGDTMAGAEEDIIADQAVAGWGPTDLGGEDIGL

SEQ ID NO: 209096 - protein, 58 aa, Glycine max
  Coding DNA Sequence Number=SeqID_92318
MDQLKRLSIPSGMLRFSNHASYPTSGPSDKLVPKTLEGQCTVPPTIIHNIQRMNVAKS

SEQ ID NO: 209097 - protein, 75 aa, Glycine max
  Coding DNA Sequence Number=SeqID_92319
  Subcellular localization annotation: CTP_CleavageSite=40; ConfidenceScore=5.21e-01
MTRQLMLSSSRCNPNYSHKSNHRGLHCLRSLRLVPQLLVSAQRGVVLIPQRPIQTRVTQTNADCTSKKILLAWLP

SEQ ID NO: 209098 - protein, 66 aa, Glycine max
  Coding DNA Sequence Number=SeqID_92320
MPKTISNYGDHGMVLATGHGAEIAMDANEAMSRETNEVEFTGLGATATIDLEEPSYTTKKRLFKDD

SEQ ID NO: 209099 - protein, 577 aa, Glycine max
  Coding DNA Sequence Number=SeqID_92321
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=99%, HitCoverage=89%, E-value=1e-156, Identity=43%"; Hit description =Leucine-rich receptor-like protein kinase
  Pfam annotation: Domain name=LRR_1; Domain location=105-127; Score =9.3; E_value=5.1; Accession=PF00560.23; Description=Leucine Rich Repeat
  Pfam annotation: Domain name=LRR_1; Domain location=129-151; Score =14.5; E_value=0.39; Accession=PF00560.23; Description=Leucine Rich Repeat
  Pfam annotation: Domain name=LRR_1; Domain location=153-175; Score =8.1; E_value=8.7; Accession=PF00560.23; Description=Leucine Rich Repeat
  Pfam annotation: Domain name=LRR_1; Domain location=177-200; Score =12.0; E_value=1.6; Accession=PF00560.23; Description=Leucine Rich Repeat
  Pfam annotation: Domain name=LRR_1; Domain location=202-224; Score =10.4; E_value=3.2; Accession=PF00560.23; Description=Leucine Rich Repeat
  Pfam annotation: Domain name=LRR_1; Domain location=226-248; Score =10.1; E_value=3.7; Accession=PF00560.23; Description=Leucine Rich Repeat
  Pfam annotation: Domain name=LRR_1; Domain location=249-270; Score =15.0; E_value=0.27; Accession=PF00560.23; Description=Leucine Rich Repeat
  Pfam annotation: Domain name=LRR_1; Domain location=28-50; Score=9.4; E_value=5; Accession=PF00560.23; Description=Leucine Rich Repeat
  Pfam annotation: Domain name=LRR_1; Domain location=5-27; Score=2.0; E_value=1.2e+02; Accession=PF00560.23; Description=Leucine Rich Repeat
  Pfam annotation: Domain name=LRR_1; Domain location=81-103; Score =10.9; E_value=2.6; Accession=PF00560.23; Description=Leucine Rich Repeat
  Pfam annotation: Domain name=Pkinase; Domain location=333-575; Score=- 1.7; E_value=1.8e-08; Accession=PF00069.15; Description=Protein kinase domain
  Pfam annotation: Domain name=Pkinase_Tyr; Domain location=333-575; Score=-17.2; E_value=2e-11; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=105-127::129-151::153-175::177-200::202-224::226 -248::249-270::28-50:...
  Pfam module annotation: Domain location=:5-27::81-103::333-575::333 -575
MEHESLRFFDASVNELAGTILTELCELPLASLNLYNNKLEGVLPPILAHSPNLYELKLFSNKLIGTEILAIICQRGEFEESLKRVRLKSNNLSGSVPDGVWGLPHLNLLELSENSLSGKISKAISGAYNLSNLLLSNNMFSGSIPEEIGMLDNLVEFAASNNNLSGRIPESVMKLSQLVNVDLSYNQLSGELNLGGIGELSKVTDLNLSHNRFDGSVPSELGKFPVLNNLDLSWNKFSGEIPMMLQNLKLTGLNLSYNQLSGDIPPFFANDKYKTSFIGNPGLCGHQLGLCDCHCHGKSKNRRKAKKLKVLSVSRWKSFHKLGFSKFEVSKLLSEDNVIGSGASGKVYKVVLSNGEVVAVKRLCGAPMNVDGNVGARKDEFDAEVETQGRIRHKNIMRWLWCCCNSEDQRLLVYEYMPNGSLADLLKGNNKSLLDLPTRYKIAVDAAEGLSYLHHDCVPPIVQDVKSNNILDPMATLHQNTRTLRVNEKCDIYSFGVVLLELVTGRPPIDPEYGESDLVKWVSSMLEHEGLDHVIDPTLDSKYREEISKVLSVGLHCTSSIPITRPTMRNVVKMLQE

SEQ ID NO: 209100 - protein, 214 aa, Glycine max
  Coding DNA Sequence Number=SeqID_92322
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=99%, HitCoverage=34%, E-value=5e-26, Identity=37%"; Hit description =Leucine-rich receptor-like protein kinase
MVKPNINVVQRQVTPRIPRLRSNKFVTEQFKLIEVGRMRKNRWDGTHEVAAREEKRFEVPEVTELIGMRLGKNSFEVAKGRGYCFGEEVADEVERFEAGEGGEARRNVAGEVEVLERGGMGPTRLFWERSRTTRLRHTAATTAERGDDAAEDGGKGAGEGGGGEAHGSNGGGERVTGDAAPPAWVGGRGVPGGEGVFRVGKLPSCFEEKETVLG

SEQ ID NO: 209101 - protein, 97 aa, Glycine max
  Coding DNA Sequence Number=SeqID_92323
MTNANCPQESLHSVSNGNLSPNAWRGLFIQHICGASAGLQGKRWQWWWFALTYSIWKHRNNIIFSNTTLFSLRCIKSLTNNSNLSSSWEVIRRNGGN

SEQ ID NO: 209102 - protein, 113 aa, Glycine max
  Coding DNA Sequence Number=SeqID_92324
MVHAKLWGILLGIHIAWSQGCTRGSFSWSHAHREANQVAYALASFAQSFEDRLRIFDVVPSLIDLAVMTNVISMIPSCALSEIMVMPPCRGQSHNLKGGSRVAPTSCLALASK

SEQ ID NO: 209103 - protein, 84 aa, Glycine max
  Coding DNA Sequence Number=SeqID_92325
MLGAPSSTQKVLDDISYDMENGDMEDGSDSESFDVEFIDDDACSMESFEGCESDGSDNVIIIHFINDIYSLELSTMVPTDAKKL

SEQ ID NO: 209104 - protein, 130 aa, Glycine max
  Coding DNA Sequence Number=SeqID_92326
  Gene Ontology: Mol. function=transporter activity; Cellular component= integral to membrane; Biological process=oligopeptide transport
  Homolog annotation: Hit_ID=Q7XJQ3; Match level="QueryCoverage=89%, HitCoverage=20%, E-value=4e-39, Identity=60%"; Hit description =Putative peptide/amino acid transporter
MSQFIPSLKPCINERCHQPRKVHEVVFFLALYCIALGTGGFKPCLESFGGDQFDDDHFEERKKKMSFFNWWTFTLFVAMLFGATMIVYVQDFVNWGVASLILTIFMALNIIAFYVGKTLKETLSCQFYKS

SEQ ID NO: 209105 - protein, 73 aa, Glycine max
  Coding DNA Sequence Number=SeqID_92327
LSVRLALSPNPLTRTKRDGGAKRIVSAYFGKRALEAERGATCALKSGFCNLIEISSLESECEMLRRGGGILLV

SEQ ID NO: 209106 - protein, 114 aa, Glycine max
  Coding DNA Sequence Number=SeqID_92328
MKGITGAPYRARCDALTITNVSWLSYTEHRGVRAFELISSFQGQLRWGPKMVTARLERVVSADYMEWFFRISHPFMIPTQAGDQPRDAPAVDPEEYIQPPSPPVPVAFDPPPHA

SEQ ID NO: 209107 - protein, 113 aa, Glycine max
  Coding DNA Sequence Number=SeqID_92329
MPLQQGRYLAQDVPDATKKPNRKRKSGIEGRYLTKARDVTVAEDVDTEVQRHKDAKSGGEEGYETETRRVEVKKELRPRRREHEKIGLWYHIFLNHVGVKGVTRGGGGRGGRQ

SEQ ID NO: 209108 - protein, 63 aa, Glycine max
  Coding DNA Sequence Number=SeqID_92330
VKKRLSHEVPKRSLSVLSAIKESGRALISRSHAKHEISVLSVVVVFSQAQLTTGAKLKSTYSR

SEQ ID NO: 209109 - protein, 408 aa, Glycine max
  Coding DNA Sequence Number=SeqID_92331
  Homolog annotation: Hit_ID=Q4LBN8; Match level="QueryCoverage=94%, HitCoverage=82%, E-value=9e-31, Identity=26%"; Hit description=Type IV pilus protein
  Pfam annotation: Domain name=PAP_PilO; Domain location=26-408; Score=- 86.0; E_value=4e-07; Accession=PF06864.3; Description=Pilin accessory protein (PilO)
MKRIRKAPAPAQDPGDIRVMTINHRRFVVGLTWQTIRAQRNPMKEIRRVGKEQGLDLVAVRRSDSIQAGFAPKTRLRLRGTFSLTVSLASLLEGCCIAVVPLGEGPDGTQQYTLVGKTERGGIHPWSDKVYAAALLRQTLIDLRGELRGSKSDLEVPVYGDPAVAGVTAPLDLEAVLAPKQLSKDFRLRPLTWGMTRGQLMTAAAVAALALAGLGFWLHVEGEREAAARAALQREMARQAELNKQARYKAALDSFRHPWTEQPSVGAFIGQCQRMLDRVPLSIAGWMTVTVVCAQGDASVQSIRRTNSAATTAGYVAEVKKLFGVTPVFSFADSSQASFTLSQTPKPEGDDPMVPVDERLMQFISRFQSLNIDLAVSAVPIKDVKKNSEGEDLPLQDWQEYQFSAETD

SEQ ID NO: 209110 - protein, 116 aa, Glycine max
  Coding DNA Sequence Number=SeqID_92332
  Pfam annotation: Domain name=TraY; Domain location=49-108; Score= -8.0; E_value=0.0045; Accession=PF05509.2; Description=TraY family
MEAAMAAVDPMVYAQLCKPFPVLTERQDQSYLMAVTYLMLTLRIHGVDMAAPKNHKGIAIMLYMSTELNEKLTASAKKSGRAKVTEALFRLEDHLSLFESIATPGQRFPAGTGSKD

SEQ ID NO: 209111 - protein, 213 aa, Glycine max
  Coding DNA Sequence Number=SeqID_92333
MKRFPKGWPHGLKRLRRPMRLCRRLPPTEANGQPSDAADCRQPSPTIGLFEMKYLIAALGLITFSSPVFAASCEKNFTVSGVPMVTAVSYKSWQELPKAKAPAVLQKLAQAVAAEGFSGIQINKALSSIDAHQETSGSGRIQTLRVVARQKGAAVRIDAVFNIQAGQIADKNVIREGPAHPKLIAGQAASAPSPDACAGAAPVVAGMALTVWM

SEQ ID NO: 209112 - protein, 102 aa, Glycine max
  Coding DNA Sequence Number=SeqID_92334
  Gene Ontology: Mol. function=electron carrier activity; Biological process=electron transport
  Homolog annotation: Hit_ID=Q26DC1; Match level="QueryCoverage=87%, HitCoverage=45%, E-value=3e-29, Identity=66%"; Hit description=Thiol- disulfide isomerase/thioredoxin
MIERAKQKGFTFPYLVDEGQKIYPQYGATKTPHVFILQKENGKNIVKYIGAIDNNYDNPNDVSEYYAQDAVNALLKGEPVKMTKTVAIGCTVKKKQASKKEA

SEQ ID NO: 209113 - protein, 152 aa, Glycine max
  Coding DNA Sequence Number=SeqID_92335
  Gene Ontology: Mol. function=thiamin phosphate kinase activity; Biological process=thiamin biosynthetic process
  Homolog annotation: Hit_ID=Q1XMZ3; Match level="QueryCoverage=94%, HitCoverage=41%, E-value=1e-43, Identity=59%"; Hit description =Thiamine-monophosphate kinase
MEGYDYILERQLKPEARTDVKTILKELDIKPTSMIDISDGLASEILHLSDQSKVGFRLYEEKIPMDSLTISTADEMNLNPVVTALSGGEDYELLFTIAPADFDKIKNHPDFTIVGHAVDKEDGNFMVARGSNQLIPLTAQGWDAFLGNQQGE

SEQ ID NO: 209114 - protein, 96 aa, Glycine max
  Coding DNA Sequence Number=SeqID_92336
MTTFKVPNKTLTILRKNFQKLLHKWKFGNLLEAPNTLPMKGLFVTKLESNEVLLSPIALKVVGPFLLDSNSSRDDTNPPSNSLYGNPQTRKQRDKQ

SEQ ID NO: 209115 - protein, 243 aa, Glycine max
  Coding DNA Sequence Number=SeqID_92337
  Gene Ontology: Mol. function=DNA-directed DNA polymerase activity; Cellular component=mitochondrion; Biological process=DNA replication
  Homolog annotation: Hit_ID=Q6QZN8; Match level="QueryCoverage=65%, HitCoverage=20%, E-value=3e-37, Identity=53%"; Hit description=DNA -directed DNA polymerase
MTLFRSFCNIPVVAARNDVVAPAEGSTLLSRPEFIDDVFIREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPNWKELSVKNKESTTTLGKKTCLLLHFLAFPFLHFPVLPLRIPTLKFIEINSVIESETS

SEQ ID NO: 209116 - protein, 74 aa, Glycine max
  Coding DNA Sequence Number=SeqID_92338
MVNELGMRILLRLGGVDGDPVLRGTRRRATYVVVPEDMSPGVRRPWARQVGCYCPKPSLADPDPTRAKSASENL

SEQ ID NO: 209117 - protein, 121 aa, Glycine max
  Coding DNA Sequence Number=SeqID_92339
  Pfam annotation: Domain name=AT_hook; Domain location=46-58; Score =16.7; E_value=0.03; Accession=PF02178.9; Description=AT hook motif
  Pfam annotation: Domain name=AT_hook; Domain location=88-100; Score =10.9; E_value=0.3; Accession=PF02178.9; Description=AT hook motif
  Pfam module annotation: Pfam domain module=AT_hook::AT_hook; Domain location=46-58::88-100
MEGRENFGVVVGDEAPESFHVAPRIENNLDFSRATVPAPAPPTEGKKKRGRPRKYGPDGKPALGAVTALSPMPISSSIPLTGEFSAWKRGRGRPVESIKKSSFKFEVESPGPGFTVTSVAK

SEQ ID NO: 209118 - protein, 182 aa, Glycine max
  Coding DNA Sequence Number=SeqID_92340
QSNTSRLRFPALITALCRARGVVSDSLTFERLSPVVAPPGSIPSVEKFKEMVAWPGTQPSLRREDEGSTTQVPQHVEDESSEATIPEPFVIGEEAGETQVRQVAAATPEISLEATSEPPTPVVDLPSPQCTTDPSTPILEILEDPTTLVLAMDTSPPATPVLHLTDEEDVQTQDTQDQSQEF

SEQ ID NO: 209119 - protein, 56 aa, Glycine max
  Coding DNA Sequence Number=SeqID_92341
PFAKHEPCAKLIFGHALSRESQALSAQPLHLRLIHSAKLAKAKLSLIEFDLNLAKQ

SEQ ID NO: 209120 - protein, 350 aa, Glycine max
  Coding DNA Sequence Number=SeqID_92342
  Gene Ontology: Mol. function=hydrolase activity, hydrolyzing O -glycosyl compounds; Biological process=tricarboxylic acid cycle intermediate metabolic process
  Homolog annotation: Hit_ID=Q7CFV6; Match level="QueryCoverage=99%, HitCoverage=79%, E-value=1e-144, Identity=72%"; Hit description =Phospho-beta-glucosidase
  Pfam annotation: Domain name=Glyco_hydro_4; Domain location=1-325; Score=255.3; E_value=1.3e-73; Accession=PF02056.6; Description =Family 4 glycosyl hydrolase
LRVGQLAARAADERLGLKYGRLGQETTGVGGFAKALRTIPVMLEIARKVEQLAPDAFIINFTNPAGIVTEAVARYSNAKIIGLCNVPVNMHHMIAGMLQAPFDEVALRFAGLNHLVWVHQVLCRGEDVTAGVIEQLCEGQALTMNNIKEMPWSPAFLRALQAIPCPYHRYYWQTPQMLAEEQEKAQHGQAGTRAEQVMKVEAELFTLYADPQLTHKPEQLSFRGGAYYSEVAVELISAIHNNSGQNLVVNCQNRGAIHGLPDDAVVEVNCVVDAQGAHPLVFGALPPLMHGLTQQIKAFERLTIDAAVHGDRGAALLALVGNPLVGDVASAEALLDEVLTLNQPWLPQFA

SEQ ID NO: 209121 - protein, 69 aa, Glycine max
  Coding DNA Sequence Number=SeqID_92343
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P46317; Match level="QueryCoverage=89%, HitCoverage=13%, E-value=1e-09, Identity=53%"; Hit description =Lichenan permease IIC component
MSNRNIIERYVLPAALKVAGQKHVLSVRDGIILNMPFMLIGSFFSDLRLPARPGVGPSDGRPVRRQLAQ

SEQ ID NO: 209122 - protein, 91 aa, Glycine max
  Coding DNA Sequence Number=SeqID_92344
MYPVERYMKILKGYTKNLYHPEASIVERYIAEEAIEFCSEYLEKGKAVGLEEGRIFAANEQLQISFPPQVQASCVAALRAQKIPKTNPSYY

SEQ ID NO: 209123 - protein, 113 aa, Glycine max
  Coding DNA Sequence Number=SeqID_92345
  Subcellular localization annotation: CTP_CleavageSite=39; ConfidenceScore=5.09e-01
MALIISMHTIAINLQEIQSKSTSTTQVDVPSTCTTKDVSSNVLRQSSQAVKPLKLCEWGYKRILKREIGDTKEFRRLVLCSFGKGRRETQTEFRRLVLGEFLLAKGEGNEKDE

SEQ ID NO: 209124 - protein, 61 aa, Glycine max
  Coding DNA Sequence Number=SeqID_92346
GAKGPAKPADKSDPDVNPLCLMTLTIPWLFLKPLQVSWDATVFGVYNDNFPLYIGMKIFLK

SEQ ID NO: 209125 - protein, 35 aa, Glycine max
  Coding DNA Sequence Number=SeqID_92347
MPDNYLKGIINNALKGFDDSQQSKSKHATRWIVVK

SEQ ID NO: 209126 - protein, 186 aa, Glycine max
  Coding DNA Sequence Number=SeqID_92348
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=7e-25, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHVLAFRGLHALTFRGLHALAFKGLHVLAFRGLQVLAFRGLHALAFRGLHVLAIRGLHAFRGLHALKGLHILAIRGLHVLAIRGLHALAFRGLRGYMHALKGLRVLTFRGLHVLTFRGLHVLAFRRLHTLSFRGLHALTFRRLHVLAFRGLHALTFRGLHVLTFRGLHVLAFK

SEQ ID NO: 209127 - protein, 101 aa, Glycine max
  Coding DNA Sequence Number=SeqID_92349
MARTLERKVTQGGLPPTVKNGSATSTHAKKSTESNLINDVLLPHYQKINKVEMAQRRAKGMLFWIQIYLERTTMRMTAADLLFKSEFELEDMLKVRARVMI

SEQ ID NO: 209128 - protein, 111 aa, Glycine max
  Coding DNA Sequence Number=SeqID_92350
  Gene Ontology: Mol. function=ribonuclease H activity
  Homolog annotation: Hit_ID=Q1SZM6; Match level="QueryCoverage=55%, HitCoverage=20%, E-value=2e-12, Identity=54%"; Hit description =Ribonuclease H
MGIPITHPMAPLVKIIVELVSSQWHVMFQHTLREGNKIVDWLTKKGASSVDVFKSWDGCPTQLRHTLVAKESIIQGKEHPTRGVELGVALQGNSSLQKYKNILMFRCKTPF

SEQ ID NO: 209129 - protein, 115 aa, Glycine max
  Coding DNA Sequence Number=SeqID_92351
MDQSWMKASRISDEYENWVDQFLEFAQQNAQELGGKYLCPCVKCGNERRHVVNNIKTHLICDGIILSYTRWIWHEDASKPKHIVEKDRRDECQGYIARWLKHLKREIYLGAYLNK

SEQ ID NO: 209130 - protein, 214 aa, Glycine max
  Coding DNA Sequence Number=SeqID_92352
  Gene Ontology: Mol. function=RNA-directed DNA polymerase activity; Cellular component=integral to membrane; Biological process=RNA -dependent DNA replication
  Homolog annotation: Hit_ID=Q1S6N2; Match level="QueryCoverage=75%, HitCoverage=54%, E-value=1e-34, Identity=45%"; Hit description=RNA -directed DNA polymerase
MTFFKSSWEVIGSDVCLAIQEFHHNAKLPKAFTSSLIALIPKWMKTIISSSNISILVNGSLTSEFLASRGLKQGDPLSPFLFLIVDQGMMWLVHSAVEKGLFKGLKVGEEFQYSILQYANDSILVGEAIHDNLWAIKETFKGFELVSGLSVNFYKSVFYGIGTNQRFNEAVANFLSCRVDSPPFHFLGLPVGVSPTLSSTWEPVTIKFWKRLLK

SEQ ID NO: 209131 - protein, 100 aa, Glycine max
  Coding DNA Sequence Number=SeqID_92353
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=50%, E-value=1e-35, Identity=66%"; Hit description=CTV.20
MNEELLQYCQREIKDLLDKGLIRKSKSSWSCAAFYVNKQEELERGTPRLVINYKPLNQALQWIRLNSTKIFSKFDMKSGFWQIQIQESDRYKTFFTVPFG

SEQ ID NO: 209132 - protein, 83 aa, Glycine max
  Coding DNA Sequence Number=SeqID_92354
RGNPGKTPLSGGNNTSDGVVIREDQNPRNPSSDATASREQVNAMYDPAFERAGVPIDPILRLFNANSAEKPAEEGRENPNWKS

SEQ ID NO: 209133 - protein, 96 aa, Glycine max
  Coding DNA Sequence Number=SeqID_92355
MANFKVFTIMTNKSHAKQSIDTEYSRERDNTIFFFKDSMQESITLKSQIELLQKVAWGYKCARECSYKSCKSIEFRNNVHSFQLLGASNWSKRKEA

SEQ ID NO: 209134 - protein, 44 aa, Glycine max
  Coding DNA Sequence Number=SeqID_92356
  Homolog annotation: Hit_ID=Q1S5Z7; Match level="QueryCoverage=66%, HitCoverage=3%, E-value=6e-08, Identity=93%"; Hit description=DNA topoisomerase II; Serine/threonine-specific protein phosphatase and bis(5-nucleosyl)-tetraphosphatase
MVNRYINYLFLGDYVDRGQHSLETISLLRALKVENIQRPITMEA

SEQ ID NO: 209135 - protein, 49 aa, Glycine max
  Coding DNA Sequence Number=SeqID_92357
MVKGAQWWCDTLTSCEIFEKEHRWFQSGLGRGVRGGNNVSFWEAKWLGD

SEQ ID NO: 209136 - protein, 65 aa, Glycine max
  Coding DNA Sequence Number=SeqID_92358
MHGVRGCCQPVRRGEAAHDENYAVCDFGLASIACRKIGLRRVERRAVSCSGPPYCRQSASASIDA

SEQ ID NO: 209137 - protein, 174 aa, Glycine max
  Coding DNA Sequence Number=SeqID_92359
  Homolog annotation: Hit_ID=Q1SM26; Match level="QueryCoverage=66%, HitCoverage=28%, E-value=7e-18, Identity=40%"; Hit description =Nucleic acid-binding, OB-fold
  Pfam annotation: Domain name=DUF223; Domain location=40-135; Score= -12.6; E_value=0.043; Accession=PF02721.5; Description=Domain of unknown function DUF223
MARIPNKIRSSDGSKEALKLAVRITDLWFVGTPDKSEQAEMVFVDSEGDQIHAICKSDHLKSWKADLKENCTYVMHNFKVVKNDGQFRVCEHEYKLFFIGVTVVREADLHELPFKEFIFVEFANVAAGNFVSGLLFGSYPASVSNSFKASKLLINDPILEIQEFKDRLLDLGVE

SEQ ID NO: 209138 - protein, 553 aa, Glycine max
  Coding DNA Sequence Number=SeqID_92360
  Gene Ontology: Mol. function=DNA binding; Biological process=plasmid partitioning (sensu Bacteria)
  Homolog annotation: Hit_ID=P07620; Match level="QueryCoverage=43%, HitCoverage=61%, E-value=1e-108, Identity=77%"; Hit description =Plasmid partition protein A
  Pfam annotation: Domain name=CbiA; Domain location=1-176; Score= -11.0; E_value=0.00061; Accession=PF01656.13; Description=Cobyrinic acid a,c-diamide synthase
  Pfam annotation: Domain name=ParB; Domain location=423-549; Score =152.0; E_value=1.6e-42; Accession=PF08775.1; Description=ParB family
  Pfam annotation: Domain name=ParBc; Domain location=280-367; Score =48.2; E_value=2.7e-11; Accession=PF02195.8; Description=ParB-like nuclease domain
  Pfam module annotation: Pfam domain module=CbiA::ParB::ParBc; Domain location=1-176::423-549::280-367
LRILVIDLDPQSSATMFLNHERSVGLVEATAAQAMLQNVSRDELKSEFIVPSIIPGVDVLPASIDDAFIASRWEELCAEHLPQQNVHAVLYENVVAKLKKDYDFIFIDSGPHLDAFLKNAIAASDLLMTPVPPAQVDFHSTLKYLTRLPELIDIIEESGATCRLQGNIGFMSKLSNKADHKMCHSLAKEIFGGDMLDAALPRLDGFERCGESFDTVISANPSTYVGSSEALKNARSAAEDFAKASPLQNEPSEDGHSQTFILSTGKRALFTLEHITAKEIEERTYVVMETNGRDQSGLTPESLRDIIRTIKLQQFFPAIGVKRGDRIEILDGSRRRAAALHCKTGLDVLVTDVTISAEEARRLAQDIQTAREHNLREVGMRLMSLKDSGLSQKEIAQSEGLSQAKVTRALQAASVPLELVTLFPNHSELTYPDYKTLLQAYEKLQETGQTVDALIETIGMDVDSVCAREGLAEDEVKNGILRLVRNGSQTLVQAPTKDKVVATPLWTFADKDRYARKKTRGRMFSYEFNRQSRELQEELDRVITETLNKYLNQ

SEQ ID NO: 209139 - protein, 94 aa, Glycine max
  Coding DNA Sequence Number=SeqID_92361
MGFFLVGNLALSVFGLFLFCFCLARGEQATDAQILSGPKTFLYISSCRNVPFMGERGRGSRVRFPKEERCAESPPTFIWENVGKTEGNWSKGKF

SEQ ID NO: 209140 - protein, 54 aa, Glycine max
  Coding DNA Sequence Number=SeqID_92362
MVINLSLKGVPNRVTCPQVQVFSLMRNYNMKHGHHQCIDRGSLRILSHLPPEMA

SEQ ID NO: 209141 - protein, 175 aa, Glycine max
  Coding DNA Sequence Number=SeqID_92363
  Gene Ontology: Mol. function=iron ion binding; Cellular component =mitochondrion; Biological process=iron-sulfur cluster assembly
  Homolog annotation: Hit_ID=Q5PH66; Match level="QueryCoverage=61%, HitCoverage=99%, E-value=7e-48, Identity=77%"; Hit description =Hypothetical protein sufA
  Pfam annotation: Domain name=Fe-S_biosyn; Domain location=18-94; Score=91.3; E_value=2.9e-24; Accession=PF01521.11; Description=Iron -sulphur cluster biosynthesis
MELHSETFNPADFSWRGLTLTPAAAAHIHELVAKKPEILGVRLGVKQTGCAGFGYVLDTVTEPEKDDLAMPFIDGTEVDYVREGLNQLFKFHNPKAQNECGCGESFGTDELAKGINEDVVRAISAKRNEPEWMLEFRLSAYRAWLEMEEPHWLKAHYDKLNYQDYSYYSAPSCGS

SEQ ID NO: 209142 - protein, 168 aa, Glycine max
  Coding DNA Sequence Number=SeqID_92364
  Gene Ontology: Mol. function=protein-N(PI)-phosphohistidine-sugar phosphotransferase activity; Cellular component=organelle inner membrane; Biological process=phosphoenolpyruvate-dependent sugar phosphotransferase system
  Homolog annotation: Hit_ID=Q2NUP1; Match level="QueryCoverage=100%, HitCoverage=24%, E-value=2e-79, Identity=87%"; Hit description=PTS system N-acetylglucosamine-specific IIABC component
  Pfam annotation: Domain name=PTS_EIIC; Domain location=1-168; Score= -54.7; E_value=0.013; Accession=PF02378.9; Description=Phosphotransfer ase system, EIIC
MVPVATLPAAAILMGVGYWIDPDSWGAGNALAALLIKSGSAIIDNMSVLFAIGVAYGMSKDKDGAAALTGFVGFLVVTTLCSPAAVAMIQKMPVEQVPAAFGKINNQFVGILVGILSAEVYNRFSHVELPKALSFFSGRRLVPILVSFLMIVVAFILMYVWPIIFGGL

SEQ ID NO: 209143 - protein, 290 aa, Glycine max
  Coding DNA Sequence Number=SeqID_92365
  Gene Ontology: Mol. function=RNA-directed DNA polymerase activity; Biological process=RNA-dependent DNA replication
  Homolog annotation: Hit_ID=Q8H6Q8; Match level="QueryCoverage=97%, HitCoverage=10%, E-value=2e-24, Identity=26%"; Hit description=CTV.20
MEPEFWDKNPFKATTKVFPPGFHFRPNATNKTRIFYEFILIDTNSVSIKHFKDTNDPNLNTHSTIQILKVLQPKQFGTNLNQPKNFSAPFDPIGYTYWDYVDAWMNFVKWWDFFGPNSEIYPEQVQQGFDQFKRMFNSQESRIPADMMYFSSFALSWIFSWQYKYGKTESNKQFPSLQRHAFIKLWNQFDTSNVAPDKVKIWFQAHPKFLKATDLETSLFLNKKSQLAAFLASSRSKESLAKNLKEVLQILQQQQEEGSSSNKEDNNSSKEEDPFYQNEDDCFGISINDD

SEQ ID NO: 209144 - protein, 77 aa, Glycine max
  Coding DNA Sequence Number=SeqID_92366
MDQKVTTGLFSNDQGVLCLCEEIDRKGLRIFFAIIYPLSADLVLSAQSSRAKPSLLALCAWTLIGWLNNSAKRTSLH

SEQ ID NO: 209145 - protein, 496 aa, Glycine max
  Coding DNA Sequence Number=SeqID_92367
  Homolog annotation: Hit_ID=Q1H2K8; Match level="QueryCoverage=47%, HitCoverage=97%, E-value=1e-87, Identity=69%"; Hit description =Pyridoxal phosphate biosynthetic protein PdxJ
  Pfam annotation: Domain name=PdxJ; Domain location=256-492; Score =431.7; E_value=9.9e-127; Accession=PF03740.4; Description=Pyridoxal phosphate biosynthesis protein PdxJ
  Pfam annotation: Domain name=RecO; Domain location=13-254; Score =57.2; E_value=5.3e-14; Accession=PF02565.6; Description =Recombination protein O
  Pfam module annotation: Pfam domain module=PdxJ::RecO; Domain location=256-492::13-254
  Subcellular localization annotation: CTP_CleavageSite=44; ConfidenceScore=5.03e-01
MAVHSPDSGSHKQSLQPVFILHTYPFKETSLVVEMFSRDLGRIAAVAKGARRPLSAMRGMLQSFQQLAGTWSGKNELKTLHGLEWMTGLTLLRGDALMCGFYMNELLLRLLPRDDAHTQLFEYYAQTIQLLSTLQQDAASGQLAEMMRRFELKMLQELGYAVPLTHDEHGEVIHADEMYRFEADYGACAPSATKNGLLVQGSTLLEMARGNYSSATTQSQSKQLMRYLLQHYLGEKPLHTRHQRESVADKSKVTMLKLGVNIDHVATIRQARGTKYPSVVQAALRAEQSGADSITLHLREDRRHMQDADIFALRPLLQTKMNLECAVTSEMIDIAIQVNPQDVCLVPERREERTTEGGLDVLTHYAKVEHAVKKLSDQGIRVSLFIAPDLAQIDAAAKMGAPVIEIHTGTFADAETEKQQQDELDKIQAALKHAKAAGLVVNAGHGLHYHNVHHIARLPGFEELNIGHAIVAHALFVGWDSAVREMKALMKEFSAR

SEQ ID NO: 209146 - protein, 49 aa, Glycine max
  Coding DNA Sequence Number=SeqID_92368
MTMTSVTQGEGSTSRRATESTEVTRVLFESRDYNAMPTTTVSSKARSSK

SEQ ID NO: 209147 - protein, 117 aa, Glycine max
  Coding DNA Sequence Number=SeqID_92369
  Gene Ontology: Cellular component=integral to membrane
MQIPISVGVSGYEAASLYKGRRQISSVGDQGKTFTSQQLTIYCIFGVLAGIVGGLLGIGGGFVMGPLFLELGVPPQALNGLNQAPTAWYNMFDEYLQGLGFVNTLQVKLSYMSKKNV

SEQ ID NO: 209148 - protein, 83 aa, Glycine max
  Coding DNA Sequence Number=SeqID_92370
MYKDKWAHTEPMGPKYTLRLMRILGPSPASLAQSSWSLLSNAPRGRIASENMHLFFNKYAIQRHLPPSVPKHDFEVINLTIAL

SEQ ID NO: 209149 - protein, 279 aa, Glycine max
  Coding DNA Sequence Number=SeqID_92371
  Homolog annotation: Hit_ID=UPI0000503967; Match level="QueryCoverage =91%, HitCoverage=87%, E-value=1e-09, Identity=27%"; Hit description =UPI0000503967 related cluster
  Subcellular localization annotation: CTP_CleavageSite=23; ConfidenceScore=5.04e-01
MVERPGGSFGPADHPFLEPMNCAFVHVSSTFEFGAMRSDCLVQFSILTLFRSPMNCVFVHVSSTFEFGAMRSDCLVQFSILNLFRSPMNCIFVHVSSTFEFGARRSDCLVQFSILNLFRSPMNCVFVHVSSTFEFGAMRSDCLVQFSILNLFHSPMNCIFVHVSSTFKFGAMRSDCLVQFSILNLFRSPMNCVFVHVSSTFKFGAMRSDCLVQFSILNVFQSPTNCVYVHASSNFEFGAMRRDCLVQFSILNPFPEPHELRNVHVSSNFKFGAMRSDCL

SEQ ID NO: 209150 - protein, 249 aa, Glycine max
  Coding DNA Sequence Number=SeqID_92372
MAGDTGSCGSRESRMQKDWRFDRPVRNTEDRRRLDRARVLVRTPLLPLIRSEVIVRVGELEYRVWIVEETGFEGGSNRKGSSSSDGWSEMITSDDGGEVGDVLDDTNTNFSFSSELPNQKLSPSRTQRAEGGTDVRCCDLRPLGNIQADVTPKEKSKGTVEGMLGSSFGKLNLGDSFAGTEEEAANTKEVTCYNTLQDDQRHRNHIEGKYLNGGAKVAADQTFIGEEEGHVTQSLSPSLSGEIQQGIGP

SEQ ID NO: 209151 - protein, 111 aa, Glycine max
  Coding DNA Sequence Number=SeqID_92373
MTYTKKTDQMMFEAAKKIANKIDSMEEQASEDSIVAHGQHPGRVCAAGADVMIKQYFEPAPRTSHTSSSMTPKYMEQLRQKIRDQLEESITEKVTRQVMLSFSQMQSQFQS

SEQ ID NO: 209152 - protein, 130 aa, Glycine max
  Coding DNA Sequence Number=SeqID_92374
  Gene Ontology: Mol. function=zinc ion binding
  Homolog annotation: Hit_ID=Q1SXX9; Match level="QueryCoverage=85%, HitCoverage=11%, E-value=1e-51, Identity=83%"; Hit description=Zinc finger, RING-type
MQGEINIHQLFTGYTNGRRDWLACPQILKLKDWPPSNLFEEQLPRHCAEFISSLPFKEYTDPHKGSLNLAVKLPNGSLKPDLGPKTYIAYGFPQELGRGDSVTKLHCDMSDAVCSICLFLSWAVIFKDFF

SEQ ID NO: 209153 - protein, 316 aa, Glycine max
  Coding DNA Sequence Number=SeqID_92375
  Gene Ontology: Mol. function=hydrolase activity
  Homolog annotation: Hit_ID=Q8PH61; Match level="QueryCoverage=50%, HitCoverage=92%, E-value=2e-43, Identity=72%"; Hit description=HAM1 protein homolog
MARWLMAFFSAGSISAAVRPRNIRAAQLADDLALPTAFADQRLRVGGVAQQHDHRIEAGAALAVGNIGHRVQQLGVVGRGVGRVTGIARAVQARRTAEGIDDQARIIGQRRQAGCFAGGARLQQRVLDEGRRGSPASPPACRRCGWPVPVSSLTGLQQVPGVAIQIAEHRNRCIGFFARRFQELDAGGQHRRVVAVEVIGVEEEGDPATGLVADAAALLLIAGTGQQQGSGTAVGRPDHHPALVALVDVFQQREAELAGVPGDGFVIVGHHKGGQRDPAVHADSAACCAASSSVTPFSARPSSASSSSRRKAWPSA

SEQ ID NO: 209154 - protein, 340 aa, Glycine max
  Coding DNA Sequence Number=SeqID_92376
  Gene Ontology: Mol. function=selenide, water dikinase activity; Biological process=purine nucleotide biosynthetic process
  Homolog annotation: Hit_ID=Q63NL2; Match level="QueryCoverage=71%, HitCoverage=68%, E-value=5e-75, Identity=61%"; Hit description =Selenide, water dikinase
  Pfam annotation: Domain name=AIRS_C; Domain location=75-249; Score =56.3; E_value=9.8e-14; Accession=PF02769.12; Description=AIR synthase related protein, C-terminal domain
MGARPLFALAIVGMPINTLPQDTIRGILQGGERACADAGIVVAGGHSIDSVEPIYGLAAIGVLDPQRLKRNADARAGDVLVLGKPLGVGVYSSALKKEVLDADGYRQMIASTTRLNTVGMPLAALDGVHAMTDVTGFGLLGHLLEVCRASGVAAEVDSAQVPLLPQALELLQRGCVTGASHRNWTSYGTEVRFAEGLPAHWQPLLTDPQTSGGLLVSCAPEAVDAVLACFHDAGTFSSTAALDVRLSTDFEPSVLASRLNSCSRKSRRRPTGSRCLSTRRISTMWLPRRSSSSSTSSFCSHSTSSCSARPGSTGCGRSARRAASLARWPSRMAGISMRTS

SEQ ID NO: 209155 - protein, 60 aa, Glycine max
  Coding DNA Sequence Number=SeqID_92377
MAKIQGQKEEKPILIFTKNNGLNLAPWAQKSTLRHICWECLVGPQPSARGYRWCVTGISL

SEQ ID NO: 209156 - protein, 90 aa, Glycine max
  Coding DNA Sequence Number=SeqID_92378
  Gene Ontology: Cellular component=integral to membrane
  Homolog annotation: Hit_ID=Q00M73; Match level="QueryCoverage=94%, HitCoverage=17%, E-value=9e-36, Identity=81%"; Hit description =Membrane protein-like protein
MGAALSTVYYNLNLRHPTLDLPIIDYDLALLIQPMLMLGISIGVAFNVVVADWMVTMLLLVLFLGTSTKAFFKGVETWKKETIMKEVTFN

SEQ ID NO: 209157 - protein, 139 aa, Glycine max
  Coding DNA Sequence Number=SeqID_92379
MDQLKHLSIPSGMLRFSNHTSYPRLGHPTRKISMQQGQADILIARFPDPNYGVKTKTKGQIRVFVLYRNRKPSWKIPLRLKGSSRCGFSMENNDDLWWLMVAMGDGESAWDFRNGFGRKKEEEMTFFLSYTKAKAEMLK

SEQ ID NO: 209158 - protein, 87 aa, Glycine max
  Coding DNA Sequence Number=SeqID_92380
MDILAALDEMKSMKSSHGTVNVDEMVEALQRTIAYKNSDGFVRRIPNEHIETEEELVQFCNGHGETSSSNPKGPAPPEQEEMKRDRA

SEQ ID NO: 209159 - protein, 93 aa, Glycine max
  Coding DNA Sequence Number=SeqID_92381
  Homolog annotation: Hit_ID=Q2HW42; Match level="QueryCoverage=78%, HitCoverage=7%, E-value=4e-15, Identity=62%"; Hit description =Phospholipase D/Transphosphatidylase; Pleckstrin-like
MVQDDDEGDDEYVSLHTEQTHESGKDRDVPSSAALPIIRPTLGIQHSIADRAKRPMQGYLNHFLENISIVNSREDFYKVERNLKDRRSLGDWM

SEQ ID NO: 209160 - protein, 60 aa, Glycine max
  Coding DNA Sequence Number=SeqID_92382
MDMEFGWQIILGTIVGFFGAAFGSVGGVGGGGIFVPMLSLIIGFDAKSSTAISKCKSSTT

SEQ ID NO: 209161 - protein, 152 aa, Glycine max
  Coding DNA Sequence Number=SeqID_92383
MTETVCTDNRLGISIRHLTSRVRMTEIVCTDNRLGISIRHLTSRVRMTETICMDNRLGISVRHLTSRVRMTEGAEDNVSLHASTGSTEIVCADNHLRIFAGHLTSWVRMTETVCTDNRLGIFVRHLTSWVRMTEGAEDDVSLRVSMGSLAPD

SEQ ID NO: 209162 - protein, 274 aa, Glycine max
  Coding DNA Sequence Number=SeqID_92384
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-35, Identity=29%"; Hit description= UPI00006A17C9 related cluster
LHALAFVGLHALTFRGLHVLSFKGLHALAFRGLHALAFRGLHALSFIGLRVITFIGLHALTFRGLHVLTLRGLHALAFIGVHALTFRGLHVLSFRGLHALALRGLHILSFRGLRVLTFRGLHALAFRGLHALAFRGLHVLAFKGLHVLTFKGFLRPRLRRATCPHLQKAFALRGLHVLTFRGLHVLAFRGLHALAFRGLHVLTFRRLHILTFIGLHALTFRGLLALAYRGLHVRTFGGLHALAFRGIHVLTFRGLHALAFIGLHALTFRGLHVL

SEQ ID NO: 209163 - protein, 33 aa, Glycine max
  Coding DNA Sequence Number=SeqID_92385
MPNPRQRQIEVSGNVATICCPMSSPAFRVSSPG

SEQ ID NO: 209164 - protein, 132 aa, Glycine max
  Coding DNA Sequence Number=SeqID_92386
  Gene Ontology: Mol. function=chitin binding; Cellular component =extracellular region; Biological process=chitin metabolic process
  Homolog annotation: Hit_ID=UPI0000612705; Match level="QueryCoverage =75%, HitCoverage=91%, E-value=2e-12, Identity=31%"; Hit description =UPI0000612705 related cluster
  Subcellular localization annotation: CTP_CleavageSite=91; ConfidenceScore=5.55e-01
MTCVPLKARACSPLNARTCSPLKARVCNPLKLRKCSPLMARALHPLMARTCSPLKVRTCSPLKVRACSPLLARTCSPLMARACSPLKVRLRLMHSAPHCPSVGLLGINLVFCHDLVAGNLLGENFQSAPRFA

SEQ ID NO: 209165 - protein, 121 aa, Glycine max
  Coding DNA Sequence Number=SeqID_92387
MVVVGDGESSWDIRNGFGRKKEEEMVFFLSYTKAKVENAQVRNGLGHGNVSHTPDNFPKIPTLQTKFREDPTINEGWEAFLPRQLMWLPQETSLRGFLKKLPRGFFEKLDPYLPTPLYKLN

SEQ ID NO: 209166 - protein, 66 aa, Glycine max
  Coding DNA Sequence Number=SeqID_92388
MVVIWKGMAPKKLLSKKARKDVVGEGSSAAPQVDVEFGGHRFEVRNTSAVLRQLRVGHSSRKNGSS

SEQ ID NO: 209167 - protein, 194 aa, Glycine max
  Coding DNA Sequence Number=SeqID_92389
  Homolog annotation: Hit_ID=Q470N6; Match level="QueryCoverage=35%, HitCoverage=17%, E-value=2e-27, Identity=87%"; Hit description =Coenzyme PQQ biosynthesis protein E
MRKDLETLVAHAHKLGFYVNLVTSGVGLTDERLGALRAAGLDHIQLSFQDSTRELNDFLSSTRTFDLKRRSNSCSPGDPLVLERPPPRWSSNSPYSESYYNSLAVVLQRRDWEKPGVTQLNRLAAHPPFASWRNSEEARTDRPSQQLRSLNGEWDAPCSGALSAAGVVVTRSVTATLASADVRRCFCRYAPPRQ

SEQ ID NO: 209168 - protein, 94 aa, Glycine max
  Coding DNA Sequence Number=SeqID_92390
  Gene Ontology: Mol. function=transcription factor activity; Cellular component=intracellular; Biological process=regulation of transcription, DNA-dependent
  Homolog annotation: Hit_ID=Q16A73; Match level="QueryCoverage=59%, HitCoverage=16%, E-value=3e-16, Identity=71%"; Hit description =Transcriptional regulator, lacI family, putative
  Pfam annotation: Domain name=HTH_3; Domain location=35-87; Score =15.4; E_value=0.089; Accession=PF01381.12; Description=Helix-turn -helix
MTGARRGVLLWDMNNGFPAGPSVVANFKPPEGQGLQLGMTEQKIRTMEEFAAASGLSRPTVSKYFDNPESVKPSTRARIEKALKDYNYQPNIFA

SEQ ID NO: 209169 - protein, 206 aa, Glycine max
  Coding DNA Sequence Number=SeqID_92391
  Gene Ontology: Mol. function=sugar porter activity; Cellular component=membrane; Biological process=transport
  Homolog annotation: Hit_ID=Q926G6; Match level="QueryCoverage=89%, HitCoverage=62%, E-value=1e-74, Identity=76%"; Hit description =Putative sugar uptake ABC transporter periplasmic solute-binding protein
MAGAASAEGIGASLLTQQHPFYISLADAMKKEAQAENVPLEVSIANQDLSKQLADVEDFITKGVDVIIISPVDSKGVRSAINKAEKAGIKVITVDVPANNVDVTSFVGTDNFAGGEKAAELMAKSIGEKGNVAVIDYPTVQSVVDRIEGFKKGIAKYPDIKIVAIQPGITRPEALSAAQNILQANPDIVGIFGFGDDAALAAASAV

SEQ ID NO: 209170 - protein, 119 aa, Glycine max
  Coding DNA Sequence Number=SeqID_92392
MASVTLRKRGVELRCKDYSPIELSISLFGLTMRTGITLPLCSGILYNKRPTESFDLIHQLKDPSTISRPWKILFARINCFFHSSSLRGRENKTTLGTSKPYTGAMKGPMQKPQANLGAD

SEQ ID NO: 209171 - protein, 83 aa, Glycine max
  Coding DNA Sequence Number=SeqID_92393
MVVQIADHTDCQFYPRRKKKSNNGVKQHKEEEEVELSNMRSGGRRQKEEEPQPRSGGTRRAAITTCVKENEEEILRQNCMNTL

SEQ ID NO: 209172 - protein, 278 aa, Glycine max
  Coding DNA Sequence Number=SeqID_92394
  Gene Ontology: Mol. function=DNA binding; Cellular component =membrane; Biological process=electron transport
  Homolog annotation: Hit_ID=Q4IY01; Match level="QueryCoverage=84%, HitCoverage=86%, E-value=3e-44, Identity=47%"; Hit description=RDD precursor
IPGLSSQRRHAALLKSGPDQDLSRPPCLWLPAGEDSGAHNEGHRADGRTDARYLPRGGDARGCAAAVACRRPGTAGDGLAGRSRRAHRGTGAGVHSAGAAGQVRLRPLPGADVPGLLGLPDRLRSSVGTHPGQACAGAARAVPRWRAGRLDGGDHPQPAAHGGHAALRLCAGPDQQPVRSAWPPPGRPGGRHRGGACTRAVSATAADHRQRAGPAAAPATRGTGRADGLRRARATLVGGAPAGAGRYCRATDRHPRPGRRSAPVCDGQLAAGAAMKQE

SEQ ID NO: 209173 - protein, 120 aa, Glycine max
  Coding DNA Sequence Number=SeqID_92395
  Gene Ontology: Mol. function=chitin binding; Cellular component =extracellular region; Biological process=chitin metabolic process
  Homolog annotation: Hit_ID=Q86AI8; Match level="QueryCoverage=97%, HitCoverage=25%, E-value=4e-10, Identity=30%"; Hit description =Similar to Homo sapiens (Human). Mucin 2
GQHARHRKSLHALAFRGLHTLTFRGQLVRAFKGLHVLTFRGLHIPAFRGLHVLTFRRLHVLAFTGIDALTFRVPNVIAFRGLHALAFVGLHALPFRGLHAYTFRGLHVPAFRGLHVLTFR

SEQ ID NO: 209174 - protein, 312 aa, Glycine max
  Coding DNA Sequence Number=SeqID_92396
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=9e-40, Identity=31%"; Hit description= UPI00006A17C9 related cluster
MPSPSEDYMSSPSEDYAPLLSWGYTPSPSEDYTSSPSEDYMSSPSEDYTCSPSEDYTFWLSEGYTPSPSEDYTLAFRGLHALTLKGLQVLAFRGLHRVAVRGLTVLTFRGQHALTLNGLHALAFRGLHTLTFRGLHVLTFRGQHALTLKGQHALAFRGLHTLTFRGLLVPSFKGLHVLTFRGLHVLTLRVLHALTFRGLHVPAFRGLHVLTFRRLHVLAFTGINALTFRVLHVLAFRGLHALAFVGLHALPFRGLHVLAFRGLHTLAFIGVHVVAFKGLHVLTFRGLHVLTFRGLHILAFRGLHTITFRGLH

SEQ ID NO: 209175 - protein, 61 aa, Glycine max
  Coding DNA Sequence Number=SeqID_92397
MLNGMPRNSPMISTCHIRVASSGKWGLRDLCWAYGYHCIIEQIREGAVWSWMCNRWILWPI

SEQ ID NO: 209176 - protein, 82 aa, Glycine max
  Coding DNA Sequence Number=SeqID_92398
MFVGPGSLNYTLLDYIQELAVVLICPFRGDRKRLRVLALTFLSRKFEDNDALVLSDSDYVANLDARRYVTGYAFTIDNSLAS

SEQ ID NO: 209177 - protein, 211 aa, Glycine max
  Coding DNA Sequence Number=SeqID_92399
  Gene Ontology: Mol. function=ATP-dependent helicase activity; Cellular component=intracellular; Biological process=mRNA processing
  Homolog annotation: Hit_ID=Q1SDL2; Match level="QueryCoverage=91%, HitCoverage=11%, E-value=7e-82, Identity=76%"; Hit description=Von Willebrand factor, type C; Zinc finger, RING-type; Zinc finger, C6HC- type; Zinc ...
  Homolog annotation: Hit description=finger, C2H2-type; ATP-dependent helicase HrpA
  Pfam annotation: Domain name=HA2; Domain location=71-167; Score=62.9; E_value=1e-15; Accession=PF04408.13; Description=Helicase associated domain (HA2)
MKASIRSFRERIREGSRLYTKVDYQSMDLNQESEIRRVHLGVAVLRILALGVKDVLGFDFVDAPSPSSIDMAIKNLIQLRAIELNYDVHDLTSEGWCLVRMGIEPRLGKLILGCFKHGLGKEGIILATVMANASSIFCRVGSEFDKQRFDGLKVQFCHCDGDLFTLLSVYKEWEALPRERKNKWCWENNINAKSMRRCQDTILELETFLEH

SEQ ID NO: 209178 - protein, 166 aa, Glycine max
  Coding DNA Sequence Number=SeqID_92400
  Homolog annotation: Hit_ID=Q1SDL2; Match level="QueryCoverage=33%, HitCoverage=3%, E-value=1e-17, Identity=71%"; Hit description=Von Willebrand factor, type C; Zinc finger, RING-type; Zinc finger, C6HC- type; Zinc finger,...
  Homolog annotation: Hit description= C2H2-type; ATP-dependent helicase HrpA
NTSGCICAVHKFTGNMRDEDRDKWGRITFMSPNVVKRAAKLDGHEFCGSSLKVVPSQVELKLGRCLHGQILRATFYLDAHVETSLIVMYLKEVSTKSMYMETQSYNEDMKLTSNPTPTMAARLSYSMVATMGLRNQKRYLAQWRATTFDVNGEEESEREYTEKKRT

SEQ ID NO: 209179 - protein, 370 aa, Glycine max
  Coding DNA Sequence Number=SeqID_92401
  Homolog annotation: Hit_ID=Q6ZGL9; Match level="QueryCoverage=30%, HitCoverage=26%, E-value=2e-25, Identity=59%"; Hit description =Putative minor histocompatibility antigen H13 isoform 1
  Pfam annotation: Domain name=RRM_1; Domain location=292-363; Score =21.3; E_value=0.0015; Accession=PF00076.12; Description=RNA recognition motif. (a.k.a. RRM, R
EVFICEIFLRKMKNTERIANLAVAEVITDYATTGFKKVWCLEGCGLTLAPLIVKVDSNVNVILTACLTVYVGCYRSVKPTPPTETMSNEHAMRFPFVGSAMLLSLFLLFKFLSKDLVNAVLTAIKRSNNHGPPVAGRTTPKGCKPPNSYDPPKGCKGCKVRRCESRGHDPWEQSQPTVMIRPRGARQRTREKRDSSHHRVSSPRRARNKSCTETARWNSREARVRYHSNVAVSWSTEQENANDNNANFGDWIEVSRKRRKRAEENSSRVVGNGKQRRYKNLHRRDHEDVTTFYFSRFPDGTRETDLWKIFQKWGRVREVFIPKYKNKEGHKFGFVRFKEVMDERRLERDLDNNIFIDGMKLFVNRPKFDR

SEQ ID NO: 209180 - protein, 37 aa, Glycine max
  Coding DNA Sequence Number=SeqID_92402
MGSANFKDKGSGVVYMRGRVWPFLLRILKCDEELKPT

SEQ ID NO: 209181 - protein, 86 aa, Glycine max
  Coding DNA Sequence Number=SeqID_92403
MSYHTFTAALSTCGGIKGEEDIVGRSIWRHRNNVIFSDQQPHPKQCLAAVKASDRKRQTNLIKSIIDGMRGTVTEGVLYQFVAKIA

SEQ ID NO: 209182 - protein, 78 aa, Glycine max
  Coding DNA Sequence Number=SeqID_92404
MILVKERKLLEFMCMVKREAGTDSFNAEFPPTHAKKGRGSSRKRRNGGYRRGSTSLSDPDPIADDILRKDPKHETTQD

SEQ ID NO: 209183 - protein, 148 aa, Glycine max
  Coding DNA Sequence Number=SeqID_92405
  Gene Ontology: Mol. function=nucleic acid binding
  Homolog annotation: Hit_ID=Q10KX7; Match level="QueryCoverage=79%, HitCoverage=78%, E-value=2e-11, Identity=30%"; Hit description=OB -fold nucleic acid binding domain containing protein, expressed
MTLLYCKGIPISFMEIVGSIMLWNLKHDQFLCFAVDDGTNCILLLSLNDANSSSVACRHHHDHAMRFASLVKLDIVAIVKGMLSCFRGAVQVTMSNVVVERNPNAEIFHCLNCILLTHNCYNVFPGWGIDGVMGPVQVSGKRPWQQRE

SEQ ID NO: 209184 - protein, 130 aa, Glycine max
  Coding DNA Sequence Number=SeqID_92406
  Gene Ontology: Mol. function=transition metal ion binding; Biological process=electron transport
MKILFPMGMEYQKIHACPNDCILYRHEFEEMHKCPRCGVSQYKVKDDDEYSSDKNSKKDPSAKTLHGNQEHESALTPLASDQVLQWVQHLNTIFGKTQKKERKKNVCDGVIGTLLNIQGKMKDGLNTRQI

SEQ ID NO: 209185 - protein, 318 aa, Glycine max
  Coding DNA Sequence Number=SeqID_92407
  Gene Ontology: Mol. function=AMP deaminase activity; Cellular component=integral to membrane; Biological process=purine ribonucleoside monophosphate biosynthetic process
  Homolog annotation: Hit_ID=Q1SKM8; Match level="QueryCoverage=96%, HitCoverage=42%, E-value=1e-151, Identity=76%"; Hit description =Adenosine/AMP deaminase active site
  Pfam annotation: Domain name=A_deaminase; Domain location=146-318; Score=-51.9; E_value=7.9e-06; Accession=PF00962.12; Description =AdenosineAMP deaminase
ALSPDEVEAYVFLQECLEMRKRYVFREAVAPWDKEVISDPSTPKPNPDPFLYIPEGKSDHYFEMQDGVIRVYPDRDEKEELFPVADATTFFTDLHHLLRVIAAGNIRTLCHHRLNLLEQKFNLHLMLNADREFLAQKSAPHRDFYNVRKVDTHVHHSACMNQKHLLRFIKSKLRKEPDELYVLGINPVMSFFNIYDLNVDLLDVHADKSTFHGFDKFNLKYNPCGQSRLREIFLKQDNLIQGRFLGELTKQVFSDLAASKYQLPRLYNMYKEMGIVTSFLNMLDNIFIPLFEVTVNPDSHPQLHVFLKQLNPRFVLTV

SEQ ID NO: 209186 - protein, 147 aa, Glycine max
  Coding DNA Sequence Number=SeqID_92408
HYQAHPHPLGQECVANSAKRVVKGTHPGSIRDRSHMSEWWWSRYVGMLVQRCLVWMWVTDVRWVMAMEAAGYGCEVMKCGCTVVAMVIGDGGVVVAMAMEKTVVDMRMALERTKGMEYATTNLRLIYGWHILCTTGMASTMASPRCL

SEQ ID NO: 209187 - protein, 95 aa, Glycine max
  Coding DNA Sequence Number=SeqID_92409
MCAKARAMSEIEEVQEQMKADMEAMKEQMATMMEAMMSMKKMMEVNMAIVVATSIAIEVDPTHPSGLNPVNPPVSDIVGQRGEVLGSAGGPHFVQ

SEQ ID NO: 209188 - protein, 145 aa, Glycine max
  Coding DNA Sequence Number=SeqID_92410
MLPFNFRHVTELHRLPNDGCQVSRSGQTRVASQQTDCPQTKLGNHAHKTPSGPGGAHQGPGVSSSGYGPLLVLQGACSPPARSHHHDIGITLARHSVDLKNSNRVLGFPTLIIGLCQFYGVPVTPRKVIKPPTNRAFIKKYCAPR

SEQ ID NO: 209189 - protein, 114 aa, Glycine max
  Coding DNA Sequence Number=SeqID_92411
MSTLSRTTIPKYVLNFFLWGPSALPVAGSTWTTGLSAPAGLVDKDHRREVFHVRFTLDGEADALERGGGGGEGGERGGGGEAGGEAMILYLIGNLFLLKMKVVKGLHKLEIWQI

SEQ ID NO: 209190 - protein, 192 aa, Glycine max
  Coding DNA Sequence Number=SeqID_92412
MTLSELSYRLGIIGVIEYQERFEIYRWLEDKSNSISDPRNALGEYYAPSEEERMDDENESDKNNRMEDSQLSQTGARGGQTIEDEDDSMHFLAFKKWLFTIGDADCFPSVPHGHYQRKTTPWPKLNPYTGVVHSSMKVEDVPSRLTKREMRILWNDTKFIEECRKQILWYSGFAPDYSFPNARFGRHILPRW

SEQ ID NO: 209191 - protein, 253 aa, Glycine max
  Coding DNA Sequence Number=SeqID_92413
  Homolog annotation: Hit_ID=Q1Z978; Match level="QueryCoverage=84%, HitCoverage=65%, E-value=4e-23, Identity=31%"; Hit description =Hypothetical Lysophospholipase
MTSRNVRFVPRAEVEDQDQERRLNIRIFEPASTVEDILIVYHGGGVNSDAGYDMLAHHISHHGAICTCLIDIRGHGRSLGNKGSVSNPEQVWQDIDTVLEHVRVKFPWARVHLLGHSSGGGMLINYFTRFTPSQQSDSLILLAPEFGPFAPAKICRKTMVPFASVSKWPFVLNALSVGLLCGNRYAVTLNFPNEVMLLRPEFVQRYSVNMANALTPRQPARQIAALPLPVTVLIAEKDELFDARQMSEFVEGC

SEQ ID NO: 209192 - protein, 118 aa, Glycine max
  Coding DNA Sequence Number=SeqID_92414
SYLTGIRQDVCLNIEKAEKFSGEKYRLFNTEVNGAKDAFMDAMTAYVDSTLPFMSVDYPNRKPVMLSLPHDWKSKSVESEANFRFHQQNVRETSGVMIARYEDFVRTFKAHGFISDKL

SEQ ID NO: 209193 - protein, 542 aa, Glycine max
  Coding DNA Sequence Number=SeqID_92415
  Homolog annotation: Hit_ID=UPI000066C98E; Match level="QueryCoverage =49%, HitCoverage=24%, E-value=1e-19, Identity=34%"; Hit description =helicase involved in UV-protection
MPITFNQALTAECEFSEWTISNKNRAKLIEVIAYLYLRQEENAQRVIDALEPRWRVSKGRVAENVVRKLTAPRAEDVELLQSGTEAQKEAARKRINTSIIHRDGLLFQHISWIAARLELSDGYMTSPHVRQADKGFDGFIIELDERVCEIKRIVLCEDKASKSPRNLITSSVWPEIRTIRSGDRDDEILADLVTLLRSVPSIDAEEAVDKIFWEGAREFRVAVATGEDQRRAGDFLHIIAGFKTAAGGELEARMAGVLAFEDVRTGLDLLAGEVAAKVEEIANAPDLPGLAPETLDELLTAAHIELATVRLLSREGEPEAISDVLDQVRRLASTFEAYVALDLRPEQTRATAFVAASAHQILSRVRETATDRPTVVSSDAIGSSISATLLFLIAGRAADAAEVASQLRAKGERRAVRRSLILSLRELATGNLTTLIERDLGEHIIATRDSREVATDLLLRECAYVVQGLGQEARGSAVPDTDIRSRLKRVLHLSEASEVEINAALEGKVHHQFAGPHHLATLLSRLIDGVQAAMLIRLPAPS

SEQ ID NO: 209194 - protein, 105 aa, Glycine max
  Coding DNA Sequence Number=SeqID_92416
MDSFSRRQGYSRPDAEISIRHEAPESLRTAIVSIAYRCGFAPSELRLGLCGILYKTPDKSNWSEYPNIDDEVGILMDELEWFEVYDFIEHLAEKSLYKGGDFSGE

SEQ ID NO: 209195 - protein, 509 aa, Glycine max
  Coding DNA Sequence Number=SeqID_92417
  Homolog annotation: Hit_ID=Q47DY4; Match level="QueryCoverage=45%, HitCoverage=90%, E-value=3e-68, Identity=53%"; Hit description=TatD -related deoxyribonuclease
  Pfam annotation: Domain name=TatD_DNase; Domain location=166-456; Score=124.2; E_value=3.7e-34; Accession=PF01026.11; Description=TatD related DNase
  Pfam annotation: Domain name=Transposase_8; Domain location=418-497; Score=77.8; E_value=3.4e-20; Accession=PF01527.10; Description =Transposase
  Pfam module annotation: Pfam domain module=TatD_DNase::Transposase_8; Domain location=166-456::418-497
MARFNELLTNLGINAVLHNSYAFKTKGEMALECRDQQFIRQHASNTMSCSSPQSRRYDPDPAERAPKHCGRCVPCLIRRASLHAAFRLDETPYRIPDLNAQTLDSRKAEGEHVRAFQLSLAKLATNPGRAKFDVHKPGPLSDHPDSIADYVGAEIMTAMQKKASPLWVDFHCHLDLYSDHVGIIADCDQERVATLAVTTTPKAWPRNCELTAESHYVRVGLGMHPQLIQEREQEVALFERYLPSARYVGEVGLDAGPRFYKSFEAQERVFSRILRASAEQGNKILSIHSVRTASKVLKHLEESRLFDNSQAILHWFTGTVSEARRAVELGCYFSINEEMLRSEKHRKLISILPLERLLTETDGPFILHEGTPLRPRDTVGLSSLRNAALQRSMMRALIIVIRITQALILALREERMGTPRFTPEFKEEAVRQITERGYSVAEVSDRLGVSAHSLFKWLWTIKPDNSEQHARGLLEAQCEILKLRAQLKRTEEERDILKKAAWYFTREPD

SEQ ID NO: 209196 - protein, 535 aa, Glycine max
  Coding DNA Sequence Number=SeqID_92418
  Homolog annotation: Hit_ID=Q83SV2; Match level="QueryCoverage=45%, HitCoverage=89%, E-value=1e-83, Identity=61%"; Hit description =Possible lipoprotein
  Pfam annotation: Domain name=KAP_NTPase; Domain location=267-532; Score=34.1; E_value=1.2e-09; Accession=PF07693.4; Description=KAP family P-loop domain
VRIYPIQQGLTGMFMKKVMAALAIVFSLSSCDKPKIDTSSDESMKTSIQKVRESLPENQRTTYDSALKVVALNHLNLADLMQAGMTKNTSGIEAQMKSELSGKTGEEIISYAETVRKERAEREQTQALQEISELLQKQKTAESSLKELEAFKVSRSRFYFEKKNYGRDQPIIELSVENGTNKAIARAYFKGVIASPGREVPWFTDTFNYQISGGLEPGEKAEWNLAPNMFSDWGKVNAPSDAVFTVTVIRVDDAQGNPETATDLLYYSAIAETVVKLIEETPEAPITIGVHGDWGAGFEDAKTVIIETLVEELVRARPGCTKVAAAAKKVLRRVDWLKLARKTGGLALTAFTGIPTMDQLKGVLDIAAGLISNPQETLSAEGIKAFVGKAGDFIKEADAEQETLPKHIHAFRNEFSELLKEAQIDKLVVIVDDLDRCLPETAIDTLEAIRLFLFVEKTAFVIGADEAMIEYAVRNHFPDLPQSQGPLSYARNYLEKLIQVPFRIPALVYGPVGEAREEMQRPWLSSGLDRKVVSE

SEQ ID NO: 209197 - protein, 168 aa, Glycine max
  Coding DNA Sequence Number=SeqID_92419
  Gene Ontology: Mol. function=DNA binding; Biological process=DNA integration
  Homolog annotation: Hit_ID=Q1RZ71; Match level="QueryCoverage=38%, HitCoverage=5%, E-value=2e-20, Identity=72%"; Hit description =Peptidase aspartic, catalytic; Polynucleotidyl transferase, Ribonuclease H fold
MDVKSVLLNGYIEEEVYVDQLLGFMDYNHPNRVYKLKKALYGMKQAPRSWYERLSNFLIEQSFVRELIKKFGMEKCKETSTPMATVNGVEMVIDASVLKEVVGLDMGGVRKFDEMANGYSKMQTYRGMLLSPGRNLRNHLRVGRLTTKDRILVYLVIYILTLRSSSHA

SEQ ID NO: 209198 - protein, 87 aa, Glycine max
  Coding DNA Sequence Number=SeqID_92420
MRSPMIDGLGGLAARPVSHLQSLLDPSLSGVILQGVTNKRNKQVSNGEEANVDDCIGDDVLNELDRIAKNIVDQCNNFEGGVGSVEE

SEQ ID NO: 209199 - protein, 480 aa, Glycine max
  Coding DNA Sequence Number=SeqID_92421
  Gene Ontology: Mol. function=DNA binding
  Homolog annotation: Hit_ID=Q1SFS3; Match level="QueryCoverage=97%, HitCoverage=92%, E-value=1e-144, Identity=54%"; Hit description =Lambda repressor-like, DNA-binding
  Pfam annotation: Domain name=DUF1723; Domain location=48-97; Score =16.9; E_value=0.0051; Accession=PF08330.1; Description=Protein of unknown function (DUF1723)
MNFTKRNTQKYNFKDPDLTNLRKLGSLVVSPDDFRKRYGNLLSILKTNVEEGILNTLVQFYDPLYHCFTFPDYQLVPTLEEYSYLVGLPVSDKLPFSGLEPTPKPLTIAAALHLKTSDITSNLTTKGGFQGLTPSFLYQKAYTFAEATSTGAFEATLALLIYGLILFPNIDDFIDINTIQIFISGNPVPTLLADTYHSIHHRTQKKCGVITCCAPLLYKWFTLHLPQTHLFKTNPEKTRWPQRIMSLTPIDILWYQPASNIGVIIDSCGEFPNVPLISTRGGITYNPTLARRQFGYPMKEKPNNLSLTGEFYLNHEDHAGMRLRFVRAWHTVRRLDRNQLGRRTGFVHGSYTQWVIDRASILGLPYPLPRHVSSTVPSPSLPVPFDNKEECNEQLIQMRLERDTWKKKYQELERENETLKGKLAQKDHELFVQNQRIIEKDDLLRRKDALLRQDSKRRRRFMDSLSSAHPDFEDPSTPGV

SEQ ID NO: 209200 - protein, 647 aa, Glycine max
  Coding DNA Sequence Number=SeqID_92422
  Gene Ontology: Mol. function=RNA-directed DNA polymerase activity; Cellular component=intracellular; Biological process=RNA-dependent DNA replication
MVASAPTDFTEMVNMGVRLEEGVREGRLTVESTPAASNTKRFGNHFAKKKNQEVANVASTIPNPAYHQQRPHYPYQYPPPQYPPQQYHQPQYPQQQQNRKTPQQPYRSQNRQKVTFDPISIKYADLLPALLAKNHVQVRAPPRTPDVLPPWYRHDLTCAFHQGVPGHDVEHCLALKTEVQKLIQAKLLTFKDSDSSPNVQANPLPNHGSSVNMVQDDQEGCPIFNVHNIRTPLVPIHIKMCEAALFDHDHAACEVCSVNVKGCQKFQQLEISYNSGRPATTPLVISLLGPVPYASLKVVPYKYNVPMVESGQEVPLPSLTPATYVDNIVSNSKVLRNGRVIPTLFSKKVNDPVVEQVTVNGPGTKKEIGQPSGTDKDANHDEILKLIQKSEYKVVDQLLQTPSKISILSLLLNLEAHREALMKVLDQAFVEKDVTVNQLDSIVGNITACNNLSFSDEELPEEGRNHNLALHISVNYKSDALSNVLVDTGSSLNVMAKTTLDQLSYQGPPMRRSGVVVKAFDGSRKSVIGEVDLPITIGPSVFQITFQVMDIRATYSCLLGRPWIHEVGAVTSTLHEKLKFVRNGRLVIVSGEEALLVSHLSAFSFIGADETEGTSFQGLTVENKEPEKSEVSFATWKSAQKVVQEGT

SEQ ID NO: 209201 - protein, 276 aa, Glycine max
  Coding DNA Sequence Number=SeqID_92423
  Gene Ontology: Mol. function=RNA-directed DNA polymerase activity; Biological process=RNA-dependent DNA replication
MDLIEQENQSLKEEVATLREGMDRLTTMMNALLSAQNSQAAAAIVDQPFMPPGCTWGMPPPACGNLQPVVSEVPLPFAQQSAPVPQPGTSFPQAAMTYSAPLIHTIQQEVEPIYHAESIGAPNKMDELQERFDGMQKEVEALRGRDLFGKDARELCLVPNVTIPHKFKVPDFEKYKGNTCPRSHLVMYARKMSMYTDNHKLLIHFFQDSLTGAALKWYMNLDSANIQTFNDLGEAFIRQYKYNLDMAPDRDQLRAMMQKDKETFKEYAQRWREVAA

SEQ ID NO: 209202 - protein, 130 aa, Glycine max
  Coding DNA Sequence Number=SeqID_92424
  Gene Ontology: Mol. function=RNA-directed DNA polymerase activity; Biological process=RNA-dependent DNA replication
MTAYRTPLGMSPYKVVFGKACHLPMEIEHYVYWVVKGCNMTFAEAGIERKLLLQELEEICVEAYENSKIYKEKFKRFYDSRIFRKEFHIGKKVLLFNSHLKLISIEIKNEVTGKVFKVNGHQLKLFHESS

SEQ ID NO: 209203 - protein, 139 aa, Glycine max
  Coding DNA Sequence Number=SeqID_92425
  Gene Ontology: Mol. function=nucleic acid binding
MKAFHFSLDGVDKDWLYLQPDTINTFTYMKKRFLEKFFPASRTTSIRKEICGIRKQLGETLYEYWDIFKKLGATCPHHQIIVAPSRAATSEVSISMDTDNQRLENKLIELASLVRQLAIGQQQNMMAVNQPRLCGICCA

SEQ ID NO: 209204 - protein, 93 aa, Glycine max
  Coding DNA Sequence Number=SeqID_92426
MNWVLLIKGIMLKSHRLVDYEFPYAVVASKFIDYFNVDVSNEIVDFTEASSENTKRHLKKLEIKFVDHEWIMTRQSTAGNFNQMEDVAKVEAP

SEQ ID NO: 209205 - protein, 312 aa, Glycine max
  Coding DNA Sequence Number=SeqID_92427
  Gene Ontology: Cellular component=integral to membrane
  Homolog annotation: Hit_ID=Q9LV46; Match level="QueryCoverage=86%, HitCoverage=95%, E-value=1e-54, Identity=66%"; Hit description =Arabidopsis thaliana genomic DNA, chromosome 3, P1 clone: MOB24
  Pfam annotation: Domain name=Mpv17_PMP22; Domain location=243-299; Score=18.2; E_value=1.2e-06; Accession=PF04117.3; Description=Mpv17 PMP22 family
  Subcellular localization annotation: CTP_CleavageSite=61; ConfidenceScore=5.59e-01
MSNRTSQFLILTSSSHRSQSIPFSCSFHSSTNTVPHRNRRKLWKWYQNCLAVHPVKTQVISSGLIWGAGDIAAQAVTHYTAKKRVTFDARVKRVGGWFLIEVALGLMILWKMVGKCGHSCVVMERNWKLLGESRELSLKDLAFSPCLPNLKGPKFGAYFSFNGNLSQDDTKEFKINWRRVSTTSLFGLGFVGPVGHFWYEGLDRFIRLKLMLKPNSFRFVATKVAVDGFIFGPLDLLVFFTYMGFSAGKSVPQVKEDVKRDFLPAFVLEGGIWPIVQVANFRFIPVSCFLSWVEQQQDAPWKQWLKSFLPMK

SEQ ID NO: 209206 - protein, 84 aa, Glycine max
  Coding DNA Sequence Number=SeqID_92428
MRGYLMVTHTFRQPGANEPVDAQRLTSSPAPSVVLTREVRDSESGGRRRYLMVIYTFRQPRGTNLTVPLGGDIDRPNDVPLERN

SEQ ID NO: 209207 - protein, 189 aa, Glycine max
  Coding DNA Sequence Number=SeqID_92429
  Gene Ontology: Biological process=biosynthetic process
MWNSESTSSRYGSAPWPHAVRPQPSPHITYVTLNQALASQLAAWCEHQVEIEVMRNTYPFDPSHPRKDLRRQFGLLPQDKVIARTTRIIPAKRLDRDIHLLHALNSELIAQHQPQRVYLMVAGDPLEDSVHYHALKQLISQFQLERYVIFFGALNHDFMERNPQATTIQDLYHACDVVSFLTAWDYDSY

SEQ ID NO: 209208 - protein, 137 aa, Glycine max
  Coding DNA Sequence Number=SeqID_92430
MEGAPSEESITPFIAQGFSDPNARVLQGVRMAWGAVQSKDKELRGSSNGIVGGYHKWLRVRTQELDWLPKLKAAREEEAETSKESEEVQTLNAELERAQVVKEKFKSTAIKVRKEYNELRDINMTTTEALERETKRV

SEQ ID NO: 209209 - protein, 63 aa, Glycine max
  Coding DNA Sequence Number=SeqID_92431
MRGYFMVTHTFRQPGANEPVDARRLTLSSAPFVVLTRESADMRGYLMVTHTVRQPWANEPNDA

SEQ ID NO: 209210 - protein, 285 aa, Glycine max
  Coding DNA Sequence Number=SeqID_92432
  Gene Ontology: Mol. function=quaternary-ammonium-compound -transporting ATPase activity; Cellular component=membrane; Biological process=amino acid transport
  Homolog annotation: Hit_ID=Q0SDJ2; Match level="QueryCoverage=67%, HitCoverage=51%, E-value=1e-73, Identity=73%"; Hit description=ABC quaternary amine transporter, ATP-binding component
  Pfam annotation: Domain name=ABC_tran; Domain location=122-285; Score= 147.6; E_value=3.4e-41; Accession=PF00005.17; Description=ABC transporter
  Subcellular localization annotation: CTP_CleavageSite=37; ConfidenceScore=5.15e-01
MQMKSNFKAAPFQPTGHDPGASFQRLIYGNALTVAPRSARAEFFLDIVIANWGSPLSTDLGERQCGAISLSISNDNLRAAIEGGQKPRLQRIVCVITFDQVSKHYRGATTAVDRLSLTAPTGKLTIFVGPSGCGKTTSLRMINQLITPSSGSILLDGEPTDKMDVALLRRRIGYVIQNAGLFPHRTVVQNIATTARLNGTPKQQALRTAHDLLERVGLSAAFADRYPWQLSGGQQQRVGVARALASDPKFMLMDEPFSAVDPVVRAQLQDEFLRLQREIGKTIIM

SEQ ID NO: 209211 - protein, 283 aa, Glycine max
  Coding DNA Sequence Number=SeqID_92433
  Gene Ontology: Mol. function=oxidoreductase activity, acting on CH-OH group of donors; Biological process=response to oxidative stress
  Homolog annotation: Hit_ID=Q12CC5; Match level="QueryCoverage=97%, HitCoverage=52%, E-value=9e-23, Identity=27%"; Hit description=FAD dependent oxidoreductase
  Pfam annotation: Domain name=DAO; Domain location=14-275; Score= -49.7; E_value=0.012; Accession=PF01266.14; Description=FAD dependent oxidoreductase
  Pfam annotation: Domain name=Pyr_redox_2; Domain location=14-283; Score=-28.1; E_value=0.015; Accession=PF07992.4; Description =Pyridine nucleotide-disulphide oxidor
  Pfam module annotation: Pfam domain module=DAO::Pyr_redox_2; Domain location=14-275::14-283
MVEYNPGASSISFQVCVIGAGPVGLALAFALERQGVSVLLVEAGRNGHDGRLASITNHHHAPLASSTAGGLGGTTSLWGGRCVPFDDIDFLERAHVPNSGWPIGHESISRYYADALHFLNVRASALSPGVGASPAGDVHLDSIEWWSSQPDLGVTCRERIEKSRLIHFLSDTSATTIDVDATGAVTDVRLSNGHGDMRVPVTTLVLACGGVGNVRLLHELRKKQPERISPTLGHYYQGHLTGYIAVIELENDATVEQLSFQRAPSGGIFRRRFQLSGDVQQRL

SEQ ID NO: 209212 - protein, 315 aa, Glycine max
  Coding DNA Sequence Number=SeqID_92434
  Gene Ontology: Mol. function=cation transporter activity; Cellular component=integral to membrane; Biological process=cation transport
  Homolog annotation: Hit_ID=Q01V83; Match level="QueryCoverage=99%, HitCoverage=30%, E-value=5e-50, Identity=35%"; Hit description =Acriflavin resistance protein
  Pfam annotation: Domain name=MMPL; Domain location=157-255; Score= -17.9; E_value=0.072; Accession=PF03176.6; Description=MMPL family
PGLHWEFAGILGDLIGDLTWSPKPLELKLFSTDIKWLQKTAPLVQAKLDQIPGVVDSFDGLESTGPSIHVRVRSADAARFGLTSNDIQLAVSTAMLGQKASYVLEGDRVVNIRVRMPSEVTGQMDKLMQLPLRTADGRTVQLKQVADLELVAGELEMQREDMRQLVAVTARLEHRDLGSAINEIQHKVAQDPVLAKANIEFGGLYQQQHESFIKLTLVLLASLFLVFTVLLIQFRTFQAPISIVSGAILAMSGTVIAWYVTGTSVNIVSLLGAIIGVGVVAKNGILMLDGVQKFHQAGLDLPASLLASGVSRLRP

SEQ ID NO: 209213 - protein, 228 aa, Glycine max
  Coding DNA Sequence Number=SeqID_92435
MKVEVVNYPLNWSSQFSGKKFVCAPDAYDAKTFWNHIMWTNTYKAFTSGYDGSDNVVHHDIIQVLRLVRKYNFDDACVCFRKDADNYSRLLKLWMTPLYEGSLLILPILVSNATAVDEVEHNILELASKQSTTSNEATSRDKGEPDAIIVYSTSSGLAPLRYAQPTMITKDQAQISMLGFFGAPAPAPIPPLAPQSLEPSSPMLALTPPPHPSSPLPTQPPPPSPASG

SEQ ID NO: 209214 - protein, 155 aa, Glycine max
  Coding DNA Sequence Number=SeqID_92436
MEDDFKHTLVVKGSVVAKQQKFSKTNLKAMKVALENSLKEAPQVDLDTINKRKKKFSKAITDEDQARTSVPQRLKDLSEIDEEDEGAKTVLPAQEPREPVISSAIPRRIKTKATKANPKIGEKEWPVFFTGNKEFSTSFCSKGNHQCPSHYMDEV

SEQ ID NO: 209215 - protein, 89 aa, Glycine max
  Coding DNA Sequence Number=SeqID_92437
MTFVAFLETIPLAPKHSLLFFVLAITRKVVVRQFEASDTLRLGSGPLICAISELGYLRRKQPSPPGRAGRQPPPPFPINRRREAVPKGP

SEQ ID NO: 209216 - protein, 183 aa, Glycine max
  Coding DNA Sequence Number=SeqID_92438
FSFIGADETEGTSFQGLTLEGKKPEKNEVSFATWKSAQKVVQEGTGVGWGKVVQLLESKNREGLGFASSAGSATNSVGSSSITSTFCSAGFINNSPEANAVLEDAPEEIVLAFVTPGKLVRNWDAVDIPSVVITGNREDKRKSDGASLEAAVKRKVIELLKEYADCSLVVPGYARLGSPYCGA

SEQ ID NO: 209217 - protein, 141 aa, Glycine max
  Coding DNA Sequence Number=SeqID_92439
MEPRRCGVMTVDHFFCHFSFSLRVFLCGGDDDGDGSDVNNDDKDTSDGHSGSGNNNDDGGGVGISGGGDVDSGGSNDMVLVTNSSDGGGHGGINNGGGSNVSGVGGSDGGGVIVMVGMKVILLVVVVTMTMTVTLMIDGGG

SEQ ID NO: 209218 - protein, 203 aa, Glycine max
  Coding DNA Sequence Number=SeqID_92440
  Gene Ontology: Mol. function=nucleic acid binding; Biological process= DNA integration
  Homolog annotation: Hit_ID=Q1SDG1; Match level="QueryCoverage=71%, HitCoverage=12%, E-value=1e-17, Identity=37%"; Hit description =Integrase, catalytic region; Zinc finger, CCHC-type
  Pfam annotation: Domain name=zf-CCHC; Domain location=80-97; Score =25.9; E_value=5.2e-05; Accession=PF00098.13; Description=Zinc knuckle
MELVRLNQHEENDKKRKGIALKASSSIQEESDKEDLIDLDEDDDLSLFVKRFNKFLRIRGNQRRPNFKPKRKTRDSSSTPKCYECNQPGHLRVNCPIFMKRMEKSEKKNFSEKKVKKAYITWDDNDMESYEDSENEEIKLCLMAKSYESDEEVSLKKKWYIDSGCSKHMTGDASKFTHISPKKSKHVTYGDKNKGRILGVGKI

SEQ ID NO: 209219 - protein, 45 aa, Glycine max
  Coding DNA Sequence Number=SeqID_92441
  Homolog annotation: Hit_ID=Q8LEE4; Match level="QueryCoverage=69%, HitCoverage=8%, E-value=4e-12, Identity=87%"; Hit description=Zinc finger protein
MEKARLILIHQNQDPGLVQMDSISESYLVQVVKEGVIPLVQFVTE

SEQ ID NO: 209220 - protein, 135 aa, Glycine max
  Coding DNA Sequence Number=SeqID_92442
MKNPNGRESSYVEMFMLTHKPEKEETSKIILKEEVASHPEALKQSPTTDDVFFKVLGKDGHGYVRTYGKGFVPSNLWGTKSQVGNQKVLDEVKINSQVELQSLQERMQKEMEVKLKEQVKAMEAELLGNFKNVLT

SEQ ID NO: 209221 - protein, 312 aa, Glycine max
  Coding DNA Sequence Number=SeqID_92443
EGVKNMSENVSARVSDGGPHGTTDQEGEPFCKEAGRKINTSEFAVKKVEVWVRIESWNEDFITKVDNMLGVLLKIENIWPGQQFGRKSQTNQKSEDKKEKGKAVKMGQKIAKKGPINGKGKMKVLGSSVEGDYYVGFLGSYFENDDIEKYLKDQLRSHLLDQSMVDEDEDDISWFRDDQEEQTTLLAKKHKISRPSSSMTSVIDEKEPTTLVAKKHKVSCPCGSMAAIFEDLRPHQALSNSISTQTRWLNAHGQPIGSYRATLSNYLGTLARNAYLIPLTFTSCKGLKENWDDLWKTVIENFDIEERAKSGF

SEQ ID NO: 209222 - protein, 290 aa, Glycine max
  Coding DNA Sequence Number=SeqID_92444
  Homolog annotation: Hit_ID=Q9M670; Match level="QueryCoverage=77%, HitCoverage=64%, E-value=5e-19, Identity=25%"; Hit description=Small heat shock-like protein
  Pfam annotation: Domain name=HSP20; Domain location=28-121; Score= -1.3; E_value=0.00065; Accession=PF00011.11; Description=Hsp20alpha crystallin family
MDFRQRAPTFRPQLSVRRVYETLEPRSETKELPEAYLLRVYIPGFPRENVKITYVASSRTVRITGERQLQGNRWHKIDKSYPIPDYCEAEALQGKFEIPILTITMPKKATSQAATKQQEVGTSQEKGAVVAEPKPQEKVQETTSAPQPTTTTKVEEPIEEKKSASPTSPDLKAQQKNDTFEDTPSQSLSKPIKDQKGQEELVPKPTPTPTPTPRATTMQTYEKAQKGQEEEEVESKSTPTMLTKAKTAERPQKGEEEFEAKRTPTMLTKVKTAERPQKGEEEFEAKSTPA

SEQ ID NO: 209223 - protein, 99 aa, Glycine max
  Coding DNA Sequence Number=SeqID_92445
FLPAAASKFLYGSKKYITLHRGLGKRTQRQRGLGKCTQWQVPIHDGVPSIADPWFQYLHEKKLMAGDEVVFYFRFDDHAGELLIRKDIEWDKEDIHLDD

SEQ ID NO: 209224 - protein, 364 aa, Glycine max
  Coding DNA Sequence Number=SeqID_92446
  Gene Ontology: Mol. function=coproporphyrinogen dehydrogenase activity; Cellular component=cytoplasm; Biological process=porphyrin biosynthetic process
  Homolog annotation: Hit_ID=P32131; Match level="QueryCoverage=54%, HitCoverage=49%, E-value=1e-76, Identity=65%"; Hit description =Oxygen-independent coproporphyrinogen III oxidase
  Pfam annotation: Domain name=HemN_C; Domain location=84-174; Score =83.9; E_value=4.9e-22; Accession=PF06969.6; Description=HemN C -terminal region
RVIALNPDRLRVFNYAHMPALFAAQRKIKDEELPTAAQKLQILQQTIATLTGAGYQFIGMDHFAKPDDELAVAQRAGVLHRNFQGYTTQGETELLGLGVSAISMLGDSYAQNQKELKPALICNFALDFADFEARWPVVFERYFAEDLALLAPLVADGLLEMGERRLQVTGIGRLLIRNICMCFDRYLRQKARMQQFSRTDADGADHGGQRGLRPVNVPLPACGPAYDAAQWSAAYAPSPVVLLTAGFDDRNAARGLPTAPAALPSCPAATEPDFPAYSTQTAPAADPESALPGPRPSPSASGSCSPAGARYPTSAVASARIQSPDAEFSIIRPAHAVRPAGSSAPDAGYPHDVHAVAADARESR

SEQ ID NO: 209225 - protein, 90 aa, Glycine max
  Coding DNA Sequence Number=SeqID_92447
  Subcellular localization annotation: CTP_CleavageSite=52; ConfidenceScore=5.79e-01
MARAFNPMKVRACSPLKVRTCSPLKARTSSPLKVKAGSPLKARTGSPLKAIGSSTQGSTPLGTYWVKTSNLPLGSLEVFAWCLSLPQCRA

SEQ ID NO: 209226 - protein, 179 aa, Glycine max
  Coding DNA Sequence Number=SeqID_92448
  Gene Ontology: Mol. function=nucleic acid binding; Cellular component= nucleus
  Homolog annotation: Hit_ID=Q8LEE4; Match level="QueryCoverage=95%, HitCoverage=44%, E-value=7e-53, Identity=56%"; Hit description=Zinc finger protein
  Pfam annotation: Domain name=zf-CCHC; Domain location=115-132; Score =8.6; E_value=0.038; Accession=PF00098.13; Description=Zinc knuckle
  Pfam annotation: Domain name=zf-CCHC; Domain location=152-169; Score =14.9; E_value=0.0034; Accession=PF00098.13; Description=Zinc knuckle
  Pfam annotation: Domain name=zf-CCHC; Domain location=57-74; Score =19.6; E_value=0.00059; Accession=PF00098.13; Description=Zinc knuckle
  Pfam annotation: Domain name=zf-CCHC; Domain location=84-101; Score =16.4; E_value=0.0019; Accession=PF00098.13; Description=Zinc knuckle
  Pfam module annotation: Pfam domain module=zf-CCHC::zf-CCHC::zf -CCHC::zf-CCHC; Domain location=115-132::152-169::57-74::84-101
MKIIHQDPKLQAQRVAAIKKAKGTVAARKHSSKIMKAYYSDPVNSQKRSMALKGVKFYCQNCGREGHRRHNCPELEDSLVDRRFTCRICGDKGHNRRTCRKLKISLSNGRTIKHHRCKVCHQFGHNRRTCPQAVPSFVVPSKRRNAASRRPYKCRLCKKEGHNIRTCPSRTVVTEHPRD

SEQ ID NO: 209227 - protein, 403 aa, Glycine max
  Coding DNA Sequence Number=SeqID_92449
  Gene Ontology: Mol. function=transcription factor activity; Cellular component=nucleus; Biological process=regulation of transcription, DNA-dependent
  Homolog annotation: Hit_ID=Q1SQ04; Match level="QueryCoverage=84%, HitCoverage=87%, E-value=7e-89, Identity=53%"; Hit description =Pathogenesis-related transcriptional factor and ERF
  Pfam annotation: Domain name=AP2; Domain location=170-235; Score =106.6; E_value=7.4e-29; Accession=PF00847.10; Description=AP2 domain
  Pfam annotation: Domain name=AP2; Domain location=71-141; Score =107.0; E_value=5.4e-29; Accession=PF00847.10; Description=AP2 domain
  Pfam module annotation: Pfam domain module=AP2::AP2; Domain location =170-235::71-141
MELAPVKSELSPRSHRLVIIDGSDVISTKCAKRRRRDSSMAVLGGNGQQGEQLEEQKQLGGQSTATTVKRSSRFRGVSRHRWTGRFEAHLWDKGTWNPTQKKKGKQGAYNDEEAAARAYDLAALKYWGTSTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQLFATSNSMQTRGNIEVSNSNMHSFPSGELDSTKKRDFSKYMNPLSPCNKPSSPTALGLLLKSSVFRELMQRNLNSSSEEADVELKYPQEGNDGVGGIYDNDNTSNSYFCSSNISRLPNLESSEECPLPMYHGTMQSLWNSAFNMSN

SEQ ID NO: 209228 - protein, 53 aa, Glycine max
  Coding DNA Sequence Number=SeqID_92450
MEDSPPFLTNDEVDAIPKVLANMTIQQLSNDIVTMGDSSKFFNEEELRSNVHQ

SEQ ID NO: 209229 - protein, 379 aa, Glycine max
  Coding DNA Sequence Number=SeqID_92451
  Gene Ontology: Mol. function=alpha-amylase activity; Cellular component=chloroplast; Biological process=carbohydrate metabolic process
  Homolog annotation: Hit_ID=Q5BLY3; Match level="QueryCoverage=83%, HitCoverage=66%, E-value=4e-67, Identity=47%"; Hit description =Plastid alpha-amylase
  Subcellular localization annotation: CTP_CleavageSite=68; ConfidenceScore=5.66e-01
MSISTTTTPLFSFNHYFTREREPSIHRSKPKPFSLTSSSTLTLFNSNNSCNYSFASCKLHKFHTPKFEAFAANTDTLESLQSSDVLFDQIFPINRTGLSFVFSLFFFLEWCLVYRVLGIPRREIVEGKIFARLDRGEGFGKLEAYKGCNLSGKWILHWGVSRVDDVGSEWDQPPLDMIAPIPPGSIPIKDYAIETPMKKSLSSTEGDILHEVKIDLKPNNDISAINFVLKDEETGAWYQHKGRDFKVPLGPLGQISNILLKSEATHDKVQDDNSGSRNTKVENSQLEDIPGDILLHWGVCRDNLKWWEIPPAPHPPETIAFKDRALRTKLQNQNGIWNIFGGHVNWDDRAIVADDSYFQGRGNKSTGDNFHAAPNIDHS

SEQ ID NO: 209230 - protein, 128 aa, Glycine max
  Coding DNA Sequence Number=SeqID_92452
MEYMKEMLESSMEYMKKLASQHTTQLAELTENITATAEINKMLKKGVVCLKNWQQLNKSRLKSMCEGSKSWLPKLGRYQRSNSWVIFLEVFGQNYAARYAFMISKAIELARDLEEDFRLTQKLGGSRF

SEQ ID NO: 209231 - protein, 133 aa, Glycine max
  Coding DNA Sequence Number=SeqID_92453
MGCSKQMLTVATYPSAGGRRETHRCVFHGRKICGVATNVYSRKTSEKPKKVWSTNFKYERFGSCIYVRGRKAGVAAHDVQRYVKESDWAAQCTRQDKMSNEELELQDPRCRIRCPGHPARKYWTHKSVISLTD

SEQ ID NO: 209232 - protein, 104 aa, Glycine max
  Coding DNA Sequence Number=SeqID_92454
MPYPMFFQTKRGLTLEALERKIHQRPRLQPLDQVCDVAFQYPQVVGRRMLKFTAVQLVDDEDVKVEPTSSTQPNDPKFTVKLGLPNEELGPFSEDEDEDLRNQP

SEQ ID NO: 209233 - protein, 187 aa, Glycine max
  Coding DNA Sequence Number=SeqID_92455
MQIMMIGASIGTSKVNTHLFEEERKFYVPQENIPTNKWFRPGNEGSNSHFKEFEVSSLALRRGGTTKGSRKGYYDYQNPPWVIRNMSKTQWRWHHRMRKYAILAVQHKNVARPSIFDKISEGPPPRFEKKISIKDQKDSLEAICGVISILPAEYTKDYHNRNILSDYAREDYFDGPCLSHKAVGRGL

SEQ ID NO: 209234 - protein, 165 aa, Glycine max
  Coding DNA Sequence Number=SeqID_92456
  Gene Ontology: Mol. function=RNA-directed DNA polymerase activity; Biological process=RNA-dependent DNA replication
MGCTHGPEIYPKAHKNPRAFSCISGPIYLEFSIQCPCGVGLHHGISHEYDIVYVTQKATKGNSLAEYLVHYPIEDYQSMQCEFLDEDILALFEVGKYKDEGKWTMLFDGASNAPGYEIRAMLISPMNQLIPFTARLGFDCTNNVAEYEACAMGVRATIEFKGRIL

SEQ ID NO: 209235 - protein, 107 aa, Glycine max
  Coding DNA Sequence Number=SeqID_92457
  Subcellular localization annotation: CTP_CleavageSite=59; ConfidenceScore=5.12e-01
MVRLGSRLCPFYSPLFIFFHHVSALPSPPMQPLHVLLPLLLRSTIFRFQISNFKFKFKSTGYVGELSKAASELIICCKKTFSTSDLPESSGKDDVKVDDAPELMDVL

SEQ ID NO: 209236 - protein, 567 aa, Glycine max
  Coding DNA Sequence Number=SeqID_92458
  Homolog annotation: Hit_ID=Q10RM9; Match level="QueryCoverage=37%, HitCoverage=23%, E-value=7e-43, Identity=46%"; Hit description =Expressed protein
  Subcellular localization annotation: CTP_CleavageSite=51; ConfidenceScore=5.40e-01
MSKNLKAQDESSQFSKVQSPNSAKSSLSSKSPDRTKIASIDDQYAIMVSCRCNYTASRLFFKQATSWQPRSSRDIIISVASEMSGESPGPYERNSQLPVQVLTLQASNLTSEDLTLTVLAPASFTSPPSVVSLSSPTSPMSPFIGFKEFLGRINVERHVGAIQGGSFTSLIKDNEKQNDDVRPESVSMNDDVIASSGLSCTHLWLQSRVPLGCIPSQSTATIKLELLPLTDGIITLDSLQIDVMEKVVIKMQNAHYVIAQVLMDLHYGLNRVKAMNHLSIHGIRQLQFSVFQLIISGSLCAGRKSGGSSKGRDSGKFVNFQCQFCLKYDHTRNVCHFRSDMSFQSHGTLTFFDPATLQPIPYSSGSVRTSSTWVNPKYKFGTAALASTHPNAMLTNSTSHGNGHANSTWIPDSGASFHGTNKVFLHGVVSANGLYSFHNLTLQDHSSLLLSTSASPVSSTTYNCLSSVDIAANKIPNVVSNLVISSPSNVSLWHARLGHPNSHAMKSDFNHCNISSSNNFFSRLLLLMLYGKVSPIVLSLFYFCILSFGAYFYRPVGIFSFNFICWL

SEQ ID NO: 209237 - protein, 533 aa, Glycine max
  Coding DNA Sequence Number=SeqID_92459
  Homolog annotation: Hit_ID=Q10RM9; Match level="QueryCoverage=95%, HitCoverage=57%, E-value=1e-106, Identity=43%"; Hit description =Expressed protein
MALFCIVCLFTEELPENWNHVSDMQSLRSLDRSFLFPGEQVHILACLSACKQDTEIITPFKVAAVMSKNGMGHSSDKENGNVENRNDSVSGEGQLSPSKQEQKEDKLEKVKTDHPADASAGESLLRMEVHKRQTALLLEKFESSHFFARISESDEPLWSKRGSSEKSYSELNGQRISSFEIKDTAKNASSISAVIDRANFDATISGGVARNSVNCCALPNGDIVDSDVMGCLSPTLSSVGCLVEYLNFWNIPFVMCRIQVLLQVNVGVDFLRDPCIEILQYEKYQDKILSSENQNNSVHTNQDPCGALLKWILPLDNTLPLASRPLSPPQFSLNSGIGNTSQRSNSSASPGSQLFSFGSHFRSYSMSALPQNTNAPNPPLKAASSKPSFDIEDWDQFPSQKLRKKNGVEELLSFRGVSLERERFSVCCGLEGIYTPGRRWRRKFEIIQPVEIHSFAADCNSEDLLCVQIKNVAPAHVPGIVIFIDAITIVYEEATKSGPPSSLPIACIEAGNDHSLPNLALRFRNVVILLWKI

SEQ ID NO: 209238 - protein, 99 aa, Glycine max
  Coding DNA Sequence Number=SeqID_92460
  Gene Ontology: Mol. function=protein dimerization activity
  Homolog annotation: Hit_ID=Q53M47; Match level="QueryCoverage=66%, HitCoverage=6%, E-value=2e-15, Identity=56%"; Hit description=HAT family dimerisation domain, putative
MAFEASCLLCSNVVETLAHALCDCPKVKELEIFVKEQMVVVLHYVNKKGQVIECFPGLVHVPNTDVLSLKLALESLFAKYGLSLSRLRRQGYDGASNMQ

SEQ ID NO: 209239 - protein, 130 aa, Glycine max
  Coding DNA Sequence Number=SeqID_92461
  Homolog annotation: Hit_ID=Q69KD0; Match level="QueryCoverage=41%, HitCoverage=9%, E-value=5e-07, Identity=45%"; Hit description =Putative disease resistance protein Cf-2.1
MFDVRSFDFDRKCPKESCLISSPSVYYVSTLNEDTDLVQQKPIVWRVSVRKNKRQGRNDEVAERERDRTPDKEPSMYSLLKLKSWPMVFGRLPLNKLELTVNWFKDVTFPRLEGMEAKKMFSVRPRCCRY

SEQ ID NO: 209240 - protein, 202 aa, Glycine max
  Coding DNA Sequence Number=SeqID_92462
MARRDKLWSFCAFSSRLDHDRWHAETNYGHFAPFCHPEAIVPDDMRRQIMVILCPLTFRSSESSDKRAETNYGATSRVINSQRQIMVIMRPLSFWGSESSGGRRQIMVIPHTFSPSRGDHVRWRAETNYGHSAPFHPGPIVSDGTQRQIMVILRLVSTKRNEFDSIRMMGVQIAIKPTWAFQDLPTEGGAFWWKQPSLPERA

SEQ ID NO: 209241 - protein, 62 aa, Glycine max
  Coding DNA Sequence Number=SeqID_92463
MTTTQLRQEKGHGGGVAKDDSTICESGKNTNVRAQRWFSPSSRELTVIELKIEPLEDQKDPV

SEQ ID NO: 209242 - protein, 137 aa, Glycine max
  Coding DNA Sequence Number=SeqID_92464
  Gene Ontology: Mol. function=protein dimerization activity
  Homolog annotation: Hit_ID=Q1SYN6; Match level="QueryCoverage=63%, HitCoverage=12%, E-value=2e-17, Identity=50%"; Hit description=Zinc finger, BED-type predicted
MESFEAMFNENVEVDVEVDENNISSNDVEEDELNDEPKRPNKRDRNMSSTGLKVASHVIHKIRESIKYIKRSEGRMRDFRACAAKLGGITTKMGLHLDVVTRWNSTFLMLESALLYHHAFISLEFEDRSNVNYPTNE

SEQ ID NO: 209243 - protein, 107 aa, Glycine max
  Coding DNA Sequence Number=SeqID_92465
MEVVWRRLFSSLLWYCKEVDLGDIGVVVPAVEEEGKWAVIITPPLKKVVVLNDQRIRREATIVLSGNVGDVKTRIGWLGKEVGIEGTLVLGSGLLGKGRHVEGIRMV

SEQ ID NO: 209244 - protein, 227 aa, Glycine max
  Coding DNA Sequence Number=SeqID_92466
  Homolog annotation: Hit_ID=UPI00006065FE; Match level="QueryCoverage =30%, HitCoverage=70%, E-value=2e-09, Identity=52%"; Hit description =PREDICTED: similar to RIKEN cDNA 3110050K21
MNDNITLILHHGGRFTPRACDGTVEYIGGEFDVWEDISADCLNAFILYDLVKASVENEDDLDDVPVAGHEEDVGAGEQRDAGEQMDAGKQRDGGEQRDGGEQRDTDAGEQRDGSEQRDTDAGEQRDGSEQRDAEVGEERDVDGEERDVADSEEEKEVDSDETDAEWFINFSCMLNEVEAEVETDGYHSEELNIPISSDDEDEDVEVYPQYSQSSGVGEQKLELGMEF

SEQ ID NO: 209245 - protein, 171 aa, Glycine max
  Coding DNA Sequence Number=SeqID_92467
  Gene Ontology: Mol. function=ATP binding; Biological process=defense response
  Subcellular localization annotation: CTP_CleavageSite=23; ConfidenceScore=5.07e-01
MGSPPASTPPPPPPPPPPTSDASASTPPGVERPVVHVDPAIGKADGPHKKKLRTYLGIVARDKVDITYENWKEVPTAQKDLIWEDIQAEFDIPEAFDSRTKRKLLQTVGERWRQFKSDLTRKWAFAADQDGVEDTVCDKYGLSKEKWAQFCQTRRDPSSEDVRMKAQAIQK

SEQ ID NO: 209246 - protein, 202 aa, Glycine max
  Coding DNA Sequence Number=SeqID_92468
  Gene Ontology: Mol. function=DNA-directed DNA polymerase activity; Cellular component=mitochondrion; Biological process=DNA replication
  Homolog annotation: Hit_ID=Q6QZN8; Match level="QueryCoverage=97%, HitCoverage=25%, E-value=1e-12, Identity=25%"; Hit description=DNA -directed DNA polymerase
KFKLEDKILEGFFLAPKCYSYTTEESDGNKKVYKYKGPGRNVITPEWYKEQYADPSQSLIKKVTYQFRPDWKELSVKKKESTTTLRTLSNSKRIPFFNEKGKYVSTDPLDINDLSSLNYIGTKLLESFKRKTALLEKENSALSQKLQKLEQERGIIAQRRVEEGNNTEDNNTLEQNNAKRAEDNINGDLLDPDTMPRDKKPP

SEQ ID NO: 209247 - protein, 324 aa, Glycine max
  Coding DNA Sequence Number=SeqID_92469
  Gene Ontology: Mol. function=RNA-directed DNA polymerase activity; Cellular component=intracellular; Biological process=RNA-dependent DNA replication
LGIYEPVEHNNPALSPNFESPVYEAEEEEDDEIPEELARLLEYEKKTIRPHEEVVEVINLGTEEDKKEVKIGASLEVTVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMAVEDREKTSFITPWGTFCYRVMPFGLINAGATYQRGMTTLFHDMMHKEIEVYVDDMIVKSGTEEEHVEYLLKMFRRLRKYQLRLNPNKCTFGVRSGKLLGFI

SEQ ID NO: 209248 - protein, 56 aa, Glycine max
  Coding DNA Sequence Number=SeqID_92470
MKKICSNFQGKDNAPPPPPQWIEAKFFFNGTPLDTDTITTLRKKWAAYFLEDGKWM

SEQ ID NO: 209249 - protein, 57 aa, Glycine max
  Coding DNA Sequence Number=SeqID_92471
MKEQLATFRSQLEDFARKHNLKKVRARKQERGCIVRDVMRGEERKMGIRDGKGITGE

SEQ ID NO: 209250 - protein, 107 aa, Glycine max
  Coding DNA Sequence Number=SeqID_92472
MSCSMSIGKGDLIKGFYVLVSPSDLDSEASTNICNSISIQEYNKSTLACTNSTSCKDPNIVEAKPHDDNKGDDKKLKDQSKNNSSESRTIQEFKIRIKKNSRLKKKV

SEQ ID NO: 209251 - protein, 54 aa, Glycine max
  Coding DNA Sequence Number=SeqID_92473
MIHREDLIPNQRVGFTETHQEMHSILKLSILTPMFDSIAFTEKLKVHFAAQNTP

SEQ ID NO: 209252 - protein, 322 aa, Glycine max
  Coding DNA Sequence Number=SeqID_92474
  Gene Ontology: Mol. function=DNA binding; Cellular component=beta -galactosidase complex; Biological process=DNA integration
  Homolog annotation: Hit_ID=Q1SS72; Match level="QueryCoverage=85%, HitCoverage=18%, E-value=1e-64, Identity=46%"; Hit description =Integrase, catalytic region
MDRALYFQSKVPIQFKETRSNLVPLPTTSSTRVFESVPPQQILRRWVYKLKYKPNGTVDRYKAQLVAKAYTQQAGIDFSDTFSPVAKLTLVRVFLAVTTTRNWCLQQLDVNNVVLNGDLFEEVYMDLPQGYKTTAPGLVCKLNNFLYGLRQASRKWFCKFSSTILQQGFIQSKNDYSLFTYGSGSSLVVLIVYVDDSILVGPSSLYVAEVQTKLQSMFKLKILGSLKYFLGLKISKSSKGISLSQRKYTLSLLDDIGYLGSKPTHLHMDTNLKLTLTEDNLIPDPSLYRRLIGRLIYLTILRPDITFEVHKLSQYMKIPLTT

SEQ ID NO: 209253 - protein, 145 aa, Glycine max
  Coding DNA Sequence Number=SeqID_92475
MGAKKQMQKLDTRVKSKNLHGGEETNHGELEPATKLEIKSQNQGCRESINGEEAKETKNKSRHLANEVIENIRNLSMSMEEEDIPSPELQMTLLYDPCMVAEIEAEMMKMRVEMEVVLLPQNINSVHEPICVKAAVMSSSLTKLS

SEQ ID NO: 209254 - protein, 414 aa, Glycine max
  Coding DNA Sequence Number=SeqID_92476
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=54%, HitCoverage=96%, E-value=4e-35, Identity=39%"; Hit description =Transcription factor, MADS-box
  Pfam annotation: Domain name=SRF-TF; Domain location=9-62; Score =30.2; E_value=7.1e-06; Accession=PF00319.9; Description=SRF-type transcription factor (DNA-binding and dimerisation domain)
MGRPKLILKPIPNGRDRDLAFTKRKKALMKKMTEFSNVCGVKACMIMYDGNYGDAPPLTWPQDDPIEVHSIIKRYESIKNEKLPKNFDLNNFFEIRKNMVDNDISKVQKETLKIKYPTWHPSFNNLGVEELRNFIARLDIKLEACNQRNEMSKHNHQNEANFNFMQSMVQSDSVAPNPSQLNFMQEISQNQFSLAPMRPLNDGNQVASYLLNLDIGSSSQSQMLNFDPNLMQLIAKNQGVMDITNQVVVPLACANQINALGNFTNQHDVPVDLTNHQLGECLDYFSQLDEIEDLTSQLNEIVNSGSQPGESIIWTNQHGVPVIGGSTTAMNGATNYGTKFHGDEHNQESSHCNYNEVVQSMQPYNYDAALQNIASQSENVQQIVTWPSLLPPKDEFQTDHYNKTLQNQYSNHFI

SEQ ID NO: 209255 - protein, 181 aa, Glycine max
  Coding DNA Sequence Number=SeqID_92477
  Gene Ontology: Mol. function=phosphoric monoester hydrolase activity; Cellular component=chromosome, pericentric region; Biological process= biological_process
  Homolog annotation: Hit_ID=Q6VEY3; Match level="QueryCoverage=89%, HitCoverage=36%, E-value=6e-66, Identity=71%"; Hit description=CTD -phosphatase-like protein
  Pfam annotation: Domain name=NIF; Domain location=10-175; Score =200.0; E_value=5.6e-57; Accession=PF03031.8; Description=NLI interacting factor-like phosphatase
LKILFTLAICHVFLYTETLVHSTLEHCDDADFTFTVFFNLKEYIVYVKQRPYLHTFLERVSEMFEVVIFTASQSIYAKQLLDILDPDGRFISRRMYRESCLFSDGNYTKDLTILGVDLAKVAIIDNSPQVFRLQVNNGIPIKSWFDDPLDCALMSLLPFLETLADADDVRPIIAKRYGNKE

SEQ ID NO: 209256 - protein, 171 aa, Glycine max
  Coding DNA Sequence Number=SeqID_92478
  Gene Ontology: Mol. function=nucleic acid binding; Cellular component= mitochondrion; Biological process=DNA integration
MGHAASLQHPFSLHAYCDADWASDPDDRRSTSGAAIFLGPNLISWWSKKQSVVTRYSTEAEYKSMALIAAEVTWIQSLLSELQVTHTTPLILCDNTSTVSLAHNPVIHSRTKHMELDLFFVREKVLTKQLNVVCVPAVDQLADILTKALSPLFLLFRSKLRVVERLSSNPS

SEQ ID NO: 209257 - protein, 60 aa, Glycine max
  Coding DNA Sequence Number=SeqID_92479
MAYQSLPWPCELRLLSYLDEEELTNTCTANLETIFSPAFEPIEVHSQHYTEKDAVGHSWK

SEQ ID NO: 209258 - protein, 206 aa, Glycine max
  Coding DNA Sequence Number=SeqID_92480
  Gene Ontology: Mol. function=phosphoric monoester hydrolase activity
  Homolog annotation: Hit_ID=Q9FL21; Match level="QueryCoverage=46%, HitCoverage=29%, E-value=5e-08, Identity=38%"; Hit description =Similarity to
MAEVGADEGRSICGYETCDVSDFYISDMIITNLPFGGNSFDDDISETNCLSDYGSTEPSMFTASEQYMILPALEDDIKVGTTSDIISYEETMMVRESASLYSAMGQIRSCNQESDVKSDLDKSECFDPQSFIKNLPELSEIEVNGKPTLIPKQSPRRKSITLVLDLDAKKQNSCNYFLSIAWTKNWCQITKTGRGQTTSRTEIEAG

SEQ ID NO: 209259 - protein, 434 aa, Glycine max
  Coding DNA Sequence Number=SeqID_92481
  Gene Ontology: Mol. function=chitin binding; Cellular component =extracellular region; Biological process=chitin metabolic process
  Homolog annotation: Hit_ID=UPI00006A17C9; Match level="QueryCoverage =71%, HitCoverage=100%, E-value=5e-36, Identity=34%"; Hit description= UPI00006A17C9 related cluster
  Subcellular localization annotation: CTP_CleavageSite=42; ConfidenceScore=5.28e-01
LHVLAFKRLHVFTFKGLHVLTFRGLRTLTFRGLHMLTFRMLHALTFRGLHFLTFRVLHALTFRGLHVLTFRALRALTFRGLHVLTLRGLHALTFKGLHVLAFRGLHALGFRGLHVLTFRALRALTIRGLHFLIFRGLNALTFGGLHVLTFSGLHAFTFRGVHVLAFRGLHALTFRGLHVFTFRGLRTPTFRGLHILTFIGLHALNFRGLHVLAFRDLHAFTLRGLHVLTFRGLRALTFRGLHVLALRGLHVLAFRGLHVLASRGLHALAFRGLHVLAFRGLHICTLRGPKGGQLCEHNQREAIMQPLCILGQDFTCAATKGQVRIMSTNMTTLTQIWMTDRAHKTPSGPGGAQQGLGVIVAPSKVIRPPTNRAFIKKYCSPRQAQGEAPQQPGDGRQRAIDAPPPPPEPLNSSTKARALPTTRGRLAGDQVQSQ

SEQ ID NO: 209260 - protein, 167 aa, Glycine max
  Coding DNA Sequence Number=SeqID_92482
MGTRGCINYNPILAIRQLGYPMRGAPSEKSIMPFIVGGFSDPNARVLQGAAREEETETPEESEEVQTLKAELQKAQIVKEQFKSTAINYKEKLSLAATHEQRLEDEYAKVSILQAEREARERVIDSLHREAMMWKNRFAFTLNGSQELPRLLAKAKAMGDVYSAPDK

SEQ ID NO: 209261 - protein, 164 aa, Glycine max
  Coding DNA Sequence Number=SeqID_92483
MKNSWWGKKLHPYNQYEEETTLNLESMFTEFVAYHASSKANQNSTQNQEIRVGKNYSMENCQWEQELQPYNQHEEERSSNLDNLLMQFKESTESTQQAFKSLEIQVGKLAKEVAKFMSTREENFVEVEAQEESLVEEHDSREKDEEKSKEKAQQWEKCSQIEIQ

SEQ ID NO: 209262 - protein, 46 aa, Glycine max
  Coding DNA Sequence Number=SeqID_92484
MADEHDLKTTLEDYSREAKRWLHSFKGNSLKTWEEVVEKFLKKYFP

SEQ ID NO: 209263 - protein, 58 aa, Glycine max
  Coding DNA Sequence Number=SeqID_92485
MLNFDTAGGLEDEELKQRAHHTGACSAQETKLEASYFDTAGGLEDVEELKQRAQHTGA

SEQ ID NO: 209264 - protein, 74 aa, Glycine max
  Coding DNA Sequence Number=SeqID_92486
MQDVKKVSVARAEVHDDLAGATGGMPSQHLRLCAQSAPVSLMLLAIPPSCPVSTCLAAANGETSLPPVGMAEST

SEQ ID NO: 209265 - protein, 392 aa, Glycine max
  Coding DNA Sequence Number=SeqID_92487
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =61%, HitCoverage=32%, E-value=1e-74, Identity=61%"; Hit description =ATP binding / kinase/ protein kinase/ protein serine/threonine kinase/ protein-tyrosine kinase
  Pfam annotation: Domain name=Pkinase; Domain location=169-392; Score=- 14.9; E_value=1.1e-07; Accession=PF00069.15; Description=Protein kinase domain
  Pfam annotation: Domain name=Pkinase_Tyr; Domain location=169-391; Score=-8.0; E_value=5.6e-12; Accession=PF07714.7; Description =Protein tyrosine kinase
  Pfam module annotation: Pfam domain module=Pkinase::Pkinase_Tyr; Domain location=169-392::169-391
MENGFGCNRSLHVSPPTGMLNYTKCPDYDLYYKHIITADDVSRSSLVAYIIIRVDLTDECADCNYRHGGQCKLDSTEKFCCANAVIKKGLSLKAKLGIGLGIGIPSMLAIGLLFLFLQYKRKYGTSGGQLESRDSYSDSSSNPHGESSSEYFGVPLFLYEQLKEATNNFDHTKELGDGGFGTVYYGRILNQTLLDTQHYSPCMVWNYYMLIGPSQSPSIQGPELLCVCGPGKLPDGREVAVKRLYEHNWKRVEQFINEVKILTRLRHKNLVSLYGCTSRHSRELLLVYEYISNGTVACHLHGGLAKPGSLPWSTRMKIAVETASALAYLHASDIIHRDVKTNNILLDNNFCVKVADFGLSRDVPNDVTHVSTAPQGSPGYLDPEYYNCYQLT

SEQ ID NO: 209266 - protein, 84 aa, Glycine max
  Coding DNA Sequence Number=SeqID_92488
MPLVSRRMSRRKENKGKQNKSTGAIPISQFSEEQVMNSLNNNLTREMSVGDLEKKRAYCHKDRTGVNKNTFIALKGGNFGQTTI

SEQ ID NO: 209267 - protein, 72 aa, Glycine max
  Coding DNA Sequence Number=SeqID_92489
MEFVVDFCSMYTLFDRLCGPVGGRIVIGTCSAGFGVINKVNKGYWWFHQMRKSWWKRYESNAVKPRQLTHME

SEQ ID NO: 209268 - protein, 86 aa, Glycine max
  Coding DNA Sequence Number=SeqID_92490
MVSSLSFAIPCIVSCRNKWKNHKSNGKAAKLGRVEAMSACVHGGYWIYRLTSQLHKELGGLTFLSCITCRTLLLIYYTNEGFLFFR

SEQ ID NO: 209269 - protein, 60 aa, Glycine max
  Coding DNA Sequence Number=SeqID_92491
MACDVATGKRLLLFARRFFLHLLIGNLTINPVTRQPCSSYFRFDSQLSMAVNGSHPKSLE

SEQ ID NO: 209270 - protein, 322 aa, Glycine max
  Coding DNA Sequence Number=SeqID_92492
  Homolog annotation: Hit_ID=Q9ZU41; Match level="QueryCoverage=82%, HitCoverage=68%, E-value=6e-75, Identity=56%"; Hit description =Predicted by genscan and genefinder
  Pfam annotation: Domain name=DUF789; Domain location=1-285; Score =389.8; E_value=4e-114; Accession=PF05623.3; Description=Protein of unknown function (DUF789)
RTTRGLRACGAEFQPYFVLGDLWESFREWSAYGAGVPLVLNDKDSVVQYYVPYLSGIQIYSQNVKPTVKSRQLGEDSDSDFRDSSSDGSSDSEPVHGRGLRNLPHLLEEVPQWMGGLSLRDHHSLPPDGFSSDDGESVNSQGYLIFEYLERDPPYSREPLADKIMDLAFQFPELVTLRSCDILPSSWISVAWYPIYRIPTGPTLKDLDACFLTYHSLYMPMGGSQRVQAPMPHPTEMDNVHKMSLPVFGLASYKFKGSLWTPNGGHECQRSLLQGADDWLRLHQMAILDEVGVNNIIDRRKMKNGEKMFSTVLGNFLYRFLP

SEQ ID NO: 209271 - protein, 107 aa, Glycine max
  Coding DNA Sequence Number=SeqID_92493
SGCGPLLVLQGACTPRQGITPAGHPVDPKKSNRVLGFPTLITGLRQFYRVPVAPSKVIRPPTNRAFIKKYCAPRQAEGETPQQPGDGQQQATNAPPPLPESLSSFTK

SEQ ID NO: 209272 - protein, 73 aa, Glycine max
  Coding DNA Sequence Number=SeqID_92494
MAHTLSSRELSSRMESASKELLMPRLDEGDKKVLMQSYPLKALDRRLQDNCTKDAREGPRVLMSLRVDFGPMG

SEQ ID NO: 209273 - protein, 135 aa, Glycine max
  Coding DNA Sequence Number=SeqID_92495
NLTLPSTREFDIAPNQTDIRLFYGCGSLPWLEEHKVGCFNETSSVLALYKEDKNISFVSKNCQGEVVDTIVEDGIIGGNEEALTKGFLLTWKAGNCSVCHNTGGRCGFDFVMYTFRCFCTDRVHSAKCGPDDDPG

SEQ ID NO: 209274 - protein, 127 aa, Glycine max
  Coding DNA Sequence Number=SeqID_92496
  Gene Ontology: Cellular component=chromosome, pericentric region; Biological process=cell division
  Homolog annotation: Hit_ID=O48626; Match level="QueryCoverage=98%, HitCoverage=20%, E-value=2e-26, Identity=52%"; Hit description =Centromere/kinetochore protein zw10 homolog
MIQEVLMKFMEKAVRFDGDLNQVEVKYHLEVENVNGIQLHTVVEAMDVVGILEYGLAKVADLMIKYVITPFVNHGQPLSFLEELHQESALLKIVPSLDSKKYLLPEKFLDAVFWTVDMAKDIRANNI

SEQ ID NO: 209275 - protein, 45 aa, Glycine max
  Coding DNA Sequence Number=SeqID_92497
MENIQLQGEEAETCDDARVRQTRCLDAHRDGFARRRLEEEDSAEA

SEQ ID NO: 209276 - protein, 42 aa, Glycine max
  Coding DNA Sequence Number=SeqID_92498
MEKGQKERPKDVKSYISPLSRKSQCTGEKFEWRKVQVFLWEK

SEQ ID NO: 209277 - protein, 64 aa, Glycine max
  Coding DNA Sequence Number=SeqID_92499
  Subcellular localization annotation: CTP_CleavageSite=23; ConfidenceScore=5.13e-01
MAKRAWLAKPYSLTKSSKTDSLSVTHYTGLVETGSFSPGLFKLQRHGGLARLTRLATNRIPKAS

SEQ ID NO: 209278 - protein, 182 aa, Glycine max
  Coding DNA Sequence Number=SeqID_92500
  Gene Ontology: Mol. function=nucleic acid binding; Biological process= DNA integration
  Homolog annotation: Hit_ID=Q1SG63; Match level="QueryCoverage=99%, HitCoverage=14%, E-value=2e-13, Identity=27%"; Hit description =Integrase, catalytic region; Zinc finger, CCHC-type
MAKTMLNDNSTPKHFWAEVVNTSCYSRNKIYIRLILKRLLLNFGKDENPTFHISILLDAYKVYNSRNLVVEEGIHVRFNDTKPDIEMSELNESFADIRLGKGIRPLIEKSTGTYASNQVIEQPQEERETTREILRKNHPKSQIIGDPSTKVQTRGFLRQQDYIAFISEVEPKHIGDVMEDEN

SEQ ID NO: 209279 - protein, 311 aa, Glycine max
  Coding DNA Sequence Number=SeqID_92501
  Gene Ontology: Mol. function=transferase activity; Biological process= DNA integration
  Homolog annotation: Hit_ID=Q1S9I4; Match level="QueryCoverage=23%, HitCoverage=6%, E-value=7e-14, Identity=52%"; Hit description =Integrase, catalytic region; Zinc finger, CCHC-type
MPRDMRFVYSHPPNLIIGETSSGVKTRASLNKKRGMMDLLSSIEPKNINEALSEDSWVTTMEEELSQFTKNKKNDGIFIHEEKQTKDLLKRFKIDEAKPMATPMHPSMVIDEDEKVDNNNFTLKATLKGTEILISKQLLNNFLGDPPIVKDCMMTGWKIVHWINMLSVRPRAGTFQEATKPISLPFFIINHVIKATKPIKSTSSVPYGMLMNLIFRHFGVFMKNESRDDEVFSSSAKNVATLSMKRMKTKARRSPLSKKNEVYKTFEENIVKETISSQIVVESDLESEISKLVEKHFKKASSEEAKNSKDC

SEQ ID NO: 209280 - protein, 310 aa, Glycine max
  Coding DNA Sequence Number=SeqID_92502
  Gene Ontology: Mol. function=transporter activity; Cellular component= membrane; Biological process=transport
  Homolog annotation: Hit_ID=Q1H122; Match level="QueryCoverage=97%, HitCoverage=37%, E-value=6e-96, Identity=55%"; Hit description=TonB -dependent receptor
  Pfam annotation: Domain name=Plug; Domain location=30-139; Score =52.8; E_value=1.1e-12; Accession=PF07715.5; Description=TonB -dependent Receptor Plug Domain
MRAARRPKESQAQESSLGSVTVTANRRKENAQKIATPITVLKGKDLLNQGVGRSAQEVFNYVPNATAVGQQHGRPRWWIRGVGAGQQQQDLASPIGFYLDEVYISNANATGFPLFDLERVEVLRGPQGTKYGKNTTGGAVNIISQKPSLKEGKTDDYIKADYGTFNDKVLQGGFNVPLIEDRLGARISVYQEDIDGRFNNIFRGTKDGGLQDGAIRGQLLGKISDDAEALLNVHYRKYKTNGTITTTNSYAANGVFRNNYAPSTGYNDVSTNADNWTESSQTGANLNLKWNIGKLAFTSITGFEGFKNEG

SEQ ID NO: 209281 - protein, 329 aa, Glycine max
  Coding DNA Sequence Number=SeqID_92503
  Gene Ontology: Mol. function=monooxygenase activity
  Homolog annotation: Hit_ID=Q1H123; Match level="QueryCoverage=88%, HitCoverage=81%, E-value=1e-120, Identity=71%"; Hit description =Thermophilic desulfurizing enzyme, TdsB protein
  Pfam annotation: Domain name=NMT1; Domain location=95-295; Score= -77.7; E_value=0.038; Accession=PF09084.1; Description=NMT1THI5 like
MWMSCLDKVGMLFAIKPVMYITIEAAMSQPTPDQKQDIHLWYTRCGAATASALAIRQQWLQQEFAGPGTQLHSLRDSESLETRNSHYHHKQSGMFREGGNIPPIWAKGLGHDTVVVGITWLDEYQGIIVREDSDIHTISDLKGKRLAIPDHAQAVIDFQRGAAQHGFATALGLYGLTPNDAKWVDIPAPSYDLSDGPRAERNSFRHVELEALNAGEVDAIFVRFARGVRVANTPGYRQLININEHPDPFIRVNNGTPRPITVDRAFLQKHPDIVDRYLAVLLRTASWAKEHPQEVLQLLTPEAQSASLSEVIASHGANVYQSFTPSLKE

SEQ ID NO: 209282 - protein, 103 aa, Glycine max
  Coding DNA Sequence Number=SeqID_92504
  Gene Ontology: Mol. function=ribonuclease H activity; Biological process=DNA integration
MARKILSAGYYWLTMESDCCLHVRKCHKCQTFADNVNAPPLPLNVLAAPWLFSMWGIDVIGAIEPKAANGIEVVLPFEVEVPSLRILVESGLKESEWAQAHFD

SEQ ID NO: 209283 - protein, 120 aa, Glycine max
  Coding DNA Sequence Number=SeqID_92505
MWAIIDEYKEKLNLAATHEQRLEDEYAKISAEREARERGSNTITKHAPRHPYRTRSKSRAMGDIEEVQEKMKSDMSALKDQMASMMEAMLGMKRLLESNAATAATASTAAEEDPFHLLQI

SEQ ID NO: 209284 - protein, 55 aa, Glycine max
  Coding DNA Sequence Number=SeqID_92506
MDQQHICNLTVNGSSFLGDPFVPSSEGKGKNSYPKSRFMADELRFWLKRLVEGRT

SEQ ID NO: 209285 - protein, 94 aa, Glycine max
  Coding DNA Sequence Number=SeqID_92507
  Homolog annotation: Hit_ID=Q1SRN1; Match level="QueryCoverage=93%, HitCoverage=6%, E-value=1e-07, Identity=30%"; Hit description =Integrase, catalytic region
MDPISIKLGDDNYSIWKAEALGKIKKCNLEKFITMTNLGGKPPVFSEEYKSWEEQDQVLYWWLLDSLHPEFLIQMERCDNALELWMEIEVYFLE

SEQ ID NO: 209286 - protein, 322 aa, Glycine max
  Coding DNA Sequence Number=SeqID_92508
  Gene Ontology: Mol. function=signal transducer activity; Cellular component=membrane; Biological process=signal transduction
  Homolog annotation: Hit_ID=UPI00005F7523; Match level="QueryCoverage =76%, HitCoverage=42%, E-value=2e-59, Identity=44%"; Hit description =COG2200: FOG: EAL domain
MADKMLKPRAKRGSCVIFAFIPAQKNADLGYTCCAFRQLSRPPAARRGFVARQSFVNDKADGHRVRRGAGHHLVDYAQQMENVAHTVRQPLSEAVLKADIPQAERILNTLKPAGILSRADVVLPNAFQALHADFAPEKPVPRFVARLFELPVQITLPLYSVERSGLPKPIAYLHAVHHDHHLSAAGADSVRGDQLELPPPAILTHKLALPHNHRDDEIGMLIRSYNRNQQVLESIHDEMSRLTTHFAVTDLPNRALFLALLDQHIRHRHSQQPWGLMVIRIETLQEANGVLSDEQRDTLMLTLVEKIRSTIDDHTLLAQTGP

SEQ ID NO: 209287 - protein, 90 aa, Glycine max
  Coding DNA Sequence Number=SeqID_92509
MSEYTVTEELLPRDCTKEPSSAIEINNCGRSFFRAILLKNFFRESARKNLLLGIPAEEPSSVHPCGRTSSVGLHERRLLNLELVDIHSLK

SEQ ID NO: 209288 - protein, 76 aa, Glycine max
  Coding DNA Sequence Number=SeqID_92510
MAISMNKEKVTLDVANRVYGRGRPKVERDYWYWGKPGGFLVQSVTSGLPHSLWRFSYARVIEVQGVPQQANTNRRD

SEQ ID NO: 209289 - protein, 339 aa, Glycine max
  Coding DNA Sequence Number=SeqID_92511
  Gene Ontology: Mol. function=oxidoreductase activity; Cellular component=apical plasma membrane; Biological process=L-ascorbic acid biosynthetic process
  Homolog annotation: Hit_ID=Q0PGJ6; Match level="QueryCoverage=74%, HitCoverage=79%, E-value=2e-90, Identity=69%"; Hit description=Aldo -keto reductase
  Pfam annotation: Domain name=Aldo_ket_red; Domain location=1-276; Score=195.5; E_value=1.3e-55; Accession=PF00248.11; Description =Aldoketo reductase family
MKDNFDLSQTHKQLTDSVTDAKEMLVIAILIVLKFTAIRRRTKGFSIPEVKMMDRCTDHAPEDVPEALDRTLRDLQLDYIDLYLGSMHICNIINYILMSFPIKIHWPIRMKKGSVGFKAENIVPSDIPNTWKAMEALNKSGKARAIGVSNFSTKKLGELLEYARVTPAVNQSECHPAWRQDKLKAFCKSKGVHFSGYSPLGSPAWLEGDFLNHPVINMIAKKLGKTPAQVALRWGLQMGHSVLPKSSNPARIKENFDIFDWSIPEDMLDKFFEIQQSKSLVRTCSNRKERRVFKKEFPGSKKYLRSTKLRQERGLRAIGQFELVYGRVEVEAARVLDLA

SEQ ID NO: 209290 - protein, 350 aa, Glycine max
  Coding DNA Sequence Number=SeqID_92512
  Gene Ontology: Mol. function=protein serine/threonine kinase activity; Cellular component=integral to membrane; Biological process=protein amino acid phosphorylation
  Homolog annotation: Hit_ID=Q9LZM4; Match level="QueryCoverage=88%, HitCoverage=47%, E-value=1e-119, Identity=68%"; Hit description =Putative wall-associated receptor kinase-like 20 precursor
  Pfam annotation: Domain name=Pkinase; Domain location=58-336; Score =126.5; E_value=7.3e-35; Accession=PF00069.15; Description=Protein kinase domain
  Pfam annotation: Domain name=Pkinase_Tyr; Domain location=58-336; Score=107.9; E_value=2.9e-29; Accession=PF07714.7; Description =Protein tyrosine kinase
  Pfam module annotation: Pfam domain module=Pkinase::Pkinase_Tyr; Domain location=58-336::58-336
MYGLESNTKCKGHGKDSHCKVRKKKKMLRAGKKSQVPKPVLSSRIFTGREIKKATNDFSQENLIGSGGFGEVFKGTFDDGTVFAIKRAKLGSTKGIDQMQNEVQILCQVNHRSLVRLLGCCLELEHPLLIYEYISNGTLFNYLHRHSSGSREPLKWHQRLKIAHQTAEGLCYLHSAAEPPIYHRDVKSSNILLDDNLDAKVSDFGLSRLVELAEENNSHIFASAQGTRGYLDLEYYRNFQLTDKSDVYGFGVVLMELLTAQKAIDFNREEESVNLAMYGKRKMVEDKLMDVVDPLLKEGANELELETMKSLGYLATACLDEQRQKGPSMKEVAGEIEYMIKIVRGQISKS

SEQ ID NO: 209291 - protein, 93 aa, Glycine max
  Coding DNA Sequence Number=SeqID_92513
  Homolog annotation: Hit_ID=Q9M338; Match level="QueryCoverage=42%, HitCoverage=12%, E-value=7e-09, Identity=70%"; Hit description =Reductase-like protein
MSNEIRFFELNTGANIPSLGLGTWLADPGVVGDVIAHAVEPRSQEQASKGSPLSHIAMLPGTIKIGLKHQILEILHLLHPRLCLVPKTHSFNL

SEQ ID NO: 209292 - protein, 72 aa, Glycine max
  Coding DNA Sequence Number=SeqID_92514
  Subcellular localization annotation: CTP_CleavageSite=53; ConfidenceScore=5.46e-01
APQTLYLTTLPVNSYRKPVMPPKAIGTSLRGGRSSGKGFKLDLSEPTTKKGSSASSGSPTQTGSSTQKPKIE

SEQ ID NO: 209293 - protein, 146 aa, Glycine max
  Coding DNA Sequence Number=SeqID_92515
  Gene Ontology: Cellular component=membrane
  Homolog annotation: Hit_ID=Q8L9I2; Match level="QueryCoverage=66%, HitCoverage=31%, E-value=5e-10, Identity=33%"; Hit description =Nodulin MtN21-like protein
MVCVVVLIVLVIALYPAEGSKAVAESGRATPEIPSSPNTMKDLGVVAILLSVEFFDVIVYTVSKAAMKKDMNDSVFVMKRALPLLTYFIVGQLFINGFLSCSVQMLRFFGIGYCSPTLATAMSDLIPAFTFILPIVFRHSNISKSM

SEQ ID NO: 209294 - protein, 318 aa, Glycine max
  Coding DNA Sequence Number=SeqID_92516
  Gene Ontology: Mol. function=diaminopimelate decarboxylase activity; Biological process=lysine biosynthetic process via diaminopimelate
  Homolog annotation: Hit_ID=Q7CGZ1; Match level="QueryCoverage=61%, HitCoverage=46%, E-value=1e-87, Identity=78%"; Hit description =Diaminopimelate decarboxylase
MLVIDAGTDVHMHADQSQAVAANFLHRLRQVGIPDTVLAVLAAGVGFLAVAVAKTRVNAQPHRVPCGNLAELIQHVDGTGVDRDLQFADARQRGVIQHVRGKHDFARFAARLKTGLQRPLDLAQRHRIHLHALLAHQAQNMNVRTGLLCEADSVEVAQLSNALADDVRIIGPNRAAETLRQGQQVSGVQRSGGVVQRACSIGCAGACPPTVQGLRLFEEVQRSYYGLDRIVNAAAGIRQFQQAQLSIVCLPVFFPIAAAGGVPALYRTLPGSQLQRYPARVAAAGRVVVGPAPRSRADGNHPDAGGHRAGDADDVERS

SEQ ID NO: 209295 - protein, 119 aa, Glycine max
  Coding DNA Sequence Number=SeqID_92517
MLNTPRASQYRPLSQPLHFVRGEGSLVVFEKEKIKHIEERLHTIEGRGSYGFADMSELFGTRCDYSPKEFKVTDFDKYKETTCPKNHLRMYCKRMGAYAKDEKLLMHLFQESLVGAAII

SEQ ID NO: 209296 - protein, 92 aa, Glycine max
  Coding DNA Sequence Number=SeqID_92518
  Gene Ontology: Mol. function=metalloendopeptidase activity; Cellular component=integral to membrane; Biological process=cholesterol metabolic process
MEVEARRIRRFVPQRPSHRTILPLHASSSSHNVSNTISCWYCDYKICSFNRPLFHFGRRYARFLKVWFSIGVGFALSAVLGVTLVRVLVFLN

SEQ ID NO: 209297 - protein, 82 aa, Glycine max
  Coding DNA Sequence Number=SeqID_92519
MARRQSTKVNSGEGYCSPMNKALSKAENKNVAVRIQNQSLYICKGKAAYNDPPPNLCIARNTGIWSNLVLVPTFFIDGDFDP

SEQ ID NO: 209298 - protein, 67 aa, Glycine max
  Coding DNA Sequence Number=SeqID_92520
  Gene Ontology: Mol. function=metalloendopeptidase activity; Cellular component=integral to membrane; Biological process=cholesterol metabolic process
MKSSEGIQVEYIAVFIAILFPGALVAFNYEFLQTLPHLTALRVYSAGIWHNAVAMAQCLGSALGLDV

SEQ ID NO: 209299 - protein, 435 aa, Glycine max
  Coding DNA Sequence Number=SeqID_92521
  Homolog annotation: Hit_ID=Q1S1B7; Match level="QueryCoverage=49%, HitCoverage=45%, E-value=1e-60, Identity=43%"; Hit description =Integrase, catalytic region
  Pfam annotation: Domain name=RRM_1; Domain location=265-335; Score =21.7; E_value=0.0014; Accession=PF00076.12; Description=RNA recognition motif. (a.k.a. RRM, R
  Pfam module annotation: Pfam domain module=RRM_1::RVT_2; Domain location=265-335::1-146
MAALDISDTWELVPLPTSKTTVSFRGVYTMKIKPDDNIDCYKVRLVAKGYTQIFGLNYGGTFSLLAKIASVRLFLAMAAIQHWPLYQLDIKNAILHDMGPLKYFLGSEVAQSSSGIVISQWKYVLDILTETGMLDCRPSDTPMDPNVKLLPDVTFAIGRGLLYEDKGNAKIVCYFDANWVGSPLGSRSTSGYCVLIGGNLISWRSKKQKTIPRSNAEAEYHAMAAAAWRVRVEQPTDRADPRQNYKGNRFGQQGNWRNRMDITSYYFTRFSDETMEKELWMEFKKWGDVREIFVSRQRNKRGRRYGFVRFKGVTDDKRLERQLDNIIIGGLKMYVNLPKYGRDNRTQRSFTANHGRQGQAENVNDEIAAARDVAAHGIAPKRTYAKILNTSTVKIGQRRFLTRNQHSQGGSHSSVQLQVGEKGWYTDAWVGRLKK

SEQ ID NO: 209300 - protein, 200 aa, Glycine max
  Coding DNA Sequence Number=SeqID_92522
MWRLYDITHESKDYVMEDLIATRWKPLRDIGRAVPIRERLDELQIHVVMGCTHEDHRDVRPFAQQSLFFGFIICGTHVRPYRSERVLRLTPRTLCIDFTRFPIPMSFHQRKDSRHVVLYDYRPLKYNHNLGSQCRLCMRWRLLFPGLIPDSVRSYAELVRPKSCAKGHNSSSTHTTSFGIVVGGLISWVQLRGIETQEED

SEQ ID NO: 209301 - protein, 155 aa, Glycine max
  Coding DNA Sequence Number=SeqID_92523
  Pfam annotation: Domain name=DUF1723; Domain location=55-100; Score =17.7; E_value=0.004; Accession=PF08330.1; Description=Protein of unknown function (DUF1723)
MAYTKQMSYVVGCDPSYEGHCNKGSLDLHLEEVHLICPFFSRIAIIVLGTFGFVMSGLRPFWRAHTKRSSFHLPIEEMIITLNDMSRLLQLPMTSRPIGHVLSHFDRKVVKILMMSHLGILTVTKAFVVANTSVKVRLMWLKDLYHCYIESGLFV

SEQ ID NO: 209302 - protein, 80 aa, Glycine max
  Coding DNA Sequence Number=SeqID_92524
MEGLIPFVYKAIMQYKGDKDGHPIGSWLCESPSYSYMRLPAGDSASPSSTNPNSSSATQIIVSSGVQSPHQCLTHRRIAA

SEQ ID NO: 209303 - protein, 55 aa, Glycine max
  Coding DNA Sequence Number=SeqID_92525
MTLDKGVLDESPALHAKPGNFQRKLTREYITYLTLYMHYLPYLTNGIDIIDSTMI

SEQ ID NO: 209304 - protein, 266 aa, Glycine max
  Coding DNA Sequence Number=SeqID_92526
  Gene Ontology: Mol. function=protein dimerization activity; Biological process=DNA integration
  Homolog annotation: Hit_ID=Q2R1C3; Match level="QueryCoverage=74%, HitCoverage=49%, E-value=1e-22, Identity=37%"; Hit description=HAT family dimerisation domain containing protein
  Pfam annotation: Domain name=DUF659; Domain location=38-152; Score= -18.6; E_value=7.4e-06; Accession=PF04937.6; Description=Protein of unknown function (DUF 659)
MSTSNQVKEQGDDTKPLWNYVSQIKGVSGGGGNFEITPSRLAKLTKMDNEAALRIKRSKKKFVSLPPSDPQKRPLINFMVVTKSGPMFLKALDCSDEVKDRDFIAEQMRDVIMEVGHLNVVQIVTDNTLVCKAADDINKAKSVKKTLLDDIWWDKVDYILSFTTHIYDVLRKTDTDAACLHLVYKMWDSMIENVNKVIYRHERKGEGQVNVEFANFSGEREDFDEIDSLRDRGLIETKSWWLVHGAHAPTLQKIALKLLGQPRSSS

SEQ ID NO: 209305 - protein, 57 aa, Glycine max
  Coding DNA Sequence Number=SeqID_92527
MQLRSRSTSTRAKEVKHTNRRIGDRNAPCANKTLFAGEVVRWWSKGKSSSNNSCKGK

SEQ ID NO: 209306 - protein, 190 aa, Glycine max
  Coding DNA Sequence Number=SeqID_92528
  Gene Ontology: Cellular component=cellulose and pectin-containing cell wall
  Homolog annotation: Hit_ID=Q9SII5; Match level="QueryCoverage=69%, HitCoverage=36%, E-value=6e-44, Identity=65%"; Hit description =Expressed protein
MFMELVPAKCSMLKFFKFISWKIGMALIRDADIVLEVDTGLQNRAPNPLHQKLPSIPTAKIKRSPFAIFHNGTNIATATTHSVQALVQIFDLGGRGGVLIGVLRVHERVRRELRQLVPDHTHHVVHPDVSVRRYEVAGAAATHVPGDGEGISANLKALFFGVPHPRVIQRKCHTAQKNFKFFHKMKDLKC

SEQ ID NO: 209307 - protein, 131 aa, Glycine max
  Coding DNA Sequence Number=SeqID_92529
VPKCQGDGEGIEASILYCFMRCIFLPPQTCFFKFQRWRFLWERKRLRYEGYFYKLRHDIEIPNSENAQNWVANQVLKFHNDPTVNEFEIIVFLRPGRVLKDLGLEILSLGLHVHDEGIDNLGSTWIEKYCA

SEQ ID NO: 209308 - protein, 111 aa, Glycine max
  Coding DNA Sequence Number=SeqID_92530
MAAPKRSRTRKYMTCQRWVMQGDSIGSFFEVKGCEMCTWGEGGFHSTGMKRMGGGHGHDEPYYLHAKHMYNLDKMKHQGLKMSLAVFTAFSIGVAVPVYAVIFQQKKTASA

SEQ ID NO: 209309 - protein, 75 aa, Glycine max
  Coding DNA Sequence Number=SeqID_92531
MALSSIKLSLGCKKVSLATMIGAQLHEPQFFSQRDELGGNDSCLAKVSALANLADQISLRCKGWALSTLDSQLSA

SEQ ID NO: 209310 - protein, 75 aa, Glycine max
  Coding DNA Sequence Number=SeqID_92532
MVQPTDPRSSPRFSTVEARLQEILMMPTVKCSSWIIQVNFKKSKKYKLHLQVRFSSWIYKLYLKAQSELVIDYQS

SEQ ID NO: 209311 - protein, 60 aa, Glycine max
  Coding DNA Sequence Number=SeqID_92533
MKDEIILVREWKNTTKGNTLVGTRKQSWNSRLPSVMDCPDLKDEGEKMEEVLRDLILLEN

SEQ ID NO: 209312 - protein, 229 aa, Glycine max
  Coding DNA Sequence Number=SeqID_92534
  Gene Ontology: Mol. function=DNA binding; Cellular component=nucleus; Biological process=regulation of transcription
  Homolog annotation: Hit_ID=Q0PJL5; Match level="QueryCoverage=99%, HitCoverage=82%, E-value=1e-102, Identity=78%"; Hit description=MYB transcription factor MYB57
  Pfam annotation: Domain name=Myb_DNA-binding; Domain location=32-81; Score=41.0; E_value=4.1e-09; Accession=PF00249.21; Description=Myb -like DNA-binding domain
MKWESITLSSPTPCTPNSNTNWLVMEDNNRSSTKWTSEDKKLFENALAVHDKDTPDQWHKVAKMILGKIVVDVIRKYKELEVDISNIETVLIPVPGYSSIATSPFTLDWVNTHGYDGFKGYGKRSSSLRPIEHERKKGVPRTEDEHKTPTQVGSHAQKYFIRQLSGGKDKSRASIHDKTTVNLTETITTSSEDTNRSTSPHVLSSNNSQILLLLHQELVFNGVVSLTQG

SEQ ID NO: 209313 - protein, 287 aa, Glycine max
  Coding DNA Sequence Number=SeqID_92535
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=16%, E-value=4e-18, Identity=26%"; Hit description=Chromo
  Pfam annotation: Domain name=zf-CCHC; Domain location=263-280; Score =6.4; E_value=0.086; Accession=PF00098.13; Description=Zinc knuckle
  Pfam module annotation: Pfam domain module=Retrotrans_gag::zf-CCHC; Domain location=66-156::263-280
MGLIKAMEPYKKYDRIASRARLPIRKVYERRKLELLIFSSDDAYGWTHRLERYFELRNVHEEEKLCATVVAMEDRELRWYQWWARCNPELTWDGFKLAVVRRFQPSMAQNPFELLLALKQTGTMVEFVEEFEKYVGALKAIDQEFARGIFMNGLKKEIQVEVKLYELKSLSDLIQKSIMIEEKNLVWTKKGTNTFTKPTTISKASSYTKSVTVDTKPWLDRKTEIGTSATNLVSVQAGEMNKTRGGDFIRLSGAEMRDKREKGLCFICDEPYHREHKCKNKQFHMII

SEQ ID NO: 209314 - protein, 1015 aa, Glycine max
  Coding DNA Sequence Number=SeqID_92536
  Gene Ontology: Mol. function=RNA-directed DNA polymerase activity; Cellular component=chromatin; Biological process=chromatin assembly or disassembly
  Pfam annotation: Domain name=Chromo; Domain location=770-821; Score =26.9; E_value=7.1e-05; Accession=PF00385.14; Description='chromo' (CHRromatin Organisation MOdifier
  Pfam annotation: Domain name=DUF125; Domain location=850-1009; Score =24.2; E_value=2e-05; Accession=PF01988.9; Description=Integral membrane protein DUF125
  Pfam annotation: Domain name=RnaseH; Domain location=360-484; Score= -33.1; E_value=0.07; Accession=PF00075.14; Description=RNase H
  Pfam module annotation: Pfam domain module=Chromo::DUF125::RVT _1::RnaseH; Domain location=770-821::850-1009::176-340::360-484
TPSYIVELGDGHRLKCKGKCFKLSLLLQGMEIKQDFYFFTLQGVDLVLGLDWLSSLGEVKTNFGKLELTLSRDGKLITLVGDPSLTKIELSYGAFMQILKEEGKGLLIQYDYAEQKSIEDPQGLPPQRRLDHAIHLKEGVEIPNLRPYKYPHYQKTEIERLVSKMLEVGIIRPSISPYSSPIILVKKKDGGWRFCMDYSALNKITIPSKFPIPIIEELFDELDGATIFTKLDLKSGYHQIRMKEDDIEKTTFRTHEGHYEFLVMPFGLTNASSTFQALMNEDLDVHLVHIHQVLAILMQNGLKANKKKWVAACPSKTAAITSWPIPIDVKGLRGFLGLTGYYRRFVQSYAMVDLPLLVVPDVTKVFVVETDASSKGLGVVLMQKGKPLAFWSKGLSLRVQQRSVYERELMALVQAVTKWRHYLLGNHFIVRTDQRSHKFLTDQRLFSTEQFKWVVKLIGLDFEIQYKPGKKNTATDSLSRRDMYVAISVLHVEDDDSWDEELQQDPKLQQLVQDLIVSPTSHVGYEFKKGRLLYKGMRGDIKKFIEECDVCQRNKYSTLSLAGLLQPLPIPCQEWQDISMDFVGGLPRVRGKDTILVVIDRLTKYAHFFPLGHPYNAKEMLKVGCHDFLTMLMNTIPSKLDDVNQLAQQRDDLLEDLRQNLLKSQDQMRTRANKHRWLVNFEVGEWVFLKLQPYKLKSLAHRPYAKLAPKYYGPFQILSRVGEVAYKLDLPLEVKIHLVFHVSLLKKALKPHHSPQTLPPMLTEELELAVQPEDILQWRNDVGGNMEVLVKWAHLPSCDNSWERASKMLEVFPSFPLEDKVVLLGGGIDRIASRARLPIRKGGLVGTELQLKGNSVGIFVTTTLFNFFSFNNTLLGETILIFAPSSILEFSSDFTTSSNTVHQTMVEAKCDKGQLNEETQREKLPNPFQAALASALAFSVGVLVPPIAAVFIRNHKIRMGVVAAAVSLALLVFGGVGAVLGKTPVTRSCRRVLVGGCMAMAITFGLTKLIGSVDL

SEQ ID NO: 209315 - protein, 71 aa, Glycine max
  Coding DNA Sequence Number=SeqID_92537
MWIFVGHVELLKVNFRTIHKISQCFGALDPSRPIRKLQHKATSSLGRAKLAWASRLLLEEGVQHPWYSDFT

SEQ ID NO: 209316 - protein, 112 aa, Glycine max
  Coding DNA Sequence Number=SeqID_92538
AGPYGSPACHQTRCLWMTKVEKGAGPHGSPACHQIRRLWMTKVKKSAGPYGSPACHRTRRLWMTKVKKGPYGSPTYHRTRRLWMTKVKKGVGPYGSSRCHRARRLWMTKVKK

SEQ ID NO: 209317 - protein, 151 aa, Glycine max
  Coding DNA Sequence Number=SeqID_92539
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=3e-19, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=5; ConfidenceScore=5.09e-01
MARTCSSMKARTCSPLKEMMYSPLKAKACNPLKARTCSPLKARTSSPLKARACIPLMGRMYIPQKAWTYSPLKARTPLKARSCSPLKMRTHSPVKARTCNPLKARVCSPLKARTCCPLACSPPKASMCSPLKARMCSPLKASACSPLKART

SEQ ID NO: 209318 - protein, 83 aa, Glycine max
  Coding DNA Sequence Number=SeqID_92540
  Homolog annotation: Hit_ID=Q8GZU1; Match level="QueryCoverage=70%, HitCoverage=5%, E-value=3e-08, Identity=51%"; Hit description =Kinesin related protein
MQIEKLERKHNTEINTMKQYSTKSKLPESALQPLYREDFDVPHNATSSYTYDDQASRAAETAHMIKIKTICLASDPTWIKGNS

SEQ ID NO: 209319 - protein, 130 aa, Glycine max
  Coding DNA Sequence Number=SeqID_92541
MPNSLKIVRSGVANCRNLPFGERATRGSRVRLPREEGARSRHLHLFEENVGKIGMRGLRTLSVKGSGVVFTHGEEASFMMMNQEILMMPKAQVIDSRLIQDFKIKHQESNPRFKIQEKKSRSNKSRLHIG

SEQ ID NO: 209320 - protein, 77 aa, Glycine max
  Coding DNA Sequence Number=SeqID_92542
  Gene Ontology: Mol. function=oxidoreductase activity; Cellular component=chloroplast; Biological process=metabolic process
  Homolog annotation: Hit_ID=Q1S775; Match level="QueryCoverage=86%, HitCoverage=18%, E-value=8e-19, Identity=57%"; Hit description =Aldehyde dehydrogenase
TKEDVDLVVATAKAALSRNKGVDWASASGSVWARYLRAIAAKDDVAGCFQFYADLAEKSNAQKKAHVSDVPSFSSIF

SEQ ID NO: 209321 - protein, 829 aa, Glycine max
  Coding DNA Sequence Number=SeqID_92543
  Gene Ontology: Mol. function=transcription regulator activity; Cellular component=nucleus; Biological process=regulation of transcription
  Homolog annotation: Hit_ID=Q2VWB7; Match level="QueryCoverage=80%, HitCoverage=96%, E-value=9e-75, Identity=31%"; Hit description=Prf interactor 30137
MDATSIMHLLKGFCDHTQWKYAGFWKLDQHFPMTLTWENGYQKRDEVKESMWGDLSFKSPDELYSSSGENSDYSARLLLIEMSHRKYSLGEGVVGKIALARDHCWVSYEDILTSKFDTDLITECPDEWLLQFACGIKTIVLVPVLPQGVLQFGSFEAVAEDKEFVTNIKEKFYSTHYLEADITPLNLGTDCQDVSFSDLMHNLMGSLDESSSSVTKSILKSEVSTSPAALNSNGSRLNPTMLSFIQDDCFFSRENLLESLKRENENEIGSSSTEMPRHIGKVETKPNHMEEIWSWSHLLNNVGVFREMSNGLDSSSVINTTQKQLGGIETGHDAKNVNDFAFPSESEFRKALGSVSYGETGKFMSKCISVEETYSNSTLVINKKEHDHIKGLEFPKDVDLEYLLDAVVGNFCGAAADTSSISNSVRSLTTMPTEFTSSIQPENYSEESTLIVDSSDVKNDLMPAIMVKGKDEFSNHFTSSFDGNASLLIDEAQQEKANSHMQPIGGPKLSSSSKKRTRVGNNQKSRPRDRQLIMDRMKELRELVPEGGRCSIDNLLERTIKHMLYLRKITSQAEKLKRIANRAVPECKRQKVNASHPGRSCAFDFESEVSWPIVIEDLECSGHMLIEMICNEHGLFLEIAQVIRKLDVTILKGILENCSSNSWACFIVESISGNGAPTAPTPTWVKSQPLHNFVLNVLKWGMNNINNAHHQHHRRPYLPITPLNPIPAPIALNLESPTTKSPSLSNHHHHTEPSTTTSMTPSKTGGTFAIANPHSLPKAALEIDTKPSFPTTTTPATTVTENSKTTTTIPRQSHSGSEEKEQILDYFLP

SEQ ID NO: 209322 - protein, 73 aa, Glycine max
  Coding DNA Sequence Number=SeqID_92544
MRAPQTGTLTVTEAADDSTALWSAWEKEFPLSNDINSNSNRDKFCFLVESSPRDSLFIAKTHYCTLPKEAKLV

SEQ ID NO: 209323 - protein, 101 aa, Glycine max
  Coding DNA Sequence Number=SeqID_92545
MAGMDSWEADETIGAGLARFRCQEVRAWRSRARRSSGWRRRVGGRMATRLVGLGRASQDAPNPTVTKEKWQRTTATRRRTTAYKIYIEYIRRERQLTYKIT

SEQ ID NO: 209324 - protein, 66 aa, Glycine max
  Coding DNA Sequence Number=SeqID_92546
MEEAIQSRSTDTVIDPPSPIRRHVKWKMACTKKTSQITFEAAKEIAEKIDSLEEQASQGSFVTHGR

SEQ ID NO: 209325 - protein, 134 aa, Glycine max
  Coding DNA Sequence Number=SeqID_92547
  Gene Ontology: Mol. function=nucleic acid binding; Biological process= DNA integration
MQDFLKKEENIGMLPIPIIVQETTPVIENNIPIIVDNIVQEQDKNEILPQTPIQQLQEVSLRRSIRERRISIPNDYITFLQEQEDDIGLTKDDPIYFCQAMRSSNFKNWIDATKDEMKSMQENDVWNLVELLKV

SEQ ID NO: 209326 - protein, 120 aa, Glycine max
  Coding DNA Sequence Number=SeqID_92548
MGDWGNFLHRILEEDSEDSAPIKMFLLVGGSTASNDGSWRPPVVVGGGEGGVRVWVAFGEEERVKIMFFTLKNGVTTTMVEEATRVCLADFQEIAPLANINMYPNVEHLLSLHPEKLESL

SEQ ID NO: 209327 - protein, 111 aa, Glycine max
  Coding DNA Sequence Number=SeqID_92549
MKLTKTLLPSSSLKLAPLKPCPSPPLPHHSSEFREDDFKVNVSPNEKETRTSLWHQTNTISSPTLFDGGEGQVCKVVNVGGGGCRAVHVQLDPAGCLVISGELGHPNNPWV

SEQ ID NO: 209328 - protein, 157 aa, Glycine max
  Coding DNA Sequence Number=SeqID_92550
  Homolog annotation: Hit_ID=Q0WWY1; Match level="QueryCoverage=48%, HitCoverage=15%, E-value=1e-24, Identity=67%"; Hit description =Regulator of chromosome condensation-like protein
MVPSIFQKFRCLQTMQSARAVLISPTNAALLSIPCVLEPRVVVYQIGDFLAMNETEAVEDAREVVVVKEEERAEKMVYMWGYLPGASPEKSPILSPAPVTLSDPSLAVDSWKDVCGGGCGFAMVISEKGKLITWGSADDEGQSYLISGKHGVMQLVF

SEQ ID NO: 209329 - protein, 65 aa, Glycine max
  Coding DNA Sequence Number=SeqID_92551
MKFPKAMYTTKAMLDYVYFDCWGPLRVPPLGGEEFERSTIKNTSDQKQFEALDEIDQELQMHPQH

SEQ ID NO: 209330 - protein, 91 aa, Glycine max
  Coding DNA Sequence Number=SeqID_92552
MQIEDRVTIDRSSSLPGAGQAENVAARQPRDGLRIMLYSEAMGHATLPPFSCYLCLSMRPTSARRNAPMTYEYGFERLGLWDCFIYIEDSK

SEQ ID NO: 209331 - protein, 129 aa, Glycine max
  Coding DNA Sequence Number=SeqID_92553
  Gene Ontology: Mol. function=oxidoreductase activity; Cellular component=cytoplasm; Biological process=metabolic process
  Homolog annotation: Hit_ID=Q8LFZ4; Match level="QueryCoverage=98%, HitCoverage=48%, E-value=8e-24, Identity=52%"; Hit description=Short chain alcohol dehydrogenase-like
MGTNFESCFHLCQLTQPLLKAFGYGSIVLISGLKAFPLCSTYATTKGALNQFTKMELAKDNIRANTVAPGPIKTLLLEYLIKSTAEVHKMVVAMESQMTVGRLGEPKDISTPIAFLCLPAACDASYITS

SEQ ID NO: 209332 - protein, 157 aa, Glycine max
  Coding DNA Sequence Number=SeqID_92554
  Gene Ontology: Mol. function=nucleoside-triphosphatase activity; Cellular component=protein complex; Biological process=protein catabolic process
  Homolog annotation: Hit_ID=Q1SKI7; Match level="QueryCoverage=99%, HitCoverage=61%, E-value=6e-47, Identity=71%"; Hit description=AAA ATPase; 26S proteasome subunit P45; Nucleic acid-binding, OB- fold
  Pfam annotation: Domain name=AAA; Domain location=33-157; Score= -12.6; E_value=0.0019; Accession=PF00004.19; Description=ATPase family associated with various cellular activities (AAA)
MLHEDPGNIIYLVVDGLSDWELRESIELPLMNHELFLRVGIKPPKVVSASAIIDKYIGENAKLMREMFGYARDHQSCIIFMDEIDAIGGRRFNEGTSADREIQRTLMELLNQLNGFDQLRKVVGGRDLMGLIFEMSAQKLEWQQFGQSVIMWSMKIL

SEQ ID NO: 209333 - protein, 63 aa, Glycine max
  Coding DNA Sequence Number=SeqID_92555
MGERWRQFKSDLTSKWALATNKDGVNDTFLEKKLMDEMKKKQLEEAAQSGSTDPVIDPSSPIR

SEQ ID NO: 209334 - protein, 99 aa, Glycine max
  Coding DNA Sequence Number=SeqID_92556
MCKKEHKSFKEYAQRWRNLALQVAPPMMEREMITMIVDTLPVFYYEKMVTYIPSSFVDLVFASKKIKVGLRRGKFDYPTLMNGKPGGMERIRMREETMP

SEQ ID NO: 209335 - protein, 282 aa, Glycine max
  Coding DNA Sequence Number=SeqID_92557
MALRKLPSKRFRKDTVREGSNADPQANTDFDSIDFRADDEFPDFQEEIGCMHWAPLMTPMAKFDPKIVMEFYANAWPTEEGARDMRSWVRGQWIPFDPDALSQFLGHLLILKEPEEELGLGEMGDDHAHQHDHPDPDMDDIIPQQHPTQNDAYKTPYGPGQVQQGPGVPSFDHRPLPGQTSQQPKEDQQPATDALPPPREQQAANHRGQGWLNETFYRYNLHQQSQDPNPFPWPTPEQFKATVAWPGDEAEFEMQGGPVGTSGGGDKAQDDQDMADLIDFLL

SEQ ID NO: 209336 - protein, 136 aa, Glycine max
  Coding DNA Sequence Number=SeqID_92558
MRVPKNCSFDTLKLRMHNTLQLTNDQLLDEIYYRQPFIDAELLCTIIRTPDAILNLLQSTITPTHDAIMYSNGKWNIPRQDEFLGYSFTGTNPIRFGIPSRCDMEKLKDLIKQVAPTRVPPNGIHGSQLVRRLFFR

SEQ ID NO: 209337 - protein, 65 aa, Glycine max
  Coding DNA Sequence Number=SeqID_92559
MVMVSSPQQARNLEFQFDPHSSTPATTPWTLDIFLPHATPLDVAGTDPPYYRRIQPYQPSTTPPK

SEQ ID NO: 209338 - protein, 524 aa, Glycine max
  Coding DNA Sequence Number=SeqID_92560
  Gene Ontology: Mol. function=2,5-didehydrogluconate reductase activity; Cellular component=cellular_component; Biological process =L-ascorbic acid biosynthetic process
  Homolog annotation: Hit_ID=Q46857; Match level="QueryCoverage=52%, HitCoverage=100%, E-value=1e-134, Identity=83%"; Hit description=2,5- diketo-D-gluconic acid reductase A
  Pfam annotation: Domain name=Aldo_ket_red; Domain location=156-409; Score=414.9; E_value=1.1e-121; Accession=PF00248.11; Description =Aldoketo reductase family
EPENYNVRANIMWAATQALNGLIGAGVPQDWATHMLGHELTAMHGLDHAQTLAIVLPALWNEKRDTKRAKLLQYAERVWNITEGSEEQRIDAAIAATRSFFEQMGVPTRLSDYGLDGSSIPALLAKLEEHGMTKLGENQDITLDEEGMTHPTVIKLHDGNLMPQLGLGVWKAGNEEVVSAIHKALEVGYRSFDTAAAYQNEAGVGNALSSAGVNRDELFITTKLWNDDQKRPHEALKESLSKLKLDYVDLYLIHWPVPAIGHYVEAWQALIELQQQGLAKSIGVCNFQVPHLQKLIDETGVAPVINQIELHPLMQQRQLHAWNATHKIQTESWSPLAQGGKGVFDQKIIHHLADKYGKTPAQIVIRWHLDSGLVVIPKSVTPSRIAENFDVWDFRLDKDELSEIAKLDQGKRLGPDPDQFGGRTRPEQEAAAAHNQTNVAPIPGRAAPRPHKRITVDADRPFPPLARRINLAIVRIPTSHIIILRVRLKPAIIELIKGVDNFAAAFPRRSEPPGKRLSGTPSSA

SEQ ID NO: 209339 - protein, 307 aa, Glycine max
  Coding DNA Sequence Number=SeqID_92561
  Gene Ontology: Mol. function=carbohydrate binding; Biological process= iron ion transport
  Homolog annotation: Hit_ID=UPI00005F9359; Match level="QueryCoverage =92%, HitCoverage=67%, E-value=1e-65, Identity=50%"; Hit description =COG2382: Enterochelin esterase and related enzymes
MHNLRHWWHQVFASATPDLLNPYRSWQSASGHSVSGLHMPDAPPQPVWRSFDEYEIASGRCTPPLPARLQRHTWQSERLGNSRDVWIYTTGDSKPAEHAGLGAADAADPRGGVAGSGVCVDRHHRSAAPGARINLQGRFLAGGAGRTDAAAGRLGAAQRQTGRYGGGGAKLWRPGFPVCRAALAAVLRRGNYPVRFLLVAAARHAAAAEHPRRRLLADAAGGTAWPGQPRCAEGIYGSRFAGKAGASGQRRNGGSPERRRPSGALPGGGRRARRVVLAQRPDRRAAGGLGLRFRHRLSGIGDGTRNT

SEQ ID NO: 209340 - protein, 171 aa, Glycine max
  Coding DNA Sequence Number=SeqID_92562
  Gene Ontology: Mol. function=DNA binding; Cellular component=plastid chromosome
  Homolog annotation: Hit_ID=Q9LL85; Match level="QueryCoverage=55%, HitCoverage=33%, E-value=9e-26, Identity=59%"; Hit description=DNA -binding protein p24
  Pfam annotation: Domain name=Whirly; Domain location=90-169; Score =17.4; E_value=5.2e-07; Accession=PF08536.2; Description=Whirly transcription factor
  Subcellular localization annotation: CTP_CleavageSite=65; ConfidenceScore=5.91e-01
MSNLQLQIHSPPPSLLSYSSSSLSSSSSLKLFPNHPFSSKSLPFNTPKPFSLRCRHSDLFDQNTLASTPRPTRPSASVGALPPRVYVGYSIYKGKAALTLTPRPPEFMPLDSGAYKISKEGYVLLQFAPAVGTRQYDWNRKQGNIYAGVICQNLESCAGFQLGGLQCLLGK

SEQ ID NO: 209341 - protein, 175 aa, Glycine max
  Coding DNA Sequence Number=SeqID_92563
MAFLGETSSQTVVNSTLGFIFPNGSIVHNDSGVSFQASTPIPIRVPNGCDFQTLKTRIHNILKITDKQFLDEIYYRQPFTYAGKSPKNFDIPTGCTMDELKDLIKQVAPRGIPPYGVDETQMVIRTLIRKKKNKQGQFWHLIGLLGAPTIMMGAPSNTPKSGGLDTKWFGSFFST

SEQ ID NO: 209342 - protein, 86 aa, Glycine max
  Coding DNA Sequence Number=SeqID_92564
MTDLVSADDDVNLRVSTGLLAAIDEGRRMTIIWLCVPSDTTVSEWQKGCGMTIICLRMSSGPPPLDDKRVQNDHNLSLRAIGHDCV

SEQ ID NO: 209343 - protein, 242 aa, Glycine max
  Coding DNA Sequence Number=SeqID_92565
MVDRHGRRQSGLGLTDGTMIRFMGDDYNAEASFSVSDTVNAATSQLLVGHIGEPKEILMQSYTPRVLDRRLQEDWARAAKEGLRVLMNLREASQGSFSRLLKEPSSSFSKNLLKKTSQESFSLLKEVKFPTSSFAVVGGGKRGAQMMDEDEWMYEIMSEREDMDYENAESCGVNEPHVDCLNAFKTSQDVCGGLDPWLMKTDLWRSGEYKCRKKEFIRRDTRIRKCGCPFKLRCKPVVGGEG

SEQ ID NO: 209344 - protein, 92 aa, Glycine max
  Coding DNA Sequence Number=SeqID_92566
MCYWKVVVVATYPSAGGRRGARGCVFHERKMRGVATNVYSRKTSEKLERCGLQTLSVKGSGVVFTHGEDCATMFPFDFRHVAELHGLPNNGC

SEQ ID NO: 209345 - protein, 46 aa, Glycine max
  Coding DNA Sequence Number=SeqID_92567
MEAIEQFNGHNFSLEGPIQEHNISRRSKMNNGSSRDIQMAITFHTE

SEQ ID NO: 209346 - protein, 107 aa, Glycine max
  Coding DNA Sequence Number=SeqID_92568
  Gene Ontology: Mol. function=oxidoreductase activity; Biological process=metabolic process
  Homolog annotation: Hit_ID=Q9AR59; Match level="QueryCoverage=90%, HitCoverage=37%, E-value=3e-27, Identity=60%"; Hit description =Tropinone reductase I
MDYTVEDISTTMGTNFESSYHLCQVAHPLLKESGHGSVVFISSIAGLRAFPFFSAYAASKGAMNQFTKNLAFEWAKDNIRANAVAAGPVMIVLMEAVKKVFSAVLIS

SEQ ID NO: 209347 - protein, 198 aa, Glycine max
  Coding DNA Sequence Number=SeqID_92569
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=98%, HitCoverage=11%, E-value=2e-68, Identity=53%"; Hit description=RNase H, putative
AIDYFTKWVEAASYANMTRNVVEMCEDFKIQHHNSTPYRPKMNGAVEAANKNIKKIVQKMTMSYKDWHEMLPFTLHGYQTFVCTSTGATLFSLVYGMEVVLPFGGKRLVVISHGRLHQSGMKNAFDKRVCWREFSEGDLVLKKVSHVQKDHRGKWALNYEGPFVVKKAFSGGGLLLMNMDDEQLSSLVNSDVVKRYYA

SEQ ID NO: 209348 - protein, 176 aa, Glycine max
  Coding DNA Sequence Number=SeqID_92570
MLRVAREIVTVQAPVWMQHDYEHTLSKAFKTLTSDAIVHHPPPQWTRPVQPNIVKMSPYWLVPGTQQRVRPSMEWNPKIEFQIKIHLWTPITKLLPVHPIDLNLSQEEHSSLGKLHEQLYLRDQATAYSPSLYISRATDIKMVDDKVSPCLPVWDVAKKKGFKLYYSEGMLSQPTL

SEQ ID NO: 209349 - protein, 105 aa, Glycine max
  Coding DNA Sequence Number=SeqID_92571
MAFANTPITETIPTTEITTIHTNNQPSIHVEQFFDIQELEKVEFVNKKTIASKVLGVKVVLSSDTIAKATRFLGEGSTYQEGWEKNYDSHVTRILYRENADKVGD

SEQ ID NO: 209350 - protein, 1078 aa, Glycine max
  Coding DNA Sequence Number=SeqID_92572
  Gene Ontology: Mol. function=RNA-directed DNA polymerase activity; Cellular component=chromatin; Biological process=chromatin assembly or disassembly
  Pfam annotation: Domain name=Chromo; Domain location=1028-1078; Score= 26.0; E_value=0.00014; Accession=PF00385.14; Description='chromo' (CHRromatin Organisation MOdifier
  Pfam module annotation: Pfam domain module=Chromo::RVT_1::Retrotrans _gag; Domain location=1028-1078::378-545::64-155
MAENTRTIKLPFVKWKNVSAAKWNQDLSSSLLPCNKQYTECFSRGNKILQQQAIHLEVRDLAPILVALDWLGKALQWHSAYIKSVGLENLPSWNEYQILLLDRFGDVCEDPMADLIKLRQTGSIIEYHEEFDSIVSRIDLSDEHQLSYFLGGLKQEVQIIVRMFQPNSVRKAYSLAKMYESSFFNTQAKPFVKNQKSSFVSKPPLIPNPPRSTNPLTINPSTKPQTPKHLTPAYMAERRSKGLCYFCDEPFTLEHEPDANVVSEHDSEPLISVNALTGVANFRTMRVTGSLLHSLTTHASQQVLPLDINSLLLEFTDVFQEPSGLRPCRVGHDHKIPLTQGANPVNKRPYRYAKQQKQIIDGLIQDYLKSGIIQKSDSPYASPVVLVGKKDEAWRLCVDYRDLNKAMVKNKFPIPLVEDLLDDLYGSTIFSKIDLRAGYNQVRMDAADIHKTAFRTHAGHFEYLVMPNALATFQGLMNSVFQHYLRRFLLVFFDDILIYSRSMEDHLSHLYQTLLTMRTHCLYAKKSKCYFGVDKQLRSFLGLADYYRRFVSQYGAIAKPLTDMLKKDNFSWSSIAKEAFQELKQRLVATPVLALPDFSKEFVVEVDASGLGLGVVLMQNHHPIAFISRSLNTQQQSLSTYEKELLAVVFAVQKWRHYLLPKKEFDFSIEYREGRENVAVDALSRLDSPEIMALQVHQLDSSMLSRIQQSWQKDSILQQLVSDLKSNPSSHKHYTWVRNELRRKGRLVIGSNSQLRQDILSWIHASACGGHSGRDATLQKMKNVVYWRGMSKAVKFFVYQCATCQRSKYDTAASPGLLQPLPIPEHAAHFMALSHPYTAADVAQCFLDHVFKFHGFPDTITSDRDPVFVSHFRKEFMSLQGIQWSKWLPLAEWWYNSTYHSTVKASPYEIVYGKAPHVHLLYLPGESKIALVDRSLQKHEEMLKLLKFHMKRAQDRMKQLAKSNAKLAPKYYGPFPVEDKIGAVAYKLKLPLGSMVHNVIHVSQLKKFNGTATAGNFSPSPLLDTSQKEPAAIIDRMTVKRENRAVTKVLVQWKHQLPEDATWEFFYDLNQKFPHFNP

SEQ ID NO: 209351 - protein, 454 aa, Glycine max
  Coding DNA Sequence Number=SeqID_92573
  Gene Ontology: Mol. function=beta-lactamase activity; Cellular component=integral to membrane; Biological process=beta-lactam antibiotic catabolic process
  Homolog annotation: Hit_ID=Q5Z8Y3; Match level="QueryCoverage=99%, HitCoverage=71%, E-value=0.0, Identity=74%"; Hit description=ABC transporter-like
  Pfam annotation: Domain name=ABC1; Domain location=108-228; Score =115.0; E_value=2.2e-31; Accession=PF03109.7; Description=ABC1 family
MGWGDIYKRRVRVFTMALIVYLDYKGVQQREKWTSKSRQAALWEKAHERNAKRVLNLIIEMEGLWVKLGQYMSTRADVLPAAYIRLLKQLQDSLPPRPLEEVYGTIQKELGKSMDELFADFVNEPLATASIAQVHRATLLNGLEVVVKVQHDGIKTIILEDLKNAKSIVDWIAWAEPQYNFNPMIDEWCKEAPKELDFNHEAENTRTVAKNLGCRNQYDGNMSANRVDVLIPDVIQSTEKVLVLEYMDGIRLNDLESLDAYGVDKQKLVEEITRAYAHQIYVDGFFNGDPHPGNFLVSKESPHRPILLDFGLTKKLSSTIKQALAKMFLASAEGDHVALLSAFAEMGLKLRLDIPEQAMEVTTVFFRATTPANEYHKTMKSLADQRDRNMKVIQEKMNLDKKEMKRFNPVDAFPGDIVIFGRVLNLLRGLSSTMNVRIVYMDIMRPFAESVLSG

SEQ ID NO: 209352 - protein, 396 aa, Glycine max
  Coding DNA Sequence Number=SeqID_92574
  Gene Ontology: Mol. function=DNA binding
  Homolog annotation: Hit_ID=Q1S5N2; Match level="QueryCoverage=45%, HitCoverage=34%, E-value=2e-44, Identity=51%"; Hit description=Viral capsid/hemagglutinin protein
  Pfam annotation: Domain name=DUF659; Domain location=124-268; Score =168.6; E_value=1.6e-47; Accession=PF04937.6; Description=Protein of unknown function (DUF 659)
  Pfam annotation: Domain name=zf-C2HC_plant; Domain location=12-65; Score=65.5; E_value=1.7e-16; Accession=PF07567.3; Description =Protein of unknown function, DUF1544
  Pfam module annotation: Pfam domain module=DUF659::zf-C2HC_plant; Domain location=124-268::12-65
MGHTKKKKDTGITWNHCESVPPARLLVKCKYCSYTCWGGIARMKHHLAEIKENVIACIKVPNEVKEMFLKILEDKEKMKEANKQDCFEEVSTQDNTKKGTLESFAKKGKQGTMKQQTMAGMLKDREPVNADICKCIYVEIWKRVGKWGCTLMCDDWTDGKGRSLTNFLVNSPSGTVFLKSVDTSNVIKDANHMFELLDSMVEEIGEDNVMQVVTDGASNFVKAGKMLENKRTKLFWSPCATHCLDLILEDNGQLLVFYNTIANAKKVTTFIYRHPWVLNLYRKHSKGRELARPVITRFDNAKNYDPDTEVLMGLYETIEKMIPDRRTRFLVDQQLDRFRTAKGLFGMSMAIDTRNEATCAEAEFRSMAQGIFEVPWLKRVAEELEKNKSSSYAAML

SEQ ID NO: 209353 - protein, 122 aa, Glycine max
  Coding DNA Sequence Number=SeqID_92575
  Homolog annotation: Hit_ID=Q336U8; Match level="QueryCoverage=56%, HitCoverage=5%, E-value=8e-10, Identity=50%"; Hit description=TPR Domain containing protein, expressed
MKLATVNPELNFDVDMIISKDILHSRIGHGTGAYGPSINSSHTFPNRSFHGTLAGMPSASSQFPPWPQALGLAYLHLGRFTAAIKSNGHAIELDDIMVFALVESGNISMTLGSFSKVHFANH

SEQ ID NO: 209354 - protein, 73 aa, Glycine max
  Coding DNA Sequence Number=SeqID_92576
  Subcellular localization annotation: CTP_CleavageSite=50; ConfidenceScore=5.50e-01
MAMQDFGSVLHNPQVVWVWTTGVSLETRPVRRVRTNVLSLCKSAGQTDPSATNVGLRRVSRPVYPLLILTVNG

SEQ ID NO: 209355 - protein, 251 aa, Glycine max
  Coding DNA Sequence Number=SeqID_92577
  Gene Ontology: Mol. function=glutamate-5-semialdehyde dehydrogenase activity; Cellular component=cytoplasm; Biological process=amino acid biosynthetic process
  Homolog annotation: Hit_ID=Q9AYM4; Match level="QueryCoverage=97%, HitCoverage=31%, E-value=3e-84, Identity=69%"; Hit description =VuP5CS protein
  Pfam annotation: Domain name=AA_kinase; Domain location=1-247; Score =148.6; E_value=1.6e-41; Accession=PF00696.18; Description=Amino acid kinase family
MVGTAVVTRSDGRLALGRLGALCEQLKELNNNDYEVILVTSGAVGLGRQRLRYRRLVNSSFSDLQNPQGDLDGKACAAVGQSSLMALYDIMFSQLDVTSSQLLVNDGFFRDTAFRKQLSDTVSSLLDLRVIPIFNENDAVSTRKAPYEGKNCLQDSSGIFWDNDSLAGLLALELKADLLVLLSDVEGLYSGPPSDPKSKLIHTYVKEKHQREITFGEKSRLGRGGMTAKVNAAVCAAYAGTPVIITRYLQF

SEQ ID NO: 209356 - protein, 111 aa, Glycine max
  Coding DNA Sequence Number=SeqID_92578
MQKFTRLLCDNKVRVGKQQHTMGTNLRKCRATKLQQPPNKQRCANFYFWKSIKGILLHLHVTYAAMECIKGKDTTRVVYLRFVHAPILVKGWFHLGKLGKQKSQYVGIGFY

SEQ ID NO: 209357 - protein, 353 aa, Glycine max
  Coding DNA Sequence Number=SeqID_92579
  Gene Ontology: Mol. function=protein dimerization activity; Cellular component=nucleus; Biological process=regulation of transcription, DNA-dependent
  Homolog annotation: Hit_ID=Q0GPE8; Match level="QueryCoverage=87%, HitCoverage=97%, E-value=1e-128, Identity=78%"; Hit description=BZIP transcription factor bZIP16
  Pfam annotation: Domain name=Herpes_BLRF2; Domain location=163-262; Score=-37.3; E_value=0.057; Accession=PF05812.3; Description =Herpesvirus BLRF2 protein
  Pfam annotation: Domain name=bZIP_1; Domain location=140-201; Score =44.5; E_value=3.6e-10; Accession=PF00170.11; Description=bZIP transcription factor
  Pfam annotation: Domain name=bZIP_2; Domain location=140-194; Score =30.9; E_value=4.4e-06; Accession=PF07716.5; Description=Basic region leucine zipper
  Pfam module annotation: Pfam domain module=Herpes_BLRF2::bZIP_1::bZIP_ 2; Domain location=163-262::140-201::140-194
MESKWGAAATSIIAANFDDFKWIASMFYPDVANDNVKPCKLDPFTDEAFQNLEAVTASSTCGGVTEDTLVHSQNLTPIQSTISATIDSLSSICVGSPLSANKPNARDNQVKGATTTTSGSSREPSDEDDEAGPCEQSTNAIDVKRLRRKVSNRESARRSRRRKQAHLADLEWQVERLRLENANLFKQLTDASQQFREADTNNRVLKSDVEALRAKVKLAEDMITRGTLTPTNNQILQNQSPLNTPPQLNTNNLRRMGYVSPTFTVHGNDATASYGGGITVSGQNSPLGGLGNLDNIPCSDFNSGVNSDNAHQQKKNTQSRGEDHHHHAANNVEEERAKEDKGQSRMENETKET

SEQ ID NO: 209358 - protein, 48 aa, Glycine max
  Coding DNA Sequence Number=SeqID_92580
MEDVYVIQLKFQLKTQSIQAIAELRRQCARTDSNQNCNLEIKSSVYVA

SEQ ID NO: 209359 - protein, 38 aa, Glycine max
  Coding DNA Sequence Number=SeqID_92581
TSRIISLGSHASSSTRVIAISYMAEWVVGTGSFGIVFQ

SEQ ID NO: 209360 - protein, 158 aa, Glycine max
  Coding DNA Sequence Number=SeqID_92582
MGNLQQYLRVKRIYPSIIILDLAEEQRLRSRRWVAAAGPKHKGCLYDTGDLAHTYKCGNDIFMQHTQGSSSSTEDVAENNRLREELRQSKEEMRVFQSVVLQFLPLKHRTLFINNNLTSSTSTSTSTRTSTNTNTMQMTSRNMMTNRDTLLMTTLIID

SEQ ID NO: 209361 - protein, 340 aa, Glycine max
  Coding DNA Sequence Number=SeqID_92583
  Homolog annotation: Hit_ID=Q1SWX1; Match level="QueryCoverage=40%, HitCoverage=27%, E-value=3e-07, Identity=25%"; Hit description=IMP dehydrogenase/GMP reductase
MGSSQTPSLKKRFYQVKVKSLGITCLKELGQLMGQLQRQAFCKAYDKFWDLAMVEVSIEAIASLAQYYDQPLRWFTFGDFQLSPMVEEFEEILGCPLGGRRPYLFSGFYPSLARISKIVQISAQELDHRKQVENEVVGIPRKYLEAKARILANNQGVPLLTKASPSGKARLNLNQLKPFRYEDLAITIKSLLYYGCLESIMILPSYRFEGFNPSINEAINLIQGNIQYQYSLMRAQTQGYQWFFSDSDKRDFDLIRETHATKLFLSAYNGMFFIPFSVEHNNKLVQFFQKEKKDKEIYEASGCHEQQTPSFPSTDLSMEDSSDIFCFGNIHEEENVTNTK

SEQ ID NO: 209362 - protein, 113 aa, Glycine max
  Coding DNA Sequence Number=SeqID_92584
MKRLDLRMNAFLELKLLHPRKTMICLQPDLITSQEKSFRFSFDREALADDPSLISVLLTSLFQREKLEEVVVGVSLSLDHALSEYHPLSETSARIASKRNLEGNLPCKHAPSV

SEQ ID NO: 209363 - protein, 86 aa, Glycine max
  Coding DNA Sequence Number=SeqID_92585
MASRKRKDPASRPRESYNTSRLASEVPWERYAQNVHSRNILLERNSRPDPQEFVTRLCIPGRGFVLNAEGAPWKLLRKDLTTLAHT

SEQ ID NO: 209364 - protein, 244 aa, Glycine max
  Coding DNA Sequence Number=SeqID_92586
MDRARLVYALVIKMDMDVGSFISGQISQMAQSNSSRLGFPALITTLCITRGVVSDSLTFESLSPAINLAYIKKNWTRKARARGSEGPSSSAPPASTAPPPLPQLAPAQIGTSASLSSSFQCRCSESMHDSTQHRPFISMDEFMAQVAWPGVQPSSFGGEVDPEAILDIPEPDMPEVNLETDPTTQEDTAEATPKMTPQASPMTTPVLEFSTPQASPVMTLELELSEEEDDATAMDYAPSAPQDL

SEQ ID NO: 209365 - protein, 98 aa, Glycine max
  Coding DNA Sequence Number=SeqID_92587
MVKVSPGSKPDGDPKLAFTMITKSFDSKGKGPAMPEGTPMMEAGGGADGSFTGEGAGIEEDLRRWIVYVALKLPTMYLTNDVTFKFNSKDYFATLMQR

SEQ ID NO: 209366 - protein, 1637 aa, Glycine max
  Coding DNA Sequence Number=SeqID_92588
  Gene Ontology: Mol. function=RNA-directed DNA polymerase activity; Cellular component=chromatin; Biological process=chromatin assembly or disassembly
  Pfam annotation: Domain name=Chromo; Domain location=1415-1462; Score= 26.4; E_value=0.0001; Accession=PF00385.14; Description='chromo' (CHRromatin Organisation MOdifier
  Pfam annotation: Domain name=RVP_2; Domain location=490-609; Score= -45.2; E_value=0.0033; Accession=PF08284.2; Description=Retroviral aspartyl protease
  Pfam annotation: Domain name=RnaseH; Domain location=973-1091; Score=- 19.2; E_value=0.0035; Accession=PF00075.14; Description=RNase H
  Pfam annotation: Domain name=rve; Domain location=1159-1304; Score =10.7; E_value=0.00075; Accession=PF00665.16; Description=Integrase core domain
  Pfam annotation: Domain name=zf-H2C2; Domain location=1167-1208; Score=18.6; E_value=0.0012; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1415 -1462::490-609::732-916::270-431::973-1091::1159-1304::1167-1208
MANIMNYCCLLDFEAKGGCFTWRKNIQNGGQVRKKPDRVMANSDWCLSFPHALVELLPMNKSDHNHLLLSCRVTKKDFNFILDKIQSRLAGWKSKLLNKAGVWDNIDANIHSFLLGKRHTHWVDWNSVTQSKALRGGSGPSKSRYRVANILVLSFIFSTTAFMSEPPYSSPSTEKLEDAILKLTSLNLTLGESVQSMNLRFDALLQRLSSPFPFPPPIPTSATSSSTPPATNHKMKLDVPRFDGNDPLGWIFKINQFFDYHHTSKQDKLTIASFYMEGRALAWFQWMTSNGQFTSWLGFLQALQTRFSPSQYEDPTGILFKLTQRGSVAQYLAEFEELANRPVASDVGSGSRSGTTSGGETRRAQNLPSGTTPPVLSATPSRSSSTTPAIPSSPTLLPPPPPLLPPRLPAPGLKRLSPEELASRRDRGLCFNCDEKYHRGHRCASRVFFMVADAEDPCLSNIDSPDPEPDPPDETDPTQAQISLYSLAGHLAPETLRLLGSIAGHPVIILIDGGNTHNFIQESLVAQLGFSSSETRPLRVMVGNGQYLECTQWCEALTIDIQSVQFSLDLYVLPIAGANVVLRVQWLKSLGPVLIDYNTLRMQFFYEGQLVELRGNHEPTSHLLSPPQFNRVLKKQSSGVFFHISVLQEHTTNHHHDHYPPEIQELLAQFQILFKPPTTLPPERPTDHHIHLFPQATPVNVRPYRYPHCQKCEIERQVEVMLQQGVIQPSTSPFSSPVLLVRKNDGSWRFCVDYRALNAITVRERFPIPTIDELLDELGQARWFSKLDLLQGYHQIHMSAGDIPKTAFRTHHGHYEFKVMPFGLCNAPSPFQATMNQIFRPFLCRFLIVFFDDILIYSASFREHLQHLTTIFQVEYLGHIVSQGGVAPVAAKLGTIDQWPTPRTTRALRSFLGLAGFCRRFIQGYSTIAAPLVKAMITEPFQWGNETQAAFDQLKKALSQAPVLALPNFQLPFTVETDASGVGIGVVLSQQGHPIAFFSKPFTPKLLRASTYVRELFAITTAVKKWRQYLLGQRFTILTDHRSLKELLTQVIQTPEQHLYLARLMGFDYQIKYRSGANNQAADALSRLPEQTTSTCMILSTPCYNFLSEIHHQLETNQEYLKLREEIERCPAKYPDFKLTDKLILHKNRIWLPQGLPIIPMLLAEYHSTPTGGHTGIVKTLARLSENFYWSGMRGDVTHFVTTCIDCQHTKYETKRIADRDPLFISNFWQDLFRLSGTKLRMSSSYHPQSDGQTEALNRVIEQYLRAFVHRRPATWGKLLPWVEWSHNTSWNVATGTTSYEITFGKKPGTIPDYIAGTYDIVAVDAVLTDREETFKCIRRKLLKAQSLMKQQADTRRRDVEYQVGPVAYRLQLPTGTRVHPVFHCSLLKPFKGTPPSDITAVQLPEKFFGTQPIITPLAILDHRQTSQDPPRWEVLVQWQGLPPDDTSWEDWSTLCRDYHLEDKVLLQGPWSVSKVADTKPSARESSWNNAEDLAGLSIPQQGNKHNGICHFVIFSSCHNCNSIRGSGPSKSRYRVANTLLGKHVRSLLHDDDKLWTKLVNGKYLYGDNILQTKNWVLKGRLCHKVPFIDYQDVNMRVGMFANPNFMVNDYKQWIKTQATSKNGYLLFATCRVHLEV

SEQ ID NO: 209367 - protein, 283 aa, Glycine max
  Coding DNA Sequence Number=SeqID_92589
  Gene Ontology: Mol. function=RNA-directed DNA polymerase activity; Cellular component=chromatin; Biological process=chromatin assembly or disassembly
  Pfam annotation: Domain name=RVP_2; Domain location=11-106; Score= -62.3; E_value=0.072; Accession=PF08284.2; Description=Retroviral aspartyl protease
MRVIGYCGKKPLHILIDSGNTHNFLDLHIAQKMDCQAEAMDIVSVTVADGNKVQISSKVPKFSWSIQNTNFTSDMMLLPLGCCDLVLGIEWLVSLGDITWNFHKLTIEFFVHGKRHVLRGATPTNLATARKQHLHKTISYGVHLSLISLQSAVEGSLLHSLTTHASQQEPSGLPPCRVGHDHKIPLMQGANLINKRPYRDLNKATVKKKFPIPLVEDLLDELHGSTIFSKIDLRVGYNQVRMDAADIHKTAFRTHAGHFEYLVMPFGLTNASAAFQRLMNSVF

SEQ ID NO: 209368 - protein, 407 aa, Glycine max
  Coding DNA Sequence Number=SeqID_92590
  Gene Ontology: Mol. function=RNA-directed DNA polymerase activity; Cellular component=chromatin; Biological process=chromatin assembly or disassembly
  Pfam annotation: Domain name=Chromo; Domain location=357-407; Score =22.1; E_value=0.002; Accession=PF00385.14; Description='chromo' (CHRromatin Organisation MOdifier
  Pfam annotation: Domain name=rve; Domain location=90-246; Score =129.9; E_value=7e-36; Accession=PF00665.16; Description=Integrase core domain
  Pfam module annotation: Pfam domain module=Chromo::rve; Domain location=357-407::90-246
MALQVHQPDSSMFSRIQQSWQNDPILQQLIHASACGGHSGRDATLQKMKNAVYWRGMSKAVKFFVFQCATCQRSKYDTTASPGLLQPLPIPEHVWQHITMDFIEGLPFSFGKQAIFIVVDRLSKAAHFMALSHPYAAADVARCFLDNVYKLHGFPDTITSDRDPVFVSHFWKEFMSLQGIQVQLSTTYHPQTDGQSEVVNRCLETYLKCMCSDSPAQWSKWLPVAEWWYNSTYHNTIKASPYEIVYGQALPVHLPYLPGESKIALVDKSLQKREEMLKLLKFHMKRAQDRMKQLADRGRSDRSFHIEDKIGVVAYKLKLTLGSLVHNVFHVSQLKKFNGTTTTGNSSPSPLLDTSQKETASIIDRMTVKRGNRVVTKVLVQWKHQLPEDATWEFFYDLKQKFPHFNP

SEQ ID NO: 209369 - protein, 377 aa, Glycine max
  Coding DNA Sequence Number=SeqID_92591
  Gene Ontology: Mol. function=kinase activity
  Homolog annotation: Hit_ID=Q1SIP3; Match level="QueryCoverage=99%, HitCoverage=66%, E-value=3e-77, Identity=43%"; Hit description=TRNA -binding arm
  Pfam annotation: Domain name=Laminin_I; Domain location=115-369; Score=-55.3; E_value=0.078; Accession=PF06008.4; Description=Laminin Domain I
VMELEIEIPHDQGKEKHEDQERVKNGELRIENNAEDFRVKVNAYEQELRIVNEKLRLSEEEIGKLKIELEEYRSMKSKNLKGGVGLSSTVEGVKVGGEALELKKLREELRVNKDKLESSEMQIVSLKFGATKTFETIQQLQEQLDLYEKDIASWKTKFNSQKRENSKLQERHARMRTNVADRDHEVRDLKGSLSDVEQKMFFERANMKSEMPKLLGEQTHLEEKLKEREFHCQALEDEIKKIHSEKLEMGETLKGEIEKLKEEIESRKKSIEDANVSLDALKLERNDLKEEVGSLKEVVNSRNDEVEEAHKQVEELTSRAKKQEKEIEKQKVEILEGAEEKREVIRQLCFSLEHYRNGYNVLRQAFTGHKRVPLLAT

SEQ ID NO: 209370 - protein, 44 aa, Glycine max
  Coding DNA Sequence Number=SeqID_92592
MKAMKCRHKSEEHIDGLAIMGSVSYVGAVIDTDGKLEPPVPTTG

SEQ ID NO: 209371 - protein, 111 aa, Glycine max
  Coding DNA Sequence Number=SeqID_92593
ELGREQSPTDNIFPLFDQNESTTKITQHLEAQCGKPFFSAKAKNGIRGLVYQIKYIVRLKGHLAHPNRTHPLTTYPHMSNNPQTPGPASLKTWMETGVWGPRAHKEVSACG

SEQ ID NO: 209372 - protein, 423 aa, Glycine max
  Coding DNA Sequence Number=SeqID_92594
  Gene Ontology: Mol. function=glutamate-5-semialdehyde dehydrogenase activity; Cellular component=cytoplasm; Biological process=amino acid biosynthetic process
  Homolog annotation: Hit_ID=Q9AYM4; Match level="QueryCoverage=99%, HitCoverage=52%, E-value=1e-159, Identity=71%"; Hit description =VuP5CS protein
MADALKNNESVIRLENGADVADAEEMGYEKALISRLTLRPEKISSLVKSVRMLAEMEEPIGQILKRTELADKLILEKISCPLGVLLVIFESRPDALVQIAALAIRSGNGLLLKGGKEAKRSNAILHKVITSIIPDTVGDKLIGLVTSREHIPDLLKANLVVPRGSNKLVSQIKDSTKIPVLGHADGICHVYVDKTANIDMAKKIIRDAKIDYPAACNAMETLLVHVDLSRNGGLDELVAELRHEGVQLYGGPRASSLLKISETHSFHLEYSSLACTIEIVDDVFAAIDHIHHNGRQIQVPLQNLCFDSLYLKNLFLSCFCSAHTECIVAEDSEIAEAFLSQVDRMDKIKNEIIRKKVGVVCMEDKKIILKRCMVGISTSRLHARGPVGVEGLLTNRWILRGSGQVVNGDRGVTYTYKDLPVKA

SEQ ID NO: 209373 - protein, 343 aa, Glycine max
  Coding DNA Sequence Number=SeqID_92595
MAAFYSCHTSFNYRNPHHPLNKALMASFHDCHTNFDYHNPHHPPNHLSSLLPLHTTFHQQPPSLPFQHTPRMTDAELFSAREDRLEAALTKLAAAQCRIESTLDAILLKLPLRTSHHYPSSFVQSPLPPLPPMPTPPSLPALIQLCPTPLPTPLSTPTPSPMPTPLPIPSLPSMPPPLPMSTAPPCPAPMQPSLPPLSGPLPRSALHLPTFGHVRAAIPISDNLFSVILRSGHTTTPHAKHGEHRDIALFELGPGFFGTIMVSRKCIPSIFALRTGAKLSEFCHNRPWDLGITFGSHGLKPQHLEDKVFLMGQGMLGGRKQSSSNNTHSKQAQVTLCSKQTRC

SEQ ID NO: 209374 - protein, 148 aa, Glycine max
  Coding DNA Sequence Number=SeqID_92596
  Gene Ontology: Mol. function=structural constituent of ribosome; Cellular component=large ribosomal subunit; Biological process =translation
  Homolog annotation: Hit_ID=Q1S7K3; Match level="QueryCoverage=84%, HitCoverage=86%, E-value=3e-47, Identity=75%"; Hit description =Ribosomal protein L24/L26
  Pfam annotation: Domain name=KOW; Domain location=55-88; Score=18.3; E_value=0.028; Accession=PF00467.19; Description=KOW motif
  Subcellular localization annotation: CTP_CleavageSite=62; ConfidenceScore=5.35e-01
MAMQGNVMVIDRVSSSHHKSSKAHFTAPSSMRHVLMSAPLSTDLRSKYNAWSIPLRKDDDVQVVKGTYKGHEGKVVQLYFCLWVIHIEHIIREKVNGSTVNVGIHPSKVVVTKLRIYKDRKFLLDWKAKGCATTDKEKGTKFAHEDIV

SEQ ID NO: 209375 - protein, 242 aa, Glycine max
  Coding DNA Sequence Number=SeqID_92597
  Gene Ontology: Cellular component=mitochondrial matrix
  Homolog annotation: Hit_ID=Q8W487; Match level="QueryCoverage=66%, HitCoverage=64%, E-value=4e-37, Identity=50%"; Hit description =Protein At2g39795, mitochondrial precursor
  Pfam annotation: Domain name=MAM33; Domain location=1-172; Score =95.8; E_value=1.3e-25; Accession=PF02330.6; Description =Mitochondrial glycoprotein
MTALKPTFKVEVPVDFPFDIEDNPGERTIQLKGKFRDEIIKVQVDIPNVAPEEEHEDDENGNNEKNDSESSIPLVVSVFKENGVSLEFGVTAFPDEISIDSLSIKQSEESEDQLAYEGPEFIDLDENLQKAFHKYLEIRGIKPSTTNFLQEYMFAKDNKEYLMWLKNLKNFVEKNYLALSKHNHVNPRCQTVIWVREIMDKENTNGPLHFDLNTGAKIPSVGLGTWKAPPGVVGDAVIAAVK

SEQ ID NO: 209376 - protein, 92 aa, Glycine max
  Coding DNA Sequence Number=SeqID_92598
MATMEELIETVHMEHIIMFRPCLGGANKEWGIPQRARHRTLKMIIREHMVFSPTTDIAPLLSGMPSEARESPKLTENALSQVITTQRSSRFL

SEQ ID NO: 209377 - protein, 137 aa, Glycine max
  Coding DNA Sequence Number=SeqID_92599
MSRGLELDQRVASQFFAERLRVRVRVKDRERELQCQEESESERPRTGVSTRRGEARLGFNRTYLVCYYGGSGKRGDLGVLLLMEVDGSGSTTTFASGGSESFCHARNRKVEHHIVRDKGSNMSNMLNNLSRKSLKKC

SEQ ID NO: 209378 - protein, 234 aa, Glycine max
  Coding DNA Sequence Number=SeqID_92600
  Gene Ontology: Mol. function=transcription regulator activity; Cellular component=nucleus; Biological process=regulation of transcription
  Homolog annotation: Hit_ID=O81313; Match level="QueryCoverage=42%, HitCoverage=60%, E-value=2e-34, Identity=74%"; Hit description =Protein INDEHISCENT
  Pfam annotation: Domain name=HLH; Domain location=118-165; Score =25.3; E_value=0.00022; Accession=PF00010.16; Description=Helix-loop -helix DNA-binding domain
MDTNQNITTTGNHENMGRDEHNNIILHDHHHHNQIPTPHYNHHPLHIVQPSSNVAPSFVSDVLGVVHFEEEDEDEEEVEEELGAMKEMMYKMAVMQPVDIDPASVRKPKRRNVRISDDPQSVAARHRRERISEKIRILQRLVPGGTKMDTASMLDEAILYVKFLKRQIRLLQSTSSPLINCTGAAPNSDYWPFAPNIFHSSITNTNASMDIPVIGMEFNTRGHGHAGDASSIHL

SEQ ID NO: 209379 - protein, 817 aa, Glycine max
  Coding DNA Sequence Number=SeqID_92601
  Gene Ontology: Mol. function=nucleic acid binding
  Homolog annotation: Hit_ID=Q9LIH5; Match level="QueryCoverage=99%, HitCoverage=99%, E-value=1e-48, Identity=25%"; Hit description =Arabidopsis thaliana genomic DNA, chromosome 3, TAC clone:K24M9
  Pfam annotation: Domain name=zf-CCCH; Domain location=120-145; Score =26.8; E_value=7.8e-05; Accession=PF00642.15; Description=Zinc finger C-x8-C-x5-C-x3-H type (and similar)
  Pfam annotation: Domain name=zf-CCCH; Domain location=179-204; Score =17.8; E_value=0.0059; Accession=PF00642.15; Description=Zinc finger C-x8-C-x5-C-x3-H type (and similar)
  Pfam annotation: Domain name=zf-CCCH; Domain location=242-267; Score =18.9; E_value=0.0042; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=120-145::179-204::242-267
MSGSGKKRSSKWDLRDNPDFSPDDGDKLKHFSGGRGSNKDNIMNKDYRVLDSTMEWDEDESYDHKMSPGLDAWKHKRHNSQSPKNGWSRSVSRSSRSRSPPHGFRWDSGVNDRSRMRAGGSTQPCRDFAAGKCRRGSHCHFLHDNQNHEDGWEDKYREDGAPRYSAPREGRDYSLKSGRSDEACINFPKGRCRMGASCKFVHHNNSDGHSKVSVDGLTREREIDRRHRDSSFEQGSGHGPNRGDTLCKFFANESCRNGKYCRFSHDRQACRSHNRRLRDDRWASNPGGDYHMLDRPKLSDSVSPNRRPRGDRWGSDGNKADADKVWDSPERNDTVAVSDTAKLVEDKSENVVAAEQGFTPLAMRDGWGHSLDKSRVHSKQPFSSDKKEADSWIAGNAANMHGSQSVGTDIWLGDDAKMSPDWDYRVRSSSCIEEKHEQNKHGITQGFMYLATSEHDRIQIAPGQDFNQNAESFNPLHSSSCQVVGQTQVAAPILPSQGGIVDGMLKQEVSTEKKYTTEPNIMDAGLLQVSSRDPPPTENVVGKEQLAQLTNLSASLAHILGTGQQLPQLYAALNSHDAKGTSSLAKAEVLAMPLSNTLIRPDPAVGLLKQYDPMCDSVEPKSAVASSGVTPAIPPCKKVAEDVVEISSQSNTARQNCGNSSKSAGSEELVKSDPLILLQPGQNIGVNKDDNKEVLPEERQKSKDDPKNTKESGPLENMEQTDGPDEAKKTKGMKGSRAFKFALVEFVKELLKPTWKDGQITKDDYKTIVKKVVDKVTGSMQGANIPQTQEKIDHYLSFSKPKLNKLVQAYVEKVQKA

SEQ ID NO: 209380 - protein, 75 aa, Glycine max
  Coding DNA Sequence Number=SeqID_92602
MACTHILVEDSTSDSPQISASPHPLDFAPYASGSYSAQWNAPGLFHDMHMLRSSRILRKMEVVFVIGSAVDRLCG

SEQ ID NO: 209381 - protein, 207 aa, Glycine max
  Coding DNA Sequence Number=SeqID_92603
  Gene Ontology: Mol. function=oxidoreductase activity; Cellular component=cytoplasm; Biological process=alcohol metabolic process
  Homolog annotation: Hit_ID=Q9M6B5; Match level="QueryCoverage=93%, HitCoverage=77%, E-value=8e-40, Identity=76%"; Hit description =Alcohol dehydrogenase 6
MSTSGKPGDHVLPVFTGECKECDHCKSKESNMCDLLRINTDRGVTLNDGKLSEYTVVHVSCVAKINPAAPLYKVCVLSCGISTGLGATLNAAKPTKGSSVVVFGLGAAGLAGWGVAVPNKDDAIKTHLVNLLNEKTLKGTFFGNYKPRSGIPSVVEMYMNKEIELEKFITHEVPFEEINKAFEYIVKGESLRCIIRMSEWNLFKQLL

SEQ ID NO: 209382 - protein, 1046 aa, Glycine max
  Coding DNA Sequence Number=SeqID_92604
  Gene Ontology: Mol. function=nucleoside-triphosphatase activity; Cellular component=integral to membrane; Biological process=protein catabolic process
  Homolog annotation: Hit_ID=Q9FLG0; Match level="QueryCoverage=72%, HitCoverage=89%, E-value=0.0, Identity=79%"; Hit description =Similarity to FtsH
  Pfam annotation: Domain name=AAA; Domain location=542-735; Score =286.7; E_value=4.5e-83; Accession=PF00004.19; Description=ATPase family associated with various cellular activities (AAA)
  Pfam annotation: Domain name=AAA_2; Domain location=539-673; Score= -18.4; E_value=0.00022; Accession=PF07724.4; Description=ATPase family associated with various
  Pfam annotation: Domain name=AAA_5; Domain location=542-679; Score= -4.5; E_value=0.0039; Accession=PF07728.4; Description=ATPase family associated with various
  Pfam annotation: Domain name=Arch_ATPase; Domain location=516-715; Score=-98.5; E_value=0.089; Accession=PF01637.9; Description =Archaeal ATPase
  Pfam annotation: Domain name=DUF246; Domain location=2-183; Score =69.9; E_value=1e-18; Accession=PF03138.5; Description=Plant protein family
  Pfam annotation: Domain name=FtsH_ext; Domain location=338-516; Score= 85.1; E_value=2.2e-22; Accession=PF06480.5; Description=FtsH Extracellular
  Pfam module annotation: Pfam domain module=AAA::AAA_2::AAA_5::Arch _ATPase::DUF246::FtsH_ext; Domain location=542-735::539-673::542 -679::516-715::2-183::338-516
MGISNTHEVGWQITVNMAWVIHVAKSDSRLANNDLPLDIQRLRCRAMYHALRFSPPIENLGKEVGIFLHALGYPPSTPIYIAAGVIYGGNTHLSELSSRFPSIIFKESLATPEELKDFANHASQTAALDYIICVESDVFVPSYSGNMARAVEGHRRFLGHRKTINPDRKGLVGIFDMLETGELVEGRELSNMVQRMHKNSSNSQNPSSLAKPLSPNFPTLHLAFSPPDSSLATSRIDANSESPHPILLPTQPLPSKSKNKNKTPNPLNYSSCELMRRVNCVQKLKETERKRMNELEEFDKKANVQLERQLVMASSWSRALLTLRGKLKGTEWDPQNSHRIDYSDFLRLLDSNNVQFMEYSNYGQTISVILPYYKNGKPIGTEGNPKDIIFQRHPVNRMPIDSWNDVWRKLHQQIVNVDVINVDAVPAEIYSTIAVAVIWSMRLALAVGFYVWIDNLMRPIYAKLIPCDLGTPGQKTTQPLRSRALGSLGQSRAKFISAEERTGVTFDDFAGQEYIKNELQEIVRILKNDEEFQDKGIYCPKGVLLHGPPGTGKTLLAKAIAGEAGLPFFAANGTDFVEMFVGVAASRVKDLFANARSFSPSIIFIDEIDAIGSKRGGPDIGGGGAEREQGLLQILTEMDGFKVSTAQVLVIGATNRLDILDPALLRKGRFDKIIRVGLPSEDGRFAILKVHARNKFFRSEEEKETLLKEIAELTEDFTGAELQNILNEAGILTARKDLDYIGRDELLEALKRQKGTFETGQEDSTEIPEELKLRLAYREAAVAVLACYFPEPHRPFLETDINSIRSQPNMRYAEISGQVFARKLDYINSIVRACAPRVIEEEMFGIDNLCWISAKATLEASKRAEFLILQTGMTAFGKAYYKNYSDLVPSLAMKLEALRDEYMRYATEKCSSVLKEYHLAVETITDILLEKGQIKAEEIWDIYRGAPRVAQPAVSPVDEFGALIYAGRWGIHGISLPGRVTFAPGNVGFATFGAPRPTETQIVSDETWKLVDDIWDKKVQNIKDEASKVIEEEKEKPQLLMASHFL

SEQ ID NO: 209383 - protein, 139 aa, Glycine max
  Coding DNA Sequence Number=SeqID_92605
  Gene Ontology: Mol. function=receptor activity
  Homolog annotation: Hit_ID=Q2QYS7; Match level="QueryCoverage=53%, HitCoverage=41%, E-value=2e-15, Identity=50%"; Hit description=PRA1 family protein
  Subcellular localization annotation: CTP_CleavageSite=47; ConfidenceScore=5.12e-01
MTKLLHYLRFNSTIISWRKTKSRTNLRRIHRTDRPSRSCRLHARDCRCGAAEEREESGAIRLLIVEKQILGNAKSPVRAHDCQSNHEGRDQQGSNTGGQNDKGAFEEDDRLIQRAKEIKERPRREETEDRGQIARMNAR

SEQ ID NO: 209384 - protein, 106 aa, Glycine max
  Coding DNA Sequence Number=SeqID_92606
  Gene Ontology: Mol. function=structural constituent of ribosome; Cellular component=ribonucleoprotein complex; Biological process =translation
  Homolog annotation: Hit_ID=P51414; Match level="QueryCoverage=93%, HitCoverage=78%, E-value=2e-24, Identity=64%"; Hit description=60S ribosomal protein L26-1
MDGLQDILKSELGTLFLDGSGTTLGLSIEQGFVVLVHSMLSDDNLGRVNANVNINLLTGDVLNADDPLAAIDLEPLTSSSLRTERDHTLYFNQRSMERGTLDGIMK

SEQ ID NO: 209385 - protein, 381 aa, Glycine max
  Coding DNA Sequence Number=SeqID_92607
  Gene Ontology: Mol. function=oxidoreductase activity; Cellular component=mitochondrial outer membrane translocase complex; Biological process=aromatic compound metabolic process
  Homolog annotation: Hit_ID=Q9FVQ0; Match level="QueryCoverage=98%, HitCoverage=98%, E-value=1e-119, Identity=54%"; Hit description =Flavin-containing monooxygenase, putative
  Pfam annotation: Domain name=FMO-like; Domain location=6-381; Score= -462.8; E_value=0.022; Accession=PF00743.9; Description=Flavin -binding monooxygenase-like
MEEVSVIIAGAGPSGLAISACLSQNSISHIILEKDDCSASLWRKNAYDRLKLHLASEFCALPLMPHSPSSPTFLSKDEFVQYIDSYIARFNINPLYCRFIEFAAYDEVENKWRVEAKNTLEGTREIYVAKFLVIATGENSEGYIPDVHGLESFEGEIMHSKYYKSGSKYESKEVLVVGCGNSGMEIAYDLNDWGANTSILIRNPVHVFTKELINEGMRMMKHLPIHVVDTIITSLANMEYGDLSKYGIYQPKKGPFQLKFITGRAPVIDVGTIRRIKEGAIKVIPSHIVRIENKKVIFGNDVEKKFDVIVFATGYISVANKWLKDYKYILNDEGMPKNDFPNHWKGDRGLYCAGLSNRGLFGVKMDAEAIADDINQTLKLH

SEQ ID NO: 209386 - protein, 158 aa, Glycine max
  Coding DNA Sequence Number=SeqID_92608
  Gene Ontology: Mol. function=citrate transporter activity; Cellular component=integral to membrane; Biological process=citrate transport
  Homolog annotation: Hit_ID=Q9LT68; Match level="QueryCoverage=84%, HitCoverage=18%, E-value=8e-24, Identity=52%"; Hit description =Similarity to Na+/H+ antiporter
MTIVEIVDTHRGFKLVTDNITTKNPRLPPWVFSPRQLGIRHSHDFSVAEISTSVRVSEFKSALVIAFLMIVEEKTFNRVCESSKFVVSFSNYLEDIGRCCCNSSKYWWCMESYWCCYHYYAVDKWPSICSANNEGLLENSLPVSYICLDHVKSLCGTT

SEQ ID NO: 209387 - protein, 86 aa, Glycine max
  Coding DNA Sequence Number=SeqID_92609
  Gene Ontology: Cellular component=integral to membrane
  Homolog annotation: Hit_ID=Q60CZ6; Match level="QueryCoverage=58%, HitCoverage=29%, E-value=5e-17, Identity=76%"; Hit description=HVA22- like protein c , putative
  Pfam annotation: Domain name=TB2_DP1_HVA22; Domain location=12-81; Score=52.7; E_value=1.2e-12; Accession=PF03134.9; Description=TB2DP1, HVA22 family
MGASDDNNNNFLQVVFNNFDVLALPLVTLVYPLYASIKAIETKSTTDDQQWLTYWILYSILTIFELTFVKVLELSKAKEFVILDGA

SEQ ID NO: 209388 - protein, 71 aa, Glycine max
  Coding DNA Sequence Number=SeqID_92610
MKNSGKPSRICSRKRLGSVTDAPQLGFSLWKQFYSPNTAEMHSQGGKGGGGCRPACLGELSSPRHARLLPP

SEQ ID NO: 209389 - protein, 105 aa, Glycine max
  Coding DNA Sequence Number=SeqID_92611
  Homolog annotation: Hit_ID=Q06H24; Match level="QueryCoverage=41%, HitCoverage=29%, E-value=7e-20, Identity=93%"; Hit description =Ubiquitin-conjugating enzyme 9
  Pfam annotation: Domain name=UQ_con; Domain location=1-102; Score= -14.6; E_value=0.00039; Accession=PF00179.16; Description=Ubiquitin -conjugating enzyme
MLSISGPVAEDMFHWQATIMGPPDSPYTGGVFLVSIHFPPDYPFKPPKAISYPRRKEIFLRWWCLRLSELRSHTPVVVVVVVPQWLKCSMLWWSRDTVGARLPGL

SEQ ID NO: 209390 - protein, 73 aa, Glycine max
  Coding DNA Sequence Number=SeqID_92612
  Gene Ontology: Mol. function=small conjugating protein ligase activity; Cellular component=proteasome complex (sensu Eukaryota); Biological process=protein modification process
  Homolog annotation: Hit_ID=Q39372; Match level="QueryCoverage=63%, HitCoverage=36%, E-value=3e-19, Identity=93%"; Hit description =Ubiquitin conjugating enzyme, E2
MTDVLQRNIHKVTINSLTMLKEEHDHPMAYFCVQLRAVASYLALSVLYMWAISGTSGSSGLGSVNSEQMDKRT

SEQ ID NO: 209391 - protein, 174 aa, Glycine max
  Coding DNA Sequence Number=SeqID_92613
MAITRIGVNTAVMEQLANNQHNKDVHVEDQTNMSSIVRRLYAQVSEMQKHHTEEIVALWDENTHLQEAHRHNRRHGREFKNWKVSLSVPPSPSAPSSLSVPPALIMRNHMGSQMSRVNNRSWQPKANLLRGGEAGSTAIGLPQATNLSMSLDAISLSFNTLGRQLSQFKNPFRP

SEQ ID NO: 209392 - protein, 99 aa, Glycine max
  Coding DNA Sequence Number=SeqID_92614
MPQGWLRRNFLQKRARKATTGEGSNATPQAEIEFDGHRFRSEEHHRHFEVIKDWSFLKERWIQLAEREYTEFQAEVARRRWTQQIEPMAKYDPEVVMKF

SEQ ID NO: 209393 - protein, 316 aa, Glycine max
  Coding DNA Sequence Number=SeqID_92615
  Gene Ontology: Mol. function=DNA binding; Cellular component=oxygen evolving complex; Biological process=DNA integration
  Homolog annotation: Hit_ID=Q1SS72; Match level="QueryCoverage=99%, HitCoverage=26%, E-value=1e-84, Identity=47%"; Hit description =Integrase, catalytic region
MEGLDFLDTFSPVAKLTSVRLLLALAALHGWHLHQLDVNNAFLHGELNEEVYMQLPPGLIVDNPCQVCRLRHSLYGLKQASNDLATIRHITSLLDQAFKIKDLGRKYILDILSDLGMLDCRPSTTPMDYGTRLQATVGGPFPVDASSSYRRLVGRLIYLTTTRPDIAHAVQQLSQYMAAPTTAHSNAASRVLQYLKGTPGSGIFFSATGHLQLKAFSDSDWASCRDTHRSITVFSIYLGDSIISWRSKKQPTVSRSSSEAEYRALASTTCELQWLTYLLQDFRVAFIQPANLYCDNNPLFRSHLTKSFTNAPSILI

SEQ ID NO: 209394 - protein, 54 aa, Glycine max
  Coding DNA Sequence Number=SeqID_92616
MNEESFLVMVGATPTWALEQVPTGAKSTIGFAHDRRKELGSVRWQSLDYNHVSN

SEQ ID NO: 209395 - protein, 599 aa, Glycine max
  Coding DNA Sequence Number=SeqID_92617
  Gene Ontology: Mol. function=protein kinase activity; Cellular component=integral to membrane; Biological process=protein amino acid phosphorylation
  Homolog annotation: Hit_ID=Q9LVM0; Match level="QueryCoverage=99%, HitCoverage=93%, E-value=0.0, Identity=59%"; Hit description =Receptor-like protein kinase
  Pfam annotation: Domain name=LRRNT_2; Domain location=4-42; Score =36.2; E_value=1.1e-07; Accession=PF08263.3; Description=Leucine rich repeat N-terminal domain
  Pfam annotation: Domain name=LRR_1; Domain location=118-140; Score =17.9; E_value=0.037; Accession=PF00560.23; Description=Leucine Rich Repeat
  Pfam annotation: Domain name=LRR_1; Domain location=142-163; Score =10.8; E_value=2.7; Accession=PF00560.23; Description=Leucine Rich Repeat
  Pfam annotation: Domain name=LRR_1; Domain location=164-186; Score =10.8; E_value=2.7; Accession=PF00560.23; Description=Leucine Rich Repeat
  Pfam annotation: Domain name=LRR_1; Domain location=47-70; Score=2.2; E_value=1.1e+02; Accession=PF00560.23; Description=Leucine Rich Repeat
  Pfam annotation: Domain name=LRR_1; Domain location=72-94; Score=8.5; E_value=7.2; Accession=PF00560.23; Description=Leucine Rich Repeat
  Pfam annotation: Domain name=LRR_1; Domain location=96-115; Score =16.5; E_value=0.097; Accession=PF00560.23; Description=Leucine Rich Repeat
  Pfam annotation: Domain name=Pkinase; Domain location=317-572; Score =117.9; E_value=3e-32; Accession=PF00069.15; Description=Protein kinase domain
  Pfam annotation: Domain name=Pkinase_Tyr; Domain location=316-572; Score=65.7; E_value=1.5e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=4 -42::118-140::142-163::164-186::47-70::72-94::96-115::317-572::316-572
  Subcellular localization annotation: CTP_CleavageSite=40; ConfidenceScore=5.44e-01
IADLSSDKQALLNFANAVPHRRNLMWNPSTSVCSSWVGITCNENRTRVVKVRLPGVGLVGTIPSNTLGKLDAVKIISLRSNLLSGNLPADIGSLPSLQYLYLQHNNLSGDIPASLSPQLIVLDLSYNSFTGVIPKTFQNMSVLTSLNLQNNSLSGQIPNLNVTLLKLLNLSYNHLNGSIPKALEIFPNSSFEGNSLLCGPPLKPCSAVPPTPSPASTPPPSTTGRQSSKNKLSKIAIIVIAVGGAVVLFFIALVFVICCLKKEDNRGSNVIKGKGPSGGRGEKPKEEFGSGVQEPEKNKLVFFEGSSYNFDLEDLLRASAEVLGKGSYGTAYKAILEESMTVVVKRLKEVVVGKKDFEQQMEIMGRVGQHTNVVPLRAYYYSKDEKLLVYDYVPGGRTPLDWDSRIKISLGTAKGLAHIHSVGGPKFTHGNIKSSNVLLNQDNDGCISDFGLAPLMNVPATPSRAAGYRAPEVIETRKHSHKSDVYSFGVLLLEMLTGKAPLQSPGRDDMVDLPRWVQSVVREEWTAEVFDVELMRYQNIEEEMVQMLQIAMACVAKMPDMRPSMDEAVRMIEEIRQSDSENRPSSEENKSKDSNVQTP

SEQ ID NO: 209396 - protein, 187 aa, Glycine max
  Coding DNA Sequence Number=SeqID_92618
  Gene Ontology: Mol. function=DNA binding; Biological process=DNA integration
  Homolog annotation: Hit_ID=Q1SS72; Match level="QueryCoverage=96%, HitCoverage=12%, E-value=1e-47, Identity=45%"; Hit description =Integrase, catalytic region
MSERVEHTSSMDSCLYLHPSENPAIALVSPVLDSSNYHSWSRSMMTALSAKNKVEFIDGSIPEPQKSDRTYDAWRRCNNIVVSWIAHSISTQIRQSILWMDKAKEIWRDLKSRYSQGDLLRISDLQQEAASMKQGDLSVTEYFTKLRIVWDELENFRPDPVCSCTVRCTYSALTVISQRKLEDRAIQ

SEQ ID NO: 209397 - protein, 245 aa, Glycine max
  Coding DNA Sequence Number=SeqID_92619
  Pfam annotation: Domain name=Hin1; Domain location=85-221; Score =53.2; E_value=8.9e-13; Accession=PF07320.4; Description=Harpin -induced protein 1 (Hin1)
MEEGKSKSTLAKNPSRSRNPSRRVALDVPSPRHMGSTLSGIHSSIDHLDKGRYHPCCFACCAWSCLIVFILIIAILFLGITYLAFLKSGMPKINVRAFNITKFQVDDGSQKMNSVIGLGLIFSNKNDKLKLLYGPLDVDVTSEDVLLGKKKQGGFSQKPLNVTNLDMTMTLENADVDKYAAEELKSDIKAYEMVFDLYVGGHIGFQVGKLQMNNVPFLASCNQIKREDVDFGRKPECEVKLFAAR

SEQ ID NO: 209398 - protein, 148 aa, Glycine max
  Coding DNA Sequence Number=SeqID_92620
MYCTSETPSGPREVQQGTGIFGIDHRSLPIRREILHAKEGTTAGARRAAAVDHGCTTTASTSATISRVHPSSHVEDRALDARHRQDLNPYPWPTPEQVKVTVTWPGDRPNFQEEAGPTNAQGAAQGDEGGAEDDGGMTDLLDFFIGGD

SEQ ID NO: 209399 - protein, 104 aa, Glycine max
  Coding DNA Sequence Number=SeqID_92621
MEFTLGDQHVCVISTSLGRELLGAPSNIAGAPSNLLKGQFCPSFKNIKNFIPLSEAFCLLSSAKKLFSSLLSSAKKHSVFFSSSPRGFSGFIFSARLVFHLHSR

SEQ ID NO: 209400 - protein, 164 aa, Glycine max
  Coding DNA Sequence Number=SeqID_92622
  Subcellular localization annotation: CTP_CleavageSite=57; ConfidenceScore=5.74e-01
SSNPISDGTSTFTQAPFPYNTFHSLNPASNFRSISPGDPSKGIVLDLTSNLNEPPLRFSSGSSSNTTTDPRFSWMQNKYQGGGAIAMNNTFHKPRALDIHDRIWKGEESNNNKPLDHDNVSSIASDPKFRVAVAAAITSLMNKESHATHPIGTSFGPRSGQNGS

SEQ ID NO: 209401 - protein, 59 aa, Glycine max
  Coding DNA Sequence Number=SeqID_92623
MGFQTTLMGIGIEIAKVVNWIFKVVSGGGGVTMTGRWRQWTGCQRQRIGSSEVAEKEGE

SEQ ID NO: 209402 - protein, 273 aa, Glycine max
  Coding DNA Sequence Number=SeqID_92624
  Gene Ontology: Biological process=regulation of transcription
  Homolog annotation: Hit_ID=Q1SCJ0; Match level="QueryCoverage=23%, HitCoverage=14%, E-value=7e-28, Identity=93%"; Hit description=TCP -domain protein
  Pfam annotation: Domain name=TCP; Domain location=28-188; Score =144.5; E_value=2.9e-40; Accession=PF03634.4; Description=TCP family transcription factor
MEEQRVHHDENVTRKPNFPLQLLEKKDEGPPPPPSAAKAKRAPTKDRHTKVEGRGRRIRMPAACAARVFQLTRELGHKSDGETIEWLLREAEPAVISATGTGTIPANFTSLNVSLRSSGSSQSHYFLNRHNNLHNHNTNNYPFFTTTTPPEFSSSGSYFKSHPSFSLMQNSRRFSRKRRHEVISHVGNYCLSQMCTDSVPAMMSGADSVWAIPSVASSSASGIHFTNFASLLTGQHVGGAMVSSETNFNVLATLNAYSGQQPHHRHEGEETNN

SEQ ID NO: 209403 - protein, 82 aa, Glycine max
  Coding DNA Sequence Number=SeqID_92625
MTGVGLVQSSEVFVLINCLVLGLDLTADNGKPGDSDSSVLRSSEEEMDDEGFLGRVPDSSWTVPHIPSPPTSIIKKILPLGW

SEQ ID NO: 209404 - protein, 84 aa, Glycine max
  Coding DNA Sequence Number=SeqID_92626
MTYMYDDLRRAFHGQTTRGQYEGDSLHDASSTASRRGLSDGSQTSLRQGLVMMGHKFLFQHLVKTGDAGEDERGHWVKSGKGWL

SEQ ID NO: 209405 - protein, 503 aa, Glycine max
  Coding DNA Sequence Number=SeqID_92627
  Gene Ontology: Mol. function=nucleotidyltransferase activity
  Homolog annotation: Hit_ID=Q9SKH2; Match level="QueryCoverage=97%, HitCoverage=95%, E-value=1e-147, Identity=52%"; Hit description =Expressed protein
  Subcellular localization annotation: CTP_CleavageSite=64; ConfidenceScore=5.45e-01
MDPHRRHRRRTWCCSFAFPPSSPDNLNSNSSKPAFSLPTSPKSRIPVKIDPRRILSPGRVSPIDSDSVAGEPLPFPPPSPELPRPRSPAATCENRDVRMSLRGNNGGCMVLEVNSEVLCANSEVFAGLIEDYKKGSWSGSGSGSNKMCRIEVPEVDNLGVFRETIELMFENEDGVTKRLLNIGVFRSIDILEVSAGIMFTKGVLSCLQYLEAVPWTEEEEEKLRSLFTRFKFDEATTRDILGRLYLHDSVDSSSQPNVARQLVWSITTCVDNNARNELKTLVKGLLCKSSVYEKNHLDLSKEDLYSVCQSCLDTLISLFEEASDTERLTKKDKNKPLIERISRQVDNINWLLEIMLDGQIAEDFVNIWTDQHQLIKMHENASPMVRYELSRVSAILFVAMATRKLQCRLEARSGLLQAWFRPMLLDFGWLQRCRRGLDIKVLQEAMGQTLLTLPLNQQYMLFMEWFRYFSSHGTECPNLSKAFQIWWRRSFLRGSETDAIETR

SEQ ID NO: 209406 - protein, 158 aa, Glycine max
  Coding DNA Sequence Number=SeqID_92628
MEMGINDGNRGLWSEVVESGGNHLQSGLIFRLSGKRGREIKSCFRVTLGEWFEWKNVDVERFYRELREIYLPKAISVSWSVFPCTKEHYLKHVLIKEKKNVCEKSNCIWVGVLWSLWKARNNTIFRGGLFDKDKIMQVVFHMWTWLKNLDSSFGYSYD

SEQ ID NO: 209407 - protein, 498 aa, Glycine max
  Coding DNA Sequence Number=SeqID_92629
  Gene Ontology: Mol. function=DNA binding; Biological process =regulation of transcription
  Homolog annotation: Hit_ID=Q1RT19; Match level="QueryCoverage=99%, HitCoverage=98%, E-value=2e-86, Identity=39%"; Hit description=No apical meristem (NAM) protein
  Pfam annotation: Domain name=NAM; Domain location=1-128; Score=249.0; E_value=9.9e-72; Accession=PF02365.6; Description=No apical meristem (NAM) protein
MPGYRFQPTDVELIEYFLKRKVRGKKFPSEIIAEVDLYKFAPWDLPAMSLLKNGDLSWYFFCPRGKKYSTGGRLNRATEAGYWKTTGKDRPIEHNNTVVGMIKTLVFHTGRAPRGDRTDWVMHEFRLDDKVLADEAVSQDAYVICRVYQKEGPGPRNGAQYGKPYDEKEWETDEEIDSVQSAPVAAVCAPVPIQPSESHISVANYTHPSTSGCAGLTSVSCVSELMPSCSTHPSALNNPVDSVSCVSELIPSCSAHPSAPNSQVGSLSCVSELMPSFSPPSTPKNPVYSVSCVSELMPSCLAHLLASNNQVDSVPCVSEFMPSCSAHPSAPNSQVGSVSGLIPSFLAHSSASNNQVGSVPCVPELVPSCLAHPSAPNNQADVGILPFLDCSIEDDDTLAVNENNSIENVDDPDQANNAERGPCSDPHAIFEDLGDLNSLVGLGEGSFSCGQKNEYTTSAMLYTGDIFRSCDHDFLELIDLETPPPLWQNKHGSDSQDK

SEQ ID NO: 209408 - protein, 406 aa, Glycine max
  Coding DNA Sequence Number=SeqID_92630
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=37%, E-value=0.0, Identity=80%"; Hit description =Glycosyl transferase, family 48
MSLSGFEAAILKLARRKGDDALKAALASQSLVQLGLIMTLPMFMEIGLERGFRTAIGELIIMQLQLAPVSFTFSLGTKLHYFGRTVLHGGAKYRATGRGFVVRHEKFAENYRMYSRSHFVKGIELTILLICYKIYGSATPDSASYALLSWSMWFMVCSFLFSPFLFNPSGFEWKKIVEDWDDWQKWISNRGGIGVPSNKSWESWWNEEQEHLQHTGFLGRICEIILDMRFFVYQYGIVYHLNVARGDKSILVYALSWIVIVAVMVILKIVSMGRKQFSADFQLMFRLLKLFLFIGAIVALSLMFTLLSLTVGDIFASLLAFLPTAWAVIQIGQACRPFLKGFGMWGSVKALARGYEYLKGVVIFAPVAILAWFPFVSEFQTRLLFNQAFSRVLQIQRILIGGKKNK

SEQ ID NO: 209409 - protein, 262 aa, Glycine max
  Coding DNA Sequence Number=SeqID_92631
  Gene Ontology: Mol. function=protein translocase activity; Cellular component=chloroplast inner membrane; Biological process =intracellular protein transport
  Homolog annotation: Hit_ID=Q9ZQZ9; Match level="QueryCoverage=76%, HitCoverage=70%, E-value=1e-58, Identity=51%"; Hit description =Putative chloroplast protein import component
MTPQFAASHSFFRVPPTSPSLRFTRNKDLIPERYTIINRKKNHAITAFAGNSLGKSAIQLNAASSPLFADKEAHLSLKLPMSRKSNTTIRQAFIYHSSGFRIPSNAEKPEWWWRTLSCVPYLLALQISAAGFYLEPILEKFPLFRNLVFYIPGAVNRLPNWFPMLYCNVAIVWVVKNKDLPLIFRFHLMMGMLLEHALQIVWISSNFLPLIHFKGTLGMYYWAGVALTYIFVIIRCIRCALLGTFVSIPLLSESAFIHSLFS

SEQ ID NO: 209410 - protein, 63 aa, Glycine max
  Coding DNA Sequence Number=SeqID_92632
MATLAFVTSTQECQERWGREHFRLEDTTMVISKQRIKLSPKSTMQKAKKPKLLIPKSSMQEYN

SEQ ID NO: 209411 - protein, 222 aa, Glycine max
  Coding DNA Sequence Number=SeqID_92633
  Gene Ontology: Mol. function=protein serine/threonine kinase activity; Cellular component=cell cortex; Biological process=protein amino acid phosphorylation
  Homolog annotation: Hit_ID=Q75PK5; Match level="QueryCoverage=80%, HitCoverage=28%, E-value=9e-69, Identity=72%"; Hit description =Mitogen-activated kinase kinase kinase alpha
  Pfam annotation: Domain name=Pkinase; Domain location=87-222; Score= -58.4; E_value=4.4e-05; Accession=PF00069.15; Description=Protein kinase domain
  Pfam annotation: Domain name=Pkinase_Tyr; Domain location=87-221; Score=-114.7; E_value=2e-05; Accession=PF07714.7; Description =Protein tyrosine kinase
  Pfam module annotation: Pfam domain module=Pkinase::Pkinase_Tyr; Domain location=87-222::87-221
  Subcellular localization annotation: CTP_CleavageSite=72; ConfidenceScore=5.19e-01
MGGRQGDTKFYARSKSPGPGSRGPTSPTSPLHPKLHVLSLDSPTGRQEGECHPLPLPPGSPTSPSSSLPSTRANGMTEHTTGNLSKWKKGKLLGRGTFGHVYLGFNSDSGQLCAIKEVRVVCDDQSSKECLKQLNQEIHLLSQLSHPNIVQYYGSDLGEETLSVYLEYVSGGSIHKLLQEYGAFKEPVIQNYTRQIVSGLSYLHGRNTRMNCFCSLEKLLLL

SEQ ID NO: 209412 - protein, 108 aa, Glycine max
  Coding DNA Sequence Number=SeqID_92634
  Gene Ontology: Mol. function=transition metal ion binding; Cellular component=cytoplasm; Biological process=cytoskeleton organization and biogenesis
  Pfam annotation: Domain name=Transposase_21; Domain location=54-108; Score=-111.9; E_value=4.6e-05; Accession=PF02992.5; Description =Transposase family tnp2
MHKCPRCGVSRYKVKNDNECSSDKNKEGPPAKVLWYLLIIPRFKRLFANGDDAKDLTWHANGRNYDGMLCHPVDSSQWKKIDRLHPDFSNDARNLRLGLGTNGMNPYG

SEQ ID NO: 209413 - protein, 131 aa, Glycine max
  Coding DNA Sequence Number=SeqID_92635
  Gene Ontology: Mol. function=actin binding; Cellular component =cytoplasm; Biological process=cytoskeleton organization and biogenesis
MQSGSQSEPFDVEMGDLLEDFQQAHAPMYDTLQIDSKKPLYPGCKNSLMMLSAVFSLAKKILCPIGMEYQKIHACLNDCILHIHELQEIPKCPRCGVSWYKVKDDDECSRDEISKKGPPSEGVVSSHHSKV

SEQ ID NO: 209414 - protein, 96 aa, Glycine max
  Coding DNA Sequence Number=SeqID_92636
MDNSRFNTTINANYPARIMVFNLKRESKRTSNKNIGNRQQHQKFTKYICTCDDEQHGPKTEQQSNKELNHHLHQSSFPKTLDIKLPRHSQHSPKPP

SEQ ID NO: 209415 - protein, 114 aa, Glycine max
  Coding DNA Sequence Number=SeqID_92637
MRGLAKNVVATIVEAMPCHSTMALGKNSTMRIVETSSWLDSLTTDWIVLLCCVVLLPNWKLKSKSLFLAVVIVVVVFFLHDALRSTDELIGDYQESPYGLMLGDTPTNGAYVPI

SEQ ID NO: 209416 - protein, 173 aa, Glycine max
  Coding DNA Sequence Number=SeqID_92638
  Gene Ontology: Mol. function=nucleoside-triphosphatase activity; Cellular component=protein complex; Biological process=protein catabolic process
  Homolog annotation: Hit_ID=Q9SEI4; Match level="QueryCoverage=91%, HitCoverage=39%, E-value=1e-81, Identity=96%"; Hit description=26S protease regulatory subunit 6B homolog
  Pfam annotation: Domain name=AAA; Domain location=1-172; Score=184.5; E_value=2.7e-52; Accession=PF00004.19; Description=ATPase family associated with various cellular activities (AAA)
MLAKAVANHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVCTAKMNLSDEVDLEDYVSRPDKISAAEISKMTLFHGEIVEQS

SEQ ID NO: 209417 - protein, 503 aa, Glycine max
  Coding DNA Sequence Number=SeqID_92639
  Gene Ontology: Mol. function=nucleic acid binding; Cellular component= intracellular; Biological process=DNA integration
  Homolog annotation: Hit_ID=Q1RWN2; Match level="QueryCoverage=91%, HitCoverage=47%, E-value=2e-97, Identity=35%"; Hit description =Peptidase S8 and S53, subtilisin, kexin, sedolisin; Integrase, catalytic region; Zinc finger, CCHC-type
  Pfam annotation: Domain name=rve; Domain location=215-344; Score =49.5; E_value=1.1e-11; Accession=PF00665.16; Description=Integrase core domain
MKIGEEEDEEEEEQGDEVLPVAEEEGDNQSTKLKLNASNKVDQEDELLLMAYLDFKQGMIEEWFLDSGCNNHMSGNKDWFSELDENFRHAVKLGNDTRIVVTGKGSVLLNVNGVTHVISHVYYVPELKNNLLSIGQLQEKGLSILIQNRKCKVSHPETRQILEIEMKGNRIGLKTLSSKQMVNGLPTVTIPREICMHCLAGKQHRKPMPRKSLCRASSKLQLVHADICGPINPISSINKRFKVLVEKEADVSIGCLRTDRGGEFTSNEFGEFCKNHGIRRQFSTTYTPQQNGVAERKNKTVMNIMQSMQNTIDYFRVFGCLAHVHIPDQNRVKLDDKSKKCVLLGNIEEHQQDTLEWGDNEEYVSDSEKQSEENVVKSIGAQETKDQNEDVENDSTGTDTYPNDSHIINYETPVEGRVRRNRRKPVWTKDYEIGEVEKCNDERNGINREKHDLGAHDLPRGVKPIGVKWIFKTKFKETREIDKFKARLVAKGYMQQYGVDYTE

SEQ ID NO: 209418 - protein, 90 aa, Glycine max
  Coding DNA Sequence Number=SeqID_92640
MENSIVVNFNVNLPLVKRARVRMGKSSTEAKLNSISQVQPHVLKKGLINCLIKKDQMLGCSVDDEVVLPPSKCIHRDGSLLVGLLWRLDL

SEQ ID NO: 209419 - protein, 74 aa, Glycine max
  Coding DNA Sequence Number=SeqID_92641
MQSNVAITRVENELLTMQCVVFKGVMKVGILIFEAGDSVTRECTAKDVTTESEGFYRHVSLQQVAHPSINNTLL

SEQ ID NO: 209420 - protein, 1132 aa, Glycine max
  Coding DNA Sequence Number=SeqID_92642
  Homolog annotation: Hit_ID=Q0WVX3; Match level="QueryCoverage=88%, HitCoverage=98%, E-value=0.0, Identity=49%"; Hit description =Chromosome condensation protein-like
  Pfam annotation: Domain name=HEAT; Domain location=211-247; Score =6.2; E_value=7.5; Accession=PF02985.12; Description=HEAT repeat
  Pfam annotation: Domain name=HEAT; Domain location=255-291; Score =10.3; E_value=2.4; Accession=PF02985.12; Description=HEAT repeat
  Pfam annotation: Domain name=HEAT; Domain location=668-700; Score =0.2; E_value=41; Accession=PF02985.12; Description=HEAT repeat
  Pfam module annotation: Pfam domain module=HEAT::HEAT::HEAT; Domain location=211-247::255-291::668-700
MMPLEVVRVFEVDVIRGDEEGKDMGDEVALVIGEGGLLVEMRNKTCTTLDDLGLELEEGNENSHSRMGAPSKEIFLFVAVFGRCRMRNGVTRYKCLVHFRIHSHTPFHIHFIFTMAVREERVTEENDAEEAKRLMLKIAAILDEARTSYATHNRKLKELSLLRSKSSSHSHFFSGFSKTITPLFDFQRRLASADRIVSFVSAFAATAAASGDFLDHFLKFLLAAAAASNKTARFRACQIVSEIILRLPDDAEVSNEIWDEVIEWMKVRVRDKIPVVRTFAVRALSRFVNDSVNSDILDLFLEVLPLEQNADVRKMIVLSLPPSSATSQVIIDCTLDVSESVRKAAYCVLANKFPLQSLSIKLRTVILRRGLADRSVAVSKECFKLLKDEWLMKCCNGDPIELLKYLDVETYESVSESVMEALLKAGLVELQNGASIQQYISSNGDRTEGDSVHCPPSIQPMEAEAALYWRTVCKHLQSEAHAKGSDAAATMGTEAEVYAAEASDKNDLLEKILPATVGEYIELVRAHTNAGSNHRFACRQLLLLGAMFDFSDVTNRKTAGAFLHELMCKPPEHEDDDEGNIVVLGDGLSFGGDNDWAEAVASLARKVHAAPGEFEEVILAIIEELAQPCRERTADYVQWMHCLSLTGLLLKNAKSLRFLQGKAIGPDELLQSLLLPGAKQSHLDVQRIAIRCLGLFGLLERKPSAELLKQLRISYIKGPHSISIEACKALIDLVMWYGPQEVDKMLNLSIPCQLNSEKTTFSPVNFSDSERELDVGTLDILYGGFENDDWASPLPSNEDECVHAILGEGFAKILLLSNNYPSIPASLHPVILSKLIYLYFSDVSEHLHSCITKSFIPAMRSMWPGIFGNSSGSTFMVSQMRKRAVQASRFMLQMVQIPLYAKEIQPDCENTNTEHPQVIDSCVELPFECGEEGLALRLAVEVTSFQSKKTASEKAYVSALCRILVLLQFRISEQGPVKFMKRLLCRVIECASSEKDLVKELKRMSERLMTVDSQPDQELMQDEVNLILGKLELDCDLDLDGSVSMPQTPAAPATRPTRSRRRVRIEEESSDEDSPSVVPTTQHTVQSRSQRASKTAAMKKMSSATRSLKIDEMEELDEEDSDVTAEDYDASD

SEQ ID NO: 209421 - protein, 81 aa, Glycine max
  Coding DNA Sequence Number=SeqID_92643
  Homolog annotation: Hit_ID=Q43716; Match level="QueryCoverage=62%, HitCoverage=10%, E-value=2e-08, Identity=53%"; Hit description =Anthocyanidin 3-O-glucosyltransferase
MEIKRKKNVISFAMLIACKDLEAEIEVNMSEDGDFKQEDILKAVKTIMVEDDEEPGKRIKENHMKWKEFLSRFRNSEQIHH

SEQ ID NO: 209422 - protein, 378 aa, Glycine max
  Coding DNA Sequence Number=SeqID_92644
  Gene Ontology: Mol. function=sequence-specific DNA binding; Cellular component=intracellular; Biological process=regulation of transcription, DNA-dependent
  Homolog annotation: Hit_ID=UPI00005F7141; Match level="QueryCoverage =64%, HitCoverage=81%, E-value=9e-91, Identity=69%"; Hit description =COG2207: AraC-type DNA-binding domain-containing proteins
AGAVPPARAQPVQSPRADGAADRPLPRLRAHAAADHGRHFRAQQLALPGVQLAERGDLGLCAGGPRLRFQSNPSGKTLRKPGDDRPDAAAAAAAVRRPAGRHAGDLAQKARFLFLNPARYSAFSTSARQDRTAPPGDFIARRHAEQPLEFTAELRRALVTDADRRRAGLQAVMHHQQARLMQPVRLHVLQRRGVGHRLEIVVERRDAHVDLAGQLLDVEVVGILMFDAPQRLGDLAEVGMAIDQLLQRRAAGAAQHVVKDLAHNLRPQHPGVERLGHHVQQAFGGAQQRFRQLGQVHPVALRPRLHQVVVVADVDQQILQHLGIDIDRQSNQRQFRAGEGFAFERQRHRHQQVVARIVLEHLTAAIADLVPLKDDDDP

SEQ ID NO: 209423 - protein, 75 aa, Glycine max
  Coding DNA Sequence Number=SeqID_92645
  Homolog annotation: Hit_ID=Q1S6S9; Match level="QueryCoverage=54%, HitCoverage=7%, E-value=3e-11, Identity=80%"; Hit description =BTB/POZ; NPH3
  Subcellular localization annotation: CTP_CleavageSite=44; ConfidenceScore=5.09e-01
MEPIVYPNINNSILFACLVSILSNFQNQNKPHKFMATPNNRLSLAMERTGQWVFSQDIPTDVIVEVGETTFSLHK

SEQ ID NO: 209424 - protein, 68 aa, Glycine max
  Coding DNA Sequence Number=SeqID_92646
MPVCKMFYVPDMLRIRCVVWQCHNPSTIEAMAKMLKWMCETQSFMLSWPHDPNINITFKATLFVTVNH

SEQ ID NO: 209425 - protein, 93 aa, Glycine max
  Coding DNA Sequence Number=SeqID_92647
MKQGMRALFFYQILEVDFEDSVSIKVFLFVRWSSGKQRRLVVATSGHGWCKKRSGTCAHDDNLIRTGKVPIIVQMTEKSIKDNIVMGKFWCPE

SEQ ID NO: 209426 - protein, 242 aa, Glycine max
  Coding DNA Sequence Number=SeqID_92648
  Gene Ontology: Mol. function=transcription regulator activity
  Homolog annotation: Hit_ID=Q9ZV88; Match level="QueryCoverage=82%, HitCoverage=60%, E-value=4e-54, Identity=56%"; Hit description =BES1/BZR1 homolog protein 4
  Subcellular localization annotation: CTP_CleavageSite=22; ConfidenceScore=5.40e-01
MEIVGGSSAAASPCSSYHPSPCASYNPSPGSSSPYYTQIPNPDGNSLIPWLKNLSTASSSASSPKLPHLYLHSGSISAPVTPPLSSPTARTPRINAEWDEQSARPGPGWTRQQHYSFLPSSSPPSPGRQVVDPEWFAGIKLPHVSPTSPTFSLVSSNPFAFKEHALPSSGSPMWTPAQSGTCSPAVPPGSYQNADIPMSDAVSDEFAFGSNVLGLVKPWEGERIHEEFGSDDLVLTLRHSKT

SEQ ID NO: 209427 - protein, 553 aa, Glycine max
  Coding DNA Sequence Number=SeqID_92649
  Gene Ontology: Mol. function=ligase activity; Cellular component =nucleus; Biological process=protein amino acid phosphorylation
  Homolog annotation: Hit_ID=Q8RZQ7; Match level="QueryCoverage=79%, HitCoverage=63%, E-value=1e-111, Identity=47%"; Hit description=DNA ligase-like
  Pfam annotation: Domain name=DRMBL; Domain location=228-333; Score =58.9; E_value=1.6e-14; Accession=PF07522.4; Description=DNA repair metallo-beta-lactamase
MPIEMPKGLPFSVDTWTPSSSKRHCFLTHAHKDHSSSITSHSSYPIYSTNLTKTILLQQYPQLDASLFLNIELGQSLVIHDPAAAPFTVSAFDANHCPGAVMFLFEGKFGNILHTGDCRLTPECLLNLPDKYVGRKGKEPRCPLDCVFLDCTFGNFSQGMPSKHSAIQQVINCIWKHPDAQTVYLTCNMLGQEEILVNVSETFGAKIYVDKAKYSECFENLALTVPEILCEDPASRFHLFDGSRNLYERAKAKQVEAKETLQPEPLIVRPSAQWYACEEKFSDIDNTRKKRMDEAVKDQFGVWHVCYSMHSSKEELEWTLQLLAPRWVVSTTPSCRAMKLDYVKKHLFNSKGALNNSMWKLLDMTPETSDHVDTSEKSVSCNLVLEETPQPCAQSNVLTKSPVKQFTEAKTLKALLLHDKSLPITLFGRARFTLQDSGFSRVGCNTLPVNVLTQTVSNDARQEFLKDAEDAEVKERSPEKKNDLHQVEKNQQTEVQEDTRVHKGASYLNIGSSGLSGTVRKLYGSMNVPVPQPLPSLRDLINSRKRVKRGIKY

SEQ ID NO: 209428 - protein, 41 aa, Glycine max
  Coding DNA Sequence Number=SeqID_92650
  Gene Ontology: Mol. function=transcription regulator activity; Cellular component=nucleus; Biological process=regulation of transcription, DNA-dependent
  Homolog annotation: Hit_ID=Q9ZV88; Match level="QueryCoverage=88%, HitCoverage=11%, E-value=2e-14, Identity=89%"; Hit description =BES1/BZR1 homolog protein 4
MYGNFKLPKHCDNNEVLKALCNKAGWTVEPDGTTYRKDYLL

SEQ ID NO: 209429 - protein, 165 aa, Glycine max
  Coding DNA Sequence Number=SeqID_92651
  Subcellular localization annotation: CTP_CleavageSite=33; ConfidenceScore=5.46e-01
MAFSATLSYTSFPCLPRFPQTLRTKSVHFPLIRAVQGGQAETPESKKSEGSSNAQSSSAAAPKPKKPVYSLKKGQIVRVDKEKYLNSVNYLSVGHPPYYKGLDYIYEDRGEVLDMRIFETGEYALIAWVGVPTAPAWLPTDMLIKDQLKQKPNQAEPVFGQEQLV

SEQ ID NO: 209430 - protein, 304 aa, Glycine max
  Coding DNA Sequence Number=SeqID_92652
  Gene Ontology: Mol. function=nucleoside-triphosphatase activity; Cellular component=chloroplast; Biological process=transport
  Homolog annotation: Hit_ID=Q8H1R4; Match level="QueryCoverage=89%, HitCoverage=87%, E-value=2e-78, Identity=56%"; Hit description=Non -intrinsic ABC protein 13, chloroplast precursor
  Pfam annotation: Domain name=ABC_tran; Domain location=67-276; Score =160.6; E_value=4e-45; Accession=PF00005.17; Description=ABC transporter
MNLSYLTRFPERLVAPLYATLPTTATTSGNRPENFAIEGRNLKFSFTTRQTQDVPVLKDCSIRIPCGQFWMLLGPNGCGKSTLLKILAGLLTPTSGTVYVNGPKSFVFQNPDHQVTGIFCLILSEHHGMYAKGLNSSVPQIALQPSNDLSVRVVMPTVDSDVAFGLGKINLAHDEVRSRVSRALHAVGLSDYMKRSVQTLSGGQKQRVAIAGALAEACKVLLLDELTTFLDEADQVGVIKAVRNSVDTSAEVTALWVTHRLEELEYADGAIYMEDGKVVMHGDAASIRSFIEARQSAYITQINS

SEQ ID NO: 209431 - protein, 128 aa, Glycine max
  Coding DNA Sequence Number=SeqID_92653
  Gene Ontology: Mol. function=sugar porter activity; Cellular component=integral to membrane; Biological process=transport
  Homolog annotation: Hit_ID=Q941R4; Match level="QueryCoverage=89%, HitCoverage=32%, E-value=4e-37, Identity=67%"; Hit description=GDP -mannose transporter
MLTLRRVMDTAKLVTKSGNLNEFSMVLLNNTLSLPLGIFMIIVFNEVDYLLTTPLLRLPSFWLVMTFSGFLGLAISFTSMWFLHQTGATTYRKIPKLETLVGWDEVEVELAKLVVFEGTKAITKFTSS

SEQ ID NO: 209432 - protein, 162 aa, Glycine max
  Coding DNA Sequence Number=SeqID_92654
  Homolog annotation: Hit_ID=Q84K13; Match level="QueryCoverage=24%, HitCoverage=8%, E-value=2e-08, Identity=65%"; Hit description =Putative polygalacturonase
MYRIALRNDSVLDVFPSPTPPKSSIDKTTFLGGTSRKKPAQAREEPNGPGGKVEGEKGDEGEEEEDEGPGGSGTGSQDHGSKGCFAGFHIYNRNGTEQGVNDLILLWLEKVVVVVVVAAMEEKKNREWWRWRIGCVVKLEGSAWCTTICISVTAFHTKEGEN

SEQ ID NO: 209433 - protein, 80 aa, Glycine max
  Coding DNA Sequence Number=SeqID_92655
  Gene Ontology: Mol. function=hydrolase activity, acting on glycosyl bonds; Biological process=carbohydrate metabolic process
  Homolog annotation: Hit_ID=Q84K13; Match level="QueryCoverage=97%, HitCoverage=14%, E-value=2e-27, Identity=83%"; Hit description =Putative polygalacturonase
MDPKEWPIIEPLPSYGRGRERLGGRHISLIHGNGISNVVITGILLVMWFCRTKWDSGWSRKDVVGTLVEQNIGAHERAPP

SEQ ID NO: 209434 - protein, 72 aa, Glycine max
  Coding DNA Sequence Number=SeqID_92656
MTVTLKKKGKALPAQRRAATQIGVVRLEQVLTGTKNGCYQRSGSKDSKNCSKNRPILRGQSHIPVSGKSLIR

SEQ ID NO: 209435 - protein, 85 aa, Glycine max
  Coding DNA Sequence Number=SeqID_92657
MAVVFTGSESYPMILMAITSKGSIVDVERVREGKSVVSTEIIHWFSEDVVRVVFEGVHSRDLSFIGCREIVGEEGGGGKGTNKDI

SEQ ID NO: 209436 - protein, 299 aa, Glycine max
  Coding DNA Sequence Number=SeqID_92658
  Gene Ontology: Mol. function=transcription regulator activity; Cellular component=nucleus; Biological process=regulation of transcription, DNA-dependent
  Homolog annotation: Hit_ID=Q9ZV88; Match level="QueryCoverage=91%, HitCoverage=81%, E-value=5e-70, Identity=54%"; Hit description =BES1/BZR1 homolog protein 4
  Pfam annotation: Domain name=DUF822; Domain location=1-113; Score= -3.3; E_value=0.00032; Accession=PF05687.4; Description=Plant protein of unknown function (DUF822)
MGNGIAKSFLAGPGMPEFWELVGYLYVDDALTLFGETGCKPPVERMDIVGGSAAASPCSSYHPSPCASYNPSPGSSCLPSPRASPYPPNHNADGNSLIPWLKNLSSGSSSASSSKLPQLYIPNGSISAPVTPPISSPSSRKPRINADWEDLSTRPAAWGGPAYTFLPSSTPPSPGRQVAETDWFSKIRIPQVGLTPTSPTFSLVSSNPFGFKEDAMGGSGSRMWTTPGASGTCSPAVAAGSENTSDIPMAEAVSDEFAFGSSSSVLVNAWKGERIHEASFGTDDLELTLGSSKTRLLHK

SEQ ID NO: 209437 - protein, 112 aa, Glycine max
  Coding DNA Sequence Number=SeqID_92659
  Gene Ontology: Mol. function=nucleotide binding; Cellular component =membrane; Biological process=small GTPase mediated signal transduction
  Homolog annotation: Hit_ID=Q40207; Match level="QueryCoverage=76%, HitCoverage=42%, E-value=8e-37, Identity=87%"; Hit description=RAB1Y
  Pfam annotation: Domain name=Miro; Domain location=14-106; Score= -13.2; E_value=0.1; Accession=PF08477.3; Description=Miro-like protein
  Pfam annotation: Domain name=Ras; Domain location=14-107; Score=31.3; E_value=1.3e-11; Accession=PF00071.12; Description=Ras family
  Pfam module annotation: Pfam domain module=Miro::Ras; Domain location= 14-106::14-107
MESSPTQEFEYLFKLLMIGDSGVGKSSLLLCFTSDSFEDLSPTIGVDFKVKYLTMEGKKLKLAIWDTAGQERFRTLTSSYYRGAQGIIMGEFQFCFLIHHPTSHIYYLGEMF

SEQ ID NO: 209438 - protein, 126 aa, Glycine max
  Coding DNA Sequence Number=SeqID_92660
  Gene Ontology: Mol. function=nucleotide binding; Cellular component =membrane; Biological process=small GTPase mediated signal transduction
  Homolog annotation: Hit_ID=Q40207; Match level="QueryCoverage=92%, HitCoverage=57%, E-value=4e-54, Identity=88%"; Hit description=RAB1Y
  Pfam annotation: Domain name=Ras; Domain location=1-95; Score=5.5; E _value=1.1e-09; Accession=PF00071.12; Description=Ras family
MESPPPQRSYDVTRRETFTNLSEIWAKEIDLYSTNPECVKMLVGNKVDKESDRVVTKKEGIDFARECGCLFTECSAKTRANVQQCFEELVLKILDTPSLLAEGSKGNKKNIFKDKPSQSDATSSCC

SEQ ID NO: 209439 - protein, 374 aa, Glycine max
  Coding DNA Sequence Number=SeqID_92661
  Gene Ontology: Mol. function=ubiquitin-protein ligase activity; Cellular component=ubiquitin ligase complex; Biological process =protein ubiquitination
  Homolog annotation: Hit_ID=Q1WM08; Match level="QueryCoverage=97%, HitCoverage=86%, E-value=7e-22, Identity=26%"; Hit description =Avr9/Cf-9 rapidly elicited protein
  Pfam annotation: Domain name=U-box; Domain location=1-64; Score=24.0; E_value=1.2e-06; Accession=PF04564.6; Description=U-box domain
LDLFEDPVTLCTGQTYDRSSIEKWFSAGNLTCPVTMQKLHDPSIVPNHTLRHLINQWLQLGPQFGNSASIDYLAALKHTLESPQLENKLQALEKIRVLSDEYCSFRKSCFHQLNFLPLLLELVFGTQLSKSHNMEFTELALSCILKLLPLVSLEPLNMIKDESKLATFLLLFEKGTSSVKTSLCHLIDSTASPQTEEVCHMLGHSHKLVHEIVVLVRQNCEVSKVVAIKAMLALCSLQSNRENLVREGAIDGAITYISGCETRQKNAAPLAMAIIKKLLVLDSAKEALVNHPNGVETLVKMVFRVCNQECSESAVGILAIVCCDFGRAREEAIGAGVLTQLLFLLQSQCGTKTKTKARMLLKLLRSKWIEEPKQ

SEQ ID NO: 209440 - protein, 105 aa, Glycine max
  Coding DNA Sequence Number=SeqID_92662
  Gene Ontology: Mol. function=transmembrane receptor activity; Cellular component=membrane
  Homolog annotation: Hit_ID=Q7XIJ6; Match level="QueryCoverage=83%, HitCoverage=46%, E-value=2e-13, Identity=44%"; Hit description=TIR/P- loop/LRR disease resistance protein-like protein
MKPGHKLFEHINKAIHSSKVGVAVPTNRYCNSYFCLHELALLHESKKRVVPIFYDIKPSQLQVEGNARCPPQVLQTFTSALEETKYTVLDGAAKTDLGCCDHELA

SEQ ID NO: 209441 - protein, 856 aa, Glycine max
  Coding DNA Sequence Number=SeqID_92663
  Gene Ontology: Mol. function=transmembrane receptor activity; Cellular component=membrane
  Homolog annotation: Hit_ID=O80386; Match level="QueryCoverage=97%, HitCoverage=70%, E-value=6e-80, Identity=31%"; Hit description=COP1 -Interacting Protein 7
MKLILLSFFLLWWGLFYRFVRFVSTPAILERFASLENEILQIESSFQANALSMSIATPDEGSVPQANGITKRLSDSTKLNDVLEGVDNKEEENSKVSLHRLLESRIALLRKEQAMAYTRGLVAGFEIDSIDDLIYFANAFGAVRLREACINFKELWKKKHADDLWIKEVAAMQSSLPPALSLSGSSGIILANDITTHNSSKDSIASGDENVSLETSNSTLNRKEDVNLPTPDQKPSHMANVHMPMPWPYNVPPYMYNLQNPQMPSYQGYPMTNMQSVPPYLVPNMQWSPELGVNQKSSATKRDKSHKKRAEEYEDQQTESSEPDSGSESDSDKQNHSSHSSKDDLKRKKHRRKSSGTVVIRNINYITPKRRNGNEDGGSDESLEDDDVIDDETIKQKVGVALESLQKVHKGEKRANGKKAAVRHNVTKSRDATAEDLTENLSDASEGGKKNDNWDAFQNLLKIDEGTGTDGPERMQSIDVQDEHFVLRSSEERMPNGASSSPKFDFKQVLKNPKVPNDSFIVTRRDGGNEGGSKLDEYVDKCGPVTKSRENIGEEMLLSHRSKEHGNELSDPLSTFAADSLQTKGRTEDDWFVVDNLEKMRSADPSIVPAVFDGDYTSSVNGHSQYEKRSERILIDDSFMIQGQLVDNDRSDSQWKTDLSMVADLSAAKKLESDAAAASNEKNQEPSDLFVVLKRDSGLDSVEASRTMDYEIDFSFSETNRRSSIDDSHEKVNDSLPVSPAKTKVSGTRSSEKDGKSKALRCSSGKGKPEIMSRARKPALPKKPVVQKSKREQEDEIRQKMEELRNERQRRIAERTASSGVGRAATKKDQIEGKTARISAKSDKNKGISSVKVRGI

SEQ ID NO: 209442 - protein, 32 aa, Glycine max
  Coding DNA Sequence Number=SeqID_92664
MEDVQLFELQEQGGTQEGRLPTSNGQPNVHNR

SEQ ID NO: 209443 - protein, 68 aa, Glycine max
  Coding DNA Sequence Number=SeqID_92665
MTKARQKGVRKENEGGPCHPARPGELGCFLQKAPPSGELLGRPKLCNHPFFGFRNVTELYGLRINTSF

SEQ ID NO: 209444 - protein, 85 aa, Glycine max
  Coding DNA Sequence Number=SeqID_92666
MEREMITMIVDTLLVFYYKKMVGYTPSSFVDLVFADERIKVGLRRGKFDYPALMNRKPGENGESKNEGGTHVMTAIAIWPNSPLA

SEQ ID NO: 209445 - protein, 83 aa, Glycine max
  Coding DNA Sequence Number=SeqID_92667
MDATTRCYFQLAGYQAFGQSRSSLIYQQTLRKPNEYVQIDITGIRALWVSTYMKNMDADKKDTIKNRNANAGVNRIPAARGIH

SEQ ID NO: 209446 - protein, 119 aa, Glycine max
  Coding DNA Sequence Number=SeqID_92668
  Homolog annotation: Hit_ID=Q47522; Match level="QueryCoverage=35%, HitCoverage=53%, E-value=2e-19, Identity=100%"; Hit description=LacZ protein
RVPFAIQAAQLLGRAIGAGLFAITPAGERGMCCKAIKLGNARVFPEFDGSTITIEPWKSGAFPILRDLIVDRSALDRVIQAGDQAYRYRRPRGGARYQLLFPLVRVNFELGVIMGHSCF

SEQ ID NO: 209447 - protein, 563 aa, Glycine max
  Coding DNA Sequence Number=SeqID_92669
  Gene Ontology: Mol. function=catechol oxidase activity; Cellular component=chloroplast; Biological process=metabolic process
  Homolog annotation: Hit_ID=Q7Y249; Match level="QueryCoverage=96%, HitCoverage=97%, E-value=1e-176, Identity=55%"; Hit description =Polyphenol oxidase
  Pfam annotation: Domain name=Tyrosinase; Domain location=117-407; Score=417.8; E_value=1.5e-122; Accession=PF00264.10; Description =Common central domain of tyrosinase
  Subcellular localization annotation: CTP_CleavageSite=35; ConfidenceScore=5.48e-01
MASIPHLSFVSTVNNFSPYSTTPPSSLHPFSQFQSAKYKKPKHHHIPRVTCSGNQNNPTPNPSEGEPPHIVGHRRSVLFGLGGFCGASTLNNNNPFAFAAPLSPDITTCDSPNLPAGAEPTNCCPPPSASTNIIDFEFPPSNQPLRVRPAAHSVNDDYVAKFERALNLMKNLPSDDPLHGSWIFFPFHRWYLYFYERILGSLINDPTFAIPFWNWDSPQGMQIPSIYANPTSPLYDTLRSANHQPPTVIDLDFNIDNPGAGGNISTNLTIMYRQVVSNGRTPTSFLGDAYHAGDELSLGAGAGSLENVPHGTVHLWTGDSNQPNFEDMGTFYSAARDPIFYSHHSNLDRIWSIWKKTLGGRDFTDSDWLESGFLFYDENKNLVRVKVKDCLDERKLGYAYQDVDIPWSNSRPTPQRSRVQKVGTVAHVAETSRNVKFPLMLDSVVTTMVKRPKRSRSKKEEILVVEGIEFEKNTPVKFDMIINGEDYKLIKPDNSEFAGSFVSVPHSHKHKNKNIVTSLKLGLTDVLQDLGAENDDSVMVTLVPRFGKGRIKIRNIKIEFIAD

SEQ ID NO: 209448 - protein, 104 aa, Glycine max
  Coding DNA Sequence Number=SeqID_92670
MVMITDAELLFTKVLFETDCIRLKQAWDRSIGGDYSYFGGLVSDYRTKSRSFAACRLCHVKRGSNMEADSLFKLAYNFDVSNTGWRNILTRFLLSLSDVFFVST

SEQ ID NO: 209449 - protein, 710 aa, Glycine max
  Coding DNA Sequence Number=SeqID_92671
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=95%, HitCoverage=90%, E-value=1e-130, Identity=65%"; Hit description =Putative Na/H antiporter
  Pfam annotation: Domain name=Cation_efflux; Domain location=119-425; Score=-135.1; E_value=0.09; Accession=PF01545.11; Description=Cation efflux family
  Pfam annotation: Domain name=Na_H_Exchanger; Domain location=3-370; Score=221.3; E_value=2.1e-63; Accession=PF00999.11; Description =Sodiumhydrogen exchanger family
  Pfam module annotation: Pfam domain module=Cation_efflux::Na_H _Exchanger; Domain location=119-425::3-370
  Subcellular localization annotation: CTP_CleavageSite=38; ConfidenceScore=5.09e-01
MLGDVGYCYFAQVQGGVMLGPSVLGQNQAFANAVFPLRSVMVIETMANIGLLYFLFLVGVEMDMTVMRSVGRKAVASAIAGMVLPFVVGIVFSYLLAERTDSDINQGTFILFLGVALSVTAFPVLARILAELKLINTELGRLALSAALINDVCAWIMLALAIALAESEATTLASLWVLISSAAFVAVCVYAVRPAAAWLVKKTPEGEPFSEFYISLILAGVMVSGFITDAIGTHAVFGAFMFGLSIPNGQLSFTLVEKLEDFVSGLLLPLFFAISGLKTNLGLIHGSHTWLILLLVIFLACIGKVAGTILVALFYQMPIHEGAALGLLMNTKGLVEMVVLNVGKDQKVFDEESFAIMVVITVIMTGIILSGRTSAILIVHNTAKQDAPVLNRTEAQSDHIIKAFENYEQHASYISVQPLTAISRYSTMHEDICNLAADNRVSLVIVPFHKQQTVDGGMEATNMAYRSINQNVLANAPCSVGILVDRGLSGSNNLAGNQVSHHVAVLFFGGPDDREALCYRWRMVEHPGISLTVMRFVQTDQVQLEPFSQQQQHGSIDFHQPRVLTVQTDRDIQKQLDEKLIHEFRIRCEDDNSVGYVEKLVSNGEDTVAAIRTMDDIHDLFIVGRGQGVISPLTAGLTDWSECPEIGAIGDMLASSDFAATASVLVLQQYVGDGSPCEGLETPNAEEHITGISHSSTPPPSGHKMFNSDR

SEQ ID NO: 209450 - protein, 973 aa, Glycine max
  Coding DNA Sequence Number=SeqID_92672
  Gene Ontology: Mol. function=double-stranded RNA binding; Cellular component=intracellular
  Homolog annotation: Hit_ID=Q5YDB6; Match level="QueryCoverage=98%, HitCoverage=98%, E-value=0.0, Identity=56%"; Hit description=C -terminal domain phosphatase-like 1
  Pfam annotation: Domain name=dsrm; Domain location=718-781; Score =35.0; E_value=2.7e-07; Accession=PF00035.15; Description=Double -stranded RNA binding motif
  Pfam annotation: Domain name=dsrm; Domain location=854-922; Score =34.3; E_value=4.2e-07; Accession=PF00035.15; Description=Double -stranded RNA binding motif
  Pfam module annotation: Pfam domain module=dsrm::dsrm; Domain location=718-781::854-922
MAVGEVKIYPEENKNMDLKEIRISHFSQPSERCPPLAVLHTITSFGICFKMESSTSQKRQQQDALFHLHSSCIRENKTAVMPVRGEEIHLVAMYSRNNDRPCFWGFIVASGLYNSCLTMLNLRCLGIVFDLDETLVVANTMRSFEDKIEVLHRKMNSEVNPQQISAMQAEIKRYLDDKNILKEYAENDQVVDNGKVIKIQSESVPALSDSHQPIVRPLIRLQEKNIILTRINPQFLIIKTCRLVRIIGPTITCVFGKIRDTSVLVRLRPAWEDLRSYLTARGRKRFEVFVCTMAERDYALEMWRLLDPELNLINSKELLDRIVCVKSGLKKSLFNVFQNGLCHLKMALVIDDRLKVWDEKDQPRVHVVPAFAPYYTPQAEASNAVPFLCLARNVACNVRGGFFKDFDDGLLQKIPLIAYEDDIKDIPSPDVSNYLVSEDDASASNGNKNLLLFDGMADAEVERRLKDAISASSTILALTANIDPRLAFTSSLQYTMVSSSGTVPPPTAQASVVQFGNVQFPQPNTLVKPMSQVTHPGLSLHSSPAREEGELPESELDLDTRRRFLILQHGQDTRERMASEPPFPVRHPAQVSAPASSVPSRRGWFSVEEEMGPQQLNLPVPKEFPVDSEPFHIEKRWPRHPSFFSKVGDSISSDRVFHESHQRLPKEVHHRDDRSRLSQSLSSYHSLPGDDIPLSGSSYSNRDFDSESGRSLFHADTTAGVLQEIALNCGTKVEFLSSLVASTELQFSIEAWFAGKKIGEGFGRTRREAQSKAAGCSIKQLADIYMSHAKDDSGSTYGDVSGFHGSNNDGFVSSGNSLGNQLLPKEESGSFSTASESSRVSDSRLEVSKRSTDSISALKELCMMEGLAASFQSPPASASTHLTQKDEVHAQVEIDGQIFGKGFGVTWEEAKMQAAKKALGSLRTMFNQGSLKRHGSPRSMQGLANKRLKPEYPPTLQRVPYSARYPRNAPLVP

SEQ ID NO: 209451 - protein, 289 aa, Glycine max
  Coding DNA Sequence Number=SeqID_92673
  Homolog annotation: Hit_ID=Q1T1Y0; Match level="QueryCoverage=48%, HitCoverage=32%, E-value=3e-15, Identity=38%"; Hit description =Ankyrin
  Pfam annotation: Domain name=DUF1723; Domain location=39-88; Score =40.9; E_value=4.4e-09; Accession=PF08330.1; Description=Protein of unknown function (DUF1723)
MWPGKYKVAWNMRLCYMSKYTIWSKGSSLFPLTTCSYQIIDKGFLFAFAERWHTKTNTFHLLVEKMTVTLDDVASLLDIPITGAFYNYEHMDKEEAIIVLVELLGVEYKDAFDETKKIRGEQFSLSWLQGAYEEMCEEERWDEAAKAYLFHLVGCTLFANKNATYVEISGYATLLQIITPQQVDDRWLHLQNHLIQPIMGVVQPRDCDVGYYVWLYTISHPFVQPRYYAPPLDATKDLTHLQFRHILQLYETCHRTGQLLHQTLALACGVIDDDHLNTSKARGGTKVNV

SEQ ID NO: 209452 - protein, 567 aa, Glycine max
  Coding DNA Sequence Number=SeqID_92674
  Gene Ontology: Mol. function=sugar porter activity; Cellular component=integral to membrane; Biological process=carbohydrate transport
  Homolog annotation: Hit_ID=Q2HUE2; Match level="QueryCoverage=80%, HitCoverage=97%, E-value=0.0, Identity=78%"; Hit description=Sugar transporter superfamily; Major facilitator superfamily MFS_1
  Pfam annotation: Domain name=MFS_1; Domain location=104-504; Score =93.9; E_value=4.8e-25; Accession=PF07690.6; Description=Major Facilitator Superfamily
  Pfam annotation: Domain name=Sugar_tr; Domain location=100-544; Score= 375.8; E_value=6.7e-110; Accession=PF00083.14; Description=Sugar (and other) transporter
  Pfam module annotation: Pfam domain module=MFS_1::Sugar_tr; Domain location=104-504::100-544
MGLVGVQENGNGNGDGISEIPLGTKTKYIKMTSDPVEEDEEVLQSRKYETKKYIFACAVFASLNSVLLGYGRNANNSKMCVRECVGSIHLTLKVMSKLIWIKTKTLVGCLWFADVGVMSGAIIFIQEDLKITEVQQEVLVGILSIISLLGSLAGGKTSDAIGRKWTIGLAAVIFQTGGAVMALAPSFKVLMIGRLMAGVGIGFGVMIAPVYIAEISPAIARGSLTSFPEIFINFGILLGYISNYAFSRLPAHINWRIMLGVGLIPSLVIAIALFVIPESPRWLVVQNRIEEARAVLLKINESEKEAEEKLQEIQAAAGSANAGKYEPKAVWKEILCPTPPVRRMLITGCGIQCFQQITGIDTTVYYSPTIFKNAGITGNSELLAATVAVGFTKTLFILIAIFLIDKLGRKPLLYASTIGMTVCLFSLSLSLAILSHAKVGIALAILAVCGNVASFSVGLGPICWVLSSEIFPLRLRAQASALGAVGSRVSSGAISMSFLSVSRAITVAGTFFVFGVVSCCAVAFVHYCVPETRGKTLEEIEVLFKDEDDLQESEVEMGDVECLMQKS

SEQ ID NO: 209453 - protein, 395 aa, Glycine max
  Coding DNA Sequence Number=SeqID_92675
  Gene Ontology: Mol. function=galactosyltransferase activity; Cellular component=Golgi stack; Biological process=lipid biosynthetic process
  Homolog annotation: Hit_ID=Q2HUE1; Match level="QueryCoverage=64%, HitCoverage=93%, E-value=1e-112, Identity=75%"; Hit description =Glycosyltransferase sugar-binding region containing DXD motif; Alpha 1,4-glycosyltransferase conserved region
  Pfam annotation: Domain name=Gb3_synth; Domain location=273-395; Score=176.4; E_value=7.2e-50; Accession=PF04572.3; Description=Alpha 1,4-glycosyltransferase conserved region
  Pfam annotation: Domain name=Gly_transf_sug; Domain location=178-270; Score=93.6; E_value=5.8e-25; Accession=PF04488.5; Description =Glycosyltransferase sugar-binding region containing DXD motif
  Pfam module annotation: Pfam domain module=Gb3_synth::Gly_transf_sug; Domain location=273-395::178-270
  Subcellular localization annotation: CTP_CleavageSite=24; ConfidenceScore=5.66e-01
MLSLLFSLPTSFFALFLLLLLSYNAFTVFSVHVPKSPTTTTLSNSKFSSSLNSPLFKNPHLPLLQNSTESFSFSTIQRPSRRVKKHKRGLRSVRSESHFPVPFFHARLKAFFNNSHSSCKERFFMTWISSLKGFGERELFSMESLFKSHPEACLVIVSKSLDSNAGTQILKPFVSNGFKVMAVAPDFGYIFKDTHAETWFNRLKEGNVDPGEVSLGQNLSNLLRLALLYKFGGTYIDLDVVVLKSFSKLRNTIGAQNFDTKTGKWSRLNNAVLIFDKKHPLLFKFIEEFALTFDGNKWGHNGPYLISRVVSRVSGRPGFNFTVLPPSAFYPVDWRGIRSLFRDEISSKWLINKMEQIRKESFAVHLWNRHSRKLKVVKGSIVDSIISSCCIFCNI

SEQ ID NO: 209454 - protein, 82 aa, Glycine max
  Coding DNA Sequence Number=SeqID_92676
  Homolog annotation: Hit_ID=Q7XDY9; Match level="QueryCoverage=68%, HitCoverage=12%, E-value=1e-11, Identity=57%"; Hit description =Expressed protein
MRNIIHSRINILANRLDLWYEYASLSSSLIREGFSPSTIEETTDISSIDQNRLIVGAQVSDSLVHSKADLNLAQAPLRDSPP

SEQ ID NO: 209455 - protein, 204 aa, Glycine max
  Coding DNA Sequence Number=SeqID_92677
  Gene Ontology: Mol. function=DNA binding; Cellular component=nucleus; Biological process=regulation of transcription
  Homolog annotation: Hit_ID=Q9FLG5; Match level="QueryCoverage=92%, HitCoverage=93%, E-value=6e-42, Identity=49%"; Hit description =Similarity to NAM
  Pfam annotation: Domain name=NAM; Domain location=8-128; Score=126.3; E_value=8.3e-35; Accession=PF02365.6; Description=No apical meristem (NAM) protein
MEDESINLPPGFLFSPTDEELVVHFLYCKASLIPYHPNIIPDLDPSQLDDPWELNGKALLSGNQYYFFTKVNENRTTENGYWKDTGVTKPILSTFDKEVGMKKYLVFHIGEAPQGTETSWVMQEYHICSSEFDTASYRSVRRRRKHDQSWSKCVLCRVYEKIRSQQSVDCYRDDDDDGSGSELSWLDEVYLSLDDDLKEIGMPI

SEQ ID NO: 209456 - protein, 263 aa, Glycine max
  Coding DNA Sequence Number=SeqID_92678
  Gene Ontology: Mol. function=oxidoreductase activity, acting on the aldehyde or oxo group of donors, disulfide as acceptor; Cellular component=mitochondrial alpha-ketoglutarate dehydrogenase complex; Biological process=metabolic process
  Homolog annotation: Hit_ID=Q84JL2; Match level="QueryCoverage=90%, HitCoverage=62%, E-value=2e-87, Identity=65%"; Hit description =Putative branched-chain alpha keto-acid dehydrogenase E1 alpha subunit
  Pfam annotation: Domain name=E1_dh; Domain location=4-255; Score =121.4; E_value=2.6e-33; Accession=PF00676.10; Description =Dehydrogenase E1 component
MDINNVRSARKLLLRCILTWSLSDLWTLSSIKHKGKYREAGVLLWRGFTLQEFANQLFSNKYDNGKGRQIPAHYGSKKHNYFTVASTIALSIEIFYIQGFDGDFHAALNFAAVSEAPVIFICRNNGWAISTPISDQFRSDGVVMKGQAYGVRSIGDGNDAPAIYSAIQAARQMAITEERPILIEALTYRVGHHTTSDDSTKYRPANEIEWWRLTRDPVARFRKWIEKNGWWNDMAESQLINNLRQQARYTSLNPLIDDNWIPF

SEQ ID NO: 209457 - protein, 77 aa, Glycine max
  Coding DNA Sequence Number=SeqID_92679
MDWSEKNGLNCKFDFQYCQKLGLEERARVANKIGKIGVVKVNYGKGDESYKVGLMIEERSGSERLWVQILSLTKINR

SEQ ID NO: 209458 - protein, 136 aa, Glycine max
  Coding DNA Sequence Number=SeqID_92680
  Gene Ontology: Cellular component=clathrin vesicle coat; Biological process=intracellular protein transport
  Homolog annotation: Hit_ID=Q9SKU1; Match level="QueryCoverage=48%, HitCoverage=19%, E-value=3e-07, Identity=46%"; Hit description =Expressed protein
MSSFDAFADDLNVNSSSTRQHDDDEDNFSGYGGYSSFTGGFSADGDVAVDHSAAASPEIYGFTDSNPAYSQSPFESATVENENGNGYGDGDGVFVSDGPVLPPPTEMEPEEGYALREWRRSFLAKFLALACNKLGL

SEQ ID NO: 209459 - protein, 155 aa, Glycine max
  Coding DNA Sequence Number=SeqID_92681
MATYVVLMVCHLCLAEMRSPATYSTTPPGIMGDFVWSPFVRRSNLLVGLRHHPLAPLLLEKGVNLLLRLTQLLILLRSPPVPSTSFEPLSLYALRQAIGLTSPLSIEVFAPAIVVVISAPAVASASIPSLLHQCVQVVKLKWKSKCRVHMDFVCT

SEQ ID NO: 209460 - protein, 173 aa, Glycine max
  Coding DNA Sequence Number=SeqID_92682
MSSFFSDSAIGMGDIDSGGSIWQPLMDQEVISIRGSSSKNTCHDASNSETSSSEKLRVSRYTGGGISHLRGRAWPSAASPARELVQVTLILLPSASGGAKRSDGDVRASPRVRHSHSVGSSLSPPSVASYEWVKDDVLKCLFEVLGLILPLTAFHCALFEHLNVVILLVIIYD

SEQ ID NO: 209461 - protein, 1191 aa, Glycine max
  Coding DNA Sequence Number=SeqID_92683
  Homolog annotation: Hit_ID=Q9SIT6; Match level="QueryCoverage=49%, HitCoverage=95%, E-value=0.0, Identity=69%"; Hit description=White -brown complex homolog protein 5
  Pfam annotation: Domain name=ABC2_membrane; Domain location=343-553; Score=210.6; E_value=3.6e-60; Accession=PF01061.14; Description=ABC -2 type transporter
  Pfam annotation: Domain name=ABC_tran; Domain location=69-255; Score =169.9; E_value=6.6e-48; Accession=PF00005.17; Description=ABC transporter
  Pfam annotation: Domain name=MobB; Domain location=69-180; Score= -40.2; E_value=0.09; Accession=PF03205.4; Description=Molybdopterin guanine dinucleotide synthesis protein B
  Pfam annotation: Domain name=PPR; Domain location=687-721; Score =31.0; E_value=4.1e-06; Accession=PF01535.11; Description=PPR repeat
  Pfam annotation: Domain name=PPR; Domain location=790-824; Score =13.8; E_value=0.17; Accession=PF01535.11; Description=PPR repeat
  Pfam annotation: Domain name=PPR; Domain location=852-886; Score =45.7; E_value=1.6e-10; Accession=PF01535.11; Description=PPR repeat
  Pfam annotation: Domain name=PPR; Domain location=956-990; Score =48.0; E_value=3.3e-11; Accession=PF01535.11; Description=PPR repeat
  Pfam annotation: Domain name=PPR; Domain location=991-1025; Score =5.2; E_value=1.8; Accession=PF01535.11; Description=PPR repeat
  Pfam module annotation: Pfam domain module=ABC2_membrane::ABC _tran::MobB::PPR::PPR::PPR::PPR::PPR; Domain location=343-553::69 -255::69-180::687-721::790-824::852-886::956-990::991-1025
MKKQGCEVEAIGINYKIRTKTTEKPFKIFTKLPQLNREEDVHEAEDEQRSCRGVRHVLKDVNCMAKPWEILAIVGPSGAGKTSLLEILAGKASPQSGSILVNQEPVDKAEFKKFSGYVTQKDTLFPLLTVEETIMFSAKLRLNLPREQLFSRVKSLILELGLGHVARTRIGDESVRGISGGERRRVSIGVEVIHDPKVLILDEPTSGLDSNSALQIIEMLKVMADSRGRTIILSIHQPRYRIVKLFNSLLLLANGNVLHHGTVDLMGVNLRLMGLELPLHVNVVEFAIDSIETIQQQQKFQHGESRSGKFTLQQLFQQSKVIDIEIISSGMDITCGFANSGLRETMILTHRFSKNILRTKELFACRTIQMLVSGLVLGSVFCNLKDGLVGAEERVGLFAFILTFLLSSTTEALPIFLQEREILMKETSSGSYRVSSYAIANGLVYLPFLLILAILFTMPLYWLIGLNRNFTAFLYFLMQIWLILNTANSVVVCFSALVPNFIVGNSMIAGVIGSFLLFSGYFISKHEIPSYWIFMHYISPFKYPFEGFLINEFSNSNKCLEYLFGTCVVRGADVLKEAKLGGETSRWKNVGVMVQMFARSYPKTTESNIIMLPNDVISSVEKYSFLISKCITARRVKLANAVHGHLIKTALFFDAFLANGLIDAYSKCGCEESAHKTFGDLPNKTTRSWNTLISFYSKTGFFDEAHNLFDKMPQRNVVSYNSLISGFTRHGLHEDSVKLFRVMQNSGKGLVLDEFTLVSVVGSCACLGNLQWLRQVHGVAVIVGMEWNVILNNALIDAYGKCGEPNLSFSVFCYMPERNVVSWTSMVVAYTRACRLDEACRVFKDMPVKNTVSWTALLTGFVRNGGCDEAFDVFKQMLEEGVRPSAPTFVSVIDACAQEALIGRGKQVHGQIIRGDKSGNLFNVYVCNALIDMYAKCGDMKSAENLFEMAPMRDVVTWNTLITGFAQNGHGEESLAVFRRMIEAKVEPNHVTFLGVLSGCNHAGLDNEGLQLVDLMERQYGVKPKAEHYALLIDLLGRRNRLMEAMSLIEKVPDGIKNHIAVWGAVLGACRVHGNLDLARKAAEKLFELEPENTGRYVMLANIYAASGKWGGAKRIRNVMKERCLEKEPACSRIELRNARHEFVAKDKFHPQVEEICEVNSKLVLHSKDAGYQPYTDYPFLPDYDDDFYFS

SEQ ID NO: 209462 - protein, 932 aa, Glycine max
  Coding DNA Sequence Number=SeqID_92684
  Homolog annotation: Hit_ID=Q7G2F7; Match level="QueryCoverage=94%, HitCoverage=69%, E-value=0.0, Identity=64%"; Hit description =Expressed protein
MAGDAIITDSGAMHVAGVPIVNPSTIVVWEVMPGPGNGFQVIPRTSTNNGVPPPLSSPNWTGFAPLAAYLFSWQDHLLSEEKQGKNQTNQNLGDSIPLNCSPVSNFSAYVSPETAAQTAATTTWGSGVTAVAFDPTCGGSVIAVVIAEGQYMSPYDPDEGPSITGWRVQLWESSLQHVVLHPIFGNPTSSMGGQPPMQTVWQTKVDLSIPPTNDFKNHQAPAVGMNTDIQKVSEFGFDKSKRVNFDPFDLPSDVRALARIVYSPHGGEIAIAFLRGGVHIFSGPNFAPVDNYQISVGSAIAAPAFSSTSCCSASVWHDPSKDQTILKIIRVLPPAIPTSQVKTNSSNWERAIAERFWWSLLVGVNWWDAVGCTQSAAEDGIVSLNSVIAVLDADFHSLPSAQHRQQYCPSLDRIKCRLLEGANAQEVRAMVLDMQARLLLDMLGKGIESALINPSALVPDPWQVSSETLTSIDPEAVAVEPALVPCVQAYVDSVLDLASHFITRLRRYASFCRTLASHAVTAGTGNNRNVVASPAQCSATPATSQGGQNGTTSSSGSTQMQAWVQGAIAKISSTTDGVSNPVPNPPISGPSSFMPISINTGTFPGTPAVRLIGDSQQPRYAGGVQRTADTNLQKPQPNASVPGKVEEIAKPVSTVVRPDDGQAGRVSQLVPASKGGEEPSPGRSRIGTGNAGLGYTYEEVKVLFLVLMDLCRRTAGLQHPLPVSQVGSNNIQVRLHYIDGNYTVLPEVVEAALGPHMQNMPRPRGADAAGLLLRELELHPPAEEWHRRNMFGGPWSDPDDLDSANDAPKLISLNPLDSSSLENCDVYYGANGLWPRKRRMSERDAAFGLNTSVGLGAYLGIMGSRRDVVTALWKTGLEGIWYKLPPIFPVKMTGRFGGSAAGLMDGRIACILPAETEGGWNCTGEETCRLPD

SEQ ID NO: 209463 - protein, 105 aa, Glycine max
  Coding DNA Sequence Number=SeqID_92685
MVSTRSSLRREPPFKSSNPPLVGLPYIDTLQQLQNCIAKMERRHEEELRKLKVDQNQLEARFRHLYGDEHSTHTLPERTQEESHPQRTVNAQDYSSLSHMHHPVG

SEQ ID NO: 209464 - protein, 94 aa, Glycine max
  Coding DNA Sequence Number=SeqID_92686
MERLRGMFYCGLTVGTKCTDQNLELAHTRVNMAKVGSWTSHVDWRVAFVRRTRGETCKIKDSNTECQCQWSNEHVTIKVLNCPQYAQTYCILTC

SEQ ID NO: 209465 - protein, 77 aa, Glycine max
  Coding DNA Sequence Number=SeqID_92687
MVNHKSDKDSVYDVLHSTPTSTSVPTHHHIACNPPKDDFVKLNVDSSFIANPETSRFHFLSSTLLEHLLVVDPNLSS

SEQ ID NO: 209466 - protein, 754 aa, Glycine max
  Coding DNA Sequence Number=SeqID_92688
  Gene Ontology: Mol. function=RNA-directed DNA polymerase activity; Cellular component=chromatin; Biological process=chromatin assembly or disassembly
  Homolog annotation: Hit_ID=Q53B83; Match level="QueryCoverage=34%, HitCoverage=72%, E-value=8e-93, Identity=64%"; Hit description=GA 20- oxidase 2
  Pfam annotation: Domain name=2OG-FeII_Oxy; Domain location=239-329; Score=73.1; E_value=8.6e-19; Accession=PF03171.10; Description=2OG -Fe(II) oxygenase superfamily
HLLLMPYAKMSPPLMELSASTLVLYPASQPPQEPKNENNGGIVFDSKNLQQMQGEMPKEFLWPSRDLVDTTQEELKEPLVDLAIFKNGDEKAISNAAELVRKACLKHGFFQVINHGVDPDLIDAAYHEIDSIFKLPLSKKMGAKRKPGGVSGYSGAHADRYSSKLPWKETFSFLYDHQSFSNSQIVDYFKSVLGEDLQHTGVYQKYCEAMKDLSLVIMELLGISLGVDREHYRRFFQDGDSIMRCNYYPPCNRANLTLGTGPHTDPTSLTILHQDQVGGLEVFVDNKWLAVRPRSEALVINIGDTFMYPMSSPRMIEVRQPSGCSFGMEEGYQVEWGEDPDVFSGVRHETQGEFWTQVEVGGVRTNKSWPVWMEFDIDKVPNIESDMAAMKPQMKRRLPPEKNPVSKMEEKGATSHKLLQMGLIEDFCLAICFWVISSAKSEFGATQGLKETCYFLGLVFSLLIDRVLRNEAMDIFAHAFPDEIGMSTAKGFGNVHVSPQKLATNGVAQMVSGASPYHVPHVQEGRRLMDVYDSITGARSTFDSVIALMISEDYKMMVKEGIVMNKTSVEAGEAQKTTQISGRGWGRLVNYGANFQRIRSDPFCRNYVAQVLQCLFGKQTFGFEEVKGSSRKNRKDLLEVKQVLMEGCTVYEDVVKQNGKKFVSNFENHDVAPSSSRSSLMVGIENLSLIMMLNKPGVKHGLDLILQFSLLAIGVTRYVYRVMRLVILGGSGNWSRLRVGDEVWLLFVVVVGVN

SEQ ID NO: 209467 - protein, 147 aa, Glycine max
  Coding DNA Sequence Number=SeqID_92689
MDASIVDTKNTLRKHKRKENHSRCCWCCVYAYGCSSMRNQVLVQKERNDLNFSGTLSQRRKIREKDEIVASMKKVAESLKQLQQIFNNKLDEKDIQEVLDEVALIPNLDQQQWAKTVKWLSDDLEQLAVMRGLPIQKKKAYILAFIS

SEQ ID NO: 209468 - protein, 772 aa, Glycine max
  Coding DNA Sequence Number=SeqID_92690
  Gene Ontology: Mol. function=methyltransferase activity; Cellular component=cellulose and pectin-containing cell wall
  Homolog annotation: Hit_ID=Q9FMJ2; Match level="QueryCoverage=90%, HitCoverage=82%, E-value=0.0, Identity=62%"; Hit description=Ankyrin- like protein
  Pfam annotation: Domain name=DUF248; Domain location=285-756; Score =848.0; E_value=4.8e-252; Accession=PF03141.7; Description=Putative methyltransferase
  Pfam annotation: Domain name=Methyltransf_11; Domain location=435 -530; Score=32.5; E_value=1.4e-06; Accession=PF08241.2; Description =Methyltransferase domain
  Pfam module annotation: Pfam domain module=DUF248::Methyltransf_11; Domain location=285-756::435-530
  Subcellular localization annotation: CTP_CleavageSite=59; ConfidenceScore=5.06e-01
MALGKYARVDGRRSSSWCSTVTVVVFVALCLVGVWMMTSSSVVPVRNGDEAQENKNQVKEQTEPTEVKEAVSEVSNSNMRQFEDNPGDLPEDATKGDSNVASEDNSNLSDKQEEKSEENPVERSSDDTKSEDVEDKKTEEEGSNTENESNSDSTENSKDSDETSTKESDSDENEKKSDSDESEKQSNDTDETTDTKIEEKVEESDNKESDENSSEKNINDDTKQKSSKEVYPSGAQSELQEESTAETGSWSTQAAQSKNEKDSQESSKQPTGYKWKLCNVTAGPDFIPCLDNWKAIRSLQSTKHYEHRERHCPEEPPTCLVPVPEGYKRPIEWPKSREKIWYYNVPHTKLAEVKGHQNWVKVTGEYLTFPGGGTQFKHGALHYIDFIQEAYNNVMAILYKSCRSKDYGRHLIGNWALVIQTVPDIAWGKRTRVILDVGCGVASFGGFLFDRDVLAMSLAPKDEHEAQVQFALERGIPAISAVMGTKRLPFPGKVFDVVHCARCRVPWHIEGGKLLLELNRVLRPGGFFVWSATPIYQKLPEDVEIWKAMKALTKAMCWEVVSISKDPVNGVGVAVYRKPTSNECYEQRSKNEPPLCPDSDDPNAAWNIQLQACLHKAPVSSKERGSKLPELWPARLIKVPYWLSSSQVGVYGKPAPQDFTADYEHWKRVVSKSYLDGMGIKWSNVRNVMDMRSIYGGCNLAAVVAEADRILRPEGKLIVRDTVEIIEELESMARSMQWKVRMTYSKDKEGLLCVEKSKWRPKEQEKLEYAIA

SEQ ID NO: 209469 - protein, 83 aa, Glycine max
  Coding DNA Sequence Number=SeqID_92691
MNVALMETVEVPRKTKGEGNIVFVSDIQCDAPGLKGDNYKIWKKRILLQLGWMDIDYAIRKDKSSAIIDESSPANVALYEQWE

SEQ ID NO: 209470 - protein, 909 aa, Glycine max
  Coding DNA Sequence Number=SeqID_92692
  Gene Ontology: Mol. function=RNA-directed DNA polymerase activity; Cellular component=chromatin; Biological process=chromatin assembly or disassembly
  Pfam annotation: Domain name=Chromo; Domain location=827-878; Score =31.4; E_value=3.2e-06; Accession=PF00385.14; Description='chromo' (CHRromatin Organisation MOdifier
  Pfam annotation: Domain name=rve; Domain location=525-681; Score =120.9; E_value=3.7e-33; Accession=PF00665.16; Description=Integrase core domain
  Pfam annotation: Domain name=zf-H2C2; Domain location=470-507; Score =12.6; E_value=0.0077; Accession=PF09337.1; Description=His(2)-Cys(2) zinc finger
  Pfam module annotation: Pfam domain module=Chromo::RVT_1::rve::zf -H2C2; Domain location=827-878::12-181::525-681::470-507
MLTTGVIQPNHSPFSSPILLVKKKDGSWRCCVDYRALNAVTVKDRFPMPTIDELLDDLGQASWFSKLDLRQGFHQIRMAEEDTHKTAFRTHQGHYEFLVMPFGLCNAPSTFQAAMNDALQPFLHRFVVVFFDDILVYSPDLQSHVSHLESVLSTLADREFLLKHSKCSFAQRQLSYLGHIISSQGVAPDPDKVAAMLEWPQPTCPTTLRGFLGLTGFYRKFVKGYAAIAALLNSLLRKDSFIWSPETQHAFHQLQQAMTQTPVLANPNFLLPFTLETDASGTAMGAVLLQESHPIAYYSKVLCPRLQRASAYVRELHAITSAVRKWRHYLLGNSFIILTDHKSLKDLMSQTIQTPEQQTYLSKLLGFDYSIKYKPGPANVVADALSRIVPTEATYLTLTMPHCLFLQKLRHALLQDPQYEQLLRDVREHPTEHPELTTHQELLLRQGRIWIPFETPFTDSLLEEFHSSPLAGHPGVAKTLHRLRQNFDWPRIKIDVRRYVAQCATCQQTKYETKKSAGLLQPLPIPTHVWEDLSLDFVTGLPSSQGYTTILVVVDRFSKASHFGALPTPHSAYKVATLFLDMVCKHHGFPRSLVSDRDPIFVSKFWRELFRLSGTKLRMSTAYHPQTDGQTEVLNRSLEQYLRAYVHTQPSNWYRFLSLAEWSYNTSLHSAIGMTPFEAVYGKPPPKIADYLRGQSSNDAVDSLLSTRIRIHDQLTRRLHRAQERMKLTADKHRRDVSFTIGDWVYVRLRPYRQTSIAPTYSKLAKRFYGPFQILECIGPVAYKLLLSESSRIHPVFHVSLLKSHHDPLPASPASLPVNSNDNHPVVLPFAILDWKLDSSVTPPVKHVLVQWEGLPPEDASWELWDELRTLPKLEDKVVFNDGGVVSITADQHRPKRERKKPAYLQDFV

SEQ ID NO: 209471 - protein, 155 aa, Glycine max
  Coding DNA Sequence Number=SeqID_92693
MRVHCYPASRRPSMTTDSPPLLMFPWTRCWCLCASNEKISISCIHFKNTLKASKSYKQERKRNKREPTKEEVMILHEIRRPNSLKTVPSGVVNCRNLPFGRRATQGSQVRLPWEENAWSRHQCLFEENVGKTEKVWSTNFKRERFGSYFYALGRY

SEQ ID NO: 209472 - protein, 456 aa, Glycine max
  Coding DNA Sequence Number=SeqID_92694
  Gene Ontology: Mol. function=transporter activity; Cellular component= outer membrane-bounded periplasmic space; Biological process=transport
  Homolog annotation: Hit_ID=Q663R8; Match level="QueryCoverage=49%, HitCoverage=79%, E-value=1e-114, Identity=92%"; Hit description=ABC transporter, periplasmic amino acid binding protein precursor
  Pfam annotation: Domain name=PhoU; Domain location=1-65; Score=53.2; E_value=8.8e-13; Accession=PF01895.9; Description=PhoU family
  Pfam annotation: Domain name=SBP_bac_3; Domain location=114-335; Score=230.5; E_value=3.6e-66; Accession=PF00497.10; Description =Bacterial extracellular solute-binding proteins, family 3
  Pfam module annotation: Pfam domain module=PhoU::SBP_bac_3; Domain location=1-65::114-335
MDLDEAIRIYREDKKVDQEYEGIVRQLMTYMMEDSRTIPSVLTALFCARSIERIGDRCQNICEFIFYFVKGQDFRHLGGDALEKLLSPGASLTGLAAGAAHADKLDDIKQAGVVRIAVFDSNPPFGYIDPQSKKLVGYDVDVADAIGKALGVKVELRATNPANRIPLLVSKKVDLIAANFTITDERAKEVNFSVPYFATGQKFIARKGVLKTPEDIKKLRIGADKGTVQEITLRERFPTAKVISYDDTPLAFVALRNGNVQAITQDDAKLVGLLGNLPAAQKAEFEISPFSLTKEYQGVGIPKGEDRLTAAVNETLIKLEKDGEAVKIYDRWGAACCAPDAFCKTRIEHEPGLAAGAAIPELAVARFSADAVAFRLRGPGGHAAGLRAGGDARQQPAAVALAGDGLQLAVSQYAAAGAAVLLVLRRRADPAVRRHAVAEQITSGQPAGMAVVRVSR

SEQ ID NO: 209473 - protein, 90 aa, Glycine max
  Coding DNA Sequence Number=SeqID_92695
MARNKLSFVEGAYINRPPLFSDTNYSFRKIWSAVVNGYTIPTQVLDNKTIEKPYKFWSQEKIKKVFHQKHVILARDSKVQNQQKVLEEKL

SEQ ID NO: 209474 - protein, 82 aa, Glycine max
  Coding DNA Sequence Number=SeqID_92696
MGFPLPVVIYLAENLSGFSIHYLLSLEEIPLSFASGERMRILFIGQGSKWSKVVSQQGLFSWEPDLDIWGTTNSCVKVSVSG

SEQ ID NO: 209475 - protein, 65 aa, Glycine max
  Coding DNA Sequence Number=SeqID_92697
MDIKLKSSIRDIKGQRRGGTIRHHHHNNSNSEESHETRTAEKITTPKGSELNITIIIFGKCLDFG

SEQ ID NO: 209476 - protein, 111 aa, Glycine max
  Coding DNA Sequence Number=SeqID_92698
  Gene Ontology: Mol. function=carrier activity; Cellular component =integral to membrane; Biological process=protein insertion into membrane
  Homolog annotation: Hit_ID=Q42191; Match level="QueryCoverage=84%, HitCoverage=22%, E-value=5e-37, Identity=74%"; Hit description=Inner membrane protein OXA1, mitochondrial precursor
MAEKVPSFKHGGASWFIDLSTPDALYIFPALTALSFLITVECNMQEGMEGNPVAGTMKNVSRGLAVLTVPFTMGFPKAIFCYWVTSNLFSLVYGLGRLECIMHVIEESMAP

SEQ ID NO: 209477 - protein, 90 aa, Glycine max
  Coding DNA Sequence Number=SeqID_92699
MDHRHEDQMHKRGRPVIMGNSESMYESQDNFYQHPPSYNNSYHQPSPYAENSENNTYHEPSSYAGTSSNTSYYQPSTHPGSSANTRHQHI

SEQ ID NO: 209478 - protein, 131 aa, Glycine max
  Coding DNA Sequence Number=SeqID_92700
  Homolog annotation: Hit_ID=Q08ET6; Match level="QueryCoverage=46%, HitCoverage=12%, E-value=4e-11, Identity=56%"; Hit description=RING -finger protein
  Pfam annotation: Domain name=Copine; Domain location=1-79; Score= -50.3; E_value=0.0094; Accession=PF07002.6; Description=Copine
MKTLRTIRWFGVVLFQFECGAFGWREITKSLAGDLFLPILVTRNPDVPRGKLSPQAQATISSIAAASHYPLSIILVGVGDGPWDEMKHFDDNISERLFDNFQLEIRRIGVWRDIDKLDSTSSNSETNIRGL

SEQ ID NO: 209479 - protein, 129 aa, Glycine max
  Coding DNA Sequence Number=SeqID_92701
  Gene Ontology: Mol. function=metal ion binding
  Homolog annotation: Hit_ID=Q5JMT9; Match level="QueryCoverage=89%, HitCoverage=30%, E-value=2e-22, Identity=46%"; Hit description =Copine I-like
  Pfam annotation: Domain name=zf-C3HC4; Domain location=79-111; Score =19.4; E_value=0.0015; Accession=PF00097.15; Description=Zinc finger, C3HC4 type (RING finger)
MSINTGNFSAAALMEIPFQYRAAQNIQLNDRESVLHQHKRPFPPPNEAIDHDNARMAIPHMTNLESAEPTAPAAVEPVCPICLTNPKDMASGCGHTTCKECGSTLSSCSMCRQQITTPPRLYTWVRKLI

SEQ ID NO: 209480 - protein, 60 aa, Glycine max
  Coding DNA Sequence Number=SeqID_92702
MSSKGMNNDGKRSKDLGPSKASIKKDESLGTLPSALLDTYALISLTRNNKQMTLRPFEKV

SEQ ID NO: 209481 - protein, 77 aa, Glycine max
  Coding DNA Sequence Number=SeqID_92703
  Homolog annotation: Hit_ID=Q1SQ50; Match level="QueryCoverage=56%, HitCoverage=7%, E-value=7e-07, Identity=54%"; Hit description =Sodium/calcium exchanger membrane region
MKGISQICNRKGRDNQYSPERHKGHWISGRDFGHNHNFRGVEMNNHEGKNHKEETSVQEQGVCHPFGHKICDGHVER

SEQ ID NO: 209482 - protein, 203 aa, Glycine max
  Coding DNA Sequence Number=SeqID_92704
  Homolog annotation: Hit_ID=Q53LG7; Match level="QueryCoverage=36%, HitCoverage=72%, E-value=1e-12, Identity=44%"; Hit description =Expressed protein
MPVAPDPSSGRIFIWITACFLFTCVLAGGGCLVEYMILPASEVPPWIPLLGFTLVSLPWVFWLLTFLYRILSRCCGCRFGFGVAREGSRGGNSDGASAPGEANNNNNNNGMNRTLSAASHESQLPLANYTSSTRSNIPSPHQSSWIPSLVWDKESKRMNLVEDEEPFLGIFTSRPFTTTSYTQRMMRRNLPSNLAVNSPFSSA

SEQ ID NO: 209483 - protein, 484 aa, Glycine max
  Coding DNA Sequence Number=SeqID_92705
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=Q9LRE6; Match level="QueryCoverage=99%, HitCoverage=44%, E-value=0.0, Identity=87%"; Hit description=DNA polymerase delta catalytic subunit
  Pfam annotation: Domain name=DNA_pol_B; Domain location=1-391; Score =497.4; E_value=1.6e-146; Accession=PF00136.12; Description=DNA polymerase family B
MAYNLCYCTLVTPEDARKLNIPPESVNRTPSGETFVKSNLQKGILPEILEELLTARKRAKADLKEAKDPLEKAVLDGRQLALKISANSVYGFTGATIGQLPCLEISSSVTSYGRQMIEHTKKLVEDKFTTLNGYEHNAEVIYGDTDSVMVQFGVSAVEEAMNLGREAAEHISGTFTKPIKLEFEKVYYPYLLISKKRYAGLFWTKPDNFDKMDTKGIETVRRDNCLLVKNLVNDCLHKILIDRDIPGAVQYVKNAISDLLMNRMDLSLLGLTKTGDDYEVKAAHVELAERMRKRDAATAPNVGDRVPYVIIKAAKGAKAYERSEDPIYVLENNIPIDPHYYLENQISKPILRIFEPILKNASKELLHGSHTRSISISTPSNSGILRFAKKQLTCIGCKALLGKGYHTLCSHCKGREAELYCKTVSQVSELEMLFGRLWTQCQECQGSLHQDVLCTSRDCPIFYRRKKAQKDMGEAKLQLDRWNF

SEQ ID NO: 209484 - protein, 183 aa, Glycine max
  Coding DNA Sequence Number=SeqID_92706
  Gene Ontology: Cellular component=integral to membrane
  Homolog annotation: Hit_ID=Q1SQ50; Match level="QueryCoverage=94%, HitCoverage=30%, E-value=2e-45, Identity=51%"; Hit description =Sodium/calcium exchanger membrane region
  Pfam annotation: Domain name=Na_Ca_ex; Domain location=114-182; Score= -9.1; E_value=0.047; Accession=PF01699.14; Description=Sodiumcalcium exchanger protein
MAITDFVSKRMTYTLFLNTCFLLVIFSFMIVHFHTPEVVVVTKISAFDNIKEQECESLDSLGDYKAKCLYLKSNDPCASQGYIDYLYLFYCKFGKFPSLGYTLLFLWLLVLFYLLANTTSEYFCPSLESLSKLLRLSPTIAGVTLLSLGNGAPDVFSSLVSFQETGTRDIGFNTVLGGVSFSP

SEQ ID NO: 209485 - protein, 219 aa, Glycine max
  Coding DNA Sequence Number=SeqID_92707
  Gene Ontology: Mol. function=DNA topoisomerase type I activity; Cellular component=chromosome; Biological process=DNA unwinding during replication
  Homolog annotation: Hit_ID=Q9LVP1; Match level="QueryCoverage=94%, HitCoverage=24%, E-value=5e-29, Identity=32%"; Hit description=DNA topoisomerase III
  Pfam annotation: Domain name=zf-CCHC; Domain location=199-216; Score =22.9; E_value=0.00016; Accession=PF00098.13; Description=Zinc knuckle
  Pfam annotation: Domain name=zf-CCHC; Domain location=83-100; Score =21.2; E_value=0.00031; Accession=PF00098.13; Description=Zinc knuckle
  Pfam module annotation: Pfam domain module=zf-CCHC::zf-CCHC; Domain location=199-216::83-100
MADNSVGQQQMATSGPVYLIQFKFRRLEIPPNYSPNHLGCIGGCDEILAQLTEICGRGPRMPARPRGPTAPTSNAHHTNPRQGACMNCRETGHSSTDCPLRYGNVQHHGTSEHNVLPLGFEQMVTAIHEDTECVLLWNDGLDSLNAGTGGRSVTRSNSIPALNPRQTGGRGSRGRGGQYGSRTANTTFMSATGDPISGRRCYTCGDPSHFANVCPHRGV

SEQ ID NO: 209486 - protein, 656 aa, Glycine max
  Coding DNA Sequence Number=SeqID_92708
  Gene Ontology: Mol. function=nucleotide binding; Cellular component =nucleolus; Biological process=regulation of transcription, DNA -dependent
  Homolog annotation: Hit_ID=Q1S808; Match level="QueryCoverage=99%, HitCoverage=100%, E-value=0.0, Identity=56%"; Hit description=Plus-3
  Pfam annotation: Domain name=Plus-3; Domain location=272-381; Score =162.0; E_value=1.6e-45; Accession=PF03126.8; Description=Plus-3 domain
MADLENLLLEAAGRTGTAGRNRHSLPSSRRRHDGAYSDGGSDSRDEDSDDELNYASRKPSGSQVPLKKRLDPTERDDDLGSQEEADDDGRSDCDGDSSDESNIGDDLYKDEDDRRKLSEMTELQREMILSDRATKKDDKNLLGKIASKREKGKVAVPRKQSPPMSSSRMRASARSADRSAKNDALNELRAKRLKQQDPEAHRRLREASRNAGSRHFSPPKRKPFTSTSLSSSSHSESESRSHSDDEGSTGDGGIVDSDDDRALAGSEGPSFQDVKEITIRRSKLAKWFMEPFFEELIVGCFVRVGIGRSKTGPIYRLCMVKNVDASEPDRQYKLENKTTYKYLNVVWGNESSAARWQMAMVSDSAPLEEEFKQWVKEVDRSGGRMPSKQDVLEKKQAIQKAITFVYSAATVKQMLQEKKSASTRPLNVAAEKDRLRRELEIAQSKYDEAEVERIKTRLLELEASRQAKQKDAKALKLAEMNRKNRFENFKNASEMKPVNTGLKAGEAGYDPFSRRWTRSRNYYAAKPGEKAAAGNNSVNGNVAGAGSNGTGAPVTAEAGMVATAAALEAAAGAGKLVDTSAPVDQGTESNMLHNFELPISLALLQKFGGAQGAQAGFMARKQKIEATVGFRVSENDGRRHALTLTVSDYKRRRGLL

SEQ ID NO: 209487 - protein, 59 aa, Glycine max
  Coding DNA Sequence Number=SeqID_92709
MVCYKLKFKDIKIAVGINQDCPKEMVKLPQKDHDEKLEDVAWLQAQEELFVVLQYKNST

SEQ ID NO: 209488 - protein, 198 aa, Glycine max
  Coding DNA Sequence Number=SeqID_92710
  Gene Ontology: Mol. function=RNA-directed DNA polymerase activity; Cellular component=nucleus; Biological process=RNA-dependent DNA replication
  Homolog annotation: Hit_ID=Q1SLB1; Match level="QueryCoverage=89%, HitCoverage=34%, E-value=2e-36, Identity=41%"; Hit description=RNA -directed DNA polymerase
SASISVLVNGSLSAEFIPQRGLRQGDPLAPFLYNIVAEGLNGLMRVAIEKNLFRGFQVGVNNVEINILQYADDTIFFGEAIMENVNAIKVILRSFELAAGLKINFAKSCVGAIRMIKPKAVSAVRFYYQQVVPNKVVDKLVRIQRIFLWGGGADQNKIAWIKWETVCLPKEEEGLGIKDIRNFNCVAGQMEIESIPPQ

SEQ ID NO: 209489 - protein, 245 aa, Glycine max
  Coding DNA Sequence Number=SeqID_92711
  Gene Ontology: Mol. function=double-stranded RNA binding; Cellular component=intracellular
  Homolog annotation: Hit_ID=Q5YDB6; Match level="QueryCoverage=85%, HitCoverage=21%, E-value=1e-87, Identity=74%"; Hit description=C -terminal domain phosphatase-like 1
MRMYKSVVYQGEVVVGEVDVYPEENNNYKNFHVKEIRISHFSQPSERCPPLAVLHTVTSCGVCFKMESKTQQQDGLFQLHSLCIRENKTAVMPLGGEEIHLVAMHSRNVDRPCFWGFIVALGLYDSCLVMLNLRCLGIVFDLDETLIVANTMRSFEDRIDALQRKINSEVDPQRISGMQAEVKRYQDDKNILKQYAENDQVVDNGRVIKVQSEIVPALSDSHQPIVRPLIRLQDKNIILTRINPQ

SEQ ID NO: 209490 - protein, 338 aa, Glycine max
  Coding DNA Sequence Number=SeqID_92712
  Gene Ontology: Mol. function=RNA-directed DNA polymerase activity; Cellular component=extracellular region; Biological process=RNA -dependent DNA replication
  Pfam annotation: Domain name=zf-C4_Topoisom; Domain location=66-102; Score=8.3; E_value=0.021; Accession=PF01396.10; Description =Topoisomerase DNA binding C4 zinc finger
MVAGRLAFYPRPLIIRTAWCLEFEAKTVGSIMARLNKVKLLEAMAIFFERSTRSSSDELHATGEVVRRCGLCQESDMLLRKNRDGNFMVGCMGYPQKNLKSRWHSSISLPNCLLSIRDKLEEHFGHTLKKVKKIEVDLNKLEEETTDRQLSPQEVLRRKQFQEALWVAAQSHESILRQKARSRWIKEGDCNSRYFNLLMNANRKHNSLQGIMVDGSWIDESGEVKEVVRQFFMQRFQESDQDRPRLDGIHFQTIGHPQNEMLVGRFQEDEVKQAVWDCGSEKSPGPDGLNFKFIKEFWHLIKPDVLRFLDEFYVNGIFPRGCNASFLALIPKMSDPQF

SEQ ID NO: 209491 - protein, 98 aa, Glycine max
  Coding DNA Sequence Number=SeqID_92713
MANNGYDAYEDEYDGNEDAYESNAGHNDNINYGSIDNANDYEMYLKMKVMIFFGNEDVFEDEGGAKDDILVNVDIGVNADGRESHIQINNVVNILNLD

SEQ ID NO: 209492 - protein, 164 aa, Glycine max
  Coding DNA Sequence Number=SeqID_92714
MDVGFTHALHSYLLGKMKFVFAEDTTSNVFIKQIFIQTQLQDVCWSLNIPQPMYKLHDTKVINRFQYHRYHGYIKVMCTGPLQYACFSKYGKNYYKAMKDVANILLNKLLKAYGKKIRDFNYYNVQNIESQLRMYGDHDGTFKVEMNMLNDEMQSLNSSKGFTQ

SEQ ID NO: 209493 - protein, 115 aa, Glycine max
  Coding DNA Sequence Number=SeqID_92715
  Gene Ontology: Mol. function=DNA topoisomerase type I activity; Cellular component=chromosome; Biological process=DNA unwinding during replication
  Homolog annotation: Hit_ID=Q9LVP1; Match level="QueryCoverage=67%, HitCoverage=8%, E-value=3e-26, Identity=75%"; Hit description=DNA topoisomerase III
  Subcellular localization annotation: CTP_CleavageSite=55; ConfidenceScore=5.15e-01
MPDPADFTLQMPSIGSESVLRCPTFTWNMVQVAFFNPTKLTLESGVTRPPPLLSEADLLSYMDREEAKIGTDATMQDHIKKMLDRSYATKDSSTRFTPTNLGEALVLGYDDIDMT

SEQ ID NO: 209494 - protein, 68 aa, Glycine max
  Coding DNA Sequence Number=SeqID_92716
MALLHSHQGRVFQNRLKWKVGCGDRIKFWEDRWICGEETLAEKYPRLKVGQREQQQEVRRIAMRSYGE

SEQ ID NO: 209495 - protein, 63 aa, Glycine max
  Coding DNA Sequence Number=SeqID_92717
MVTGKVSGKGEKGHWKAEASRRNKCDDHKSPPGIVHHSTLLQGYLGQHGLYEFPSYEYIEHNG

SEQ ID NO: 209496 - protein, 145 aa, Glycine max
  Coding DNA Sequence Number=SeqID_92718
  Gene Ontology: Mol. function=nucleic acid binding; Cellular component= mitochondrion; Biological process=DNA integration
  Homolog annotation: Hit_ID=Q1T4S3; Match level="QueryCoverage=97%, HitCoverage=11%, E-value=3e-33, Identity=46%"; Hit description=Zinc finger, CCHC-type
MASPLETHWAAVKPILRYLKGALHCGLVFIQPLLINLCLFMHSVWCLNPIPWLNIGILLPAAAYILWIQTLLKELSVPHHIPMVLCDSLSAIHLAHNPIPHYRPKHMELDVFFVQEKVIPKQLIVQHIPGQDQWADLLTKPLSPT

SEQ ID NO: 209497 - protein, 514 aa, Glycine max
  Coding DNA Sequence Number=SeqID_92719
  Gene Ontology: Mol. function=RNA-directed DNA polymerase activity; Cellular component=extracellular region; Biological process=RNA -dependent DNA replication
GEGGDIPIFQEQIRFQEVEWVRPKLNGCGSDKTPGPDGLNFIFIKEFWEVIKIDVLRFMDEFYAHESFSKGCNASFITLVPNVKDPQNLHEYRPISLIGCIDKMVAKVLARRLKGVMPLFIDETQSAFIEDYEKAYDSVSWKSLLYMLKRMGFCGKWVSWIEGCLKSASISILVNGSLTSEFIPQRGLRQGGPLAPFLFNIVVEGLNGLVREAMDKNLFQSFSVGRNEVKVSILQYANDTLFLGKASMENVKVINVILRSFELASGLKINFSKSRFGTIGMSKSWKGSELWDPIVNKCERKLAKWKQKLLLLGEGVPKSILDKLVWLQRWFLWGGGGECRGSRVSTWWKDINNITFVGEDGKRLAKGIQWKVGCRSKVKFWENGWKEDGVSLKQKYPTLFSISKQQNQVIQRMGSFLDEGWKWDFKWRRELFDSELDMAEEDASGLYTTKNGYRLLMSDQINENQDGAFTELWKFKQNHAALVGIIIEDKYLSTISREPAYALPPACGWEWKWQ

SEQ ID NO: 209498 - protein, 69 aa, Glycine max
  Coding DNA Sequence Number=SeqID_92720
MGLFVNIFQWGAILYVENVTMHAYCPHEWRDAGGRGLAIPSGYLGGDSLFLLAIWHVYIAIKSGDLTLM

SEQ ID NO: 209499 - protein, 259 aa, Glycine max
  Coding DNA Sequence Number=SeqID_92721
  Gene Ontology: Mol. function=DNA topoisomerase type I activity; Cellular component=chromosome; Biological process=DNA unwinding during replication
  Homolog annotation: Hit_ID=Q9LVP1; Match level="QueryCoverage=99%, HitCoverage=27%, E-value=1e-110, Identity=73%"; Hit description=DNA topoisomerase III
  Pfam annotation: Domain name=Toprim; Domain location=2-147; Score =78.5; E_value=2e-20; Accession=PF01751.12; Description=Toprim domain
MNVLNVAEKPMVARTVATILSRNQNMRMREGRSRYNKIFEFNYTIRGQPCHMIFTSVTGHLMELEFDDRYRKWHSCDPADLFRAPVHKFVPEDKKDIKRTLEEEARRCQWLILWLDCDVEGENIAYEVIDVCTAVNPHLTIKRAWFSTLIDRDIHNAAQNDLRDPDKRVADAVDVRQEIDLRIGASFTRFQTMLMKDAFIIDTATDDRNRVLSYGPCQFPTLGFVVERFWEIQAHEPEEFWSIICSHESKEGTAEFSWM

SEQ ID NO: 209500 - protein, 91 aa, Glycine max
  Coding DNA Sequence Number=SeqID_92722
  Subcellular localization annotation: CTP_CleavageSite=43; ConfidenceScore=5.03e-01
NPRQIPSPFPEKGYRSPATRPPSWRGGPRAPISRLLGGKANPNAASKDLESGGLPEGAEHLQRRARDDVPLEGVEDNAEGKNGHGNGSFVS

SEQ ID NO: 209501 - protein, 135 aa, Glycine max
  Coding DNA Sequence Number=SeqID_92723
  Subcellular localization annotation: CTP_CleavageSite=37; ConfidenceScore=5.09e-01
MRPSSPPLCRSVGVNPGDGVTGNTCESTPDVRGTPSTASGRSAAGALDGGFVGQKVGQRDGSHQNNGVSGKVVEKGEKGCRKMGDEQQGPSRFGEKGDNKRGPPECRKKWKNRRKRCGEYKGQSEIGKRMIEERQ

SEQ ID NO: 209502 - protein, 98 aa, Glycine max
  Coding DNA Sequence Number=SeqID_92724
  Gene Ontology: Mol. function=prenylcysteine oxidase activity; Cellular component=lysosome
  Homolog annotation: Hit_ID=P57681; Match level="QueryCoverage=57%, HitCoverage=11%, E-value=2e-12, Identity=61%"; Hit description =Probable prenylcysteine oxidase precursor
MAIAVDKFVKYYEDPGSRPIFETVDEMLQWAGLYNLTTRTLRDELVDAGLSTSLINELVTVRILSTLSNVDHKFTINVLAILLSALMAIFCLSLLPAM

SEQ ID NO: 209503 - protein, 638 aa, Glycine max
  Coding DNA Sequence Number=SeqID_92725
  Homolog annotation: Hit_ID=Q9FLZ1; Match level="QueryCoverage=88%, HitCoverage=89%, E-value=1e-126, Identity=45%"; Hit description =Arabidopsis thaliana genomic DNA, chromosome 5, P1 clone:MUL8
  Pfam annotation: Domain name=F-box; Domain location=10-57; Score =35.9; E_value=1.4e-07; Accession=PF00646.23; Description=F-box domain
MEPEHHDSSNMLLFLPDDVFAIVSRFMSPRDVCNLCLCCKSLNALVASEKLWLTQCDLLSTVPHKDLVEWRKGVASYKALCRFLMSVKPLIGIWVHQNPELGNVVYVMPGFVSVVGCRIIPQELGPLGIEEGPILWASVFEVVSDLDGSMMFFLHGREKGVNYVYPGSVKVADRSCNVLLLEVEPGGCRNVSALLQSKSFVHHSGVEESSSSRKVCRSNSDVSSSQRVVGNGEGMVSFGKLAFSDRRKLLEVTTSQVRQKVPDKMIGPLFPGLRDDEENFQKDLVLLWKRRSLLSQMYKVGSGQNDEYKTSSQEAVDPTQLELDDVRASFDRSRSISHPLPEEDGHTQCIKRKGFRGYVWNGIKQILGRSNTMNASPLVAKKHTSNGEIRQARLQEFLRSSDTVRLMLKASTVKLSSYRAWPNMHDSRFALYKLPLRVPKDDQEYAGLWGGTFGWPPGKPSEDKPGKALFFLLLSYEEFQGQQLLIATKILEGTHYVLHPNGSAMFTANINDPSSEPFPWDTDADSVPVNIKQAFVGEGIASGYGFRYPGSKPGSLFVLENGILAFIWKESRAVLNLQRLNLQELLKKGERVDYDEGEGQTRDTEGKEASMVFSVTAQQGREGCVNGVGDWCGERWCI

SEQ ID NO: 209504 - protein, 114 aa, Glycine max
  Coding DNA Sequence Number=SeqID_92726
  Homolog annotation: Hit_ID=O65154; Match level="QueryCoverage=34%, HitCoverage=37%, E-value=1e-11, Identity=77%"; Hit description=RNA polymerase II transcriptional coactivator KIWI
  Pfam annotation: Domain name=PC4; Domain location=12-91; Score=53.9; E_value=5.4e-13; Accession=PF02229.6; Description=Transcriptional Coactivator p15 (PC4)
MSGKAKRRDDDGASDADSEGHAPPKKSLKKDSDDDPDSITVCEISKNRRVAVRNWKGSIMVDIREFYVKDGKQLPGRKVFLVRCFRNSKGFSFYSLVARLVIIDNVVTSLKVEG

SEQ ID NO: 209505 - protein, 702 aa, Glycine max
  Coding DNA Sequence Number=SeqID_92727
  Gene Ontology: Mol. function=amino acid-polyamine transporter activity; Cellular component=integral to membrane; Biological process=amino acid transport
  Homolog annotation: Hit_ID=Q1SJF1; Match level="QueryCoverage=74%, HitCoverage=100%, E-value=0.0, Identity=89%"; Hit description=Amino acid/polyamine transporter I
  Pfam annotation: Domain name=AA_permease; Domain location=210-694; Score=-40.2; E_value=0.00012; Accession=PF00324.11; Description =Amino acid permease
  Pfam annotation: Domain name=PsbP; Domain location=3-162; Score= -23.7; E_value=0.00061; Accession=PF01789.7; Description=PsbP
  Pfam module annotation: Pfam domain module=AA_permease::PsbP; Domain location=210-694::3-162
GVLMPNARDALLLAQELELQRYTDSEEGFTLLTPSSWTKVDKAGATVLFQEADMGSNNIGVVVNPVRLKTLEEFGTPQFVADKLLQAERRKESTKEAELITVAERSGEGGLQIYEFEYKVDSTRGGMKRIFSAAFVASKKLYLLNIVHSDKPESPLDPHKRMILEQGTPQLKPGSMGSENSFAEVTGNTTMDSAEKRLNELGYKQELRREMTMFKTLAISFSTMTLFTGITPLYGSSLQYAGPATLVWGWIVVSFFTWFVGIAMAEICSSFPTTGSLYFWAAHLAGPKWGPFSSWCCAWLETIGLIAGIGTQAYAGSQTLQSIILLSTGTNKGGGYFTPKWLFLCMYIGLTVIWAALNTFALEVIALIDIVSIWWQLIGGLVIVIMLPLVALTTKSASFVFTHLELAPESTGVSSKPYAVILSFLVSQYSLYGYDAAAHLTEETKGADKNGPIAILGSIGIITVFGWAYILALTFSIQDFGYLYDPNNETAGAFVPAQILYDAFHGRYHNSAGAIILLFVIWGSFFFGGLSITTSAARVVYALSRDKGVPFSHLWRQLHPKYKIPSNAVWLCAAICILLGLPILKVNVVFTAITSICTIGWVGGYAVPIFARLVMSEKNFKPGPFYLGKARRPVCLVAFLWICYTCSVFLLPTLYPITWDTFNYAPVALGVGLGIIMLWWLLDARKWFTGPVRNIDIQNGMV

SEQ ID NO: 209506 - protein, 141 aa, Glycine max
  Coding DNA Sequence Number=SeqID_92728
  Gene Ontology: Mol. function=triacylglycerol lipase activity; Biological process=lipid metabolic process
  Homolog annotation: Hit_ID=Q2TNK2; Match level="QueryCoverage=73%, HitCoverage=16%, E-value=2e-13, Identity=46%"; Hit description =Phytoalexin-deficient 4-2 protein
MVADEASPFETSEMLATFLTSTPLLSESWQLCTTAAAAAPRSFVTEQRGGGVVYVAFPGVEMVAASTDSSWRNFVALDSIGDMPLFSARRLNKEGDEPVMVHAGMLNLFSIFFEPFQKQSYLRGTHVNYESPCIRKFDTTL

SEQ ID NO: 209507 - protein, 181 aa, Glycine max
  Coding DNA Sequence Number=SeqID_92729
  Gene Ontology: Mol. function=ubiquitin-protein ligase activity; Cellular component=intracellular; Biological process=protein modification process
  Homolog annotation: Hit_ID=Q1SJF0; Match level="QueryCoverage=92%, HitCoverage=85%, E-value=2e-82, Identity=54%"; Hit description =Regulator of chromosome condensation/beta-lactamase-inhibitor protein II
  Pfam annotation: Domain name=RCC1; Domain location=136-180; Score =13.3; E_value=0.026; Accession=PF00415.9; Description=Regulator of chromosome condensation (RCC1)
  Pfam annotation: Domain name=RCC1; Domain location=30-80; Score=14.9; E_value=0.017; Accession=PF00415.9; Description=Regulator of chromosome condensation (RCC1)
  Pfam annotation: Domain name=RCC1; Domain location=86-133; Score =13.2; E_value=0.026; Accession=PF00415.9; Description=Regulator of chromosome condensation (RCC1)
  Pfam module annotation: Pfam domain module=RCC1::RCC1::RCC1; Domain location=136-180::30-80::86-133
MELEVTAATSPPSRVLLISAGASHTVALLSGNVVCSWGRGEDGQLGHGDTDDRLLPTHLSALDAQQIDSIACGADHTLAYSESRNELYSWGWGDFGRLGHGNSSDLLIPQPIIALQGLRIKQIACGDSHCLAVTMEGEVQSWGRNQNGQLGLGTSEDSLVPQKIQTFQAIASCIFRLASCT

SEQ ID NO: 209508 - protein, 309 aa, Glycine max
  Coding DNA Sequence Number=SeqID_92730
  Gene Ontology: Mol. function=RNA-directed DNA polymerase activity; Cellular component=membrane; Biological process=RNA-dependent DNA replication
LPKLQIVVTTLFVLGYTHWGKPKGPKESGGQDGEAAEETVCLPKERGGMGVRDLLKFNYALLGKWWWNLFHHREALGAQEGSWFKNQVSWKNGSGSRVKFWKEGWKEDGVPLLEKYPRLSCISKQQQHYIQQMSSASSGVWEWQLEWRRMLMEGEMNGAAHFLEDIDGMAVQVHHQYSWSWEGDPGGEYSVGSAYRALNQYAVEEEDERALSILWKLKIPSKVSLFDRRLIRDRLPTTKNLRNQNVVLDEVCSPFCLNHDEDAGHLFFGCTKIMPLWWETLFGGSLWFGALGIIGIGLFSQVTALMVKN

SEQ ID NO: 209509 - protein, 556 aa, Glycine max
  Coding DNA Sequence Number=SeqID_92731
  Homolog annotation: Hit_ID=Q56W45; Match level="QueryCoverage=62%, HitCoverage=60%, E-value=1e-16, Identity=28%"; Hit description=BZIP -like protein
  Pfam annotation: Domain name=DUF630; Domain location=1-60; Score =75.6; E_value=1.6e-19; Accession=PF04783.3; Description=Protein of unknown function (DUF630)
  Pfam annotation: Domain name=DUF632; Domain location=182-478; Score =44.9; E_value=1.2e-12; Accession=PF04782.3; Description=Protein of unknown function (DUF632)
  Pfam module annotation: Pfam domain module=DUF630::DUF632; Domain location=1-60::182-478
MGCVLSSIDEDENVRKCKERKRAIKQLVKIRGDFSDSLLAYLKALRNTGATLRQITESDMIEFETASNAASPSHHLPASPLRPPPRPPFLADKAMVHEDEMLENGDSNVPLLQIDSSLSSLRLFQSTDRREIVESVEEDNWEEMKTEFEDEEAEAEAAAIAERLRRGKQKLIEPVDENSSAMSLYRRDTTAMPVAVGRSGKTLEGIGKELDDHFLKASGCIKEIAVLIDINGGDTLLRQNSGHLDRKRGNSAKVFSVLSWSRYSKSPPSTKDGAEFSGHSEPCKPGAHCATVKKLYVAEKKLFKALKEEGIVALEFDRKSTLLCKQEDENLDIVKIDKTRSSVEKLESDLISLRQCISETTSSILEMIDEELLPQLVALTAGTLYEWIKLAESLKDGNECSNHSSILAICDQWERGLNKLPDKETSEAIKSLMSCLRFITGQQIEEDNILERLQKLERKFQKCLNSMAEMQQRIDGGMADTSPKHPIHLKKTETEALKKQVESAKANYLDSVQYSRAMTLDHLQKTLPPLFQSLMEFSSESAQAIEAINAPGKPVE

SEQ ID NO: 209510 - protein, 315 aa, Glycine max
  Coding DNA Sequence Number=SeqID_92732
  Gene Ontology: Mol. function=DNA binding
  Homolog annotation: Hit_ID=Q1RTB4; Match level="QueryCoverage=77%, HitCoverage=59%, E-value=2e-17, Identity=27%"; Hit description=IMP dehydrogenase/GMP reductase
MGSSQMPSLKRRFYQVKVKSLGTTSLKELGQLMGQLQRQAFRKAYGKIWNLAMVEVSTEAIASLALYYDRPMRFYPSLARISKIVQISAQELDHRKQVENRVVGIPRKYLEAKARILAGKGEWAPFIDILALLIFEGVLFPNVDGLVDLAVIDAFLAYHNHMESPVVTMLADLYDTFDRRCEKSNTKDCLLYSSSLCMVSFAPFSPRGRTGVLISCGGFSNVPLMGTRGCNSYNPVIAIRQLGYPMRGAPLEEEIAPFISRGFDKTNVETLQKWLKAHVQGLDWLPSLRIAKREEVEAPEEETEVQDLRAELEQA

SEQ ID NO: 209511 - protein, 934 aa, Glycine max
  Coding DNA Sequence Number=SeqID_92733
  Gene Ontology: Mol. function=heat shock protein binding; Cellular component=integral to membrane; Biological process=protein folding
  Homolog annotation: Hit_ID=Q1SJE9; Match level="QueryCoverage=91%, HitCoverage=84%, E-value=1e-65, Identity=42%"; Hit description=Heat shock protein DnaJ, N-terminal
  Pfam annotation: Domain name=TolA; Domain location=569-896; Score= -99.2; E_value=0.00038; Accession=PF06519.2; Description=TolA protein
MAGTLCDIVDNFKDSKVDDEDSDDDKAIVRGVVEEPANVDGESNDEDNKDDGDNTNEDEGSARAEAAGYHRTPDPFLSLSLTMNDFDGLLTTDFGFKPQGKSAPMAASKSSSSSNNNKTSSLNFDLGSRSARGASNSSVNAAATSLDDLFGDSSSVFRASADFRSKPVNDGPVFDKPVYDEDIFDGVPGLKSSSKVFYDDVFASGGSAAAAFDDLLVGLGKSEKSEKVEKGARDFDDLISGFGSSKAKASTDSKFGMPGIEFPLPCIFILEVYLSFYLVDDGTRTVPDINLSREPTINASKTASSAANDPFKVFESTSAPIDSSSDYFTDPLEEISKFTSSRSTKNDSSSNSNEVYNDIDPFGGLGNSVPAFSAERNSMKGSNSPTPRSNTSSSWTGDKESNDKSSVRSPERQKQNKIPVDHDQEFLQAAFDMPIYSSDSYKPVDQRSTSPSYDNNGFRQASIQEDMSPKYEEKLESNDDIWLMVSEIPLFTQPTAAPPPSRPPPPRPVHIPKSGAGSSASANVRKKDNEFSYFPSSSQFSQGSESAPAAAKLSSASQFDELEDFAMGKSHDNDDERINGLADEELEMNSAAAAMKEAMDRAEAKFRHAKGVRERENTKASKSKEPVQLEKDGRAVSEDRGKQERLDHERQQKEREEKEQRRREKEREEKEREQQRLEREREKARQAVERATREARERAAVEARRRAERAAVEKANTEARKRAERAAVQRAQAEARERAATEAKERAEKASAEAKEREVRERAAAARAEPEARVKAERAAVERAAAEARERAAAQARERAAAAARMSQQQNDNDLESFFSTGARANSAPRPPRSSSSDSVFDAQFQSDLTRKSTGVSSSMKKASSSTNIVDDLSSIFGAAPSSSGEFQEIEGETEERRRARLERHQRTQERAAKALAEKNQRDLQTQRDQAERH

SEQ ID NO: 209512 - protein, 248 aa, Glycine max
  Coding DNA Sequence Number=SeqID_92734
MNVVESTSRSATNPNGCKASQEAANNWDLAKKMGVSFCNQEDIMISKLASLDERDKGEAQKMGRSAETKKEAIDKALCQALWGYSEVKWELNPTINSPGGMLCLWSEATFKMENKITGSGFIFLQGIWHGYGERVVILNIYSPCDVNMKRILWDQIKQLRRASNVGHWVEEPTKVKEEVKQFFVRRFKEVGEERPRLDGVELNTLINRTMMLLWPDLKKEEVRAAVWDCGSTKSPGPDGLNFKFIKEL

SEQ ID NO: 209513 - protein, 80 aa, Glycine max
  Coding DNA Sequence Number=SeqID_92735
MGFYDKWVKWIDGCLKSSSILVLGLMREAQKKNLFEGNLVGRNNVDISILQYANDTVFRESNNVQHEGHQGYAEEFRIGF

SEQ ID NO: 209514 - protein, 326 aa, Glycine max
  Coding DNA Sequence Number=SeqID_92736
  Gene Ontology: Cellular component=integral to membrane; Biological process=peroxisome organization and biogenesis
  Homolog annotation: Hit_ID=Q56H85; Match level="QueryCoverage=95%, HitCoverage=71%, E-value=1e-130, Identity=73%"; Hit description =Amino acid transporter
  Pfam annotation: Domain name=Aa_trans; Domain location=1-314; Score =147.2; E_value=4.5e-41; Accession=PF01490.8; Description =Transmembrane amino acid transporter protein
MLFLILAHTHLLLFKGNKKVQLFPFFRRKKSMSDFHETWWLSIVAAIMSFVYSTIGLALGIAKVAEMGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAQPLFAFVEKWASKRWPEVETEYKIPIPGFSPYNLSPFRLVWRTVFVIITTFVAMLIPFFNDVLGLLGALGFWPLSVFLPVQMSIKQKRTPRWSGRWIGMQILSVVCFIVSVAAAVGSVASIVLDLQKYKPFHVDY

SEQ ID NO: 209515 - protein, 130 aa, Glycine max
  Coding DNA Sequence Number=SeqID_92737
MMEAMMSMKKIMEVNAATVATVSAVFGVDLTPPSGLNLINHPTANTGDPHFVHVQNNQQPQSDHAHVSRPMGETHEMPHHNLADFEPCLGYATKGQAVGELCLVPYVIIPPKFKVSEFDKYKELLAPRTI

SEQ ID NO: 209516 - protein, 96 aa, Glycine max
  Coding DNA Sequence Number=SeqID_92738
  Gene Ontology: Mol. function=nucleic acid binding; Biological process= DNA integration
  Homolog annotation: Hit_ID=Q1S0G2; Match level="QueryCoverage=84%, HitCoverage=9%, E-value=9e-20, Identity=57%"; Hit description =Peptidase S8 and S53, subtilisin, kexin, sedolisin; Polynucleotidyl transferase, Ribonuclease H fold
MKRLCESWIARNASKDIKPIGCKWVYKKKIGADWKVETYKAFIIAKGYHSKEDIDNDRKKSHVVMLKSIRILLAITTYYDHEIWQMDGKWISLMMS

SEQ ID NO: 209517 - protein, 261 aa, Glycine max
  Coding DNA Sequence Number=SeqID_92739
  Gene Ontology: Mol. function=transferase activity; Cellular component= 1-2nm peptidoglycan-based cell wall; Biological process=transport
  Homolog annotation: Hit_ID=Q5PN41; Match level="QueryCoverage=99%, HitCoverage=56%, E-value=5e-98, Identity=78%"; Hit description =Putative membrane protein
MPIAPKSASEKVVFGKAQRPQHRQQQYRQEGDQQPVGEGAQHRAAPPAGGVAEHPGGSAGEEVRHHAGQDQHHLQLPQQEQPGQSAKEAEQEADQHRVGGIGINHRAIQRRPRIRHQLFREAGERRHDFRQNQAHALQNDEHPGGEGDGLNDRIHQVVLAAAELAFHIGPPGGDRQDQVDDDHGHRDRNGAVAQEAEVFRQVHLFGRARVFTHLRADPAGQHVAQGAEVAEGDIVVAGDAAHIALGDRREERHHQPQGQRA

SEQ ID NO: 209518 - protein, 64 aa, Glycine max
  Coding DNA Sequence Number=SeqID_92740
MKRRADDFIGNRDAPGAPPLVEVPARLPLVVAPGPHHYWQARSPLSHRPVQSRHVSRSGGTLSS

SEQ ID NO: 209519 - protein, 307 aa, Glycine max
  Coding DNA Sequence Number=SeqID_92741
MPPKQVRVKGHLIKFDADSLNTFLETLVVLESGETLPAYSRFCRLRPNPQELAARLCIPGRGFVLNAKGLPWKLLRKDLTTLAQTWSILSYFNLAPTSHTSDLNLGRARFVYGLVMKMDMNVGALISGHTSDFQPSSLPYAWPEDPAINLSYIKKNCWNLDDPTVSFLGTRKTRARGSEGLSSATPQTSTAPALIPSEPVPATSNPSAQSTDLMMAMFEASSAQEPQLDLETTPAAQEDDSEVTPPESFVLETDPEADLVIAEASPQVSLISTPVLELSTSQGSPACMPVLHLTDDEAMDQDPPQDQ

SEQ ID NO: 209520 - protein, 124 aa, Glycine max
  Coding DNA Sequence Number=SeqID_92742
  Gene Ontology: Mol. function=transferase activity
  Homolog annotation: Hit_ID=Q3ZPN4; Match level="QueryCoverage=87%, HitCoverage=28%, E-value=2e-10, Identity=34%"; Hit description =Anthraniloyal-CoA: methanol anthraniloyal transferase
MELPDCVYPRPPFTIIPPCAPTPKHSLYLSNLDDQKFLRFSIKVLVDYYPLAGRLIRSSICDCEDDHKLEVDCKGEGAVFAEAFMDATAEELLESCKVPNDSWRKLLYKVEAQSFLDVPPLVIQ

SEQ ID NO: 209521 - protein, 246 aa, Glycine max
  Coding DNA Sequence Number=SeqID_92743
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-31, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
AIRVLHALAFRGLHGLVFRGLHVLVFRGLHALTFRGLHVLIIRGWHALTFRGLHVLAIRGLHALSFRRLHVLTIKGLHTLTFRGLHILTFKGLHALTFKGLHALTFRGLHVLILRGLHTLAFRGLLALAFRGLHVISFKVLDVLAFRGLDILTFRGLEILAIRGLHTLTFRGLHVLTIRRPHALFFRGLHVLHFRGLHALSFRGLHAHTFRGLHALAFRGLHLLAFRGLHVLILKRLHALTFRGLY

SEQ ID NO: 209522 - protein, 71 aa, Glycine max
  Coding DNA Sequence Number=SeqID_92744
MNWVITVLYLNERVYEDNDGVIFEGSKKVIQIKHGISFNALKKKIEDKENILPCKFVMTKTLKRCWKVLNN

SEQ ID NO: 209523 - protein, 78 aa, Glycine max
  Coding DNA Sequence Number=SeqID_92745
  Subcellular localization annotation: CTP_CleavageSite=66; ConfidenceScore=5.61e-01
MTIILCVKTPPVSPRATSILLPRSPNALRSRSGTPLSGPCTNILGPKAQGCYLIRVVLLRTQSHAREMNRSTNPSGWR

SEQ ID NO: 209524 - protein, 63 aa, Glycine max
  Coding DNA Sequence Number=SeqID_92746
MGPIYLVGISKIKVRVVEEATTICREIEEIVQNILKILGPKFSSLPNDHLVGMESRVEDLVKL

SEQ ID NO: 209525 - protein, 45 aa, Glycine max
  Coding DNA Sequence Number=SeqID_92747
MYAKRVCDPGLVVCRQCPKRALVVLVRGHYNTVKSCFGARIMLLF

SEQ ID NO: 209526 - protein, 110 aa, Glycine max
  Coding DNA Sequence Number=SeqID_92748
MPPTVPVNHYSDPEGQHNRIRILWCYPMLINSTGGTTRPVKDRSASPAEGTSRPVHTGGGPIDPTQGLGNLRAAAFLDVVAVSQAPSPESNPNSPSPVTTMVGHYPTIES

SEQ ID NO: 209527 - protein, 312 aa, Glycine max
  Coding DNA Sequence Number=SeqID_92749
PKFMDMEFFSDEMFECVQAFQNSGLILFVSLKIPVYPELVKVCYSNLGIQEGSLISEVYGIKMVIDQSLFFELTQLSSDGVPFEGTLDDDWKFDFSVFDARRLVCINQADMTRRLLAGSLTFDYRILHYLIVRILLPRSSKFAQFFEEDLIIMWAFLTVCQIDWAHLVRYCMNKALRSNTPLPNPHLISLFLHHFEVPLDSKPSIQIKNSFSIGAAVVASFGYRKERDGSWIKKDAQPHDVEGCSPTREDSSLLQSVMDRFDSLQTYVGERFDSLESQVDIRFREMDSRITKIEGNITFIRDCFELPPPPST

SEQ ID NO: 209528 - protein, 169 aa, Glycine max
  Coding DNA Sequence Number=SeqID_92750
MDAQKTIGVTPKVPTEGKLIDNNNAQGHNFKHKIGEGAKSEARTASMKGGNEDAEKIGEGAKKARTAAMKECMQNWNFYRCKTWTEAKFSRKFREVQPKTVLKFGKNGCPKNNVSSETTVAKHRSYLQKGRGVTPKVPTEGKLIDNNNAQGHNFKHKIGEGAKSEARTA

SEQ ID NO: 209529 - protein, 46 aa, Glycine max
  Coding DNA Sequence Number=SeqID_92751
MDGKPKPRRLYIMMDCPRCEDGGRVEEEDDALDPLPLALRVLGKVT

SEQ ID NO: 209530 - protein, 60 aa, Glycine max
  Coding DNA Sequence Number=SeqID_92752
MDDALSVTSSLEKYIVAALSAPSSAKPQILSAKCILQDQSELLSALSTCLRAKPGYASGT

SEQ ID NO: 209531 - protein, 141 aa, Glycine max
  Coding DNA Sequence Number=SeqID_92753
MAMRIISKIGITYNTMKKLVVQRRVEGAAIGDLYELHERVQHKFLERLISLRQSEDVEEGLEELVELGTEPREVAELGLVADDGGSGEGGVGRELGEEREEEGVEREEGFEDVKVWRGGFGGEEWGVTKLELSGVRHNANA

SEQ ID NO: 209532 - protein, 232 aa, Glycine max
  Coding DNA Sequence Number=SeqID_92754
MELPDKVYAKLLLKYPWLLSTSIQENYTKLLAFHILSSFFMKSYSIVEIEQTGLYLEIERTKLKSMVDQFAELGVRNKKLNQYITKSPQLLLRKPKDFLQVTQDGKYCLVLVFGAKDLQLSDFEQRQTWTEAKFSRKFREVQPKTVLKFGKNGCPKNNVSSETTVAKQRSYLQKGRGVTPKVPTEGKLIDNNNAQGHNFKHKIGEGAKSEARTASMKGGVREKRERKLTTLN

SEQ ID NO: 209533 - protein, 283 aa, Glycine max
  Coding DNA Sequence Number=SeqID_92755
MAGDSEKTRKTAAHSEPHRIEGKQQNGTWHGEHYQPAKGSTSYAEVVARDRNNAGQMKIVPKLDQKWAESRSTILLDIHSNDNQWLSNAWVGRLKNLRWFDRLEEDPTWDFGAEITLKYMGDDMVLLIGLTDTTAKRMKKETTEEEVMFYSLEKWQPSLRATHRLTWVQCWGIPLVVWDKKYFRQIVAAIGDMIDVDDDTEESRRLDRVRILICTPRCPAIHHTVCINVGGDTYNVSIVEEVSRGREMCDCRRRRISWSSEEIDYLVKANSSLTTWLKHTHQE

SEQ ID NO: 209534 - protein, 73 aa, Glycine max
  Coding DNA Sequence Number=SeqID_92756
MAMRIISKIGITYNTMKKLAVQRRVEGAAIGDLYELHERVQHKFLERLISLRRSEDVEERLEELVELGTEPRE

SEQ ID NO: 209535 - protein, 149 aa, Glycine max
  Coding DNA Sequence Number=SeqID_92757
  Gene Ontology: Mol. function=RNA-directed DNA polymerase activity; Biological process=RNA-dependent DNA replication
MAKNGKLDRIEERLRVVEGSGDYAFADMVELCLVPDVITPPKFKVPEFNKYKGTTCPKNHLKLYCQKMGAYAKDEKLLMHFFQKSLTGAVVTWYTNLEPSQIHSWKDLMIAFIRQYQYNSDMAPDRMQRQSMCKNLSRNIDASLFSPIS

SEQ ID NO: 209536 - protein, 143 aa, Glycine max
  Coding DNA Sequence Number=SeqID_92758
  Homolog annotation: Hit_ID=Q9AVH2; Match level="QueryCoverage=59%, HitCoverage=39%, E-value=6e-27, Identity=61%"; Hit description =Putative senescence-associated protein
ILPVARWELRFKASRRTNLPNDGHQRHVPLGGRGPLLLVGKRTTGARVASCPDSDLKAMIGRADIEGSKSNVAMNAWLAQASYPCGNFSDTSSFKFRRTKGSIGQAFMLILGHQHYLLTDVPPQPNSPLDNVFCPDRPAESDL

SEQ ID NO: 209537 - protein, 74 aa, Glycine max
  Coding DNA Sequence Number=SeqID_92759
MRRQNLVIPYPFAIQTQSCPMAHRDKIWSFYTLCHPEAAGPMTCGDKLWSSACFAICSAGGEIHWPNGVSLERN

SEQ ID NO: 209538 - protein, 48 aa, Glycine max
  Coding DNA Sequence Number=SeqID_92760
MVKYRAKSKTEMNRGTWGRVRMDARPMINRSLSRVQLRTIQKRYWEAA

SEQ ID NO: 209539 - protein, 444 aa, Glycine max
  Coding DNA Sequence Number=SeqID_92761
  Gene Ontology: Mol. function=transcriptional repressor activity; Biological process=regulation of nitrogen utilization
  Homolog annotation: Hit_ID=Q13L86; Match level="QueryCoverage=64%, HitCoverage=91%, E-value=6e-72, Identity=47%"; Hit description =Putative isoflavone oxidoreductase
  Pfam annotation: Domain name=NmrA; Domain location=27-264; Score= -26.2; E_value=1.3e-06; Accession=PF05368.3; Description=NmrA-like family
MGDQNMQYTQRPAIAGGFAIGFHLSSGITGELGMAVLNAMAKKVQQHPLIKISVLLRSEAAHATSGPLKTRLDALQKLNITVVEGDLQKNSLSELSALFRSYDVIINCSGFVGGPGTQLRITQAVLKAGVARYFPWQFGVDYDVIGKESGQPVWDEQLEVRHLLRAQSNTDWVIVSTGIFTSYLFEPDFGVIDAGNKTVYALGDWNYALTLTTPDDIGQLTADIFFHQPAFQNDIVYIAGDTLTYAELADLMQSHWKSAVRRVLLSRERLREDAERHPRDTGAAYRLAFARPDGVAWPKQETFNYREHIATTSAAQWLTNQPAEVSRKLMLGFGVLLILSIAVASCGIKNLHDIAERAEKLSQLKGINDQFAQAKDARLQYTALIASLPAAMNLYRQHRAETVNEVHKRQSILQALRFSDETTGGCRAGQKLRQHTAGYGNRAQ

SEQ ID NO: 209540 - protein, 221 aa, Glycine max
  Coding DNA Sequence Number=SeqID_92762
  Gene Ontology: Mol. function=catalytic activity; Cellular component =peroxisome; Biological process=metabolic process
  Homolog annotation: Hit_ID=Q87BY6; Match level="QueryCoverage=87%, HitCoverage=91%, E-value=7e-82, Identity=71%"; Hit description =Pyrazinamidase/nicotinamidase
MPGGRPSGDRDSRLAQRLAHHRVIGFGHRPGQLPQELHPEAGLHCVLRAPQHAVIAGQAAHVHFADAALVQPAGQAGSWALAIGAMVLAEGAVRIHLLARALAQDQVGHGPVHARVQGGTGAALHAVVRPQGLRLRVQQDGLEGALAGVLAGERGMVDRVPVLCRHHGAVAALRQQTGNRYHQRIALVAGQRTAGHEVWLQVDHQQGDIGGQGSHGRSTTT

SEQ ID NO: 209541 - protein, 192 aa, Glycine max
  Coding DNA Sequence Number=SeqID_92763
  Homolog annotation: Hit_ID=Q5QV94; Match level="QueryCoverage=94%, HitCoverage=83%, E-value=9e-79, Identity=73%"; Hit description =Uncharacterized conserved protein
  Pfam annotation: Domain name=DUF208; Domain location=1-182; Score =366.1; E_value=5.6e-107; Accession=PF02677.5; Description =Uncharacterized BCR, COG1636
MEAITASGIDYAIFFYNPNIHPVKEYELRKQENIRFAEQHGIPFIDCDYDTDNWFSRARGMENEPERGIRCTMCFDMRFERTALYAHEHGYDTISSSLGISRWKNMAQINDCGIRAASRYEGLQYWDYNWRKGGGASRMIEISKREQFYQQEYCGCVYSLRDANRHRRENGRERIKIGLLYYGQDAGTPQGD

SEQ ID NO: 209542 - protein, 335 aa, Glycine max
  Coding DNA Sequence Number=SeqID_92764
  Gene Ontology: Mol. function=transcription factor activity; Biological process=regulation of transcription, DNA-dependent
  Homolog annotation: Hit_ID=Q4US73; Match level="QueryCoverage=67%, HitCoverage=67%, E-value=2e-69, Identity=59%"; Hit description =Transcriptional regulator
  Pfam annotation: Domain name=ACT; Domain location=278-335; Score =21.2; E_value=0.0037; Accession=PF01842.15; Description=ACT domain
TGRGKRCQCIDVIADHAWWQRGVHALAILQQAPAQRPAIGGEAVQQPAMTAQVGGLLRGAVRFQIGRRGTEHERDACQLPRDHAIFQLCTDADAGIHRFRPMLHGAVGQAQLQLQLRVALLQRRQQGGKHMAAERAAAGDAQRPGRFDVTGGDHRLRARQVGFDVAHLRQVQRAGLAEGQLARTSVQQPYPQMRLQPVDVLADCGGADAKDAGRGSNAAGLCGAGEAADQLQQVHDRPACHGEFQVSLGTEPSRSVASVIIRPLGRALPYTVAMRPDSILTLSCPDRTGIVYRVSGLLFDHGCNILDAQQFGDEESGRFFLRVHFDRDASLPLET

SEQ ID NO: 209543 - protein, 58 aa, Glycine max
  Coding DNA Sequence Number=SeqID_92765
RAFAKHNTPGLSTRKTLEEDELYRFTKHTASAHPLSEKGALSQKSLMYAKRSIHALSG

SEQ ID NO: 209544 - protein, 84 aa, Glycine max
  Coding DNA Sequence Number=SeqID_92766
MSRHSAMALGKNSVMQVGCEVIQGEALGFLHALFGALQLGLPSVIFELDCKLVVDWVLTGIDDVSKVGSNFGRVLVYSPFLMQL

SEQ ID NO: 209545 - protein, 481 aa, Glycine max
  Coding DNA Sequence Number=SeqID_92767
  Gene Ontology: Mol. function=DNA binding; Cellular component=beta -galactosidase complex; Biological process=DNA integration
  Homolog annotation: Hit_ID=Q1SDN3; Match level="QueryCoverage=98%, HitCoverage=37%, E-value=1e-153, Identity=55%"; Hit description =Polynucleotidyl transferase, Ribonuclease H fold
MEFMMSYSEASRDPDWIEAMNVEIKALELNNAWVLTDLPKHKSAIGYRWVYKVKHRSDSSIERYKAKLVAKGYTQVKGHDYLDTFSPVAKLTTVRLLLALAAINQWYLKHLDVSNAFLHVHLHGEVYMDIPQGMKVARPEQVCKLQRSLYGLKQASRQWYARLSSFLVSHGYKQCASDHSLFIRHGSHRIDVLLVYVDGIVLSGNNLSEIQRVTHLLDDTFRIKDLGDLRYFPSFEVARSSNGINLCQRKYALDILNDSSMLGSKPMSTPDYISKLHQHSGLLLSTEEAYSYRRLIGRLIYLTNARPDIPYAVQHLCQFVTNPTSNHKQAAFQILKYLKGTPGAGIFMSAASDSDWVGCIDTIRSITGYAFYIGDSLISWKSKKQATISRSSSKTEYQALASATYELQWLTYLLKEFKIKFHNPVVLYCDNKYALHIAANLVFRERTKHIEIDCHIVHEKVLNGLVKLLPISSANQLANIL

SEQ ID NO: 209546 - protein, 459 aa, Glycine max
  Coding DNA Sequence Number=SeqID_92768
  Gene Ontology: Mol. function=helicase activity; Biological process =viral genome replication
  Homolog annotation: Hit_ID=Q9FHV5; Match level="QueryCoverage=94%, HitCoverage=34%, E-value=1e-79, Identity=34%"; Hit description =Helicase
  Pfam annotation: Domain name=DUF889; Domain location=242-457; Score =164.8; E_value=2.1e-46; Accession=PF05970.5; Description=Eukaryotic protein of unknown function (DUF889)
MRMMLSSAKGSQSFKDIITVDNVVYHTFREACFAKGFLGSDQEFLGALREANTWGTPHFLRKLFVNLLFMNTMERPEYVWQQTWRWMTDDVVFNHKSQGYAANPHQNKLIYNEMAYDKEVLATEFNRCYHSMTDKQASIFDNIMCVVASQLGGVYFLYGYGGTGKTFMWKTLSSAVRSNGGIVLTVASSGIASLLLPGGRTTHSKFAIPVLATQNSTCNIHQESDLAELLQRTKLIIWDEAPMCHKFSFEALDKSLKDIMYNDRPFGGKFSDWLLDIGDGKVGQANNGHCEITIPYEFLIMDFEDPIQAIVDATYPYLLQNYNNADFLQKRAILASTKDVVDKINDYVLSLIPSDEKEYCSADSVDKSDELLNPTFGVLTPEFLNTLKTSGIPNHKLRIKIGTPIILLRNLDQANGLCNGTRLIVTKLGTNVVEAEEYEPGRRYRQNTSCKNSSHHLSQ

SEQ ID NO: 209547 - protein, 463 aa, Glycine max
  Coding DNA Sequence Number=SeqID_92769
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=94%, HitCoverage=47%, E-value=1e-162, Identity=64%"; Hit description =Protein kinase; Adipokinetic hormone
  Pfam annotation: Domain name=Pkinase; Domain location=83-381; Score =116.2; E_value=9.3e-32; Accession=PF00069.15; Description=Protein kinase domain
  Pfam annotation: Domain name=Pkinase_Tyr; Domain location=83-381; Score=112.7; E_value=1.1e-30; Accession=PF07714.7; Description =Protein tyrosine kinase
  Pfam module annotation: Pfam domain module=Pkinase::Pkinase_Tyr; Domain location=83-381::83-381
MDLKFFPPYLNNTSNHTFNESELLRIKSKFTGWLIPDNDTFGPYELIGFNLLGSYQDASKISIKIDGVRAFTYGELSFATNNFSISAQVGQGGYGKVYKGVLSDGTVVAIKRAQEGSLQGEKEFLTEISLLSRLHHRNLVSLIGYCDEEGEQMLVYEFMSNGTLRDHLSVTAKDPLTFAMRLKIALGAAKGLMYLHTEADPPIFHRDVKASNILLDSKFSAKVADFGLSRLAPVPDMEGVVPGHVSTVVKGTPVLKLERLGLGSPIQMVSELAVIAPSPTLDEFENNEYFLTHKLTDKSDVYSLGVVFLELLTGMHPISHGKNIVREVNVAYQSGVIFSIIDGRMGSYPSEHVEKFLTLAMKCCEDEPEARPSMTEVVRELENIWSTMPESDTKRAEFISSDSGKADSHSTPSSSSASASVMKTPFVSGDVSGSDLGQLSTRELRRYKVDLVVKEEGKGGKAI

SEQ ID NO: 209548 - protein, 69 aa, Glycine max
  Coding DNA Sequence Number=SeqID_92770
  Gene Ontology: Mol. function=protein binding
  Homolog annotation: Hit_ID=Q1S6S4; Match level="QueryCoverage=70%, HitCoverage=5%, E-value=2e-16, Identity=79%"; Hit description =Protein kinase; Adipokinetic hormone
MHLWPCSLLDNNNLSGYLPRELADMPSLLIIQLDNNNFEGNSIPDTYANMSKLLKMRSNHTRENVGQDI

SEQ ID NO: 209549 - protein, 716 aa, Glycine max
  Coding DNA Sequence Number=SeqID_92771
  Gene Ontology: Mol. function=RNA-directed DNA polymerase activity; Cellular component=chromatin; Biological process=chromatin assembly or disassembly
  Pfam annotation: Domain name=Chromo; Domain location=644-695; Score =26.1; E_value=0.00013; Accession=PF00385.14; Description='chromo' (CHRromatin Organisation MOdifier
  Pfam annotation: Domain name=RnaseH; Domain location=195-314; Score= -31.8; E_value=0.053; Accession=PF00075.14; Description=RNase H
  Pfam module annotation: Pfam domain module=Chromo::RnaseH; Domain location=644-695::195-314
MADDDIPKTAFRTHHGHYEYRVMPFGLWNAPSTFQAAMNALLSPFLQKFAAAFFDDILIYSESLPDHLLHLECIFRALSQAQYYLKHSKCLIGQRQLDYLGHAVSGSGVQLDPSKVQAIVDWPTPRSPKDLRAFLGLTGFYRKFVKGYAGMAAPLTKLLCKNAFHWTSKSRTAFDSLKTAMTIAPILTLPNFGLPFILETDASGSAMGAVLQQQGHPIAFFSKPFYPRLQHASAYVRELHTIIAAVRRWRQYLLGHKFTIFTDHRSLWELMSQVVQTPEQQFYLAKLLGFDYDIQYKAGSSNIVVDSLSRVDCSSQGQCLILSVPHHEFMMQLKESLEASTEFQQQRAAILSHPEKYALPYSSGYHAAPIGGHFGVKKTLHRLQSSFQWASMAKDVRTFIRKCNVCQQVKHITQRPAGLLQPIPIPNFVTHLPSSHGFTVILVVVDRFSKGVHLGALPTQFMVFKVATLFIDTIAWHDPAYEHSLPSSIGWADGAIYGKPPPSVPSYILGSSHNDAAATVLRTRAEIHTALKRRLTKAQDTMKQFADRQRREVQYEVGQLVYVKLRPHRQLSVPTDKPNKLTKRYFGPFCILKRIGQVAYRLQLPPGSKIHPVFHCSMLRPHHGPFELQTSSLPPEAIHNQPLLKPLAILGSRMDSSTSPPTRSVLVQWAGLPPKDSTWENWEDARGDHHLEDKVLGCHGPLANHEPERAFLPATA

SEQ ID NO: 209550 - protein, 466 aa, Glycine max
  Coding DNA Sequence Number=SeqID_92772
  Gene Ontology: Mol. function=RNA-directed DNA polymerase activity; Cellular component=chromatin; Biological process=chromatin assembly or disassembly
  Pfam annotation: Domain name=RVP_2; Domain location=282-390; Score= -49.5; E_value=0.0072; Accession=PF08284.2; Description=Retroviral aspartyl protease
  Pfam module annotation: Pfam domain module=RVP_2::Retrotrans_gag; Domain location=282-390::54-151
MPPHQHPSSSPRLHQRPPFKLDVPQFDGHDPLGWIFKISQFFDYQGTPEEDRITIASFYLDSAALSWFQWMYRNGFITSWQALLQAIETRFAPSIYDDPRGALFKLVQRGSITEYMTEFERLANRIVGLSLSDALQPVSLPHAMALARLQEDKINDRRKTPRSSFPPPQTQAPSLPIQTQTSRPKTPFIQCTPEDMMYRRKKGLCYNCDEKWSSSHRCKGRVLLFIVYSDESSTSDITLTEASPQSINETVPPFDPTPLHPQISLHAMAGIPAIDTFRLYGVNNHARVTILVDSDSTHNFIQPRVAKFLGLAMEETMALRVMVGNDSVLECRQLCPATSLLIQDHSFTVTLRILPLSGADVVLGIEWLSILGPIITDYTSFTMHFSHLGQPVSLHADVHTNTDPTSAHQLRRSIHTHSVSGLFHLSLIPVTLPEPDTDPPHPISTINDLLLKFQTLFQQPTTLPPP

SEQ ID NO: 209551 - protein, 91 aa, Glycine max
  Coding DNA Sequence Number=SeqID_92773
MDEWSNSLGHGSLYGSLEPQSIHNAKDRRGQCEEYIGKWLKESQRQVAFKALKTTDEGKVPQRITDEGVAKVVDGLALKVVDEGVAKVVDG

SEQ ID NO: 209552 - protein, 77 aa, Glycine max
  Coding DNA Sequence Number=SeqID_92774
MEDLKVMLIVIRLNVVVQSLVEAEYIIVATVSHQAIWIRKVADREVQGLLVGCHLPSQLARKTWKHTVTSVVILITT

SEQ ID NO: 209553 - protein, 130 aa, Glycine max
  Coding DNA Sequence Number=SeqID_92775
MELGSPCYTELWLDAIEMGDLAYVRARMGPDGILIGYLVWSMSHVDPMGWSILSKLDNPNAPITISSWLECNNGIMWVRTACLLEILSQNVFFWYHMHVRKEKATSHCICAFCELSNLEWMSCVPYVMFE

SEQ ID NO: 209554 - protein, 135 aa, Glycine max
  Coding DNA Sequence Number=SeqID_92776
MANTVLSLAHLGFSVVAINADVGLCNLDLLRTQNCTLAKTQLVDIFSHFCAAIEGDDLGLGGGGREEIQAFNSLAKLSEIEIGCGSERKWKEKERMSWKKVTAGIAYDSGGTWLQKRKHESIVRETFLPIEKLVY

SEQ ID NO: 209555 - protein, 120 aa, Glycine max
  Coding DNA Sequence Number=SeqID_92777
MKMKDTYRLKGTLLSFRVFWTGLMDSKPMLVKGLMLWNDKWTRDLTRWTQGSQRIVIIKKGEIVEAMTSKIILMMPKNQELSKFQRFKNQVSRVKIEESSFKNNQDQDSRIKRRLNQDKY

SEQ ID NO: 209556 - protein, 51 aa, Glycine max
  Coding DNA Sequence Number=SeqID_92778
LRYYVDSHLFFEVEEPRHDLEFLLTPIEYDGRGNVRQYNVEQVHPMEVKED

SEQ ID NO: 209557 - protein, 95 aa, Glycine max
  Coding DNA Sequence Number=SeqID_92779
  Homolog annotation: Hit_ID=Q7XHS8; Match level="QueryCoverage=68%, HitCoverage=7%, E-value=2e-13, Identity=51%"; Hit description =Putative pentatricopeptide (PPR) repeat-containing protein
  Pfam annotation: Domain name=PPR; Domain location=52-85; Score=17.5; E_value=0.047; Accession=PF01535.11; Description=PPR repeat
MVYTLIILIELDEAIELFEELDSNNNVPLGNFNEACNLLERQNRKGCIPNLIAYNCILTCLGRKGKVEEAFTILEAMKMDAATNLTSYNILIHRL

SEQ ID NO: 209558 - protein, 68 aa, Glycine max
  Coding DNA Sequence Number=SeqID_92780
MVAFLVLSRVPLSVALLGFLRVKEKGTKNVLNGLLKRSCQSEVRDGGGVADLGQRPVVDWWWFWDGDA

SEQ ID NO: 209559 - protein, 56 aa, Glycine max
  Coding DNA Sequence Number=SeqID_92781
MPFITHFQASNTRAWTSVRQGLVMMGHKLLFQRLVKTRDAGKDQRGRWVKSGKGWL

SEQ ID NO: 209560 - protein, 59 aa, Glycine max
  Coding DNA Sequence Number=SeqID_92782
MDILRKVKEVTEEVKTSKKALEEALERVEAANQVCSSLVTCHATFRGDFCEFDSCKLML

SEQ ID NO: 209561 - protein, 67 aa, Glycine max
  Coding DNA Sequence Number=SeqID_92783
MGWEIQHLEIKDFKASCIPMTMAFQKLAFKIAGYLRWFCENRNIKHFHRPKAPLNIVMKIPTCEMLS

SEQ ID NO: 209562 - protein, 350 aa, Glycine max
  Coding DNA Sequence Number=SeqID_92784
  Gene Ontology: Mol. function=serine carboxypeptidase activity; Cellular component=peroxisome; Biological process=proteolysis
  Homolog annotation: Hit_ID=Q1SGX5; Match level="QueryCoverage=96%, HitCoverage=76%, E-value=1e-113, Identity=60%"; Hit description =Peptidase S10, serine carboxypeptidase
  Pfam annotation: Domain name=Peptidase_S10; Domain location=3-347; Score=295.5; E_value=1e-85; Accession=PF00450.12; Description=Serine carboxypeptidase
MNPFLFQCLKCPLRFKIEEYDGSVPNLILRPQSWTKVCNIIFVDLPFGTGFSYAKNLTAQRSDWKLVHHTHQFLRKWLIDHPEFLSNEFYMGADSYSGIPAPAIVQEISNGNEKGLQPRINLQGYLLGNPITTRNEGNDQIPFAHGMGLISDELYACLSGINTFYILDRYCKSDSPKKHEAQWRRSLTQKFEASLNSHLRVPDIRCQIFGFFLATQWANDESVRKSLHIREGTIGKWERCYTTDFEEQIFSSFEFHVNLSAKGYRSLIYSGDHDAVVPFMSTQAWIRALNYSIVEDWRPWLLEDQVAGYTRTYSNQMTFATVKGSGHTAPEYKPEEGFAMFSRWIANMPL

SEQ ID NO: 209563 - protein, 243 aa, Glycine max
  Coding DNA Sequence Number=SeqID_92785
  Homolog annotation: Hit_ID=Q9C7D2; Match level="QueryCoverage=28%, HitCoverage=15%, E-value=8e-25, Identity=70%"; Hit description =Serine carboxypeptidase, putative; 29599-27172
  Subcellular localization annotation: CTP_CleavageSite=38; ConfidenceScore=5.43e-01
MALLESNPYSPSSSSVHPHPASPSLTLHHMKLEVLHFNGTMNASPSPPSNGGTCVGLALVDGRNGQLTSWCGLLQALETRFATSTYEDPTRTLFKLMQHGSVNDYLSEFETLANRIIGFQLTSWNVLGTSKTAQEEEASTPGISTVSKMFCNFHIILLIALALLVQISSQLGSKVEVLPGFEGPLPFELETGYVGLGEKDDDMQVFYYFVKSENDPQKDPLMLWLTGGPGCSSFSGLAFQIGS

SEQ ID NO: 209564 - protein, 44 aa, Glycine max
  Coding DNA Sequence Number=SeqID_92786
MGLTEVKVGEEYEIVMTNPAGQSSKEGPQLLPSFKFKNMILHTV

SEQ ID NO: 209565 - protein, 106 aa, Glycine max
  Coding DNA Sequence Number=SeqID_92787
  Gene Ontology: Mol. function=unfolded protein binding; Cellular component=centrosome; Biological process=protein folding
  Homolog annotation: Hit_ID=Q00NU9; Match level="QueryCoverage=56%, HitCoverage=9%, E-value=6e-24, Identity=86%"; Hit description=Heat shock protein 90
MRGNQQTLLYSGHERKVPPKEVGSKAKNRNFYIPTLAITEDINIHFEEDYNKFYEGFSKNLKLGIHEDSHNKTKLAELLRYDSSKSGDEMTSLKDYVTRMKEGQNE

SEQ ID NO: 209566 - protein, 59 aa, Glycine max
  Coding DNA Sequence Number=SeqID_92788
MDLEGNDGVIPSDSLFRKARYSKDTIIVNFDTDTAWSSITSSSTQKKSWMKPYSILGPG

SEQ ID NO: 209567 - protein, 59 aa, Glycine max
  Coding DNA Sequence Number=SeqID_92789
MEVAKAAIAGGISVLEIVVSTSGSIAAGERASYNGPRERLIQATEIWMTPLPVKEDKSG

SEQ ID NO: 209568 - protein, 58 aa, Glycine max
  Coding DNA Sequence Number=SeqID_92790
MAPIGFHGKGLVLPFESDFGLVLGTQVRGAKKALNLVLEVVMVANAKWAYKMDRWANP

SEQ ID NO: 209569 - protein, 43 aa, Glycine max
  Coding DNA Sequence Number=SeqID_92791
MTEQFAALAAITQNPGMSSYRFFVNVSHVINFMSYVDGEAGFN

SEQ ID NO: 209570 - protein, 154 aa, Glycine max
  Coding DNA Sequence Number=SeqID_92792
MPRTHFQKASSSLDDGYASKDKVSIRHTIRGVKVMISLATIATMFGCLEGGLAFDKDWEKDIYQKTRVIDYVSDRDRFYMYKLMVGEKNLVPYGMIFTQIMRDVGVDMCGMAPIREATQLKGMAFMKMGIANNFLKYAQKHIKRKVKKEPKEKP

SEQ ID NO: 209571 - protein, 231 aa, Glycine max
  Coding DNA Sequence Number=SeqID_92793
MEVVTVPKEVDPIEKETLEEAMFHFFIEASLTESDTIDVDKLKCLEEIYGAPVFVSIQDVIGQGINFQEFPINKTIAPNPGSLIYEHSPIARKVYPPGATVWNHLRCLSLLPLDLQQLMGLICSLNDSPKFQDYEQSDYGLELIMKLFTYREENRSRKASFRRIQRLNTHLPFRLRSQFSCLATSKTWFQITIDKRILYQNTNCYKSKKLLVEEDEDASPTRYVKAHKAED

SEQ ID NO: 209572 - protein, 50 aa, Glycine max
  Coding DNA Sequence Number=SeqID_92794
MDKFKIIIAQSAALALTIVNFCNPSDLLGVGSMSMRHEIYCFLVGETIAC

SEQ ID NO: 209573 - protein, 146 aa, Glycine max
  Coding DNA Sequence Number=SeqID_92795
MSGFLHSRYILSRSNTRERVRILHKNPQDPKRCDWLNRFGREATTKRWRGKRKGRRRQTRKGKGEEKREEGERGRGTVMYREEGEKEEGERGRGMVTWREEEEREDADRGRGMVSKRGEEEYMRKKGEGKLTISTQIGEKGKGEGE

SEQ ID NO: 209574 - protein, 142 aa, Glycine max
  Coding DNA Sequence Number=SeqID_92796
  Gene Ontology: Mol. function=sequence-specific DNA binding; Cellular component=nucleus; Biological process=regulation of transcription, DNA-dependent
  Homolog annotation: Hit_ID=Q67BK3; Match level="QueryCoverage=99%, HitCoverage=61%, E-value=2e-46, Identity=69%"; Hit description=AGL15
  Pfam annotation: Domain name=K-box; Domain location=2-82; Score=-2.2; E_value=0.00067; Accession=PF01486.8; Description=K-box region
MVEILREEIAELETKQLYVFCQSLVGKDLTGLGLKELQNLEQQLNEGLLSVKARKEELLMEQLEQSRVQIEELRCLFPQSERMVPFQYQHTEGKNTFVDTGARYLNLANNCGNEKGSSDTSFHLGLPAGVQEEGPQERKLCK

SEQ ID NO: 209575 - protein, 59 aa, Glycine max
  Coding DNA Sequence Number=SeqID_92797
MVVVASVVATSAEVVASVVAASGAFAEVTGSGGRRKEKGQEGCSSFRLMYRLVDINMYK

SEQ ID NO: 209576 - protein, 241 aa, Glycine max
  Coding DNA Sequence Number=SeqID_92798
  Gene Ontology: Mol. function=protein serine/threonine kinase activity; Cellular component=cytoplasm; Biological process=protein amino acid phosphorylation
MGDRLEDMICDIIQEYFHQAHASMYDTLEKDSNKSLYLGCKKSLKFLSMVLSLVNVKAIYGWSDKSFTSLLKVVQGMLLEENTLPKNYYEVKKILCLMEMEYQKIHVCLNNCILYRDKFEEMHKCPMCGVSQYKVKDDEEYSSDEAQRKVPPNEGLSICLQMEMTQKTLDDMQMGETVMECSTIWLILSNGRRLIVCIQILGKMQEILGLDLLVIYNLPHWLYMKLKYIMLSMMILGPRHP

SEQ ID NO: 209577 - protein, 119 aa, Glycine max
  Coding DNA Sequence Number=SeqID_92799
  Gene Ontology: Mol. function=nucleic acid binding
MEVVTSPQEKPNPIKFWTSLRRGEHLLATPHCHVIWKVYRLYMELHYMASMREPKPTNITLHLPDCFVVHPRKVIEDVLIKVDKFIFPTDFVVLDMEEDENVPIILGCPFLNNYNCWKN

SEQ ID NO: 209578 - protein, 126 aa, Glycine max
  Coding DNA Sequence Number=SeqID_92800
  Homolog annotation: Hit_ID=Q10NJ8; Match level="QueryCoverage=44%, HitCoverage=6%, E-value=7e-07, Identity=50%"; Hit description =Expressed protein
MPINIQPSNGLLKPAEDMGFGLEFRKSSTKQHSSSKTAKESSVLPHSKQSWKDAEKLKSKSDLKQKGKLDAEGKIQNSETVRRRATERDELVKHMSNLPGYLLGTDKVENFQEKAFNVGVLDWSRL

SEQ ID NO: 209579 - protein, 137 aa, Glycine max
  Coding DNA Sequence Number=SeqID_92801
  Homolog annotation: Hit_ID=Q1SAI8; Match level="QueryCoverage=48%, HitCoverage=5%, E-value=3e-11, Identity=54%"; Hit description =Integrase, catalytic region
MEKQAATNFGATMMARESVDAPSSKDNYPPNCNNRNNKAALAVVATSSNLGKEVEIVDSGLGNGFLRLSLHVHTHLLIEPGPMLNNTTLPSSKGYWAQTLAGLFCYNSYTTLSRQCTHLGLLLRTQTGIWTPVPPLT

SEQ ID NO: 209580 - protein, 59 aa, Glycine max
  Coding DNA Sequence Number=SeqID_92802
  Homolog annotation: Hit_ID=Q1SIG4; Match level="QueryCoverage=68%, HitCoverage=7%, E-value=2e-10, Identity=80%"; Hit description=TGF -beta receptor, type I/II extracellular region
MEKSIEFSERLSFSGIASSLVLYLTKVIHQDLKTAVKNANYVAGFTTLTALLGGFLADA

SEQ ID NO: 209581 - protein, 185 aa, Glycine max
  Coding DNA Sequence Number=SeqID_92803
  Gene Ontology: Mol. function=DNA binding; Cellular component =mitochondrion; Biological process=DNA integration
  Homolog annotation: Hit_ID=Q1SF88; Match level="QueryCoverage=98%, HitCoverage=14%, E-value=2e-66, Identity=69%"; Hit description =Integrase, catalytic region
  Subcellular localization annotation: CTP_CleavageSite=65; ConfidenceScore=5.27e-01
MTPVDTKSKLSATSSTPYADTSHYCNLPGALQYLTFTRHSTSSYCVFLGDNLIPWSFKQQATLSQSSAEVEYRGVMNVVSKSCWLRNLLLELHCPIQKATLVYCDNVSGIYLSGILIQHQRTKHMEMNIYFVRERVARAQVCVLHVPSRYQIVDIFMKGLRLVLFEDFRDNLSVRKPLALTAGVC

SEQ ID NO: 209582 - protein, 77 aa, Glycine max
  Coding DNA Sequence Number=SeqID_92804
MLTSPFTLIKFPLGLGFALSATFHAECNSSRVAITLDMLVLLSKKSSACVNIYDLSIVVHVNWLEKSGCVEGEFLWG

SEQ ID NO: 209583 - protein, 200 aa, Glycine max
  Coding DNA Sequence Number=SeqID_92805
MLLCGVGDNDDGGGVSNDDIRDPSSGCGGNDSKSGSGGVGGSDDDSGGGDIVGGDDPMVVVVVMIEVVVAMVVVVLMALAMLVTLVAVVVVIMSVVAMMVVVAVVAVTSDIGGGGNNGGIGGGGGDDGDVVLAVAVVAVVLMTMVVVCGGGGWNDVDGVCGGSDEGDIGVGGGSDNNIGGITVVMATKNAIVKYGKYVLS

SEQ ID NO: 209584 - protein, 226 aa, Glycine max
  Coding DNA Sequence Number=SeqID_92806
  Homolog annotation: Hit_ID=Q1SN44; Match level="QueryCoverage=82%, HitCoverage=34%, E-value=3e-12, Identity=26%"; Hit description =Nucleic acid-binding, OB-fold
MDEHQQNWKEMANIMMKINKELDEMFNTVHVIDQPYGEVSRSFVIRWKDELQPTWHLLHSSGNMHSVTYHQDLVSPALLAGWMELREFYGLTGNHQVTLTHYGQSIFLLTIFKCSSEPKAFPKWHSLYHQVPNSVTFKVLLTKYKVTCSSLDVPSTMYSFMKVARFTHLNLEGTKCKIVYNHHRKTTKIGNGRRTFAQTHNFLPGTQIIFQFPDATSNFVLFWLCL

SEQ ID NO: 209585 - protein, 112 aa, Glycine max
  Coding DNA Sequence Number=SeqID_92807
MAKRQRGARRGTCKEANREEANRQEREEELIFFFNQDEIINYLLEIIDYLEAFAVSKKYGPQEGIGTNAKVVFKDKGILVEELNQQPENDREGPLEGLKAELVEQSDVFGKP

SEQ ID NO: 209586 - protein, 102 aa, Glycine max
  Coding DNA Sequence Number=SeqID_92808
MGCGKATIGTTKAGRIGNKPSLGKNALKIFKRFAKVEVYIVSIYVLIVDHEDATALRQQLQGAKEFEHIDIHACMKYDTWAPSMHCSWIIKDSKPPFHSRDA

SEQ ID NO: 209587 - protein, 51 aa, Glycine max
  Coding DNA Sequence Number=SeqID_92809
MVNQEESIHEGHGKFMSVLLKFMSVVVIQEGHSQSIMAQGFNVTFDHGCGG

SEQ ID NO: 209588 - protein, 72 aa, Glycine max
  Coding DNA Sequence Number=SeqID_92810
MPHKAPKKTVEVGFTQLTSFWSKQECAFLSSPISVGAEIVDIICKNFMLKPLRDEVILRPIWNMQGDYLLVQ

SEQ ID NO: 209589 - protein, 464 aa, Glycine max
  Coding DNA Sequence Number=SeqID_92811
  Gene Ontology: Mol. function=DNA binding; Biological process=DNA integration
  Homolog annotation: Hit_ID=Q1RVN6; Match level="QueryCoverage=28%, HitCoverage=18%, E-value=3e-32, Identity=50%"; Hit description =Integrase, catalytic region
  Pfam annotation: Domain name=rve; Domain location=261-409; Score=9.8; E_value=0.0009; Accession=PF00665.16; Description=Integrase core domain
MRNRKVQSSAMSARSQGTSSEEEANLCMMLDATTSKAEPTLDASSYDEDSQPDDFVNSNGEKDIKKAHQVHLVDFVLVTTSPGSVQDASACEEVKALLDEKVSNGYKNLLKDFQDLEERVKSLTITLKDSKEWCKEMLNYFKKNMSFDLNRKLKGCEVLKELPPEIVKLYEEIETLRDKLGKFVGGHEAFNKIIKVQRNLKEKSGHGFKGKKIVHGEEVTIFSFYGKMGHETYNPKSSGVVTFRGNQNGLITGVVNYVKVDSTSPLTRICVSSRTRTSFHSSKLINKEICMRLSGDMSSQTVPCLLLVKEHHLIWHKKLSHASLRTDHKGKFENDLYEKFCEENGIHRKFSTSRTPQQNGVVERKNITLQEMARTMLNDHSTSKHLWVEDNLGKFDSKCDSRILLGYFESSKAYRAFNSKTLTIEEAIDARFNDNKLDTTMSKLDESFAEMKIENIVKFVAMSS

SEQ ID NO: 209590 - protein, 245 aa, Glycine max
  Coding DNA Sequence Number=SeqID_92812
MAINWNGNPTTSFAPSRDMETFFFGGENGVQISHLFFVDDMILVAEASQQQGVSDNLATSLSQNLNVPVTKDLHFYLRFKSFTIERRATMFQSSLLSLPTYVLEATLITIAIRNEIEKLCRDFISGSNNARFWKDAWIPGVSSHDSLLPKLFLWKLMHARLLTNELRVTRHIMDDSLCPRCKYQDESILHTIRDCEDVKKGQNLKAPVGFWSSFFGIMPEAFKFIRISVGPPSIFDDGRKDDFAI

SEQ ID NO: 209591 - protein, 172 aa, Glycine max
  Coding DNA Sequence Number=SeqID_92813
MDDSNRPWFLTVVYASPKTHLRYLTSKDLSNISSTMNSPWAVASDFNNMIFEKEKQERGPINTNSTEQFWECIQRVSNLNIPSSDHYGLWLSISDGIQRHHSEDHDVQESRIALSMGNYKSLGPNGFHPAFSKSQWEHIEKSVFEFITHVRNNPANIAIVNQTLLALIPETN

SEQ ID NO: 209592 - protein, 88 aa, Glycine max
  Coding DNA Sequence Number=SeqID_92814
MTHLTSKLSLEATSNKKICNERGARVLIKRNERRIKEKQAQGSICNERGARVRYAMKREASTEKEGLGAECFELKPVGAYEYFEHVPA

SEQ ID NO: 209593 - protein, 173 aa, Glycine max
  Coding DNA Sequence Number=SeqID_92815
  Pfam annotation: Domain name=Transposase_23; Domain location=67-137; Score=3.3; E_value=0.00049; Accession=PF03017.5; Description =TNP1ENSPM transposase
MVRTKKVGQMTSEVAKEIAENIMQSQFQSQMQSQGLALPLEPEVGPSVARVSTKESCVDPLGNDPQTGDSDKCGLYIEDNPSRLVALGRVYEGSTMIHNIPLLHGQVKVVVEEIKDADTPVPVPTDEIILVGQTLNTFLAWPTHLVKPLSEHEVVSPAKPPDRPDPEMAIPYI

SEQ ID NO: 209594 - protein, 78 aa, Glycine max
  Coding DNA Sequence Number=SeqID_92816
MIHNIPLLHGQVKVVVEEIKDADTPVPVPTDEIILVGQTLNTFLAWPTHLVKPLSEHEVVSPAKPPDRPDPEMAIPYI

SEQ ID NO: 209595 - protein, 105 aa, Glycine max
  Coding DNA Sequence Number=SeqID_92817
  Subcellular localization annotation: CTP_CleavageSite=84; ConfidenceScore=5.50e-01
MARKSDKQTKLPKCPPISNPSEQQGLPSRSPFPVAGSTWTTGLSAPGGLVAKDHSCVALRVRFNVDRDADATAGGGGEAGGVARGEELKKAIGNIVYIECNSNTQ

SEQ ID NO: 209596 - protein, 67 aa, Glycine max
  Coding DNA Sequence Number=SeqID_92818
MEAVMVGLEGDALSWEKRESHEDSTNGGFDHFSISLMFGSPIRAIREKKLRNLKNLLEIPLSLSEDT

SEQ ID NO: 209597 - protein, 110 aa, Glycine max
  Coding DNA Sequence Number=SeqID_92819
MGAVWDNTYCSTNSAEKRMKWIFGRLKSKRLPSIKAPLPLKGTTLSEAEQQQSNHALIVGIASAAVVEAVDSRFVAGLSTIDFPAMSAGALLETTMSAGSRMAKITPSGI

SEQ ID NO: 209598 - protein, 108 aa, Glycine max
  Coding DNA Sequence Number=SeqID_92820
MYHNKKKNLWFLDSGFFWHMIRDKNKFLSLEKIKDEGYIAFGDDRDQGRPSRREERPKRKNPLIGLKELEKGRSLKDDPKVGLEIPKSARVKRPKENLEVINTLHGKA

SEQ ID NO: 209599 - protein, 220 aa, Glycine max
  Coding DNA Sequence Number=SeqID_92821
MAVVANVLAKLRTTNSNLEKETTEKEESAKKAEKLEVFVETAQYALEVVAGERTSIVFVKDSLFDMKNMQNLFNSPIFDFSIKIVYGLSPLHGEPSTFSIPFPQFPSHSSTIEPSKVQEEVPHVRIRSPPPIVKPPSRTMNELFERFHRLKEWIFDKARLGLIHAVAPMQHEPSPPPRATTMPLSFEKFSLKKHDWSIPFVPPFGFLLDNKWREDYKRLV

SEQ ID NO: 209600 - protein, 84 aa, Glycine max
  Coding DNA Sequence Number=SeqID_92822
  Subcellular localization annotation: CTP_CleavageSite=51; ConfidenceScore=5.09e-01
MDYAIIPSLASVMLRSFTDCALTLPFNSRRVTELHGLSNNGCQVPQSGQARVASQQTDGPWTKLGYDTWLITFLEYDNQLKDDP

SEQ ID NO: 209601 - protein, 63 aa, Glycine max
  Coding DNA Sequence Number=SeqID_92823
  Homolog annotation: Hit_ID=Q1SJD9; Match level="QueryCoverage=53%, HitCoverage=3%, E-value=9e-09, Identity=79%"; Hit description =Glycoside hydrolase, family 31
FGGEVAVGDGDLGGDEGGGARGAGLGALAEWGLVAEEKDQRQRFVPHLLTVVAAVVDLGPYTH

SEQ ID NO: 209602 - protein, 173 aa, Glycine max
  Coding DNA Sequence Number=SeqID_92824
MDDVSHFADSKGDSLPTEGVEIAHFSLEQAHYMIYTPSDPLLFVAVKDQNGVLQIADDELLEDPAITSAIDEETEFNALVVCGFSLSKRKKLRSLIHSWVKDNPIFTFLQQSCPSSQDPPMFCFYVFVCMLKKEATFCNFFLNADQKLPNMKLVFFLWNVPSWSVCISTSIWG

SEQ ID NO: 209603 - protein, 63 aa, Glycine max
  Coding DNA Sequence Number=SeqID_92825
MIIYTNARIARQNVHVPLKLVVNKETNKVLFAETGKDFVDVLFSFLILPLGTIARLVEKKSLT

SEQ ID NO: 209604 - protein, 751 aa, Glycine max
  Coding DNA Sequence Number=SeqID_92826
  Gene Ontology: Mol. function=hydrolase activity, hydrolyzing O -glycosyl compounds; Cellular component=endoplasmic reticulum; Biological process=carbohydrate metabolic process
  Homolog annotation: Hit_ID=Q1SJD9; Match level="QueryCoverage=97%, HitCoverage=85%, E-value=0.0, Identity=80%"; Hit description =Glycoside hydrolase, family 31
  Pfam annotation: Domain name=Glyco_hydro_31; Domain location=209-609; Score=619.6; E_value=2.6e-183; Accession=PF01055.16; Description =Glycosyl hydrolases family 31
PLHQALAPPSFSEKNGAYSSVYLSDGHSAVLRHDPFELFVRDDSSGDRVISLNSHGLFDFEQLKHKSEDDNWEEQFRSHTDRRPYGPQSVSFDVSFYGADYVYGIPERAASLALKPTRGPNVDESEPYRLFNLDVFEYIHDSPFGLYGSIPFMVSHGKTRGSSGFFWLNAAEMQIDVLAPGWDAESGIVLPSHRIDTFWMSEAGVVDAFFFIGPNPKDVLMQYTAVTGTPAMPQLFSIAYHQCRWNYRDEEDVEHVDSKFDELDIPYDVLWLDIEHTDGKRYFTWDRALFPHPEEMQRKLASKGRHMVTIVDPHIKRDDNFHLHKEASQKGYYVKDASGNDFDGWCWPGSSSYPDTLNPEIMSWWADKSAYQNYEGSTPSLYIWNDMNEPSVFNGPEVTMPRDVIHYGGVEHRELHNAYGYYFHMATANGLLKRGEGNDRPFVLSRALFAGSQRYGAVWTGDNTADWDHLRVSIPMVLTLGLTGMPFSGGERNTELIKDAIHVRYALLPYFYTLFREANTTGVPVVRPLWMEFPSDEATFSNDEAFMVGSSLLVQGIYTERAKHASVHLPGKESWYDLRTGTVYKGGVTHKLEVTEESIPAFQRAGTIIARKDRFRQSSTQMANDPYTLVIALNSSQEAEGELYIDDGSSFNFLQGGYIHRRFIFSNGKLTSIDLAPASGSKGRYPSDAFIERIILLGHAPGSKNALVEPSNQKVDIELRPLWVLRAHSPAVTTIRRPNVWVAEDWTITVI

SEQ ID NO: 209605 - protein, 40 aa, Glycine max
  Coding DNA Sequence Number=SeqID_92827
MISSKVNYLKIRQSSEIKTKVEGKGPKNELGCASNSSSCK

SEQ ID NO: 209606 - protein, 359 aa, Glycine max
  Coding DNA Sequence Number=SeqID_92828
  Gene Ontology: Mol. function=phosphatidate cytidylyltransferase activity; Cellular component=integral to membrane; Biological process=phospholipid biosynthetic process
  Homolog annotation: Hit_ID=Q8S601; Match level="QueryCoverage=96%, HitCoverage=80%, E-value=1e-162, Identity=75%"; Hit description =Putative CDP-diacylglycerol synthetase
  Pfam annotation: Domain name=CTP_transf_1; Domain location=42-359; Score=401.5; E_value=1.2e-117; Accession=PF01148.10; Description =Cytidylyltransferase family
MRKSVKVVWHVQRRPQEIPAEISKSNGNNLLVDDKSKYKSMWIRAYSSLWMLASVSLIIYLGHLYIWAMVVVIQIFMASELFNLLRRASQDKRLPKFKLLNWHYFFTAMLFVYGRILSQQLVNTVTSDKLLYRFVSNLIKYQMVICYFLYIAGFVWFILSLKKRYYKYQFGQYAWTHMILIVVFTQSAFTVANIFVGIFWFLFPAILIAMNDVGAYFFGFYFGRTPLIKLSPKKTWEGFIGASVATMIAAFTFANFLGRFQWLTCPRKDLSTGWLQCDPDPIFKPDYIPLPGLISHWLPWKEIAVLPVQWHALWMGLFASIIAPFGGFFASGFKRAFKIKDFGDSIPGHGGFTDRMDCQ

SEQ ID NO: 209607 - protein, 82 aa, Glycine max
  Coding DNA Sequence Number=SeqID_92829
  Gene Ontology: Mol. function=protein binding; Cellular component =ribonucleoprotein complex; Biological process=mRNA metabolic process
  Homolog annotation: Hit_ID=Q8LAK5; Match level="QueryCoverage=84%, HitCoverage=96%, E-value=2e-26, Identity=75%"; Hit description=Small nuclear ribonucleoprotein homolog
  Pfam annotation: Domain name=LSM; Domain location=4-70; Score=70.5; E_ value=5.3e-18; Accession=PF01423.12; Description=LSM domain
MASTKVQRKARIQIWLFEQKDLRIEGRIIGFDEYMNLVLDDAEEVNVKKKSRKTLGRILLKGDNITLMMNTFCIRQMPIMQM

SEQ ID NO: 209608 - protein, 657 aa, Glycine max
  Coding DNA Sequence Number=SeqID_92830
  Gene Ontology: Mol. function=beta-galactosidase activity; Cellular component=beta-galactosidase complex; Biological process =carbohydrate metabolic process
  Homolog annotation: Hit_ID=Q1SJD5; Match level="QueryCoverage=99%, HitCoverage=92%, E-value=0.0, Identity=83%"; Hit description =Galactose-binding like
  Pfam annotation: Domain name=Glyco_hydro_35; Domain location=1-288; Score=504.9; E_value=9.3e-149; Accession=PF01301.10; Description =Glycosyl hydrolases family 35
  Pfam annotation: Domain name=Glyco_hydro_42; Domain location=3-312; Score=-241.8; E_value=0.013; Accession=PF02449.6; Description=Beta -galactosidase
  Pfam module annotation: Pfam domain module=Glyco_hydro_35::Glyco _hydro_42; Domain location=1-288::3-312
MVKQMWPDLIAKAKQGGLDVIQTYVFWNLHEPQPGMYDFSGRYDLVGFIKEIQAQGLYVCLRIGPFIESEWTYGGFPFWLHDVPGIVYRTDNEPFKFYMQNFTTKIVNMMKEEGLYASQGGPIILSQIENEYQNIQKAFGTAGSQYVQWAAKMAVGLDTGVPWIMCKQTDAPDPVINTCNGMRCGETFTGPNSPNKPALWTENWTSFYQVYGGLPYIRSAEDIAFHVTLFIARNGSYVNYYMYHGGTNFGRTGSAYVITGYYDQAPLDEYGLLRQPKWGHLKQLHEVIKSCSTTLLQGVQRNFTLGQLLEVYVFEEEKGECVAFLINNDRDNKATVQFRNSSYELLPKSISILPDCQNVTFSTANVNTTSNRRIISPKQNFSSVDDWQQFQDVISNFDNTSLKSDSLLEQMNTTKDKSDYLWYTLSKPTLSVQSAAHVAHAFVNNTYIGGEHGNHDVKSFTLELPVTVNQGTNNLSILSVMVGLPDSGAFLERRFAGLISVELQCSEQESLNLTNSTWGYQVGLMGEQLQVYKEQNNSDTGWSQLGNVMEQTLFWYKTTFDTPEGDDPVVLDLSSMGKGEAWVNGESIGRYWILFHDSKGNPSQSLYHVPRSFLKDSGNVLVLLEEGGGNPLGISLDTVSVTDLQQNFSKLSLPSSA

SEQ ID NO: 209609 - protein, 638 aa, Glycine max
  Coding DNA Sequence Number=SeqID_92831
  Gene Ontology: Mol. function=beta-galactosidase activity; Cellular component=beta-galactosidase complex; Biological process =carbohydrate metabolic process
  Homolog annotation: Hit_ID=Q1SJD6; Match level="QueryCoverage=82%, HitCoverage=60%, E-value=0.0, Identity=70%"; Hit description =Galactose-binding like
  Pfam annotation: Domain name=Gal_Lectin; Domain location=560-637; Score=94.3; E_value=3.8e-25; Accession=PF02140.8; Description =Galactose binding lectin domain
MYHGGTNFGRTAGGPFITTSYDYDAPVDEYGLPRLPKWGHLKELHRAIKLCEHVLLNGKSVNISLGPSVEADVYTDSSGACAAFISNVDDKNDKTVEFRNASFHLPAWSVSILPDCKNVVFNTAKVTSQTSVVAMVPESLQQSDKVVNSFKWDIVKEKPGIWGKADFVKNGFVDLINTTKDTTDYLWHTTRLFSVFCTLSVDCHVEELENVNNTVWQLPIEKTMDSSQHTTYLDYYYEIVSNLRDSNRAQFSVDGSIFVSENEEFLKKGNKPVLLIESTGHALHAFVNQEYEGTGSGNGTHAPFTFKNPISLRAGKNEIALLCLTVGLQTAGPFYDFVGAGLTSVKIKGLNNGTIDLSSYAWTYKTLDGGIKHGNLYYFSQIGVQGEYLRLYQGNGLNNVNWTSTSEPPKMQPLTWYKAIVDAPPGDEPVGLDMLHMGKGLAWLNGEEIGRYWPRKSEFKSEDCVKECDYRGKFNPDKCDTGCGEPTQRWYHVPRSWFKPSGNILVLFEEKGGDPEKIKFVRRKVSGACALVAEDYPSVALVSQGEDKIQSNKNIPFARLACPGNTRISAVKFASFGSPSGTCGSYLKGDCHDPNSSTIVEKACLNKNDCVIKLTEENFKSNLCPGLSRKLAVEAVCS

SEQ ID NO: 209610 - protein, 37 aa, Glycine max
  Coding DNA Sequence Number=SeqID_92832
MHRKLVFQNPYVGSPSIQHGHYENDLDKPAMIEVQSQ

SEQ ID NO: 209611 - protein, 266 aa, Glycine max
  Coding DNA Sequence Number=SeqID_92833
  Gene Ontology: Mol. function=oxidoreductase activity; Biological process=electron transport
  Homolog annotation: Hit_ID=Q9LV69; Match level="QueryCoverage=53%, HitCoverage=43%, E-value=2e-15, Identity=51%"; Hit description =Arabidopsis thaliana genomic DNA, chromosome 5, P1 clone:MJE7
MGCTHGPEIYPKAHKNPRAFSCIFGPIYLEFSIQCPCGVGLHQVVSQRPEFELVVSRAGTSLDGKQNPWECYVGSCVKEPSTLEDAGTEHRRARFGSYGGVELETVWTNAESDMLKGRVNYYTNRSFASKGRYTEFYDDPVKCFIRSNSNGEVKVVQTSKNTIHSKKAVIVAAGCWTGSLIHDLFRNSGMDLHVPVMPREFCRKCFIESIGGSYTNTFANQVIIEECFGVCVNWGCGSNDSKIILMMPKNQESKSFKNQVSKNQDS

SEQ ID NO: 209612 - protein, 106 aa, Glycine max
  Coding DNA Sequence Number=SeqID_92834
  Homolog annotation: Hit_ID=Q9FEV9; Match level="QueryCoverage=42%, HitCoverage=7%, E-value=5e-12, Identity=71%"; Hit description =Microtubule-associated protein MAP65-1a
MLLPNRRLSLNAHQNGNRSTSKDGKRENRLSAPVNYVAISKEDAASHVSVNVPGVPSLGSYHRGKICSMKYYPWQAHHVIPRFTFSSQKENFLRSLDQLVTSILEL

SEQ ID NO: 209613 - protein, 895 aa, Glycine max
  Coding DNA Sequence Number=SeqID_92835
  Gene Ontology: Mol. function=DNA topoisomerase (ATP-hydrolyzing) activity; Cellular component=chromosome; Biological process=DNA unwinding during replication
  Homolog annotation: Hit_ID=Q8EVB9; Match level="QueryCoverage=57%, HitCoverage=40%, E-value=8e-10, Identity=22%"; Hit description=DNA topoisomerase IV subunit A
MELRCCGHLHFIQAIKGDLVTKAPNVVRGQPKLKFKKLTDIYDGLLSHNDDGMAERSCLGEIEESPVKTKPDASICNVNDDDDQRIINLDDDNFDNFTLSQIKASCKTRKRKHSQGLDSSKINMKVEDSSFLEDYREEQRAADDSDFLQTLSSLKSKLSKNMKTKKKKCFEEPSPTDTQEIMLVIKSEPEEILNNQEFPPSSEEILDYHEFSPSSQEIQDCQEFSPSCEEIQDGQEFPPTSEEIKIDQEIPFFSGDSVALVEVKSEVPEADCYGEPDDYCIIESQEAEIIYEWNLENELDEWQERVDFIPLRMVRPSCMDIVISNYQLSNDQSPYMPAIEFESEECIINPDLHYISPQGISLVEDHNSDIHDNQPDGDTDTAVSLPNVVTHKDLDCLGVEFKDDNIILDDCSSNEFTTGAEDQVECSSTMEHDCSNDEFTAGNEDLVEPSSTIEHDCSNDEFTAGNEDQVEPSSTIEHNSSNDEFSAGSEDQVEPSSTIEHDCTNDEFTAGNEDQVEASSTIEHDSSNDEFSAGSEDQVEPSSTIEHDCIDEFTTGSEDKVELSSTIEHGPNPDECLVCHSDDPPEYEEKQSFASVNIAEKRHVNVATDELTSWDECDGSSKLHHSERLLSTRKMVSLQAISPSSEERLCKAVESVNLNHKNNLTLFFQTINSTILERNMDFVERECKEKLYFSEKTDKMNSTAEGLDDITGARLTDIFNKISVIPRSKRVSQPRGISKNAHSSRQATRIGCNSVQSCSKSAIAFTQQQMHDAECLAMRLTKELKSMKDIVDDMLRSEFCLNTSLRHKVNEARMAVKNATRAEEATKRCLAFMSRDCSRFCKIMKFADDSPSPQKPPPDVVRKERKKIAFADEAGGKLFQVKFYEDDAVSLSKSN

SEQ ID NO: 209614 - protein, 159 aa, Glycine max
  Coding DNA Sequence Number=SeqID_92836
  Gene Ontology: Mol. function=unfolded protein binding; Cellular component=cytoplasm; Biological process=cellular protein metabolic process
  Homolog annotation: Hit_ID=Q70EL6; Match level="QueryCoverage=50%, HitCoverage=15%, E-value=4e-28, Identity=81%"; Hit description =Cytosolic chaperonin delta-subunit
  Subcellular localization annotation: CTP_CleavageSite=54; ConfidenceScore=5.37e-01
MKKSIIAKTPNPQSKNQNIKIKRKTNKITNSNEIGESDLFFTKLTVTGDPTSSSSSSKSSSRRSWTETWCSSWAILKEYRGLHEGVTVGELDEDSHGNENIDSLDGSLVEGVSDDGGVDVVGEEVEALLEEGADDDDDGGGAVAGSGVLGLGELDKHLG

SEQ ID NO: 209615 - protein, 47 aa, Glycine max
  Coding DNA Sequence Number=SeqID_92837
MQSTTARLTHLWSFSGGSFNRKSVLFGIHCHLLNGCISENIATGFWS

SEQ ID NO: 209616 - protein, 60 aa, Glycine max
  Coding DNA Sequence Number=SeqID_92838
MAVARHGSARLIDDTVDTRQRHNIFCHSQPGGTVPRYCHWRVRHVSRPDRVSSVSLAECR

SEQ ID NO: 209617 - protein, 487 aa, Glycine max
  Coding DNA Sequence Number=SeqID_92839
  Homolog annotation: Hit_ID=Q5Z4L5; Match level="QueryCoverage=99%, HitCoverage=99%, E-value=6e-73, Identity=63%"; Hit description =Putative LYST-interacting protein LIP5
  Pfam annotation: Domain name=DUF605; Domain location=9-481; Score =364.7; E_value=1.4e-106; Accession=PF04652.6; Description=Protein of unknown function, DUF605
  Pfam annotation: Domain name=Extensin_2; Domain location=136-447; Score=-138.3; E_value=0.068; Accession=PF04554.4; Description =Extensin-like region
  Pfam module annotation: Pfam domain module=DUF605::Extensin_2; Domain location=9-481::136-447
MANENEPAKLLLPYLQRADELQKHEPLVAYYCRLYAMERGLKIPQSERTKTTNALLVSLMKQLEKDKKSIQLGPEDNLYLEGFALNVFGKADKQDRAGRADLNTAKTFYAASIFFEILNQFGAVQPDLEQKQKYAVWKAAEIRKALKEGRKPTAGPPDGDEDLSVPLSSSSDRYDLGTTETTVSSPGPESDSSHSYHSPVNYQNLPSIQPTPKFHDTVNDQHSADIPPSMPFHDRVDNNKHSSVVSPSSHSYTLGVYPSQDYHSPPPSQDYHPPPPSQDYHSPPPSQDYHHPPPSQDYHHPPPSQDYHPPPPSQDYHPAPPSQDYHPPPARSESSYPEPYNHQQYSPENSQHLGPNYPSHETSSFSYPHFQSYPSFTESSLPSVPSNYTYYQGSDASYSSQSAPLTTNHSSSAQHSSGSRNGTVVEPKPTTQTYQYDSSYQPAPEKIAEAHKAARFAVGALAFDDVSIAVDYLKKSLELLTNPSAGQ

SEQ ID NO: 209618 - protein, 186 aa, Glycine max
  Coding DNA Sequence Number=SeqID_92840
MGSNFSFCCSEAYFRSQRLPKEDSGFVKASSVVWIAKNIKQTYFLRKKGMQKKKNKEEQHQKKGKELTLEEWLLKSPIMEKHGNCNGDHCDLKHGSNCDYPSVARESVYFSEWGEYSLSLDQLSNGDDYSDLKDEKFDIKEMGFNPLTRSQSSKVKKRVSFRLPEVSETIILYPLEMDFNECQCIN

SEQ ID NO: 209619 - protein, 382 aa, Glycine max
  Coding DNA Sequence Number=SeqID_92841
  Gene Ontology: Mol. function=pepsin A activity; Cellular component =cellulose and pectin-containing cell wall; Biological process =proteolysis
  Homolog annotation: Hit_ID=Q1SJD1; Match level="QueryCoverage=99%, HitCoverage=94%, E-value=1e-174, Identity=76%"; Hit description =Peptidase aspartic, active site; Immunoglobulin/major histocompatibil ity complex
  Pfam annotation: Domain name=Asp; Domain location=76-382; Score= -145.0; E_value=4.8e-05; Accession=PF00026.14; Description=Eukaryotic aspartyl protease
  Subcellular localization annotation: CTP_CleavageSite=58; ConfidenceScore=5.73e-01
MKSWKLGFLVLLVLFSTSTCSAWFGSKHKSSSGRSSFHPDEASSSSSSSSPYILNRFRAGSSVVFPVHGNVYPVGFYNVTLNIGQPPRPYFLDIDTGSDLTWLQCDAPCSRCSQTPHPLYRPSNDFVPCRHSLCASLHHSDNYDCEVPHQCDYEVQYADHYSSLGVLLHDVYTLNFTNGVQLKVRMALGCGYDQIFPDPSHHPLDGMLGLGRGKTSLTSQLNSQGLVRNVIGHCLSAQGGGYIFFGDVYDSSRLTWTPMSSRDYKHYSAAGAAELLFGGKKSGIGSLHAVFDTGSSYTYFNPYAYQALISWLGKESGGKPLKEAHDDQTLPLCWRGRRPFRSIYEVRKYFKPIVLSFTSNGRSKAQFEMPPEAYLIISVSST

SEQ ID NO: 209620 - protein, 193 aa, Glycine max
  Coding DNA Sequence Number=SeqID_92842
  Gene Ontology: Mol. function=methyltransferase activity; Cellular component=nucleus; Biological process=fatty acid biosynthetic process
  Homolog annotation: Hit_ID=Q56ZV4; Match level="QueryCoverage=96%, HitCoverage=52%, E-value=9e-80, Identity=74%"; Hit description=S -adenosyl-L-methionine:salicylic acid carboxyl methyltransferase-like protein
  Pfam annotation: Domain name=Methyltransf_7; Domain location=1-188; Score=51.9; E_value=1.8e-18; Accession=PF03492.6; Description=SAM dependent carboxyl methyltransferase
VEDKRSSAYNKGRVFIHGAGESTANAYKKQFQTDLAGFLRARTSVDPTDQGGAGLLFGTHFQDAWDDLVQEGLISQEKRDDFNIPVYAASLQDFKEVVEANGSFAIDKLEVFKGGSPLVVNQPDDASEVGRALANSCRTVSGVLVDAHIGDKLSEELFLRVERRATSHAKELLEQLQFFHIVASLSFAQMIRD

SEQ ID NO: 209621 - protein, 78 aa, Glycine max
  Coding DNA Sequence Number=SeqID_92843
  Subcellular localization annotation: CTP_CleavageSite=37; ConfidenceScore=5.41e-01
MHGATTISAFVRDVPRGAGVAIPTSAFPFGDMALKTPASMASCSWRQSNWQLTCRCSFLAIAGRATAVSEKRNYGWRQ

SEQ ID NO: 209622 - protein, 68 aa, Glycine max
  Coding DNA Sequence Number=SeqID_92844
MNSVITVLYFNGRVYEDNDGAIFESSKKEIQIKRGISFNALKKKIGDKENILPCKFVMTKTLKQCWKV

SEQ ID NO: 209623 - protein, 295 aa, Glycine max
  Coding DNA Sequence Number=SeqID_92845
  Gene Ontology: Mol. function=hydrolase activity; Cellular component =cytoplasm
  Homolog annotation: Hit_ID=Q9LUG8; Match level="QueryCoverage=99%, HitCoverage=100%, E-value=5e-64, Identity=62%"; Hit description =Similarity to endo-1
  Pfam annotation: Domain name=DLH; Domain location=93-294; Score=25.9; E_value=4.8e-09; Accession=PF01738.9; Description=Dienelactone hydrolase family
MSGPECCSNSPVLNPNAGAGHVEKLAALDSYLSGSPNSIAILLVSDVFGYEAPNLREIIKEHLFQHILINYAANRIWMFHSALFANSLFLHFCDAKCSIPLGSNTVSSLMLRNIADKVAAAGYYVVVPDFFYGDPYNPENASRPLSVWLKDHGTDKGSEAAKSIIEALKSKGVTAIGAAGFCWGGKVVVELAKSRLIQADVLLHPAFVSVDDIKGVDIPTAVLGAEIDKMSPPELVKQFEQVLTAKPGVVDCFVKIFPKVSHGWTVRYNPEDAEAVKAAEEAHQDMLNWFAKHLK

SEQ ID NO: 209624 - protein, 70 aa, Glycine max
  Coding DNA Sequence Number=SeqID_92846
  Gene Ontology: Mol. function=structural constituent of ribosome; Cellular component=ribonucleoprotein complex; Biological process =translation
  Homolog annotation: Hit_ID=P16181; Match level="QueryCoverage=53%, HitCoverage=23%, E-value=6e-08, Identity=71%"; Hit description=40S ribosomal protein S11-1
MEFVFVEFVSATYRLSSKKTRKGKSLEKGGNRFWKSIVVGFKTPREAIEGDFFVFFSRYQAHEVIDLAKS

SEQ ID NO: 209625 - protein, 306 aa, Glycine max
  Coding DNA Sequence Number=SeqID_92847
  Gene Ontology: Mol. function=transmembrane receptor activity; Cellular component=membrane; Biological process=defense response
  Homolog annotation: Hit_ID=Q1SGR7; Match level="QueryCoverage=89%, HitCoverage=24%, E-value=2e-61, Identity=50%"; Hit description=TIR; Disease resistance protein; AAA ATPase
  Pfam annotation: Domain name=LRR_1; Domain location=179-200; Score =1.8; E_value=1.3e+02; Accession=PF00560.23; Description=Leucine Rich Repeat
  Pfam annotation: Domain name=LRR_1; Domain location=202-223; Score =8.0; E_value=9.1; Accession=PF00560.23; Description=Leucine Rich Repeat
  Pfam annotation: Domain name=LRR_1; Domain location=225-247; Score =12.1; E_value=1.6; Accession=PF00560.23; Description=Leucine Rich Repeat
  Pfam annotation: Domain name=LRR_3; Domain location=179-198; Score =32.7; E_value=1.2e-06; Accession=PF07725.3; Description=Leucine Rich Repeat
  Pfam module annotation: Pfam domain module=LRR_1::LRR_1::LRR_1::LRR _3; Domain location=179-200::202-223::225-247::179-198
MEKEIFLDIVCFFLSGQFQDYDRRSIPPEKILGYRGFYPKIGMKVLVEKSLISFDRYSNIQMHDLLKELGKIIVREKAPKQPRKWSRLWDYKDLQKVMIENKEAKNLEAICICNEKYQDEFLQQTMKVDALSKMIHLKLLMLKNVNFSGILNYLSNELRYLYWDNYPFLSMPSSFHPDQLVELILPYSNIKQLWKDTKHLPNLKDLDLSHSQNLIEMPDLSGVPHLRNLNLQGCTKIVRIDPSIGTLRELDSLNLRNFLLRSLISQAVQNYLLIGCYRNQGRQNIWKKLMKIEVPSNYQHPLYTKC

SEQ ID NO: 209626 - protein, 77 aa, Glycine max
  Coding DNA Sequence Number=SeqID_92848
  Subcellular localization annotation: CTP_CleavageSite=58; ConfidenceScore=5.37e-01
MKLGGRQKYPTGYPYKLYFAIHKTQKHDSMQRLTSSTAPFVNRGVSLWFLLSSSGNIQAQRRARFFSAGQGRSTAMA

SEQ ID NO: 209627 - protein, 75 aa, Glycine max
  Coding DNA Sequence Number=SeqID_92849
MMGWYHYSARHTMVMKSGYIEGFGDIYLGEGRYAIFDGVDGIFMVFKYDDEEHAKESWNKITKKYNNPFKLKYFK

SEQ ID NO: 209628 - protein, 278 aa, Glycine max
  Coding DNA Sequence Number=SeqID_92850
MLPLKLVRSLVLGETINHNPHHILTQNHHHNSDDENKTYGTSKPHHHTRRRRRRRKYKTPGLIFLPTKEIIRDTYRLATIARDLGLDLYPTPSLSHIIFSNPSSSKPSSLSISSSSSSSCSLPSDAVPIPFPSLSATPLAHLRCFLTLSPRAFKIVLFNSDHHPDAAGTAGNWDCGSFSLYSRVVGVRVDTMEEFCRILAGKGWSFYKTKKNPSSDQRRGGAFYLFRRVDVNRVRVGALVDGACRVRELRLPHLDFGNAPLRILQYILLMTDDIFCLA

SEQ ID NO: 209629 - protein, 82 aa, Glycine max
  Coding DNA Sequence Number=SeqID_92851
MERLFVEGNEPEKLAEEFSVDVERYAMTAGCICLRLMTNGSRWDILIHSTPVQNWKMMVVPPSVWSSMNAVTVDQLLKRMLP

SEQ ID NO: 209630 - protein, 125 aa, Glycine max
  Coding DNA Sequence Number=SeqID_92852
  Gene Ontology: Mol. function=protein serine/threonine kinase activity; Cellular component=mediator complex; Biological process =protein amino acid phosphorylation
  Homolog annotation: Hit_ID=P93322; Match level="QueryCoverage=93%, HitCoverage=29%, E-value=8e-39, Identity=68%"; Hit description =Cdc2MsE protein
MSEFRLMLQLPREITHENVVKLVKVHINHMDMSLYLAFDYAEHDLYEIIKHHWDKVNQSINQYTVKSLLWQLLNGLNYLHRQVVLFLKLKTVMGEGEEHGIVKIADFGLARIYQAPLKPLFENGV

SEQ ID NO: 209631 - protein, 318 aa, Glycine max
  Coding DNA Sequence Number=SeqID_92853
  Homolog annotation: Hit_ID=Q67U54; Match level="QueryCoverage=83%, HitCoverage=83%, E-value=1e-94, Identity=60%"; Hit description=Plant viral-response family protein-like
  Pfam annotation: Domain name=DUF716; Domain location=111-266; Score =228.0; E_value=2.1e-65; Accession=PF04819.3; Description=Family of unknown function (DUF716)
MGTLVGHVAPGFGFLLIGLWHLFNHIKLHALNPKSYKGPSWFPSAKFRYIELVLIMVGSTASVAMELFIGPERHQPLDPDGTIPSNHLHNFEHSSISITFFLYAACAIILDRARVQAQFELTQLLGAIAFAQQLLLFHLHSADHMGPEGQYHLLLQILVFVSVSTALIGIVLPHSFLVNFVRSVSIFFQGLWLIVMGFMLWTPSLIPKGCYMNDEDGHMVVRCSSHEALHRAISLVNIEFSWFIIGVTVFAVSLYLVLVKVYGEKKVEYFSLGNEDEESNDDVESQKSGAFDHSSKSFIQVGKIFSQNDMERCLLIRS

SEQ ID NO: 209632 - protein, 316 aa, Glycine max
  Coding DNA Sequence Number=SeqID_92854
  Homolog annotation: Hit_ID=Q67U54; Match level="QueryCoverage=78%, HitCoverage=77%, E-value=1e-83, Identity=58%"; Hit description=Plant viral-response family protein-like
  Pfam annotation: Domain name=DUF716; Domain location=118-273; Score =227.1; E_value=3.8e-65; Accession=PF04819.3; Description=Family of unknown function (DUF716)
MLCVYQELNALKITKNSWCAVLQKGLWHLFNHIKLHALSPKSYKGPSWFPSAKFRYIELVLIMVGSTASVATEFFIGPERHQPLDPDGTIPSNHLHNFEHSSISITFFLYAACAIILDRARVQTQFELTQLLGAIAFAQQLLLFHLHSADHMGPEGQYHLLLQNLVFVSVSTALIGIVLPHSFLVNFVRSVSIFFQGLWLIVMGFMLWTPSLIPKGCYMNDEDGHMVVRCSSHEALHRAISLVNIEFSWLIIVVTVFAVSLYLVLFNLYGEKKVEYFSLGSEDEESNNDVESQESGTFDHNSKSFIHTYGQILFSK

SEQ ID NO: 209633 - protein, 70 aa, Glycine max
  Coding DNA Sequence Number=SeqID_92855
  Gene Ontology: Mol. function=DNA binding
MVKSFERFSSVESTKIFLSLQACMIEIMKTKGSNNYKIPHIQKGVMQRQGTLPTQLKCEISLVEEVMHHI

SEQ ID NO: 209634 - protein, 649 aa, Glycine max
  Coding DNA Sequence Number=SeqID_92856
  Homolog annotation: Hit_ID=Q8LLE5; Match level="QueryCoverage=87%, HitCoverage=94%, E-value=1e-96, Identity=42%"; Hit description =Coiled-coil protein
  Pfam annotation: Domain name=DUF869; Domain location=80-580; Score =339.9; E_value=4.4e-99; Accession=PF05911.2; Description=Plant protein of unknown function (DUF869)
MDRRSWPWRRKSSEKSPGETESSGSMSSHSERFFDDQVYPTQTTPPPEGMFEAAPNDEEANDVKTLTERLSAALLNSRAKEDLAKQHAKVAEEAVSGWEKAENELLILKQQLIDGKQQNSVLEDQVSHLNEALKECMRNLRQAKEEQEQKIHEALTNNSYGLESKRPDHEWKVVVAAKADAAASSVHLDLQQRLEGKEKENASLKIELQSRLEELEFRTIERNLSTQAAEAASKQHLESIKTVAKLEAECRRLKAVTRKTLSANDHRSLASSSVYVESFTDSMSDIGERQLIVESDMRKLGGWDMNEGEPNHHDSWPSTLIKELDQFKNENTAGKNSMVFSTEINLMDDFLEMERLVALPDTESVSSFPVEGAASDQLNVGPRTKNAEVEAIVQKNAALEKKLEKMEAEKLELEMDLTECQKQLEASLSRIKEVELEVVELQTKLALANNSNEEAYEKLEATEEKKEIAESKLRVAHTEAEELVSKICSLEEEIEKERALSTENMAKCGKLEDELLRIKNEAQLHKDTLILPGEGVNSELKQEKELALAASKFAECRKTIESLGLQLKSLATLEDFLLDSESPMELTCEVTQPGFQNGGEQLKKLHNGDLNLSKRDSKASVSPFEKTHNSFGRFNFNPRSKSVSKTRSH

SEQ ID NO: 209635 - protein, 68 aa, Glycine max
  Coding DNA Sequence Number=SeqID_92857
MGPSKIGKMKFESQRGIVTPMRWRPLVIKLGTCYFKCWGVRPAHENHAMYFVGEARFIAIRAKAMSLE

SEQ ID NO: 209636 - protein, 58 aa, Glycine max
  Coding DNA Sequence Number=SeqID_92858
MGRRFSKLRRMVRQQRGKFYIMRAFCFVPCHGKTIVIDENSKVWVNATVYKALPGAEN

SEQ ID NO: 209637 - protein, 176 aa, Glycine max
  Coding DNA Sequence Number=SeqID_92859
MYPPYHLPFRNHLHYQLNVCPQRRWQSIVRRGFASIAKRSSVKGTNIHPKLFCFHTGSGHLMRSAYTPTIITGPSGSSGTTQEEKFNDHRHSFRDRPNPYVSSVPHYPITSTLTHVPPLLPSLSKPPPLPIKCMPPEEMAIHREKGLCFNCKEKFSQGHKYSSNFFLLLIDEVDNQ

SEQ ID NO: 209638 - protein, 194 aa, Glycine max
  Coding DNA Sequence Number=SeqID_92860
  Gene Ontology: Mol. function=nucleic acid binding
  Homolog annotation: Hit_ID=Q8LDS0; Match level="QueryCoverage=55%, HitCoverage=71%, E-value=3e-08, Identity=37%"; Hit description =Glycine-rich RNA binding protein, putative
  Pfam annotation: Domain name=RRM_1; Domain location=98-175; Score =47.2; E_value=5.6e-11; Accession=PF00076.12; Description=RNA recognition motif. (a.k.a. RRM, R
MAQQVQVFTTCYCPPPQYEYLRRIGISKQLKCATIPSLSVSASSVLRNASFCCTSSVHCNLPSSPKIFVKEKLLLNPKKTSLLGMQSYMLEFHKFSGILGRLPLSTSEGRLMKVFSEFGDVTLEFGEVTLVQLPIDRESGQSLGFAYIWFVKEESAQLAVQEMNGKFFDGRFIYVTIAKPGSSKSSKRTTAYKF

SEQ ID NO: 209639 - protein, 204 aa, Glycine max
  Coding DNA Sequence Number=SeqID_92861
  Gene Ontology: Mol. function=RNA-directed DNA polymerase activity; Cellular component=chromatin; Biological process=RNA-dependent DNA replication
MIIRLSTSPFSSPVLLVKKRDGSWRFCVDYHAFNAITVKDCLPISTIDELLDELGGACWFSKLDLLQGYHQTLMKEKDMSKTSLITHRDHYEFHVIPFKLCNAPSSFQATMNKPCECGSNVFQDYFDDVKESRVKKVPNNQESKSFKNQVSKNQDSRIIKFQDSIKFQESRFKNNQDQDSRLKIQESREDSIKISTKKVFQNIE

SEQ ID NO: 209640 - protein, 65 aa, Glycine max
  Coding DNA Sequence Number=SeqID_92862
  Subcellular localization annotation: CTP_CleavageSite=39; ConfidenceScore=5.11e-01
MVDLSSDTVVRGSHALSGKSIRCPWPRVSSGCQRAKFIPCQLLSVGDAQRSRRRHLKIPRSEIHL

SEQ ID NO: 209641 - protein, 288 aa, Glycine max
  Coding DNA Sequence Number=SeqID_92863
  Gene Ontology: Mol. function=RNA-directed DNA polymerase activity; Cellular component=chromatin; Biological process=chromatin assembly or disassembly
  Pfam annotation: Domain name=rve; Domain location=52-192; Score=-0.0; E_value=0.006; Accession=PF00665.16; Description=Integrase core domain
  Pfam annotation: Domain name=zf-H2C2; Domain location=1-34; Score =5.2; E_value=0.074; Accession=PF09337.1; Description=His(2)-Cys(2) zinc finger
  Pfam module annotation: Pfam domain module=rve::zf-H2C2; Domain location=52-192::1-34
MGITKTLACMGENFIWPRIKNDVRQFIVVCIDYQHTKYNTRKQVGLLCPLAIHSRPWEDLSLDFIVGLPAYGGHTIVLVVLDHFSKGIHLGMLQSNYMTYIVAFLFMEIVAKIHGMPRNLVLDRDPLFISRFWKELFKLSGTKLCVSPYEVTSGKKPPSIPQYIAVTSNIEAVDEFFVNHKAMFNSLKKKFFSSILKPCHQPSISAGTTVELLPTIVDNQPVISPLVILNTRWDHPEVEGISPNDTSWEDWGSLKTAYHLEDKVLFDEGGDVKKGIMHQPGTTGTSMN

SEQ ID NO: 209642 - protein, 147 aa, Glycine max
  Coding DNA Sequence Number=SeqID_92864
MKFMETQLSTMKDLLSQRAPKTLPSQIEVNPKNEEFNVVSTSIGKPMVESKKTKKATPTLEKEALTEESHKIEKVGEKRVLAPPQKLGLQELLPTKVYLQLVDRTLTYPQRSLKTWKSLWLGISQVWEGKHFGRKHHSKKPLKWHEG

SEQ ID NO: 209643 - protein, 315 aa, Glycine max
  Coding DNA Sequence Number=SeqID_92865
  Homolog annotation: Hit_ID=Q1RW27; Match level="QueryCoverage=39%, HitCoverage=19%, E-value=8e-23, Identity=61%"; Hit description =Octicosapeptide/Phox/Bem1p; CBS
  Pfam annotation: Domain name=PB1; Domain location=12-93; Score=6.7; E_ value=0.048; Accession=PF00564.15; Description=PB1 domain
MAMCIDSTVVSDILGKALQELKSTDLHISGAEHQELLSAVMQRIGDINDGEHPTMLDDDGDKIIIATDNDLVAAVSYARSAGLKALKLDLEFPNSTKPTKLQPGTATIQKTSTLRLRSVCMLEALSLDDFDAKWKELVDKYKLSENSWIHRMYEKRHKWEEAYFRGHFCAGLKSTRAVNEVRWNEGKVEYDATHVRFALPTPHHYLPRVSNDVVARMMRFGNMMSLSSVPCYLASTSDQLFIVVHNRFQKLLDEVNEFSSAPDASNSDALNEKGGAPVSSERSKGDDALSRNVEQIKHGCPELINAVISVAEKVP

SEQ ID NO: 209644 - protein, 768 aa, Glycine max
  Coding DNA Sequence Number=SeqID_92866
  Gene Ontology: Cellular component=mitochondrion
  Homolog annotation: Hit_ID=Q1RW25; Match level="QueryCoverage=95%, HitCoverage=94%, E-value=0.0, Identity=69%"; Hit description =Streptomyces cyclase/dehydrase
  Pfam annotation: Domain name=Polyketide_cyc; Domain location=356-509; Score=59.7; E_value=9.9e-15; Accession=PF03364.10; Description =Streptomyces cyclasedehydrase
  Pfam annotation: Domain name=Polyketide_cyc; Domain location=95-230; Score=67.9; E_value=3.3e-17; Accession=PF03364.10; Description =Streptomyces cyclasedehydrase
  Pfam module annotation: Pfam domain module=Polyketide_cyc::Polyketide_ cyc; Domain location=356-509::95-230
  Subcellular localization annotation: CTP_CleavageSite=43; ConfidenceScore=5.73e-01
MIASTSTNVGPHPLRFLSKPTTHSSTRFLSLRLHSRGSAVALSSSTRTTPLKPTCHFNGKDGSFEQHEEEGEREVHCEVQVISWRERRVNAQITVDADTESVWNALTDYEHLADFIPNLVWSGRIPCPYPGRIWLEQRGFQRAMYWHIEARVVLDLQEVVNSAWDRELHFSMVDGDFKKFDGKWSVKSGTRSSTAILSYEVNVIPRFNFPAIFLERIIRSDLPVNLRALAYRAERNFVGYQKLPVSENHLHKTYVAINGSSVKKINGALSESFKKMNGALCESDKLPPAENKKEIATSVSGSMLTSSSEVRSNWGVFGKVCRLDRPRMVDEVHLRRFDGLLENGGVHRCVVASITVKAHVCEVWNILTAYETLPKIVPNLAISKVVSRDNNKVRILQRVFYYHYPQSVNQTCILSLITMEGCKGLLYMVLHARVVLDLCEYLEQEISFEQVEGDFDSFRGKWIFEQLGNHHTLLKYSVESKMRKDTFLSEAIMEEVIYEDLPSNLSAIRDYIENMNASKYSEVCEQNMNSGQQILSSGYLKDDNSGSAEEVPNCDVQCSSQQRSKVPGLQRNIKVLESELLKFIAEHGQEGFMPMRKQLRLHGRVDIEKAITRMGGFRKIATILNLSLAYKHRKPKGYWDNLENLQEEISRFQRGWGIDPSFMPSRKSFERAGRYDIARALEKWGGLHEVSRLLSLKVRQRSRQDNLAKDKRSGDHTDSEMKTPLRLYDSSPRHSPLPCLGLFHMHFVYPDEEKERRLGVVYDTTYIN

SEQ ID NO: 209645 - protein, 292 aa, Glycine max
  Coding DNA Sequence Number=SeqID_92867
  Gene Ontology: Mol. function=adenylate dimethylallyltransferase activity; Cellular component=intracellular; Biological process=tRNA processing
  Homolog annotation: Hit_ID=Q2MHM8; Match level="QueryCoverage=93%, HitCoverage=84%, E-value=1e-109, Identity=70%"; Hit description =Adenylate isopentenyltransferase
  Pfam annotation: Domain name=IPPT; Domain location=30-229; Score =13.2; E_value=9e-12; Accession=PF01715.8; Description=IPP transferase
  Pfam annotation: Domain name=IPT; Domain location=2-223; Score= -118.8; E_value=0.0018; Accession=PF01745.7; Description=Isopentenyl transferase
  Pfam module annotation: Pfam domain module=IPPT::IPT; Domain location= 30-229::2-223
MGATGTGKSKLAIELATQFPPAEIVNSDKMQVYEGLNITTNKVTEEERRGVPHHLLGTVNPNTSFTAQDFCDQATLAVGSILGRDGLPIIAGGSNSFLDALVNHHTEFRLRYDCCFLWVDVSLPVLHSSLSARVDRMIHSGQLHEVRQSFQYHNQDYTLGIRKAIGVPEFHDFFRAEADGADQRTKQRLLQAAIASLKTNNCTLAKRQLQKIHRLYSMWKRNMHRLDATEVFLKTTRQEAEEAWEDHVLSKTRRILHKFLYEDTHVVPAGIASVVIASSPPPMPATAAAATH

SEQ ID NO: 209646 - protein, 70 aa, Glycine max
  Coding DNA Sequence Number=SeqID_92868
MEAIHQRLPIILLTYPQHNLQLLQPLSHEFEDLARLRNDVVAEGEEAHEVVMVQDEVGLNMRADLEGLQL

SEQ ID NO: 209647 - protein, 266 aa, Glycine max
  Coding DNA Sequence Number=SeqID_92869
  Homolog annotation: Hit_ID=Q1T5L0; Match level="QueryCoverage=43%, HitCoverage=9%, E-value=2e-30, Identity=64%"; Hit description=Actin -binding FH2; Quinonprotein alcohol dehydrogenase-like
MFISLDARESCGEDGHNKESNKEKSLWVPKTWRIDDSKAAKSSIRATLGIKNDKANLVPGETLFKSFPSKHDENMIMQASPVLQASPAALSRCSKLIWQCSSGPMGNTCCKGILPTEERAGWFFMHFLLRVTTKILSRTISSKNNTKKLKPLHWLRLSRAVEGSLWAKTQNLAKLLSNVDWLWAPKIDMLDLESLFLAEVFSSPAKKSNVQSSTGPKYDKVQQLIKHRRAYNCEIMLSKVKVSLDDLMSLKKMTFFIKIVILEVLI

SEQ ID NO: 209648 - protein, 154 aa, Glycine max
  Coding DNA Sequence Number=SeqID_92870
  Homolog annotation: Hit_ID=Q1SDG1; Match level="QueryCoverage=39%, HitCoverage=5%, E-value=1e-07, Identity=40%"; Hit description =Integrase, catalytic region; Zinc finger, CCHC-type
MDGGAKTQIPAQRQGSEYDVVCFIRRRIHQGTQLQKCQTNVGHYSCNIQRNIIGKDEQTQSPHWKWRPQVTTLKALKNLDSMFLEELVGTLKVHEQELQQDEGIKREKSLSLSSQKNKKASPSKAQVPRCLSKVLKVDDESEEDSNEDELTFIS

SEQ ID NO: 209649 - protein, 94 aa, Glycine max
  Coding DNA Sequence Number=SeqID_92871
MGEELRLSCRDLGQHSEQEYSPQSRLKNNINRSSQTALMNKMLRDEGVYHVFNKMDDDSKHTLIAKAVGTSAPQRLKNLSETNEENEEFVEVAL

SEQ ID NO: 209650 - protein, 114 aa, Glycine max
  Coding DNA Sequence Number=SeqID_92872
  Gene Ontology: Mol. function=nucleic acid binding; Biological process= DNA integration
  Homolog annotation: Hit_ID=Q1S9I4; Match level="QueryCoverage=99%, HitCoverage=13%, E-value=9e-12, Identity=33%"; Hit description =Integrase, catalytic region; Zinc finger, CCHC-type
MARTMLNDNSTPKHFWVEVVNTASTSSSRHNPETEASTQQEVQEEVKEPIRCILRRNHLEIQIIGDPIDHVQTRLSLRTQGHIALISEMEPKLIDDAMQDDNWIKAMQEELHQF

SEQ ID NO: 209651 - protein, 235 aa, Glycine max
  Coding DNA Sequence Number=SeqID_92873
  Pfam annotation: Domain name=zf-CCHC; Domain location=100-117; Score =24.6; E_value=8.6e-05; Accession=PF00098.13; Description=Zinc knuckle
  Pfam annotation: Domain name=zf-CCHC; Domain location=13-30; Score =22.9; E_value=0.00017; Accession=PF00098.13; Description=Zinc knuckle
  Pfam module annotation: Pfam domain module=zf-CCHC::zf-CCHC; Domain location=100-117::13-30
MPKEKKDKDKSSIICYECKKSGHFKYECPGLEKGQDKKKYFKFKEKKDWDNCQGKNYSSQELQELEKNLKDLQNDLKELNELHDYQKEERKVYVHDKDTIVCYLCGKIGHMISKCKDRPKKATINTFMDNTKGPKKIWLPKKKIIHVADALDNRKQTTILGTSFVIQVEGTSTWVVVAENKRGYISCGSVQVEGTSTWLFKENKGGYIPCGSLLVKVFTRLKRNLKDRRLLGDWM

SEQ ID NO: 209652 - protein, 105 aa, Glycine max
  Coding DNA Sequence Number=SeqID_92874
MMLPCLVMILYIQNLQWGEVDEEEDLSNIQDKGSSCTVMVSLEFVKEDEYFTVVVSKSQQKKFHKIKKQVDKAYLIPISIRGWDLKLLLDEGFILECKRCGYCLG

SEQ ID NO: 209653 - protein, 110 aa, Glycine max
  Coding DNA Sequence Number=SeqID_92875
MLTRRLRKGQREKAIIEAEDATQTLMDYCTPHLKETNNIQLPTLPQGMIESNMFSGASYEDPMMHLWRIRKHTNKLLRDIGNFTQSEQENLFRSLGKILGVDKELPTSWV

SEQ ID NO: 209654 - protein, 60 aa, Glycine max
  Coding DNA Sequence Number=SeqID_92876
MVEVRLGRLTLWLGNTLNDPFERVLTHEDSEWAISPDEEEVLMLLQAQPVSNPHRFERLE

SEQ ID NO: 209655 - protein, 128 aa, Glycine max
  Coding DNA Sequence Number=SeqID_92877
MQEVLMQYISQNDLHMKLVETQLSSIHSLLSQTAPSTLPSQTKINPKKKHVRAIMTRSKKARENMKQNGGSTSDATKEVFTKENLVPEKKVEEREILTSPKVILARALEAQNQQKVLEGEIGKIEDKS

SEQ ID NO: 209656 - protein, 120 aa, Glycine max
  Coding DNA Sequence Number=SeqID_92878
MEGELAQAMDEFKYVGELIHKRCTLSCSQLTTQVDVPSTCTTKDVPSNVLRQSSQALSPSKLCEGGNKRILKREKGDTKEFKRLVHHSFGKGRRETQKEFRRLVLGEFFLAKGEGNEKDE

SEQ ID NO: 209657 - protein, 61 aa, Glycine max
  Coding DNA Sequence Number=SeqID_92879
MVFPKEPGSIPFPTLGLKKPPLEEKLEDVKAHPWVKKQVVAYPPILHVKESIEFKFYPDRI

SEQ ID NO: 209658 - protein, 273 aa, Glycine max
  Coding DNA Sequence Number=SeqID_92880
  Gene Ontology: Cellular component=vacuole
  Homolog annotation: Hit_ID=Q1SKH2; Match level="QueryCoverage=96%, HitCoverage=24%, E-value=4e-27, Identity=32%"; Hit description =Calcium-binding EF-hand
ADLSNGEVESEADPSQGAVHSEVEPSNDAMEGEAKPSQGAVETKAEPSQDAVESKASLSNGALNREAETASGAMESEAKTSSGAVETEFKPSHDVVESEAKPPNGVAETESEPSVDVCQTKKDVVNSKAETSSGALQSEREACVMSEMKNNAVESEAQPSVDVNHKKTIAINSEAELSVKGGLFVESEGSNQGDEDSRLASDALDGQNVGTKEKTKIQDAIRIERQTIKLRATIAAHRAARDLLKSKRWEIDLVQSIMNRLNNAIYVGDIDGK

SEQ ID NO: 209659 - protein, 164 aa, Glycine max
  Coding DNA Sequence Number=SeqID_92881
  Homolog annotation: Hit_ID=Q1SE16; Match level="QueryCoverage=95%, HitCoverage=36%, E-value=5e-22, Identity=40%"; Hit description=Amino acid/polyamine transporter II
GTKALKKMKNSASESGLYIIESDEDVEKDMQKDENDGNDSDYSNDSNGNLSMRKPSNYSIAWPQSYRQSIDLYGSVPSPNIGFLGTTSLSRLSSSFISSSLTRRHTLEVLQPEKKPLLQPTEEEQPRHTLLPPQISRKSSIKISKVSHEPHIPGQCTFGQAVLN

SEQ ID NO: 209660 - protein, 114 aa, Glycine max
  Coding DNA Sequence Number=SeqID_92882
  Gene Ontology: Mol. function=RNA-directed DNA polymerase activity; Biological process=RNA-dependent DNA replication
MIFVYHGHAITIQGSITPGPSESLMDRLSASCPHSKLRPYSTSNFRWNWHKVSTKRMAEHDILKTTFRTYQGHYEYVVMPFGLCNAPSTFQATMDADVILTKSGSLDTGYGDFG

SEQ ID NO: 209661 - protein, 343 aa, Glycine max
  Coding DNA Sequence Number=SeqID_92883
  Gene Ontology: Mol. function=RNA-directed DNA polymerase activity; Cellular component=chromatin; Biological process=RNA-dependent DNA replication
  Pfam annotation: Domain name=rve; Domain location=185-333; Score =14.2; E_value=0.00039; Accession=PF00665.16; Description=Integrase core domain
MPVSSSPKSLHSFLDLTRFYRCFVKNYAEIANPLTHLLRKDQFKWSPEAQMAFDALKQAMTTTPVLSLPDFSVPFIVETDTSGTGMGAVLMQQGHPIAFFSKQFCSKFLRSSTYIHELHAITTVVKRWCQYLLGHAFVILIDHKSLHELMTQLVQTPEQHMQCTDCLQTKYVHQNPAGLLQPVPPPSQSWEDLALDFITSLPNFKGATVIMTIVDRFSKGPHFGTLSTHFMAHMVVQLFINLVCKLHGFPRSLISNRDPIFISRFWCELFRLSGTKLRMSTAYHPRATARRRCSTASWNSTMCHSSTNLSPYEVTYNKPLSGIPDYLPGSSIVEAVDFLLSSR

SEQ ID NO: 209662 - protein, 72 aa, Glycine max
  Coding DNA Sequence Number=SeqID_92884
MVKIFDVTLAKNAFGRFQVKGPLLQSSYDTIEMAENRAFDENPETGQIHAKGPSGEGRRPKWRRTKPPSGEG

SEQ ID NO: 209663 - protein, 257 aa, Glycine max
  Coding DNA Sequence Number=SeqID_92885
  Gene Ontology: Mol. function=transferase activity; Biological process= DNA integration
MAATYEIEKFNEDAIEGIPTHIIDERSKEMDENAIANLHLTMENVKDIWDTFHKLYEIKSLQTRIFLKRKLCTLRTTILEEECRRKNKKDRLENSKQVEALTMTRGRSTKRGSTGSQNHGFVFMGNDHALEIVGVGTIKLKMYDGIVRTIQGVLHVKGLKKNQLFVGKLDDLECKIHIEGEILMGSFMYVMICTKPNIAQAMRAISRFMVDLGKEHWSVVKRILRYINGTSGVALCSEGSKFIVMGYVNSDFVGDLD

SEQ ID NO: 209664 - protein, 188 aa, Glycine max
  Coding DNA Sequence Number=SeqID_92886
GMMRIMKLAKYRLKAQVEKDEGLSGEGQSPRVEKDEGPSNPCGVYPDLSSFTGSGVYPDLSSFTGSGVYPDLSSFTGSGVYPDLSSFTGSGVIQTFVACIKRSTPTQIDWAHLVRYRMLKALRANAPLPYPQLITLFLRHFQIPFDDEPFVQVKRSFAIGAGAVTSFGYRKDRNVQWLKKDALPPQDE

SEQ ID NO: 209665 - protein, 120 aa, Glycine max
  Coding DNA Sequence Number=SeqID_92887
MKQANVFPLKKTLKKFIIWEINSDKGILKEDFQASYKVPIINKDSGGHTLVAMSNHKSTESALKNLEVQNPKEECKVVMTSKRFVEAEDEDSVVHKKKTADKKGTDCKKNKVRGESNQEK

SEQ ID NO: 209666 - protein, 81 aa, Glycine max
  Coding DNA Sequence Number=SeqID_92888
MSSGCLLVDPNGQKLVLFECCITWMLGKLGRIDGDPVLRETRIWAMWEYVSSVGGGQQGMVGLCALCGCGKLVVHHIPTAT

SEQ ID NO: 209667 - protein, 89 aa, Glycine max
  Coding DNA Sequence Number=SeqID_92889
  Subcellular localization annotation: CTP_CleavageSite=36; ConfidenceScore=5.19e-01
MRERVLQISIFPPILLIPPLYWCSVQSSALHSLCRRCSVLAPSLAPGVSVVSEPQGSRRTRWGRRRLCNPPWYIILVNFIEDETCWRRC

SEQ ID NO: 209668 - protein, 103 aa, Glycine max
  Coding DNA Sequence Number=SeqID_92890
  Homolog annotation: Hit_ID=Q00M75; Match level="QueryCoverage=34%, HitCoverage=5%, E-value=1e-09, Identity=86%"; Hit description=PPR -repeat containing protein
MQAIERLRLKAMSDATKPSLIGELPSSKVVCGGYHTCVLTNSGELYTWVQMKMAALRLFAMRRYGGGMLYAALPLHMQRGCFRIRTHDQQVTKAQLYRCTRAR

SEQ ID NO: 209669 - protein, 180 aa, Glycine max
  Coding DNA Sequence Number=SeqID_92891
  Gene Ontology: Mol. function=ubiquitin-protein ligase activity; Cellular component=intracellular; Biological process=protein modification process
  Homolog annotation: Hit_ID=Q22BY0; Match level="QueryCoverage=90%, HitCoverage=13%, E-value=6e-15, Identity=37%"; Hit description =Regulator of chromosome condensation
  Pfam annotation: Domain name=RCC1; Domain location=15-64; Score=26.5; E_value=9.2e-05; Accession=PF00415.9; Description=Regulator of chromosome condensation (RCC1)
  Pfam annotation: Domain name=RCC1; Domain location=67-118; Score=6.7; E_value=0.13; Accession=PF00415.9; Description=Regulator of chromosome condensation (RCC1)
  Pfam module annotation: Pfam domain module=RCC1::RCC1; Domain location=15-64::67-118
MPVLELINCSPFTDNGCVYATGLNDFGQLGVSESKHYSVEPLCVFGEEKKVVQVSAGYNHSCAITVDGELYMWGKNTSVQLGLGKRAPNIVPLPTKVEYLNGINIKMAALGSDHSLAISDMNCMMINLYDSGSNFETIHDKYGPNPTNFIMMHCGPMVERPLVGELECLVDLVMVMSQAS

SEQ ID NO: 209670 - protein, 76 aa, Glycine max
  Coding DNA Sequence Number=SeqID_92892
MTFHCFPLDLNAKPDEEEEPISCSEEASANIGGECETRPATSEPDDNIRAEVAVIDRTNVVKRGSTLRINFVFGTY

SEQ ID NO: 209671 - protein, 135 aa, Glycine max
  Coding DNA Sequence Number=SeqID_92893
REWKEEVDFLKLLFSTLFPSFQTEVKRKPKNTQFDKVEQKVNLLRRGCEHHHKQWPLGFGRGTRGRRQVSIANPSCQDPILPKSPFPHNATNLFPEALRLRWWSFKKFRRHICPERKKWMVEKGEEGGCWGEEES

SEQ ID NO: 209672 - protein, 83 aa, Glycine max
  Coding DNA Sequence Number=SeqID_92894
  Subcellular localization annotation: CTP_CleavageSite=33; ConfidenceScore=5.24e-01
MASRHLLLSLFPIAPPPLLPSKRDSTSIQTRSSFSMEWNAGERNRQGDMEKRKRREDKKERGKDTMRKRKEEQKRRNECKGKE

SEQ ID NO: 209673 - protein, 249 aa, Glycine max
  Coding DNA Sequence Number=SeqID_92895
MLLEQFERKLNSIYGCIHKSLDYLMQFRNGQIQGNNLMDVLFEKNTASTLEVGVTSHIVQNKNNLPILGNPHPPKKRRLEENQVRIPSGKKIVQGLQGTGPPQSAGWMQQALDESVRNVLTSATSTISYQPISSVTSPVSYQLPVPISSTNVKVNPGTTSHFSLNAGAFGHPYNPPSIKPHVAPQTSQDFFATGYVELYLLVTGVVVIAYHTADVLASTEGLGHVDEGVRRRGGPGSYLVPLTECCDQV

SEQ ID NO: 209674 - protein, 1888 aa, Glycine max
  Coding DNA Sequence Number=SeqID_92896
  Pfam annotation: Domain name=GYF; Domain location=525-580; Score =38.5; E_value=2.3e-08; Accession=PF02213.6; Description=GYF domain
MAQQRATSDTRPNNLAVTPPLQISKDVQGSDNPIPLSPQWLLPKPGESKPGSGSVENHVVSNSPFGHHSETVKTSGNGEDVLDTHKKKDVFRPSMFDSESGRRDRWRDEERDTKSSIRKDRWKDGDKDLGDSRRVDRRTDNLSAKNFAEARRGASDNHRWNDSGNRETNFDQRRESKWNTRWGPDDKEPEGIREKWSDSGKDGDSYLEKGLFNISNQGKDEKEGDHYRPWRPNYSQSRGRVDPSHTTPNKPASTFSYGRGRGDNTPPVSSLGHGLAGSFGSSLSSTYPGTALEKVEGGREENRPFKYNRTKLLDVYRMTGMGTDRKLVDDFVQVPNLTQDEPVEPLAFLAPNSEELTVLKGIDKGEIISSNAPQVPKDGRSSTDFTHTRRMKPGSAPFQYRGEDGGSYKVPDEVSSNRDSSVEGNSSVHPGAPWRTMPMGEHATAQFHDSRDVISDVRFRKADLNSPQPKDPHNQWENNLGYLSDPKEVAKWQANEDPVIKRQLSGILDSELETRRVPQTAPEELSLLYKDPKGLIQGPFKGIDIIGWFEVGYFGIDLPVRLENSAVDSPWFSLGDVMPHLRAKARPPPGFSAPKANDFTDVPGQQISSTFGNTLAGLNEVDILRSDSGHRQGSDTEAENRFLESLMSGSKNSPPLDNLTLSEGLQGFVGSNPGNMGPSGVDSGNNLYLLAKRMALERQRSLPNPYPYWPGRDAAASFAPKTDVVPDASLHSKLLYSVSDNSRQPQSQSSELMSIIQGLSDRMSAGLNNGAAGWPNYPLQGALDPLQNKIALLHDQNFPQMPFGIQQRLPIQNQLSLSNLLAQAADNPSNTLTAEKLLSTGLSQDPQILNMLQQQHLLQLHSQAAAQAQQMPLIDKLLLLKQQQKQEEQQQLLRQQQQLLSQVLQDQQSSQLFNNSSFGQLQGVIPLGNLRVDPSQLQPPQEIFPMSSQMPIPSVHNDHSSNSLNLPPKDSQDTSGNVSSEASIHLPHQLFGGNSCPENWGPNLTEQISEKSSQLFNNSSFGQLQGVIPMGNLCVDPSQLQPPQEIFPMSSQMPIPSVHNDHSSNSLNLPPKDSQDTIGNVSSEASIRLPHQLFGGNSCPENWGPNLTEQISEKYQNKTFPISTLVESSPLLDQNRPREEPHIGLEPHSVSDYTANSVEQLPPSNFTPDVVVTSISKPDENSGHLHCVAPTIALSSAGSNRIELPPVSGPGMEVKTKLDIVHEEQHSGRDISVSEPSPADIRSIKSHEPKKATEKKSKKQKSAKSQSSDQTKGVLKSVTSQPANQAEVEIPKLSELGEANRAESLHETNMQQTRVKGTQIGSAVIEAVDHQQAGGWSANVTGNVTGSVDVGEAKAASSIVMQKAEVPAGRAWKPAPGVKPKSFLEIQQEEQRKAETEMLVSNIAVSVNSMSLVSPWAGVVSNPDSMKVSSESHKGANTEYPVKSETSQNLKSKKSHLHDLLAEEVLKKSNEIEAEVLDSILPLHNIAVRSESVDDGNFIEAKDTKRSRKKSGKSKGSGTKASLPVASSEAPIVSSPIEKGKNSCSAQQEKEELPAIPAGPSLGDFVLWKGEREPPIPSPSPAWSTDSGRVPKPTSLRDILKEQERKGSSAIPVSPMPPPQKSQPPQSTWSSASSRSISASSPSKAASPIQINSQASQSKHKGDDDLFWGPMDQSKQDTKQSGFPQLVSQGSRGSKNVPLKGNSPGLLTRQKSVSGKPTERFLASSPASSQSVLKLKKDAMTRHSEATDFRDWCENECVRLIGTKDTSFLEFCLKQSRSEAEMLLIENLGSYDPDHQFIDKFLNYKELLPSDVLDIAFQSRNDKKVTGYGVEGTASVSADILDVDYTEGSSKGGGKKKGKKGKKVSPSVLGFNVVSNRIMMGEIQSVED

SEQ ID NO: 209675 - protein, 157 aa, Glycine max
  Coding DNA Sequence Number=SeqID_92897
  Gene Ontology: Mol. function=nucleic acid binding; Cellular component= endoplasmic reticulum membrane; Biological process=DNA integration
MSEVMRYVDSDYAGDLDDRRFTARYVFTFGGEPVCWKSIIISLVAMSTTATEYMIVAEAIKEALWLVGLVKELGIKQGGVQLHSDSHSVIDLAKNQVYQSKTKHNDVRFHKIRELMTSGQILLRMVHTSENAIDMLTNAITIRKFKHCLDLLNFAQC

SEQ ID NO: 209676 - protein, 125 aa, Glycine max
  Coding DNA Sequence Number=SeqID_92898
MKGNNYQDKLLWRSKIALPMLLRNVTFLTKDKEFLMMVLREIPLTKVEIKAQTKSGHTSHTVGVCYSKHGQPPRHPRYPERPGYHNHASSGAAANNITANAVHEATKNNGNEEDSFGLSLNVAPA

SEQ ID NO: 209677 - protein, 259 aa, Glycine max
  Coding DNA Sequence Number=SeqID_92899
  Gene Ontology: Cellular component=integral to membrane
  Homolog annotation: Hit_ID=Q2QQV3; Match level="QueryCoverage=77%, HitCoverage=78%, E-value=2e-82, Identity=71%"; Hit description =Membrane protein, putative, expressed
  Pfam annotation: Domain name=DUF502; Domain location=90-240; Score =234.5; E_value=2.3e-67; Accession=PF04367.3; Description=Protein of unknown function (DUF502)
  Subcellular localization annotation: CTP_CleavageSite=47; ConfidenceScore=5.36e-01
MASRDLELLIPVSSISENGPKSSAPSSPSVTSTQNHSSHEAFSKVIRSWASKKFMSGCVILLPIAITFYVTWGFIRFVDGFFSPIYNHLGINIFGLGFITSITFIFLVGIFMSSWLGTSVLTLGEWFIKKMPLVSYIYAASKQISAAISPDQSSKAFKEVAIIKHPRVGEYALGFITSSVVLRNRDEKELFCVYIPTNHLYLGDIYLISPEDILRPNLSVREAIEIVISGGMSIPQILTTVDADHAKFAPRKPTYESKV

SEQ ID NO: 209678 - protein, 299 aa, Glycine max
  Coding DNA Sequence Number=SeqID_92900
  Homolog annotation: Hit_ID=Q852F8; Match level="QueryCoverage=36%, HitCoverage=64%, E-value=3e-21, Identity=46%"; Hit description =Expressed protein
  Pfam annotation: Domain name=DUF1195; Domain location=119-277; Score =177.0; E_value=4.8e-50; Accession=PF06708.2; Description=Protein of unknown function (DUF1195)
MTELVAHVECRYRTPLAESRTEPASSPKCNMYMTAAQHIYLNVKKEFLTQEAQSEGNYAEALKNYYEAMLLEIDPYDQDSLHTRELRDPILPFVHLTIIAINEGLSRLPFSSSAIVFVIPSGNQVVSSDQSKRTHSIIEGKMKDEDGTPQSAGKGQYKLWVLGAIILLALWSMFTASLTLKWSAGNLNRDFDSATLNDFDVLEVEEREKVVRRMWDVYTQSKSGRGSGLPRFWSDAFHAAYDHLVSDVQSVRDAAVSEIAKISLHSLPLHHLKSHSNIMGSRKMKQAESIVNTTISSDQ

SEQ ID NO: 209679 - protein, 75 aa, Glycine max
  Coding DNA Sequence Number=SeqID_92901
  Homolog annotation: Hit_ID=O49929; Match level="QueryCoverage=61%, HitCoverage=22%, E-value=1e-09, Identity=63%"; Hit description=Pore protein of 24 kD
MEEKKMEKEKGSFSLLLAYASVSVPLFSMKATLKGSYDIGKNAGAAATLAVNTSDVKLKVSITEATFKNSPRLNG

SEQ ID NO: 209680 - protein, 847 aa, Glycine max
  Coding DNA Sequence Number=SeqID_92902
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=57%, E-value=5e-99, Identity=38%"; Hit description=Chromo
  Pfam annotation: Domain name=RVP_2; Domain location=393-510; Score= -25.8; E_value=0.0001; Accession=PF08284.2; Description=Retroviral aspartyl protease
  Pfam module annotation: Pfam domain module=RVP_2::Retrotrans_gag; Domain location=393-510::149-239
MNNKQILLFREISLLLFVSWSRHSLEECNFRSPRQQGASLVLSSIMDPSDIMNALQSKLDAQATMFRELIRDTLESHSDSIQTMLHHHLQEVDSKVAASHNVQSHRSNFVTHNLKLNVPRFDGTNVMDWIFQIEAFFNFHDTSVDARLQIVSFHMDGRAAAWFQWAMRNNLLTSWQVFLELVRHRFGPTAYEDVEGDLSKLSQTRSVAEFQAQFEDLMNKVNDISETLLISFFITGLKRSLHWELQFHRPASLMEAFAMARAYEARQDDTLGPNKNWIRNNSLDTSPQTQAQKLTHQAPVKPTSSSTLPPLLPTPQNNLPVRHLPPAELRDRRAKGLCFRCDDKWGPSHRCKSKVLLLLGVDEDAPEIDTDDSQSEDVSDDISSLHALSSQLLGRSLRVSGVYSAHQFQILIDSGSTHNFINPALVERLGLEMTPCPRFRVATGCGSSLLCQYCCAAVPLKLQGITFLVDLFMLAIEVPDVVLGFPWLQLLGKVSHDYSALTMEFTWQGQPVTLQGDSVPVSHSVSLLQFQALLHSNEVADIFTITTSTPDSPNSEHNQSDFPPNLPLSITAVLQRFKSIFMPPSGLPPHRSVDHRIHLVEGTNPINVRPYRYPQFQKTEMEKLIWEMLDQGIIVPSHSLALNTATIKDKFPIPTIDELLDKLGGASVFTKLDLRAGYHQIRESIDYLGHIVFSQGVHADPGKLDAMAKWPVPKNVKQLRGFLGLTGYYRRFIANYAAFAFRALKDAMMASPVLRLPDFSKEFIIETDASNVGIGAILMQEGHPIAFFSKKLGPKLQAASVYIKELYAITEVVLKWRQYLLSHFFLIRTDHKSIRELLQQVIQTPDQ

SEQ ID NO: 209681 - protein, 167 aa, Glycine max
  Coding DNA Sequence Number=SeqID_92903
MPLSPSTLTLTGVSLIRHFAKASLYRRAHSLVPDHPHSMQNHEALIIGHLLSLDRGFDYISIKIALALNNLNRTNSDALNVRLKLEHLNIANFEPEYGLNPMFHFALVGSEWQVRIQGRASNWQDKLVVTSTLSVEPVAFPNDYLVGMESRIEELEKLLMFRSINVV

SEQ ID NO: 209682 - protein, 107 aa, Glycine max
  Coding DNA Sequence Number=SeqID_92904
  Homolog annotation: Hit_ID=O65168; Match level="QueryCoverage=71%, HitCoverage=95%, E-value=6e-27, Identity=77%"; Hit description=Auxin- induced protein
  Pfam annotation: Domain name=Auxin_inducible; Domain location=1-81; Score=51.9; E_value=2.2e-12; Accession=PF02519.5; Description=Auxin responsive protein
MQDEKKMKVKKGFLGVQVGLEDDEEGGYSPQRFVIPISYLSHPLFKRLLDKAREVYGYHTDGPLKLPCSVDDFLHLRWRIEKESAPNQNHHNHSHHRLPHALHFHSC

SEQ ID NO: 209683 - protein, 151 aa, Glycine max
  Coding DNA Sequence Number=SeqID_92905
MPFYGYRVEVLPSMPIEGTFSIAIMVVTEDMVEKWQLLNSFVSRKKEYFLTVHRPFNVHQTKCEHENSKDTDFNGCCWIPDIAENERQQRMPVQTDHLFEEFTLGIGIECNNWHEVAILGVWQLYIMSVISIECNNYLGIMAIIISVIFTM

SEQ ID NO: 209684 - protein, 187 aa, Glycine max
  Coding DNA Sequence Number=SeqID_92906
MAEGFEAYHVPQQSRRDKLRVVATQNQHGLVEPSSLLPLYDPSSFISSDLLTSFHNGQKHNLGCGMKEERANLMMGFAAAAGGGGVMNNGSSSSCCSSNSSSVSYLDPESSLPLNQATIQVINNSNNNNMFLYQAQNLREFDQGYNNNNNNNSEIMVFKPEPLSLSLSSHNNGVNLQRYGSVVYGDT

SEQ ID NO: 209685 - protein, 140 aa, Glycine max
  Coding DNA Sequence Number=SeqID_92907
  Gene Ontology: Mol. function=transmembrane receptor activity; Cellular component=membrane; Biological process=defense response
  Homolog annotation: Hit_ID=Q1SGR7; Match level="QueryCoverage=99%, HitCoverage=11%, E-value=7e-36, Identity=56%"; Hit description=TIR; Disease resistance protein; AAA ATPase
  Pfam annotation: Domain name=TIR; Domain location=6-140; Score=122.4; E_value=1.3e-33; Accession=PF01582.10; Description=TIR domain
MAKYDTFLSFSGAETRNLVASLYKALLREGVHAFTDDQSLNIGEQIQPALFNAIEGSRVFYVVISKGYASSIWCLQELARICYCVETSARRVLPIFYDVDPSEVRKQIGCFGKAFAKHEERLRGDKETMEEVQRWREALT

SEQ ID NO: 209686 - protein, 60 aa, Glycine max
  Coding DNA Sequence Number=SeqID_92908
  Pfam annotation: Domain name=zf-CCHC; Domain location=23-40; Score =14.9; E_value=0.0035; Accession=PF00098.13; Description=Zinc knuckle
MKTHMKGDIDKRRRKFRSRYKNVECHYCHKTRHIQRNCFLWKNESKDKKPGMSSSHLTLQ

SEQ ID NO: 209687 - protein, 126 aa, Glycine max
  Coding DNA Sequence Number=SeqID_92909
  Homolog annotation: Hit_ID=O22917; Match level="QueryCoverage=53%, HitCoverage=13%, E-value=1e-08, Identity=67%"; Hit description =Putative laccase
MEFSIASSSHLVAEMSGLIIGPLGSAIRHPAAGVAIISLAWKNNLVPKVAGRKSGFVWSLAAWTVRICAVVYAVAVAVSLILERPLIPVVYAVAVAVSLKSGNTGTIGLGSCPFICCGWQICILGL

SEQ ID NO: 209688 - protein, 393 aa, Glycine max
  Coding DNA Sequence Number=SeqID_92910
  Gene Ontology: Mol. function=sequence-specific DNA binding; Cellular component=nucleus; Biological process=regulation of transcription, DNA-dependent
  Homolog annotation: Hit_ID=Q1SIG3; Match level="QueryCoverage=99%, HitCoverage=75%, E-value=1e-129, Identity=62%"; Hit description=POX; Homeodomain-related
  Pfam annotation: Domain name=Homeobox; Domain location=174-232; Score= 8.7; E_value=0.00061; Accession=PF00046.19; Description=Homeobox domain
  Pfam annotation: Domain name=POX; Domain location=9-130; Score=186.6; E_value=6e-53; Accession=PF07526.2; Description=Associated with HOX
  Pfam module annotation: Pfam domain module=Homeobox::POX; Domain location=174-232::9-130
MGPFTGYASILKGSRFLKPAQQLLEELCDVGGVCAEKIVADASLMEPIPPESSSEDPLGDHGGDQGRKKSRLLTMLDEVYRRYRQYYQQMQAVVTSFEYVSGLSNAAPYASLAIKAMSKHFRCLKNAITDQIQFANKAHFHISNRKDESPRFGNSDRGPYGQRPGFLEHQPVWRPQRGLPERAVTVLRAWLFEHFLHPYPTDTDKLMLAKQTGLSRSQVSNWFINARVRLWKPMVEEIHMLETRQAPKNLQKEEHCTNKPSDHLPSDNSIVSENPSTSTDKFQEAPYKRAINELPNIPVRTQEQLNLPCTSNQPGGVGVSMGGSASNSVSLTLGLYQNHGIGLAEPFPLNAAQRFGVALETNNEGYVMSDYESQNRHFGRDVIGGQLLHDFVG

SEQ ID NO: 209689 - protein, 384 aa, Glycine max
  Coding DNA Sequence Number=SeqID_92911
  Gene Ontology: Mol. function=RNA-directed DNA polymerase activity; Biological process=RNA-dependent DNA replication
MHYPQGQDRKIEGSCRDLFRTRNFHESKKGSMIGVKSATKLERQRNHNSRMGLPHPKLGFEMHNDSMVVKMEIASFLVWKVQIDLGSSADTLYWSAFKQQDIPESQIELFSEQLISFSSETIETMGHVNLLDTFGDDKDSKTIMISRPSNDIGMLCFKPQDYQGKEEPTEEVKPFQLDKEPSQCTKLGFQMSIEVEESRDQVLTKNADLFTWSTSGRTLFMINTTNYCYLVMPLSYKNDGAITNTTSYVKDLAKIFADVRKHDMRLNPEKCIFGGKRKKFLGFMLTHRGIEASPEKRGSRVRFPKEERCAESPPTFICGKRRKNRRKPVEMKILSSGVVFTFEEGISTSHVDKSETFAPTYPPLKRKSDLRSSFLTVNQAILFT

SEQ ID NO: 209690 - protein, 351 aa, Glycine max
  Coding DNA Sequence Number=SeqID_92912
  Gene Ontology: Mol. function=isochorismate synthase activity; Cellular component=chloroplast; Biological process=biosynthetic process
  Homolog annotation: Hit_ID=Q1SBX7; Match level="QueryCoverage=88%, HitCoverage=54%, E-value=1e-146, Identity=83%"; Hit description =Isochorismate synthases, putative
  Pfam annotation: Domain name=Chorismate_bind; Domain location=110 -340; Score=-43.2; E_value=1.6e-11; Accession=PF00425.8; Description =chorismate binding enzyme
MVHKSCRFLSERCPLIRAYGAIRFNAKAKVSSEWLAFGSFYFMIPQVEFNELEGGSMLTITIAWDNNLSWSWENAINALQETLRNVSSSIVKFPKQTPPTLISSSHNIPSKVDWDLAVNGALQMIKRNDSLLTKVVLARSTRVVPTADIDPLAWLSCLKVEGENAYQFLLQPPNAPAFIGNTPEQLFHRKCLHITSEALAGTRARGASQALDCQIELDLLTSPKDDIEFTIVRDTIRRKLEAVCEKVVIKPEKMIRKLPRIQHLYSQLSGRLRSEEDEFEILSSLHPSPAVCGFPTEEAQLLIAETETEEHNLHYGMKVHVRTGNLGELEIWNMLFGQSVMGTEMILAHIM

SEQ ID NO: 209691 - protein, 174 aa, Glycine max
  Coding DNA Sequence Number=SeqID_92913
MAGTFFLLKKQNSLEIMSGTPQFVHGQGSFMLCLITPSLLWGPCPSPDSSSQTMWILSLKKLNLRLKLLLLPWLSKYMILHPHMFMFICMKLNSPEQKKSLAQALQDRAHAKKEARKWFMIGDYFYNKITRWKFYLPPRHLGSHIHLSRDFDDSSDEFVSKLDEEVAKQKGEKK

SEQ ID NO: 209692 - protein, 124 aa, Glycine max
  Coding DNA Sequence Number=SeqID_92914
MNRDALEYSSQRGLKNLGELVSGDYLAFELGDRCTLYPYVAIAPDCHPPKCIRPSRPERIGGKGCMSSLFDCLLVAFEEWKTHPYNKQILGINDVEDTEEYRELLWQLEPTSKEESDDPSEYTS

SEQ ID NO: 209693 - protein, 186 aa, Glycine max
  Coding DNA Sequence Number=SeqID_92915
  Gene Ontology: Mol. function=DNA binding; Cellular component =mitochondrion; Biological process=DNA integration
MDVKSAFLNRYIEEEVYVSQPSDFEDYKNPNHVYKLKKDLYGLKQAPRQWYESITNFLLDKKFEKGQVDKTLFIKKSYHYILLVQGEFEMSMMGELNYFLGLQVKQMNHETFLHQTKYCNELLKKFDMDKSKEAATLMPTNCYLSANDKGKPIDQKKKRVILAGALEAKNQQKVLEGKTAKIEAIS

SEQ ID NO: 209694 - protein, 241 aa, Glycine max
  Coding DNA Sequence Number=SeqID_92916
  Gene Ontology: Mol. function=nucleic acid binding; Biological process= DNA integration
  Homolog annotation: Hit_ID=Q1S9I4; Match level="QueryCoverage=99%, HitCoverage=26%, E-value=7e-21, Identity=28%"; Hit description =Integrase, catalytic region; Zinc finger, CCHC-type
GLGNIFEEGEINVKVLKSLDRTWQPKVITISKSKDFATMTHAELFGKLREYEMDLIRMAKEEAIDKKNKGLALKTKIPSSDKSEDDNVKGSDVEKFELDCKKVQQAYITWDDNESTTTSGSSEDEEGNLCLMANNNAESECMIKRYGVPSGKYKWVPKGTKEVCLIAERKLWYLDSDDSRHMTGDKSKFVSLKAKEEGFVTYGDNNKGRILGVGSIGNSLTTSIEHVLYSEGLKYNLLSIS

SEQ ID NO: 209695 - protein, 99 aa, Glycine max
  Coding DNA Sequence Number=SeqID_92917
MASCVGTSPLYLPVGIGNFPHAHVKLTRPNIVGMKPLPYNIRKGELKIATLQNPSSHVRHAAALPGIGLEDVKILRKEVQVPIESNTLQSVHYPSRFHF

SEQ ID NO: 209696 - protein, 264 aa, Glycine max
  Coding DNA Sequence Number=SeqID_92918
  Gene Ontology: Mol. function=transcription factor activity; Cellular component=nucleus; Biological process=regulation of transcription
  Homolog annotation: Hit_ID=Q9FHZ1; Match level="QueryCoverage=58%, HitCoverage=44%, E-value=1e-43, Identity=56%"; Hit description =SCARECROW gene regulator-like protein
  Pfam annotation: Domain name=GRAS; Domain location=63-260; Score =49.2; E_value=1.4e-11; Accession=PF03514.5; Description=GRAS family transcription factor
MMKIGLRKDCASPEARGEVLLPDSDGFVAVARSEDEWDTVETGGRVPSQAPNLIGVEFESLNLFQAKQSEDEQAFDPKPHGRDSTGLKLLGLLLQCTECVTMDNLDFANDLLPEIVELSSPYGTSSECVNAYFTQVLQALMVSSCIGSYSPLTAKSFSHFTVNQAIFQDLDGEDRVHIIDLDIMQGLQWPGLFHILASRSKKIRSVKITGFGSSSELLDDSIGRRLTDFASSLGLPFEFFLVEGKIRNMETDGQEHGDRQTAHS

SEQ ID NO: 209697 - protein, 208 aa, Glycine max
  Coding DNA Sequence Number=SeqID_92919
  Homolog annotation: Hit_ID=Q8H6Q8; Match level="QueryCoverage=41%, HitCoverage=2%, E-value=5e-07, Identity=36%"; Hit description=CTV.20
MEPEYWDKNPFKATAKDPKDPNLNTHSTIQILKVMHPRHYGSNLNQPKKFSAPFDPAGYNYWDYIDAWTNVFRHQNSKFKHSWYGKTENNKQYPPLQRHAFVKWWSQFDTSKATPDQVKNWFQRNPEFLKPADPETSLFLNQKSQLAAFLASSKFKESLAQNLKEVLHLLQQEEDEEPPKKEAESSENNDDPFYQNEDDCFGISLDDD

SEQ ID NO: 209698 - protein, 117 aa, Glycine max
  Coding DNA Sequence Number=SeqID_92920
MKGRKERKTLQIWFVKGIACCCSNQSSTSTGLTVPMGAPTVIWLVTIVFDGGASRSWWFGSWVVGGVSGWRAGGGVVVLGGLSDVGLIQASGVVVFGGAMVMDVGGRKAATRERERV

SEQ ID NO: 209699 - protein, 138 aa, Glycine max
  Coding DNA Sequence Number=SeqID_92921
  Gene Ontology: Mol. function=nucleotide binding; Cellular component =nucleus; Biological process=regulation of transcription from RNA polymerase II promoter
  Homolog annotation: Hit_ID=Q1S6L0; Match level="QueryCoverage=95%, HitCoverage=68%, E-value=5e-47, Identity=52%"; Hit description=WD40 -like
  Pfam annotation: Domain name=WD40; Domain location=14-52; Score=52.7; E_value=1.3e-12; Accession=PF00400.22; Description=WD domain, G-beta repeat
  Pfam annotation: Domain name=WD40; Domain location=59-97; Score=43.5; E_value=7.3e-10; Accession=PF00400.22; Description=WD domain, G-beta repeat
  Pfam module annotation: Pfam domain module=WD40::WD40; Domain location=14-52::59-97
MPPLPIWENVGGDFECVSTLEGHENEVKCVSWNAAGTLLATCSRDKSVWIWEVLPGNEFECVSVLQGHTQDVKMVKWHPTEDILFSCCYDNSVKVWADEGDSDDWHILMPIPYGSDDLTLKVWETERVGTQSGGGFAP

SEQ ID NO: 209700 - protein, 104 aa, Glycine max
  Coding DNA Sequence Number=SeqID_92922
MKELNQGYILKLGWNLINDADAIWVCILRNKYGCGSHTLPSMNHRNVTSHTWKAITSLRHHIDSELRWVVNNRQQGRFLDELLDSSPNFYNSEKVKEKDREKRN

SEQ ID NO: 209701 - protein, 77 aa, Glycine max
  Coding DNA Sequence Number=SeqID_92923
  Homolog annotation: Hit_ID=Q1HBJ0; Match level="QueryCoverage=67%, HitCoverage=9%, E-value=5e-07, Identity=51%"; Hit description =Polyphenol oxidase
NLSEPDQTEFVGTFVNLFHGQGHNIKVTSFKVGISKVLDCLEAEEDDVVLVTLVPKVGKGDVIIGGIKVEFIPKYKD

SEQ ID NO: 209702 - protein, 105 aa, Glycine max
  Coding DNA Sequence Number=SeqID_92924
MSGQAFKSGSSDIVSGFAAAEAFWMHQQVDAVNVTVTFPLKPENQYPSIVSNPGKSISRFVFIYITPKAGAQYNRELTCGIELCCANRYAQWVATIAVAQPLLSV

SEQ ID NO: 209703 - protein, 164 aa, Glycine max
  Coding DNA Sequence Number=SeqID_92925
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=98%, HitCoverage=22%, E-value=2e-33, Identity=43%"; Hit description =Putative Na/H antiporter
MAYRSINQNVLANAPCLVGILVDKGLSGSNRLAGNQVSHNVAVMFLEDQMREKHCAMDGEWWNITRLALPVLTVQIVRNIQKQHHEKLIHEFRMRCGDDDAVDYVEKVVSNGEDTVAAIRTMDDIHDLFIVGRGQGVISPLTTGLTDWSECLEIGAIRDMLATV

SEQ ID NO: 209704 - protein, 290 aa, Glycine max
  Coding DNA Sequence Number=SeqID_92926
  Gene Ontology: Mol. function=peptidase activity; Biological process =glycolysis
  Homolog annotation: Hit_ID=Q1H4C3; Match level="QueryCoverage=80%, HitCoverage=90%, E-value=1e-67, Identity=54%"; Hit description =Transglutaminase-like protein
  Pfam annotation: Domain name=Bact_transglu_N; Domain location=17-95; Score=52.0; E_value=1.9e-12; Accession=PF08379.1; Description =Bacterial transglutaminase-like N-ter
  Pfam annotation: Domain name=Transglut_core; Domain location=166-224; Score=69.0; E_value=1.5e-17; Accession=PF01841.9; Description =Transglutaminase-like superfamily
  Pfam module annotation: Pfam domain module=Bact_transglu_N::Transglut_ core; Domain location=17-95::166-224
MPILHQVAGSRQTEAERLAGQMHAKLHYGRMLDIVRDGLRLTPRNGYGQAVKHWQIKVNGQLTPFEDAFGNLSHTLVIDQTHDSLLITVSGAVETGLQTEQPEQALPPEIYLRDTPLTQADAAMLEFARPFANAPLTELMQALRERMQYIKGATQVDTPAAEAFRLGKGVCQDHAHAFIGCCRSLGLPARYVSGYLFTVDGSLMQTHAWADVWQQGQWQGLDVSNGTLVNETHVRLAHGLDYRSASPVTGSRMGGGIEGMASVVSVNQQESRAKPQDQARLLQQAQSAQQ

SEQ ID NO: 209705 - protein, 117 aa, Glycine max
  Coding DNA Sequence Number=SeqID_92927
MDPYEIVKHLKKMYGGQSRTAIFQLSKALFRSSFAANEKMSCDLHEMLNLLNDYENQIASEKKKGTVMVVGKSSKKKDKVPKRKNLGPKGGMTKPKNKRIKIDQTDAECFFCKEKGH

SEQ ID NO: 209706 - protein, 170 aa, Glycine max
  Coding DNA Sequence Number=SeqID_92928
MDFPSSPNQLVRNEDEWPRFLVFFTSLRELVGHVLVLVPSPWNHDTPCLNWVVFSFRKTIKNGRGRVCQKQAEIMRFRVLPQPIPACNPSLLVLTVGIFKIISGVWDMIFSPGRVLQATNTFSSIKQPFLLPSSPLNPHRTPQPPPPPPLTTGDRYKPPLFSTKPPHGEE

SEQ ID NO: 209707 - protein, 53 aa, Glycine max
  Coding DNA Sequence Number=SeqID_92929
MELQWKIKEKRNIPRICQRHLNIFPLDDTSMEGVTLAHGKLPWEARKKASLRS

SEQ ID NO: 209708 - protein, 139 aa, Glycine max
  Coding DNA Sequence Number=SeqID_92930
  Gene Ontology: Mol. function=nucleic acid binding; Biological process= DNA integration
  Homolog annotation: Hit_ID=Q1SX43; Match level="QueryCoverage=85%, HitCoverage=14%, E-value=4e-12, Identity=36%"; Hit description=IMP dehydrogenase/GMP reductase
MVCLLECENLEHKGEGSQDLINKVLKCLSRQWQPKVTAIAKLRDLANITLAILFGKLQEHEMELMRLNQHEENDKKKKGIALKASSSTQEERDKEDLNEIEEDDDFRLFVKRFNINFLETKEIKRDQTSIQRRKEKIPP

SEQ ID NO: 209709 - protein, 53 aa, Glycine max
  Coding DNA Sequence Number=SeqID_92931
MEFSLKIEMPHFRVSDIVATRRVVTLMGVMAGRDGRVIADALRDLAQDYGESE

SEQ ID NO: 209710 - protein, 270 aa, Glycine max
  Coding DNA Sequence Number=SeqID_92932
  Gene Ontology: Mol. function=nucleic acid binding; Cellular component= mitochondrion; Biological process=DNA integration
  Homolog annotation: Hit_ID=Q1SQZ4; Match level="QueryCoverage=81%, HitCoverage=14%, E-value=2e-64, Identity=51%"; Hit description =Integrase, catalytic region; Zinc finger, CCHC-type; Peptidase aspartic, catalytic
MDKSHLVLLLVIKPVDLHATRRCLGRPMIDRLVSNKGCDKTKKAFSNMKLYHMDTKEEICVEQPPGFESETLPYYVFKLNKSLYGLKEAPRAWYEKLSSFLLKNGFEREKVGITLFRKNYDSQLLLVQIEFEISMMGELKFFLGLQIKQTPNGIYIHHTKYMKELLKKFNMNDAKELKTRMHPTIYLEKEEESIKMDGTQYRAMIGPLLYPMTVRLDIMFNVCLCVRFQQESREVHLTTVKHIFRYLIGTHNLGLLFKRREIFRLASFYR

SEQ ID NO: 209711 - protein, 173 aa, Glycine max
  Coding DNA Sequence Number=SeqID_92933
  Homolog annotation: Hit_ID=Q2HVD0; Match level="QueryCoverage=46%, HitCoverage=24%, E-value=3e-16, Identity=63%"; Hit description=IQ calmodulin-binding region
MVSKKEKWYTIMVVQCSVEVHGHSRVHGGVMWRWHSVVWSWRFGGQTSRFSRERKGKMSFEGPEGSGEVASYISWLASEKASNYYSKPRNVGNSQEGKSANERCNEADPVKQAEQGWCDIPRTVEEVKAKLQMRQEGAIKRDRTKAYSQSKMVLRFFLVRVSATQLLAFFCYP

SEQ ID NO: 209712 - protein, 53 aa, Glycine max
  Coding DNA Sequence Number=SeqID_92934
MEYLVFLKEFVDEGSIVDVIHSSQGLHVILARALEAQNQQKVRGEIAKIEDKS

SEQ ID NO: 209713 - protein, 136 aa, Glycine max
  Coding DNA Sequence Number=SeqID_92935
  Gene Ontology: Mol. function=RNA-directed DNA polymerase activity; Cellular component=mitochondrion; Biological process=RNA-dependent DNA replication
MENLEEVFGELCKYDMRLNPEKCTFGDETCEQAFLVFKKTIATSPFLSLPRPGVPLLLYLSVVDEAVSSALVEEEGKQQFPIYFTSYILHDTKKHYQKIEKAANTHYLGPMTRALLPESSSGSQNELPHQAGFAKA

SEQ ID NO: 209714 - protein, 226 aa, Glycine max
  Coding DNA Sequence Number=SeqID_92936
HKPHKRRPLPKRPRYERYKPLTAKHTTILEEAFNLEEQDLEDTKRSNIGTTKQIEEEIEQKTEEDKDISNNGMSDNLHKNKNPPRILESQNININASSQQSLPPMIFTDKDFKSINPVNQDNLVVVSIIIVNLMVSKVLIDMGSSTNLLYWKTFQRLEVSLDTVHPYIIPLLDFTGKRVETRGYMDWADCNRQGRLKESTIVLSRELEGSIISSHQGAYQASLPSG

SEQ ID NO: 209715 - protein, 128 aa, Glycine max
  Coding DNA Sequence Number=SeqID_92937
MDRFKCIVVQIRNLNPKVALHSMLLALSLGMFADNLCKKSPSSIDMLRERVKGYIHMEKMSKFRNEGSPASPTSVTSTPSGTSNYVDTPSVQSVPPITFTGRDFKGINPINQDDPIVVSIIISKFMVS

SEQ ID NO: 209716 - protein, 188 aa, Glycine max
  Coding DNA Sequence Number=SeqID_92938
MGEERETTGYVCRGPIVGAKCIYQNPELSHIRVDVAKVGFKISHVKLRVSFVKRTRWGTWKTKDSNAQAPQSPTSDLQVPSTEFEGTSMLEYGGNLDKSEGCGLVKPPSFDKHFTGTIFEVLLLDNGGRVPVHACCFKLSTLLLRLPLHVRGPELDPFIEHFPMCPAEALERGPFPTSSQQLGDGKGL

SEQ ID NO: 209717 - protein, 72 aa, Glycine max
  Coding DNA Sequence Number=SeqID_92939
MASTSSITKVRPTHNNAIKTKDETIHNNTRGNTSELEHLVGQAIQRHPTNLLGQLHLKEVKEHGHVGFNIEE

SEQ ID NO: 209718 - protein, 50 aa, Glycine max
  Coding DNA Sequence Number=SeqID_92940
MRKDQGTGLGYIAMDHEDFMFQKVGFESRVSNLYNCGRMRSQEAIRYSMG

SEQ ID NO: 209719 - protein, 94 aa, Glycine max
  Coding DNA Sequence Number=SeqID_92941
MVRSTSILDLPLPPPRTTSQVTNRQHQKQKIAKAKAKLKVIVEVKMRLKVEAIIEIQEKDVSFSKKNKAMKDLHEKANNFESAMAMKIKENESW

SEQ ID NO: 209720 - protein, 46 aa, Glycine max
  Coding DNA Sequence Number=SeqID_92942
MDTKDDIVVEGDLESGVIKIPISFKETWKRKKVEGKTKVVKKNNEE

SEQ ID NO: 209721 - protein, 84 aa, Glycine max
  Coding DNA Sequence Number=SeqID_92943
MTTKWHSEMTAWHDQPGCVALSHDVRSHSLLGNLDKVYEPILVGKKYLLRIPLEFKWVHQVNSGIKKFMIRLIEDDTLMPYLRS

SEQ ID NO: 209722 - protein, 52 aa, Glycine max
  Coding DNA Sequence Number=SeqID_92944
MEVINPTMIESITYVINSVIVLSIKREHHNEEVLPPRLDRYIEPRNKDHINY

SEQ ID NO: 209723 - protein, 83 aa, Glycine max
  Coding DNA Sequence Number=SeqID_92945
MNISFFSNFFNDVQINNYVLNILFFLKIPSYWRRSIDLYWNHGISAIGQSKRNFFTRGVRWKVPLPAMEDKPKEGATKVMDSP

SEQ ID NO: 209724 - protein, 61 aa, Glycine max
  Coding DNA Sequence Number=SeqID_92946
MEAGSLSFNKVLQWWFSAMVLQQKIKEKSTLEASLRRKEGSFLGKLEGESFLEKLVGRKLP

SEQ ID NO: 209725 - protein, 140 aa, Glycine max
  Coding DNA Sequence Number=SeqID_92947
  Gene Ontology: Mol. function=RNA-directed DNA polymerase activity; Cellular component=chromatin; Biological process=RNA-dependent DNA replication
MSCLEKETKVRRGSKWISTLREIEHHIDLILGALLPNWPTYRSNPQETKEIHKQVEELMNKEWVQESMSLCIVPLLLVPKKEGTWRMCTNYRAINNISIKYRHHIPRLDDLLEELHSACIFSNIDLESDYHHIRMKEVEE

SEQ ID NO: 209726 - protein, 176 aa, Glycine max
  Coding DNA Sequence Number=SeqID_92948
MLSIERSDIFTNQVSQSTWMGPIWSYLVNDSLLVDEHKARKIKLKSTHYVVIDEEYVKCIHEENQGILGDSSCLNPDRRWRARRGRRDEEEGSRQNRVKGVKLIVPPFKGRSDLDAYMEWELKIEHLFSCHDYIEEQKRERLRDEEPEVDTWAEMRRIMRRRYVPTSYNRTMCLKL

SEQ ID NO: 209727 - protein, 54 aa, Glycine max
  Coding DNA Sequence Number=SeqID_92949
MTSWDLSMDQSSEVNIKIEVGEIKGSAKSGLESSRCSQKWHREYLVVIKDLISG

SEQ ID NO: 209728 - protein, 57 aa, Glycine max
  Coding DNA Sequence Number=SeqID_92950
MMEEGFAVNKSPMFKGANYEYGKEIMIAFFESSHIDMWDVEEKDFFTTRDLRSLNPL

SEQ ID NO: 209729 - protein, 55 aa, Glycine max
  Coding DNA Sequence Number=SeqID_92951
MEIDTLFAIHRQSSLMAHEENMVIRTFLAIQRQSSLMARRDKTWSSAFLQTRDNQ

SEQ ID NO: 209730 - protein, 229 aa, Glycine max
  Coding DNA Sequence Number=SeqID_92952
  Pfam annotation: Domain name=zf-CCHC; Domain location=211-228; Score =7.5; E_value=0.058; Accession=PF00098.13; Description=Zinc knuckle
MKVACICIPKIMFILGYKCIDFPNLLPYLFEFRMTGLLKESTSCFLIRLSPLVLVPIGLFHRTQRPLLYDFMGLKVLTFIFHRTQSPHFYLSRDSESSLLSLIGLKVLAFIFHKTQSPRLYLSQDSKSSLLSFIGLTSSPLSFIGLKILCLYAFIGLKVLYEEENEEEDSDDEEDFSLFVKKFQKFVKKRRIERRQNFNNGRRSQEDSQVLRCYKCKQLGHIIANLSFK

SEQ ID NO: 209731 - protein, 66 aa, Glycine max
  Coding DNA Sequence Number=SeqID_92953
MGDRGAHLDYVNPDISLLQMLPPPKNSNPPSTMTMTDNDAFRKLQTHVAEMEHYHEEELRKLKRPC

SEQ ID NO: 209732 - protein, 157 aa, Glycine max
  Coding DNA Sequence Number=SeqID_92954
MFSSSSCASYLQQLHTSELAGLATRSRRQARKLLDCFEAKFNGCCFHICLALFRRLNSIVKINDDKETWKIVVRLINMCTIPRSPSWSLWEALAMELKECLDSHECMCVIVATITKLLVANGLIYDACPKCNRKVDGEALTIFCVGCGNESASTIPN

SEQ ID NO: 209733 - protein, 98 aa, Glycine max
  Coding DNA Sequence Number=SeqID_92955
MSSHSTSLEPKSRLTINLDPGRRRRKRRREKKENSPIKEWEKAKRKERKFPIKEWEKVKKEEEEGKKAPDRGSKEKQKKCAERSLDRTISEQYRIVTK

SEQ ID NO: 209734 - protein, 59 aa, Glycine max
  Coding DNA Sequence Number=SeqID_92956
MGAEDDVCLCVLSGFSSYRQKKKVYTDNHSDFVSVEDDVNLCVSTGLSVTIDEGRRRRL

SEQ ID NO: 209735 - protein, 107 aa, Glycine max
  Coding DNA Sequence Number=SeqID_92957
MDKLQRFRQGSMSVEEYRQQMELLLLRAGLREEERTSITRFLSGLNMEGRDKVELLPYRDLDELVQLCIRGEQQLKRNSKTVVKSCPHSTMVDSMTVKNCPAMLGSP

SEQ ID NO: 209736 - protein, 63 aa, Glycine max
  Coding DNA Sequence Number=SeqID_92958
MCPPPSSLEPLECHCLALFAIILGTFRNNWETYFNDPSSLEPERLKALRIQWAHYYLRVRDQT

SEQ ID NO: 209737 - protein, 60 aa, Glycine max
  Coding DNA Sequence Number=SeqID_92959
  Subcellular localization annotation: CTP_CleavageSite=29; ConfidenceScore=5.06e-01
MKSVQFQLSLAHQWTEHASIAKRNLSVLSAIEESSRTSISRSCAKRKISVLSPTVVFSQA

SEQ ID NO: 209738 - protein, 134 aa, Glycine max
  Coding DNA Sequence Number=SeqID_92960
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=4e-16, Identity=31%"; Hit description= UPI00006A17C9 related cluster
  Subcellular localization annotation: CTP_CleavageSite=16; ConfidenceScore=5.61e-01
MWNPLKVRTRSPLKVRACNPLKVRTCSPLKVRTCSPLKARTCSPLKVRACSPTKARTCSPLKVRTWSPLKVRKCSPLKARMCSPLKVRTSSPLKVRTCSPLKARTCSPLKVRTCNPLKVRTYSPLKAKACSPLK

SEQ ID NO: 209739 - protein, 67 aa, Glycine max
  Coding DNA Sequence Number=SeqID_92961
  Gene Ontology: Mol. function=2,4-dienoyl-CoA reductase (NADPH) activity
  Homolog annotation: Hit_ID=UPI00005FA433; Match level="QueryCoverage =73%, HitCoverage=7%, E-value=2e-18, Identity=90%"; Hit description =COG1902: NADH:flavin oxidoreductases, Old Yellow Enzyme family
  Subcellular localization annotation: CTP_CleavageSite=55; ConfidenceScore=5.61e-01
MGMRFVINVRGAVRPFFTAPSPAASPDRSRGGHPARRPRRRRRSDARFSPSPAAAAAARGAVPARRR

SEQ ID NO: 209740 - protein, 192 aa, Glycine max
  Coding DNA Sequence Number=SeqID_92962
  Gene Ontology: Mol. function=hydrolase activity
  Homolog annotation: Hit_ID=Q30UA8; Match level="QueryCoverage=58%, HitCoverage=74%, E-value=3e-32, Identity=61%"; Hit description =Putative metal-dependent hydrolase
  Subcellular localization annotation: CTP_CleavageSite=52; ConfidenceScore=5.10e-01
MHTARRTAKGASDTAGYRTPAGGNPAPYGSTGCRMPCCDLSLSGAPAHAPRSCAKRFGRDLEHRRHADFRLGLQFAALHARDGGVQAKRVLHDVDFAVVGHLAQRLGVAQILVFQIDAARLPADSDGLVAAPGFADALGSLAAAHAAHRTVWLPSDRVPPAGLAKSQRSFRTDRQTDWPRQRSCVDARCPGD

SEQ ID NO: 209741 - protein, 128 aa, Glycine max
  Coding DNA Sequence Number=SeqID_92963
  Subcellular localization annotation: CTP_CleavageSite=84; ConfidenceScore=5.15e-01
MEENNRNHNCICNKSNNLCSKCTNPDNKNAKPKQPTTSTSLNSKTSTCLPSHKQGRDTTPKGTRSDMWWWSEQWLGFLFLVVEKAMSRWARRSRRWDDFRQQSACVLGFWYSFFEDARVLNHRETRSI

SEQ ID NO: 209742 - protein, 73 aa, Glycine max
  Coding DNA Sequence Number=SeqID_92964
MAPPLTSSPLSSAASPWEKKEYHEDSTSGGFNLLSVSLTFGNSIGAVGGITEGISGNRYRCYYRWLKRRESAQ

SEQ ID NO: 209743 - protein, 159 aa, Glycine max
  Coding DNA Sequence Number=SeqID_92965
MSSRSTSIEPKSQLTINLSLKRKQNKKREKKKRRFSIKESEESKKRKFPIKDWEKAKKKKKGKKIPDQGSKGNKRNMQKGLLDQTTSEKIQSYHQVSTKRKGNHDLKWSSSFDCQPKSCASVTCSPRAKQKQKRKRPKTFKANIPTKKTPFPRKSPTDP

SEQ ID NO: 209744 - protein, 55 aa, Glycine max
  Coding DNA Sequence Number=SeqID_92966
MTKLKTTLSPETKAAAPKWIEVKTHVQLGCYECGYYVMHWMWNIITSEIKSDWSM

SEQ ID NO: 209745 - protein, 279 aa, Glycine max
  Coding DNA Sequence Number=SeqID_92967
  Gene Ontology: Mol. function=unfolded protein binding; Cellular component=cytosol; Biological process=protein folding
  Homolog annotation: Hit_ID=P55737; Match level="QueryCoverage=71%, HitCoverage=33%, E-value=4e-67, Identity=67%"; Hit description=Heat shock protein 81-2
  Pfam annotation: Domain name=HSP90; Domain location=100-278; Score= -77.0; E_value=1.6e-12; Accession=PF00183.9; Description=Hsp90 protein
  Pfam annotation: Domain name=UBA; Domain location=31-70; Score=18.6; E_value=0.023; Accession=PF00627.21; Description=UBATS-N domain
  Pfam module annotation: Pfam domain module=HSP90::UBA; Domain location=100-278::31-70
MGLEMLSTMFGGLAAGSLAVPNRSNEPPEQLYATQLSQLQEMRFFDTQENIRALIATSGNIHATVQLEGHLEELGSTLHILLLRRSLSQPNTMMMNNQLEYLEERRLKDLIKKHSEFISYPIFLWIEKTTEKEISDDEDEEEKKDEEGKLEDDDEEKEKEEKKKKKIKEVSHECSLVNKHKPIWMRKPEEITKEEYSTFYKTLTNDWEEHLAVKHFSGEGQLEFKAILFVPKRAPFDLFDTRKKPNNIKLYVRRVFMMDNCEELIPEYLGFVKCFVKGT

SEQ ID NO: 209746 - protein, 94 aa, Glycine max
  Coding DNA Sequence Number=SeqID_92968
  Gene Ontology: Mol. function=transcriptional repressor activity; Biological process=regulation of nitrogen utilization
  Homolog annotation: Hit_ID=Q9SDZ1; Match level="QueryCoverage=100%, HitCoverage=34%, E-value=1e-32, Identity=74%"; Hit description =Isoflavone reductase homolog 1
  Pfam annotation: Domain name=NmrA; Domain location=7-94; Score= -106.2; E_value=0.047; Accession=PF05368.3; Description=NmrA-like family
MAAKSKILVLGGTSYIGKFIVMASVEAGHPTFALVRESTLSHPEKSKLIQSFKSFGVTLLYAIKQVDVLIFMLGGQQIDDQVNVIAIKEAGNIK

SEQ ID NO: 209747 - protein, 87 aa, Glycine max
  Coding DNA Sequence Number=SeqID_92969
MTKLKTTLSPETKAAAPKWIEVKTHVQLGCYECGYYVMHWMWNIITSEIKSDWSMWFADETPLDIDNITTIRKKWATYFLKTACKKG

SEQ ID NO: 209748 - protein, 84 aa, Glycine max
  Coding DNA Sequence Number=SeqID_92970
  Homolog annotation: Hit_ID=Q1SXC3; Match level="QueryCoverage=89%, HitCoverage=13%, E-value=9e-09, Identity=46%"; Hit description =Carbohydrate kinase, PfkB
MDFLATVAYPKPDDKIRSTTLNVSSYSSFTFHEFICVLVLFTLIDGGFSQGEGGGNVGNALTCLARLGLNPRLISKRERDTINQ

SEQ ID NO: 209749 - protein, 139 aa, Glycine max
  Coding DNA Sequence Number=SeqID_92971
EPAIIPHNKDAHVPKPANVDADDPLCGLIKYSFDIYDKPVEINFDGSCFGIVHAPTSIFITYSDASEIIAGDKSLNIYVQQLWYMHEWSQTLGQGSMYAFLEPHLLVVSKDRRSECQQYLEKWIKESDREVYIGPYFHQ

SEQ ID NO: 209750 - protein, 156 aa, Glycine max
  Coding DNA Sequence Number=SeqID_92972
  Homolog annotation: Hit_ID=Q10QS2; Match level="QueryCoverage=56%, HitCoverage=7%, E-value=9e-08, Identity=62%"; Hit description =Expressed protein
  Subcellular localization annotation: CTP_CleavageSite=94; ConfidenceScore=5.81e-01
MRVRSAPRARRWTPSIGFSTTRSAPASLPQSSGSRCARCYPRRTTRSALASRFVSWHFSRTSPQRTPPAGPRSSGRRLRRHGLIAGVSGGGGTQAEYARALAYLIADPNVSMAVLGRPHAVLSLLRFIFSSQQWQVWLSFLKEMVGFWAPSSPAAP

SEQ ID NO: 209751 - protein, 152 aa, Glycine max
  Coding DNA Sequence Number=SeqID_92973
  Homolog annotation: Hit_ID=Q42793; Match level="QueryCoverage=80%, HitCoverage=6%, E-value=7e-53, Identity=89%"; Hit description=Acetyl CoA carboxylase
  Pfam annotation: Domain name=Biotin_lipoyl; Domain location=27-88; Score=16.4; E_value=1.2e-05; Accession=PF00364.12; Description =Biotin-requiring enzyme
MPPISVWLCLGEYYHHMMSKGRSSWNSPSNTWKDLLASDDSHVDADTPYAEVEVMKMCMPLLSLASGIIHFKMSEGQAMQAGELIARLHLDDPSAIRKAEPFTGSFPVLGHPTAISGKVHHKCVASLNVARMILSGYDHNIDEVSKFFTLIH

SEQ ID NO: 209752 - protein, 48 aa, Glycine max
  Coding DNA Sequence Number=SeqID_92974
MDTNAQLWYIIREYISNSECSSSSNLMQDRGVDADDLISFMLESVLMA

SEQ ID NO: 209753 - protein, 88 aa, Glycine max
  Coding DNA Sequence Number=SeqID_92975
MVEFSELVDFKCIERKDLAFIFQEVSLCLFSMTNLSTPVKNLLTELDKSKSLPAALTSKKVWSGKMGVVKSLHIQRILSTPSSFCQVG

SEQ ID NO: 209754 - protein, 250 aa, Glycine max
  Coding DNA Sequence Number=SeqID_92976
  Gene Ontology: Mol. function=transferase activity; Cellular component= integral to membrane; Biological process=vesicle-mediated transport
  Homolog annotation: Hit_ID=Q9ZRD3; Match level="QueryCoverage=98%, HitCoverage=92%, E-value=8e-46, Identity=85%"; Hit description=NTGP1
  Pfam annotation: Domain name=Synaptobrevin; Domain location=157-248; Score=23.5; E_value=0.00036; Accession=PF00957.11; Description =Synaptobrevin
MKITALLVLKCTGEGSDPVILANASDVSHFGYFQRSSVKEFIVFVGRTVARRTPQGQRQSVQHEEYKVHTYNRNGLCALGFMDDHYPIRSAFSLLNQESKIGTKEQLTHPALPTELNPLVLESLTRWVISTSNDFMKVSIGLMADKGGLSIVVIDEYQKNFGESWRNAQEDSTQPWPYLNEALAKFQACKYLFYVDPAEADKLMKIQRELDETKIILHKTIDSVLARGEKLDSLVEKSSDLSAASQLWSV

SEQ ID NO: 209755 - protein, 53 aa, Glycine max
  Coding DNA Sequence Number=SeqID_92977
MEMITVDAGSIWQWLFHDSMRHTMTSWRKECDNSLTTMTRKAWSGRDRRKEKE

SEQ ID NO: 209756 - protein, 812 aa, Glycine max
  Coding DNA Sequence Number=SeqID_92978
  Gene Ontology: Mol. function=nucleic acid binding
  Homolog annotation: Hit_ID=Q9LSS9; Match level="QueryCoverage=83%, HitCoverage=70%, E-value=1e-114, Identity=39%"; Hit description =General negative transcription regulator-like
  Pfam annotation: Domain name=RRM_1; Domain location=114-193; Score =23.9; E_value=0.00059; Accession=PF00076.12; Description=RNA recognition motif. (a.k.a. RRM, R
MADKGGKSCPICTEEMDLTDQQLKPCKCGYEICVWCWHHIMEMAQKDETESRCPACRSPYDKERIVTMAANCQRLVAEMNSQHKKKMQKLNLKPKSVDGRKHLSDVRVIQRNLVYIIGLPLNLADEELLQRREYFGRYGKVMKVSISRTANGIIQHSANSSCCVYITYSKESEAVQCIQSVHCFVLEGRPLRACFGTTKYCHAWLRNVPCSNRDCLYLHDHGSHEDSFTKDELVLAFARSRVQQIIGATNNLHRRSGNVLPPPVDNPKHMSSATKLVSQSPLDKCENQIKGFASGIGAVTSTVLPAVTSWVRCVSGNLPHDTSSSCSGNLANRKIEASNDPQALVSGVASTERSINIRKSGEAENSSDVCSNGAFVPSETNNHNSGGNSKTCESSVFNEVTLEKFPGIVLPNCETYVAAFMDNDQDTVAPSVSTGFLELSRQHDFNIDTAVGINSNGDVHGLCSGLSSISINIHLEDSYLTPDSDGLPFTRNSIDSSLGQHLQQDNEYSTEHSSTPAFWEDIIVDDVLNIDSKQQKFSKGINYSSSSGLHSSCLTQNVNHSSHQPFQQDQICHQNHFRKPSTESFNEHLETGHVKYGESKDNGAGVDSMVASDMGENNIISDILSLELDAWEGSLVNLLGESDELYRPFKAPILRKVQDKNQSRFSFARQDDFMNGASNLLQSFAVTGRDPEGNFSSGALMGNKDTLTGKYPHVFPSGNSVPSDKLVGSQSLVPSNFSLGETWYFEHFYSPALWMVLFSSSLAHYVALEFVVGRHYWQMVSIFLGYRWLGLRVFYGERLDQSYRAKNLYSES

SEQ ID NO: 209757 - protein, 86 aa, Glycine max
  Coding DNA Sequence Number=SeqID_92979
MDVVIWCPYERHKGVKHFSNKPFSLVSSYGVLRQFGHIQSISCHPLQHLTYQAYDTTWAEWQQHVIPLGDVVLPRGHWACTPNYLP

SEQ ID NO: 209758 - protein, 93 aa, Glycine max
  Coding DNA Sequence Number=SeqID_92980
  Gene Ontology: Mol. function=protein binding
  Homolog annotation: Hit_ID=Q9ZQC2; Match level="QueryCoverage=66%, HitCoverage=6%, E-value=3e-21, Identity=76%"; Hit description =Putative receptor-like protein kinase
MENRVPFFFFFLFSFSLLLLLLLELSSAQMPGFVSLDCGGKENFTDEIGLNWTPDKLRYGEISNISVANETRKQYTALRHFPADSRKYCYTLD

SEQ ID NO: 209759 - protein, 86 aa, Glycine max
  Coding DNA Sequence Number=SeqID_92981
MSRNFTNCLTMGVKFLEAVKRKLHAIRQWSPNEIRAINSWGFGLDGGGCMNDNQFMGLRIRFDGGGCTNSARQSIRGAPDSMVGDA

SEQ ID NO: 209760 - protein, 53 aa, Glycine max
  Coding DNA Sequence Number=SeqID_92982
MHPATRIGNTGCFVNNIGKTAAGVKRAQQSRHSLATMAGEIATEEVSLASLAK

SEQ ID NO: 209761 - protein, 90 aa, Glycine max
  Coding DNA Sequence Number=SeqID_92983
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q47522; Match level="QueryCoverage=52%, HitCoverage=59%, E-value=4e-22, Identity=97%"; Hit description=LacZ protein
RVPFAIQAAQLLGRAIGAGLFAITPAGERGMCCKAIKLGNARVFPVTTLNSIPGSNNGTGLFQTIVGLKIRDLYEQLIATKAETPVAAKA

SEQ ID NO: 209762 - protein, 81 aa, Glycine max
  Coding DNA Sequence Number=SeqID_92984
ERLSAIKGGGNYAFVDMAELCLVPNVVIPPKFKVPDFDKYKGTTCPKNHLKMYCRKMGAYAKDEKLLMHFFQESLVGAAIT

SEQ ID NO: 209763 - protein, 98 aa, Glycine max
  Coding DNA Sequence Number=SeqID_92985
MERKMITMITNTLPMFYYEKMVGYMPSSFADLVFAGERIKVGLGTWKFDYADSTGSSNRGPESSGEMKKEGEPHVVAALPAWPNFPLASYNPMYQYPS

SEQ ID NO: 209764 - protein, 75 aa, Glycine max
  Coding DNA Sequence Number=SeqID_92986
MDVEERLKTFTFRRSYGNSRIAQQHLLLVSATLRNFTDRITLLPFDFRRVSRLTYCATKGAKYLETTNQRLHVIK

SEQ ID NO: 209765 - protein, 1523 aa, Glycine max
  Coding DNA Sequence Number=SeqID_92987
  Gene Ontology: Mol. function=ubiquitin-protein ligase activity; Cellular component=intracellular; Biological process=protein modification process
  Homolog annotation: Hit_ID=Q1T683; Match level="QueryCoverage=92%, HitCoverage=88%, E-value=1e-165, Identity=41%"; Hit description=HECT
  Pfam annotation: Domain name=Arm; Domain location=194-234; Score =17.6; E_value=0.045; Accession=PF00514.13; Description=Armadillobeta- catenin-like repeat
  Pfam annotation: Domain name=Arm; Domain location=237-275; Score=8.0; E_value=1.2; Accession=PF00514.13; Description=Armadillobeta-catenin -like repeat
  Pfam annotation: Domain name=HEAT; Domain location=117-154; Score =7.0; E_value=5.9; Accession=PF02985.12; Description=HEAT repeat
  Pfam annotation: Domain name=HEAT; Domain location=242-277; Score =16.6; E_value=0.092; Accession=PF02985.12; Description=HEAT repeat
  Pfam annotation: Domain name=HECT; Domain location=1166-1523; Score =352.3; E_value=8e-103; Accession=PF00632.15; Description=HECT-domain (ubiquitin-transferase)
  Pfam module annotation: Pfam domain module=Arm::Arm::HEAT::HEAT::HECT; Domain location=194-234::237-275::117-154::242-277::1166-1523
MGSRGQKRPEMVDELPADKRACTSLDFRPSTSNSSVQTQMNSTVEAHDHDMDTSSSASASSQSEGEPEKDSAYGSCDSDDMEQHHSTLREYHRQRLSSDHGKFKNIIYSLSEGSISSMTSDLLSPLLVKLAQNESNPDIMLFSIRAITYICDLYPRSAAFLVHHDAVPTLCQRLLAIEYQDVAEQCLQALEKISREQPLACLQAGAIMAVLNYIDFFSTSIQRVALSTVVNICKKLPSESPSPFMEAVPILCNLLQYEDRQLVENVATCLIKIVERVVQSSEMLDELCNHGLIPQGLIGLLVKLSSGSLVAFRTLYELNISSILREILSTFDLSHGVSTSQHVGGHCNQVYEALKLLNELLPVQAKDQNDQLMLNKESFLESSPDLLQRLGMDVFPMLIKVFNSGASIYVCHGCLSVMYKLVSLRKSDMLVELLKNANISSFLAGVFTQKDHHMLMLALQIAEIILQNFSDNFLKLFVKEGVFFAIDALLTPERSSKLMYPAFGGIQLSLDCSQKSSSRDTLKCLCYAFSTSQSPTSSETRNCKLDKDSLYNLAEHIKNKFLAPELFDSEKGLTDILQNLRALSNDLLSMSTDNGALGVHEEKINNILYQIMDKLTGKEQVSTFEFIESGVVKSLINCLSHGQYIRENKGVQGVCYYNPVIEKRFEALASVCLCASQHLSSEKPLSMLIRNLQTALTSLEAFPIVLSNGPKLRNSFASVPNGCSIPYPCLKVHFVKGEGETFLNDYTEYFHTVDPFSSVHSIERYLWPKVSAKSTEHTKSSSIQVVLQPESPPLQSPSNASSVPVEIPVILGTPDRMTDLPEPQKEEPKLSQPRRGQAVDENVGESSSSGTQGYAEQELQMNAEPNSKLEKQHPASCSNEAGQKLVFYLEGQRLDPKLTLYQAILRNAIKQNADSFSSAKLWSQVHIITYRRDVESEDILPPECYSSPQHFSDEKVLSYYQHTPFFSDMFSCELVSDLEKSSPTYDILFLLKSLESMNRIIFHLMSRERICAFAKGKVDNLDSLEITVPSVPQFEFVSSKLTEKLEQQMRDSLAVSIGGMPLWCNQLMASCPFLFSFEARCKYFKLEAFGQPQVQPHISHNGSGTVSDRRLGPGGLPRKKFLVHRDRILESAAQMMDLHASNKVVLEVEYDEEVGTGLGPTLEFYTLVCQEFQKSGLGMWREDASSFTLKTNMEAEDIGTHSFYGLFPRPWSSMQDTSGGIQFSEVIKNFFLLGQVVAKALQDGRILDLHFSKAFYKLILGKELSLYDIQSFDPGLGKVLQEFQALVIRKKFVESVSGGNSELQHGLSFRDTRIEDLCLDFTLPGFPDIVLASGTDHTMVWHMTFLVNTRNLEDYVSLIVDATVRSGVSRQVEAFKSGFNQVFSIDHLRIFNEEELERMLCGECDSWAVNELGDHIKFDHGYTASSPPIINLLEIVREFDNEQRRAFLQFVTGAPRLPPGGLASLNPKLTIVRKHCSNRADTDLPSVMTCANYLKLPPYSSKERMKEKLLYAITEGQGSFHLS

SEQ ID NO: 209766 - protein, 143 aa, Glycine max
  Coding DNA Sequence Number=SeqID_92988
MMHCAIGLLFRHRKGRQFSGLAHSGDEDEVPVMTKLAWYATRDGGCSVGGKSRSAKPPLLGSDGGQRRERRKREEGKGKGLWWVGTNSTFVGLQTLDRRGGKKNICYSGNGVNVNGANLEQVHVKLVLTCENASKCARALVDD

SEQ ID NO: 209767 - protein, 695 aa, Glycine max
  Coding DNA Sequence Number=SeqID_92989
  Gene Ontology: Mol. function=protein serine/threonine kinase activity; Cellular component=integral to membrane; Biological process=protein amino acid phosphorylation
  Homolog annotation: Hit_ID=Q9ZQC2; Match level="QueryCoverage=99%, HitCoverage=73%, E-value=0.0, Identity=64%"; Hit description =Putative receptor-like protein kinase
  Pfam annotation: Domain name=LRR_1; Domain location=217-238; Score =15.1; E_value=0.26; Accession=PF00560.23; Description=Leucine Rich Repeat
  Pfam annotation: Domain name=LRR_1; Domain location=240-262; Score =12.3; E_value=1.4; Accession=PF00560.23; Description=Leucine Rich Repeat
  Pfam annotation: Domain name=Pkinase; Domain location=355-644; Score =99.3; E_value=1.2e-26; Accession=PF00069.15; Description=Protein kinase domain
  Pfam annotation: Domain name=Pkinase_Tyr; Domain location=356-644; Score=97.8; E_value=3.2e-26; Accession=PF07714.7; Description =Protein tyrosine kinase
  Pfam module annotation: Pfam domain module=LRR_1::LRR_1::Pkinase::Pkin ase_Tyr; Domain location=217-238::240-262::355-644::356-644
YPDDPFDRIWESDSVKKANYLVDVAAGTRKISTNKSIDVNSDEMPPMKVMQTAVVGTNGSLTYRLNLDGFPGFAWAFTYFAEIEDLAENESRKFRLVLPGHSDISKAVVNIEENAPGKYRLYEPGYTNLSLPFVLSFRFGKTSDSSRGPLLNAMEINEYLEKNDGSPDGEVISSVLSHYFSADWAQEGGDPCLPVPCLLSSKNLTGNIPLDITKLTGLVELRLDGNMLTGPIPDFTGCMDLKIIHLENNQLTGALSTSLANLPNLRELYTGNTNLHKGSRKKSHLYVIIGSAVGAAVLLVATIISCLVMRKGKTKYYEQNSLVSHPSQSMDSSKSIGPSEVAHCFSFSEIENSTNNFEKKIGSGGFGVVYYGKLKDGKEIAVKVLTSNSYQGKREFSNEVTLLSRIHHRNLVQLLGYCREEGNSMLIYEFMHNGTLKEHLYGPLTHGRSINWMKRLEIAEDSAKGIEYLHTGCVPAVIHRDLKSSNILLDKHMRAKVSDFGLSKLAVDGASHVSSIVRGTVGYLDPEVPILLLTTKLIIVTLNRYYISQQLTDKSDIYSFGVILLELISGQEAISNDSFGANCRNIVQWAKLHIESGDIQGIIDPVLQNNYDLQSMWKIAEKALMCVQPHGHMRPSISEVLKEIQDAIAIEREAEGNSDEPRNSVHSSINMGSMDLAATENYLSIDESIAQPIAR

SEQ ID NO: 209768 - protein, 104 aa, Glycine max
  Coding DNA Sequence Number=SeqID_92990
MVKINGGEQTRGITEKGKEGGVNVLLSPKFVSKLSFSSKQHQPCFSALFGNLVQIEHVLTTLVLDLDKRLWELKLEMELALLHSTQNKLPSIWLMKHQSLKFSY

SEQ ID NO: 209769 - protein, 225 aa, Glycine max
  Coding DNA Sequence Number=SeqID_92991
  Gene Ontology: Mol. function=G-protein coupled receptor activity; Cellular component=integral to membrane
  Homolog annotation: Hit_ID=Q8LCU5; Match level="QueryCoverage=99%, HitCoverage=66%, E-value=9e-54, Identity=48%"; Hit description =Transmembrane transport protein-like protein
  Pfam annotation: Domain name=TerC; Domain location=115-223; Score =99.5; E_value=1e-26; Accession=PF03741.6; Description=Integral membrane protein TerC family
MGLASVVHIHAPPFRCSVLHHPISSFCSVYHYRPPRRFPLLCSRRIGHDNYASEVKRISAQQNDDIGKVEKSPTQESLGNEGYNSSVRTVALWVCTAVAFGVGLGFKEGFDKASEFFAGYILEQSLSVDNLFVFVLIFNYFKVPVTYQNRVLSYGIAGAVVFRLTIILIGTATLQRFEAVNLLLAAILLYSSSKLFASEEDESDLSDNFVVKTCQKFIPVTSNFL

SEQ ID NO: 209770 - protein, 578 aa, Glycine max
  Coding DNA Sequence Number=SeqID_92992
  Gene Ontology: Mol. function=DNA binding; Cellular component =chromatin; Biological process=chromosome organization and biogenesis (sensu Eukaryota)
  Homolog annotation: Hit_ID=Q53QK3; Match level="QueryCoverage=92%, HitCoverage=87%, E-value=4e-37, Identity=31%"; Hit description=PWWP domain, putative
  Pfam annotation: Domain name=PWWP; Domain location=16-89; Score=55.1; E_value=2.3e-13; Accession=PF00855.8; Description=PWWP domain
MHKVGTYWGSVSSEMNFCVSDLVWGKVTGHPWWPGQIFDASAASEKAKKHLKEGCHLIAYFGDGTFAWNDVSMLKPFQTHFSQMEKLSNLENFHHAVDCALDEVSRRVEFSLSCHCMPEDVLSKIKTQVISNAGINNQSCRRNGGDRIMNAMSFEPMKLVNFVKSLAQSPLVESDRLDFVIARSQLSAFYCSKGYSQLPEFPVLGVLFENDMETLLMREKEQCDYQTHVSFLQQDHKHISGDSKWHGKKLKLLSDLMSEKGFCISNGEGTSEQEAKSVPQRRGRKRKTAFNTSEDYFHNSQNGRLTQLQYASTNDMRSQLCLAAKDPTGESCSSDMVHFFAEFRKFISHDYYASLDQEMSLERMNYDETGVTSTAALASMTPAMEPCSDSYWTDRIIQSIPKELSLTKYQNERVVFLPETLTEANPLSFKLQPSAETTTDLCYKQQDTDRNLGSESSKLVEHLDGSSKENFCPTALTLKFTNFDSVPSTTDLNNIFGRFGPLIESKTELLERTNRARVVFQRRSDAETAFSSAGKYSIFGPSLVSYRLKILPRKPPQGTGKRGRKRRKETSSVDGTAV

SEQ ID NO: 209771 - protein, 326 aa, Glycine max
  Coding DNA Sequence Number=SeqID_92993
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-23, Identity=31%"; Hit description= UPI00006A17C9 related cluster
PLEDYTSSPSEVYTSSPSEGYTSPPSEDYTSLPSEGYMSSPLEDYTSCPSEDYTSSPSEDSTSSPSDCYRASPSEDCASSPSEGYTSTPSEAYMPWPSENYTSWPSKDYTSMPSEENTSSVCRGLHFFTFRGLHALTPSCPHLQRTSRPRLQRATRPRRLHVLTFRGLHILTFRGLHVLPFRGLHVLASGGLHVLAFIGLHVLTFKGLHALAFRGLHVLPFRGLRVLTIRRLHVLTFSGLHVLPFRGLHALTFRGLCILTFKGLHALALRGLHVFAFRGLHVLAFRELHVLPFSGLRVLAIRGLHVFTFRELHVLPLRGLHALTLK

SEQ ID NO: 209772 - protein, 91 aa, Glycine max
  Coding DNA Sequence Number=SeqID_92994
MKKTNRNNSPSFKAESSIRLGVGNLHHGSPGLRVEGQLLLLECRRIEDLVVILAVADNFHLEPTAVGIRREGTKGAEKGGVGELGVEHKWM

SEQ ID NO: 209773 - protein, 674 aa, Glycine max
  Coding DNA Sequence Number=SeqID_92995
  Gene Ontology: Mol. function=phosphoprotein binding; Cellular component=membrane; Biological process=signal transduction
  Homolog annotation: Hit_ID=Q1T2L0; Match level="QueryCoverage=90%, HitCoverage=99%, E-value=1e-155, Identity=52%"; Hit description =Serine/threonine dehydratase, pyridoxal-phosphate-binding site; t- snare
  Pfam annotation: Domain name=DUF827; Domain location=290-585; Score= -104.7; E_value=0.012; Accession=PF05701.2; Description=Plant protein of unknown function (DUF827)
  Pfam annotation: Domain name=IncA; Domain location=1-228; Score= -15.0; E_value=0.053; Accession=PF04156.5; Description=IncA protein
  Pfam annotation: Domain name=Pox_A_type_inc; Domain location=275-297; Score=16.2; E_value=0.12; Accession=PF04508.3; Description=Viral A -type inclusion protein repeat
  Pfam annotation: Domain name=Pox_A_type_inc; Domain location=327-349; Score=1.3; E_value=53; Accession=PF04508.3; Description=Viral A-type inclusion protein repeat
  Pfam annotation: Domain name=Pox_A_type_inc; Domain location=440-462; Score=11.6; E_value=1.7; Accession=PF04508.3; Description=Viral A -type inclusion protein repeat
  Pfam annotation: Domain name=Pox_A_type_inc; Domain location=579-601; Score=1.2; E_value=54; Accession=PF04508.3; Description=Viral A-type inclusion protein repeat
  Pfam module annotation: Pfam domain module=DUF827::IncA::Pox_A_type _inc::Pox_A_type_inc::Pox_A_type_inc::Pox_A_type_inc; Domain location= 290-585::1-228::275-297::327-349::440-462::579-601
MILLSGFSVFVQVKSCVCAYIVTLVVLCSTALGGNGVSLLGVSLKGLCAVCLLDYYCRKCGSGALKERTGTSEVPQRKSPASPQNARKLKTPGSDTDSVSSSPKPGSKTPKNKSPKVTERKSPRSPISEKKQPSRVQESESQLAQLEEDLKRTKDKLNSSESWKRKAQQEAEEAKKQLLAMSKELEESQQQLLELSASEEERLQELHKISQDRDQAWKSELEAVQKQHSMDSTALMSAMNEIQKLKMQLERVYESEAVHISNAESDNAEIEDLRMELDEALTLVEKLKNELSDCKESESRDLEQTKTVETLQLEGEKASEAYKSLALELDQARAQVKSLEELVSKLQADLVGGANKNMLGLVIEAEPELAPKNVENEEINQLKAELVSAKSEATQLKSALDVSEVRYQEEYIRSTLQIRSAFEQLEHAKSESSRRQGENEELKRARADIEELRERLMDKESQLQGLSEENEILMSRMKQNQPSEKESEPVVELKKLDADMAKLKERLLDRETELQNVTEENNALKKEIKREELEKNKIPDEAVASAEAARATEREALVKLGYITEEADKSNRRVAQITEQLDAAQAANSELEAELRRLKVQSDQWRKAAEAAAAMISAGNNGKFVERTGSLDSSYNSITAKMSSPYSENTDDDSPKKKNTNMLKKIGVLWKKNH

SEQ ID NO: 209774 - protein, 80 aa, Glycine max
  Coding DNA Sequence Number=SeqID_92996
MEEEELPKWIFLLQNMPYTNHLPMEQCIPYILGKSLPNIGDGPIIHMMGMVEKQAMMKVDHPTNGGGNHECNIEDCNKDI

SEQ ID NO: 209775 - protein, 151 aa, Glycine max
  Coding DNA Sequence Number=SeqID_92997
  Gene Ontology: Mol. function=nucleic acid binding
MLIDNDPSTSFSTLIAYVKSTKGHTDVHESMVGKQKAIENIYGNWKKLYHDLPRLLQAMQTYLSSMVIEKEALSMPIEQENTKGTLLVTVAQDGNNKFLPIAFVVVEGETVEIRFVFLNNLKMHVTSQNDLCLLSDRHESIKSVYSRRDSG

SEQ ID NO: 209776 - protein, 69 aa, Glycine max
  Coding DNA Sequence Number=SeqID_92998
MPPLRHGVLKERMRRLEKRCVLTKIVEDHLNPNESQNNSNGWLNKTQKMDINNKDGSISKQKHCKIPQQ

SEQ ID NO: 209777 - protein, 424 aa, Glycine max
  Coding DNA Sequence Number=SeqID_92999
  Gene Ontology: Mol. function=glutathione transferase activity; Cellular component=cytoplasm; Biological process=metabolic process
  Homolog annotation: Hit_ID=Q9FQ95; Match level="QueryCoverage=81%, HitCoverage=98%, E-value=1e-121, Identity=90%"; Hit description=In2 -1 protein
  Pfam annotation: Domain name=GST_C; Domain location=198-286; Score =17.9; E_value=0.0035; Accession=PF00043.15; Description=Glutathione S-transferase, C-terminal domain
  Pfam annotation: Domain name=GST_N; Domain location=99-174; Score =18.2; E_value=0.016; Accession=PF02798.10; Description=Glutathione S- transferase, N-terminal domain
  Pfam module annotation: Pfam domain module=GST_C::GST_N; Domain location=198-286::99-174
MEDAQRKDNPHYVLEFARCNTWFLVQETINLREVQPVGNFTQAYHEYKAYIDPMYTLKSVSNVYIGLLDELCNEEFCGVRPVLPPPLTSISDPPPLFDGTTRLYISYSCPYAQRVWIARNYKGLQDKINLVPINLQDRPAWYKEKVYPENKVPSLEHNGKVLGESLDLIKYVDANFEGTPLFPSDPAKKEFGEQLISHVDTFSKDLFVSLKGDAVQQASPAFEYLENALGKFDDGPFLLGQFSLVDIAYIPFVERFQIVFAEVFKHDITEGRPKLATWFEELNKLNAYTETRVDPQEIVDLFKKRFLGLQDKIKLVPIDLQDRPAWYKEKVYPENKHNGKVLGESLDLIKYVDVNFEGTPLVPSDPAKKEFGEHLISHVDTFNKDLNSSLKGDPVQQASPSFEYLENALGKFDDGPFLLGQFSL

SEQ ID NO: 209778 - protein, 430 aa, Glycine max
  Coding DNA Sequence Number=SeqID_93000
  Gene Ontology: Mol. function=nucleic acid binding; Cellular component= beta-galactosidase complex; Biological process=DNA integration
  Homolog annotation: Hit_ID=Q0KIN0; Match level="QueryCoverage=98%, HitCoverage=39%, E-value=8e-63, Identity=38%"; Hit description =Integrase core domain containing protein
MPSSSVSNKGPHFILFPYEPLFHILPHVFGSTCFVHDLNSGLDKLKARAIKCIFLGYSRTQKGHSCYSLTNNYLYMYCLFPLSFLTRQFLLFRCPCSQPVEEPLIEENSASSPAPIIHPVADGDRVMIDEMQALESNQTWALVPPPPGKSLVGCNWIFGLDYNDTFSLVAKIAYVRLLLLMGSLVDLFASYEKPLYGLTQSPRAWFGRFGSVLQSFGMTHDDIVITRDDHRGIRDLKSHLFQHFQTKDLGQLKYFLGIEVAQWYCHLPKEICPRHPKRHWDAKLKISKTSWEAELSHQTRPDISFAVSVVSQFLNSPCTSHTDIVAYTDADWAGSTSDRMSTSGYCILIGGISFLGGVRNEILWPVFHEWTTHIEIDCHFMREKIVSREVTTAFVNSNDQLSDIFTKSLRGPGISYICSKLDACDLYAPT

SEQ ID NO: 209779 - protein, 120 aa, Glycine max
  Coding DNA Sequence Number=SeqID_93001
MVLRFLDEIMKLKSNEAAGASMNGLKSLESVFLTLLSVNIIVCTSRMLNWKTGRVQSPRFENPSRKIGLLSFGLGWRDRNKRLSLTHPMKQGKPNAEESSESLHDNGSPRKESDNQETDR

SEQ ID NO: 209780 - protein, 164 aa, Glycine max
  Coding DNA Sequence Number=SeqID_93002
MTAVADVGEVEGGRYFHVGVHVNEIKSRVLERNGEDLQRFGEEHVARSRLRSFWLFVERRGSRSLNRFEMTEHSGSYVLTSIAKAFEKLCDGFHLRLGDGGSSFWFEDLNIALEVSFVDVHDIGLRVCDVVNGDGNCDLSNVDSLLHGDLMLLGFVGISGMQIF

SEQ ID NO: 209781 - protein, 166 aa, Glycine max
  Coding DNA Sequence Number=SeqID_93003
  Gene Ontology: Mol. function=DNA binding; Cellular component=proton -transporting two-sector ATPase complex; Biological process=DNA integration
  Homolog annotation: Hit_ID=Q1T2W1; Match level="QueryCoverage=85%, HitCoverage=23%, E-value=2e-34, Identity=45%"; Hit description =Integrase, catalytic region; Asp/Glu racemase
MDPTIYECDIFTMTVTWDGKSAKFTSYGIFYKKGGVEDLFAFTNSDYAGDEEDSKSTSVSWMSKKQPIVTLSTTKAEFIVAAASACQVVWMRRALRNLNHAQEGARSKHIRVRFHFLRDLVKDGEIELVHYGTQEQVADLMTKALKLEALQKLRKKMGMLDLMEVN

SEQ ID NO: 209782 - protein, 39 aa, Glycine max
  Coding DNA Sequence Number=SeqID_93004
MVPRGFCVLGSLDWVLTLTVKVVNFDVKACVMQFGNPNN

SEQ ID NO: 209783 - protein, 238 aa, Glycine max
  Coding DNA Sequence Number=SeqID_93005
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=Q10S93; Match level="QueryCoverage=99%, HitCoverage=100%, E-value=5e-79, Identity=55%"; Hit description =Adenylate kinase, chloroplast, putative, expressed
  Pfam annotation: Domain name=ADK; Domain location=57-204; Score=22.8; E_value=1.5e-09; Accession=PF00406.12; Description=Adenylate kinase
  Subcellular localization annotation: CTP_CleavageSite=10; ConfidenceScore=5.17e-01
MAAITRLAKRAFVVSSLARRCLSSSVVNCHAPPHDATSFRPFPLREDSSKRCVQWVFLGCPGVGKGTYASRLSNLLGVPHIATGDLVRDELTSSGPLSSQEILEGVTDIDLVINLKLREDVLLEKCLGRRICNQCGGNFNVASINIKAENGSPGIIMAPLLPPENCISKLITRSDDTEAVVKERLRIYNEMTQPVEEFYRSRGKLLEFNLPGGIPESWPKLLHALNLDDYEDKRSAAA

SEQ ID NO: 209784 - protein, 417 aa, Glycine max
  Coding DNA Sequence Number=SeqID_93006
  Gene Ontology: Mol. function=DNA topoisomerase (ATP-hydrolyzing) activity; Cellular component=chromosome; Biological process=DNA topological change
  Homolog annotation: Hit_ID=Q9LZ03; Match level="QueryCoverage=99%, HitCoverage=100%, E-value=0.0, Identity=80%"; Hit description =Meiosis specific-like protein
  Pfam annotation: Domain name=TP6A_N; Domain location=126-193; Score =107.4; E_value=4.1e-29; Accession=PF04406.4; Description=Type IIB DNA topoisomerase
MADNKKRRRKDPAGDELPFKNKLKPDSAIMETLKQFSASSSSSSVSQTLTLQDLSIPFRCREVADLSLSSVQSNIESLILRIAHSILSGHGFSFDVPSRSAANQLYVPELDRIVLKDKSSLRPFANISTVRKSAITARILQLIHQLCIKGIHVTKRDLFYTDVKLFQDQIQSDAVLDDVSCMLGCTRSSLNVVAAEKGVVVGRLIFSDNGDMIDCTKMGMGGKAIPPNIDRVGDMQSDALFILLVEKDAAYMRLAEDRFYNRFPCIIVTAKGQPDVSTRLFLRKMKTELKLPVLALVDSDPYGLKILSVYGCGSKNMSYDSANLTTPDIKWLGVRPSDLDKYKIPEQCRLPMTEQDIKTGKDLLEEDFVKKNPGWVEELTLMVKTKQKAEIQALSTFGFQYLSEVYLPLKLQQKDWL

SEQ ID NO: 209785 - protein, 335 aa, Glycine max
  Coding DNA Sequence Number=SeqID_93007
  Gene Ontology: Mol. function=DNA binding; Cellular component=nucleus; Biological process=regulation of transcription, DNA-dependent
  Homolog annotation: Hit_ID=Q0PJJ0; Match level="QueryCoverage=79%, HitCoverage=80%, E-value=1e-96, Identity=72%"; Hit description=MYB transcription factor MYB118
MLFSTSPEVEYFNGISSGSNFADVSARDSDAQVCLVTSCGLFRFDRDWKKIEDFVGSKTVIQIRSHAQKYFLKVQKNGTVAHVPPPRPKRKAAHPYPQKASKNGLLLFEMLIFSALKVLVPLPASVGYASSRNTLAPGFASWDETSLLMNAGADKPMTCQDELNNVHHGNEGMHTPFVCSDIGSKGITQITNSSLSGVGNSTRTLLTSEIPKQGKQAPVLHGLPDFAEVYGFIGSVFDPETNDHVQKLKEMDPINFETGKAAYNIPPPYLRIAKSLWAMGFYTSLLKQDKVLLLMRNLTVNLSSPDFEPIGVQPHLLDVLCLRKLNKSVLILLEV

SEQ ID NO: 209786 - protein, 142 aa, Glycine max
  Coding DNA Sequence Number=SeqID_93008
MCNIKDKEGRTSGFTDSCAPKSVHEFSERFVVYLSQTSQGGRDHAVRPAGVILHTELFDEGVEAVYGPGWESIISVNKGMPIDDPPCWTMHMGETQVIYNVVCASRPPTNHGQPLALSTPHHGVAPSPRCGFGVDVKRLCLS

SEQ ID NO: 209787 - protein, 69 aa, Glycine max
  Coding DNA Sequence Number=SeqID_93009
MPKINANVDSPAAKMVRLPPRRGQIKAKIMTDLVRMVEEVGRAMCSKEGKGSRGHSMRIVILVFYAPSL

SEQ ID NO: 209788 - protein, 62 aa, Glycine max
  Coding DNA Sequence Number=SeqID_93010
MSSFALEIASGISKMFAQKKVTLSPGRHKIVILDEADRNLIRLAMPKLMEADVQFAVFTGRV

SEQ ID NO: 209789 - protein, 58 aa, Glycine max
  Coding DNA Sequence Number=SeqID_93011
MIELGIWHDVSLLRTSKPTKDQAECFDDAKGYMNHMLLKDLLKTKQLEIFKMDNQDNL

SEQ ID NO: 209790 - protein, 289 aa, Glycine max
  Coding DNA Sequence Number=SeqID_93012
  Gene Ontology: Mol. function=oxidoreductase activity; Biological process=hydrogen peroxide catabolic process
  Homolog annotation: Hit_ID=Q47522; Match level="QueryCoverage=16%, HitCoverage=59%, E-value=2e-21, Identity=97%"; Hit description=LacZ protein
  Pfam annotation: Domain name=Catalase; Domain location=60-284; Score=- 256.9; E_value=0.0084; Accession=PF00199.9; Description=Catalase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMYTKASFLQKGRETPMLARFSTVAGELGSPDTWRDVRGFSLKFYTDEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 209791 - protein, 260 aa, Glycine max
  Coding DNA Sequence Number=SeqID_93013
  Gene Ontology: Mol. function=RNA-directed DNA polymerase activity; Cellular component=intracellular; Biological process=RNA-dependent DNA replication
MCVDYTDLNKHCPKDPFGLPRIDEVVDSTAGCELLSFLDCYSGYHQISLKEDDQIKTSFITPFGAYCYTTMSFGLKNAGATYQRAIQQCLHDEIRDDLIEAYVDDVVVKTRDASTLIDNLDRTFKALNRYKWKLNPKKCIFGVPSGLLLGNVVSRDGIRPNPSKVKAVLDMRPPKNVKDIQKLTGCMAALSRFISRLGEKGLPFFKLLKASEKFSWPEEADAAFTQLKTFLTSPPVLTAPQPMKTYFFTLLQPTGSSPRQ

SEQ ID NO: 209792 - protein, 364 aa, Glycine max
  Coding DNA Sequence Number=SeqID_93014
  Gene Ontology: Mol. function=DNA binding; Cellular component=nucleus; Biological process=regulation of transcription
  Homolog annotation: Hit_ID=Q1S4I9; Match level="QueryCoverage=99%, HitCoverage=100%, E-value=1e-94, Identity=56%"; Hit description =Homeodomain-related
  Pfam annotation: Domain name=Myb_DNA-binding; Domain location=14-61; Score=44.3; E_value=4.1e-10; Accession=PF00249.21; Description=Myb -like DNA-binding domain
  Pfam annotation: Domain name=Myb_DNA-binding; Domain location=67-112; Score=43.7; E_value=6.4e-10; Accession=PF00249.21; Description=Myb -like DNA-binding domain
  Pfam module annotation: Pfam domain module=Myb_DNA-binding::Myb_DNA -binding; Domain location=14-61::67-112
MGRHSCCLKQKLRKGLWSPEEDEKLFNYITRFGVGCWSSVPKQAGLQRCGKSCRLRWINYLRPDLKRGMFSQQEEDLIISLHEVLGNRWAQIAAQLPGRTDNEIKNFWNSCLKKKLMKQGIDPATHKPLLGAEEHIIIKEEKETILETPPNPILLQVSQGILVSSNESPLVVNNSSYYDGGLNVTEEASRDVFMSKNAALDYPLSYFEFQMGYNPIRQFDQNHIVGTNSSYGFSSLPCLNSSSDHGNMLVEAEFSDNNSASKISALMKESSSNSPSMSVYPAGGGCQMMENAGFSWDGENHNNNTKIDPLLQFHVNVVKSKEFKTSSWQEGQILTQNSIDFTSYPLMSLSEDLTGANFDVFQHM

SEQ ID NO: 209793 - protein, 278 aa, Glycine max
  Coding DNA Sequence Number=SeqID_93015
  Homolog annotation: Hit_ID=Q9AVH2; Match level="QueryCoverage=82%, HitCoverage=99%, E-value=2e-72, Identity=54%"; Hit description =Putative senescence-associated protein
RLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 209794 - protein, 291 aa, Glycine max
  Coding DNA Sequence Number=SeqID_93016
  Homolog annotation: Hit_ID=Q47522; Match level="QueryCoverage=19%, HitCoverage=77%, E-value=5e-19, Identity=74%"; Hit description=LacZ protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDQVVPNSLSPQRMDAVKAAAIGVNNMMMGYSVDITGYIRPQHQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 209795 - protein, 106 aa, Glycine max
  Coding DNA Sequence Number=SeqID_93017
METLAFEFAFSQARDTFMLREESRELSVFFRSMFNFPTSKEPFKLKGYLDANSTTKARDPKPKKQQATEWLLPFRSLPPPPLLVIPVEPDVNVRYYPGFRDHKVME

SEQ ID NO: 209796 - protein, 87 aa, Glycine max
  Coding DNA Sequence Number=SeqID_93018
MTARGGYRWSWWVAEKKRARLTKWESTFGAKRDNSRSVQFPLGLEFALSVTIRAERNSSCAKRNNSRSMQFPLELELRLARGQNLLF

SEQ ID NO: 209797 - protein, 372 aa, Glycine max
  Coding DNA Sequence Number=SeqID_93019
  Homolog annotation: Hit_ID=Q8TGM6; Match level="QueryCoverage=20%, HitCoverage=62%, E-value=2e-12, Identity=58%"; Hit description =Protein TAR1
VSEPVDSHACQTPWSVFQDGSDGELAGRCSAAPRGARLAARGDRPCRRRRPEAPRAPGLRPPARPTTVHAPSRSADQQKPFRIRPGRIASPHPLPSRQFQALFDSLFKVLFIFPSRYLFAIGLSPVFSLGRSLPPDLGCIPKQPDSLTAPRGAAGSGPDRALTLPGVPFQGTWARSVAEDASPDYNSGDEATRFSSWAGPGSLAVTRGILRVVPTDLGSRSEQRCAAVPEGSLGPMHRPRVGALHREQLSVAHHVLCPTRIAGSPNFGPPRHAARGAKNHIPPRGWVGSVCWRDAQADVPSAGRPRAQLAFKNSMVRGILQFTPGIAFCYVLHRCESRDIRCRESCGLRYHRCSGSGRHADHSAVQGNMSVP

SEQ ID NO: 209798 - protein, 289 aa, Glycine max
  Coding DNA Sequence Number=SeqID_93020
  Homolog annotation: Hit_ID=Q1RTB4; Match level="QueryCoverage=66%, HitCoverage=46%, E-value=2e-10, Identity=27%"; Hit description=IMP dehydrogenase/GMP reductase
MEGASLNWFPRWKEGRIGILSSCEGFANVPLMGTRGCINYNPVITIRQLGYPMRGAPSEESIAPFIARGFSDPNARIPQGVRKAWDAVQRKDKKLRGSSNGIIGGYWKWLRVRTQGLDWLPKLRPAREEKVEAPKESEEVQAVKAELEKVQAVKEKFKSTAIKVRKEYDELKNINIATAEALERETKRARKEEHGRNKFRGALWGNNSELKLRRDERDQSRVEGMILKDELKAYLRSKRSLSQQLRETKGNMLAIIDKYKEELNLAAAHEQRLGDEYAKVSPEKEARER

SEQ ID NO: 209799 - protein, 110 aa, Glycine max
  Coding DNA Sequence Number=SeqID_93021
MPAITEPRFNLIHEKNLTPGDEVAFYYRFHEHAWELLIRKTIEIKLIDTVDLEGGPVGKPVVPAALMNRPTRGERRFAYWALAECILAYYVGTDEGVSEVLHVAGEKRLH

SEQ ID NO: 209800 - protein, 135 aa, Glycine max
  Coding DNA Sequence Number=SeqID_93022
MCKGYCNSFLGTSNRLHTLGVWETLEGNERCRFRGTIQLTATSLVHPEQPACTLQQPLEWILPTPTPYRLVEPVQLIEVSLSEEDFEVDPEELPPEPAMDAPDLPEGDEDPLLILQRILCQHLRQTLQRRVALEG

SEQ ID NO: 209801 - protein, 239 aa, Glycine max
  Coding DNA Sequence Number=SeqID_93023
  Gene Ontology: Mol. function=methyltransferase activity; Biological process=DNA methylation
  Homolog annotation: Hit_ID=Q4AM33; Match level="QueryCoverage=99%, HitCoverage=58%, E-value=2e-95, Identity=67%"; Hit description=C-5 cytosine-specific DNA methylase
  Pfam annotation: Domain name=DNA_methylase; Domain location=1-236; Score=-118.2; E_value=0.00057; Accession=PF00145.8; Description=C-5 cytosine-specific DNA methylase
MRQLFRESGYETEYRILSADDYGVLQTRKRIILVGRKGCMTGFYPEPEKWNPAVRVAEVFNDLPSLKAADGQVSPCQLKPYAGKWLYEAGIRNDAMPVTWHQSRPNTAQDLEIYRRVVEQWNQKQKRLEYNELPDYLKTHNNRTAFVDRFKVVAADLPSSHTVVAHLSKDGHYYIHPDISQNRSITPREAARLQTFPDDYYFESIKPKPGRTAAFRQIGNAVPVLLARKIAEKLKDKWI

SEQ ID NO: 209802 - protein, 127 aa, Glycine max
  Coding DNA Sequence Number=SeqID_93024
ARNQSWKPQGPVGLLRGPVGLLRVHWASCGGRLALWSLGKMLLNSNVIHVRVVMLVRMIHTHLFAAALVKSCPGMHSRCVIASLSGCARTVGRPPISGGGPGTDKRKLLALVTGSASLGEASKGKGP

SEQ ID NO: 209803 - protein, 77 aa, Glycine max
  Coding DNA Sequence Number=SeqID_93025
MDSIWMRGICSKTESFAYCSIAASAPDRESSIKRCVTNYEKGKSYSSCWTKLDQNRIKTNIQQLGYRTSIPRDNTIY

SEQ ID NO: 209804 - protein, 119 aa, Glycine max
  Coding DNA Sequence Number=SeqID_93026
  Homolog annotation: Hit_ID=P00722; Match level="QueryCoverage=35%, HitCoverage=4%, E-value=3e-14, Identity=85%"; Hit description=Beta -galactosidase
AIGAGLFAITPAGERGMCCKAIKLGNARVFPVTTFGPDDVGVESFSNGAVAESADRCIGDKGLTGDSGPELGIDTVPFDKTENGSSAYSIGSVNFCPNPAGKGPNVHGITGVSDGPINL

SEQ ID NO: 209805 - protein, 148 aa, Glycine max
  Coding DNA Sequence Number=SeqID_93027
  Gene Ontology: Mol. function=nucleic acid binding; Cellular component= chromatin; Biological process=DNA integration
  Homolog annotation: Hit_ID=Q2HSF6; Match level="QueryCoverage=99%, HitCoverage=13%, E-value=4e-43, Identity=49%"; Hit description =Glycoside hydrolase, family 1; Zinc finger, CCHC-type; Polynucleotidyl transferase, Ribonuclease H fold
MAFVSLVEPGNIDEALCDEHWLMSIRTKSMLQNKLDEFGIILRNKARLVAKSYNQEERIDYDETYAPVARLFHMDVKSAFLNGLIEEVYVDQPLGFVDYEHPNHVYRLKRALYGLKQAPRSWYDRLSSFLIEQSFTRGQVEKTLFIKK

SEQ ID NO: 209806 - protein, 208 aa, Glycine max
  Coding DNA Sequence Number=SeqID_93028
  Homolog annotation: Hit_ID=Q6CQF2; Match level="QueryCoverage=35%, HitCoverage=91%, E-value=8e-18, Identity=63%"; Hit description =Kluyveromyces lactis strain NRRL Y-1140 chromosome D of strain NRRL Y- 1140 of Kluyveromyces lactis
  Subcellular localization annotation: CTP_CleavageSite=70; ConfidenceScore=5.15e-01
ICTDDRSGRARALGFAATAAPSYSSGLGPCPDGRRGGGKRNPASGSSRIASSAYQKWPLGALDSMARLNRAAAPSYLFKSFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALT

SEQ ID NO: 209807 - protein, 304 aa, Glycine max
  Coding DNA Sequence Number=SeqID_93029
  Gene Ontology: Mol. function=acetyl-CoA carboxylase activity; Cellular component=mitochondrion; Biological process=leucine catabolic process
  Homolog annotation: Hit_ID=Q3BZ10; Match level="QueryCoverage=100%, HitCoverage=56%, E-value=1e-156, Identity=89%"; Hit description =Acetyl-CoA carboxylase beta chain
  Pfam annotation: Domain name=Carboxyl_trans; Domain location=1-304; Score=210.0; E_value=5.6e-60; Accession=PF01039.12; Description =Carboxyl transferase domain
DEVFPDRDHFGRIFYNQANLSAQGIPQIACVMGSCTAGGAYVPAMSDETVIVREQGTIFLGGPPLVKAASGEVVTAEELGGADVHTRISGVADHMADNDLQALARVRAIIAQVKWRKPDPAMAVQAPEEPLLPAHELYGVIPADTRKPYDVREVIARLVDGSRFDEFKPCYGATLVTGFAHLNGYPIGIIANNGILFSESALKGAHFIELCTQRNIPLVFLQNITGFMVGRKYEQGGIAKDGAKLVMAVACAKVPKFTVVIGGSFGAGKYGMCGRAYSPNFLWMWPNARIGVMGGEQAASVQAT

SEQ ID NO: 209808 - protein, 71 aa, Glycine max
  Coding DNA Sequence Number=SeqID_93030
MVGYTPSSFADLVFAGEMIEVGLKRGKSDHHALINAKTGANKEAITPARFPQHPFFRGYDLNATCAYHGEP

SEQ ID NO: 209809 - protein, 188 aa, Glycine max
  Coding DNA Sequence Number=SeqID_93031
  Gene Ontology: Mol. function=receptor activity; Cellular component =integral to membrane; Biological process=red or far red light signaling pathway
  Homolog annotation: Hit_ID=Q8S403; Match level="QueryCoverage=70%, HitCoverage=17%, E-value=1e-47, Identity=63%"; Hit description =Putative phosphate transporter 1
  Pfam annotation: Domain name=EXS; Domain location=2-122; Score=59.5; E_value=1.1e-14; Accession=PF03124.5; Description=EXS family
MVAAEARVTYSRQNDNLWFAIILITSVVATMYQLYWDFIKDWGFLNPKSINPWLRNDLILKNKNIYYMSIVLNIVLRVTWVETIMHFKVGPVHSQLLDFLLVALEVIRRGHWNFYKVLDRRLQEAWARATKEDPRVLMNLRVDLMEACLWGFYGGWIFELQWGPLMVIFHHGDAAEDKGEEVRGGAIH

SEQ ID NO: 209810 - protein, 86 aa, Glycine max
  Coding DNA Sequence Number=SeqID_93032
MEEKSEGYNHYSTDGGGVIGAAGEKTGCGLASTDVGGVTGVTGSLGVECSQATLEDYGGNWIIVYVLIRKLKEDGHHYEADPQDTL

SEQ ID NO: 209811 - protein, 73 aa, Glycine max
  Coding DNA Sequence Number=SeqID_93033
  Subcellular localization annotation: CTP_CleavageSite=35; ConfidenceScore=5.25e-01
MASLMTRGDQSWPSATFVNHRQASPLIDTTLVSPSSSKDNNSDDTWRQHMFVRTLPIQRLSKSPLSSRDRKVR

SEQ ID NO: 209812 - protein, 260 aa, Glycine max
  Coding DNA Sequence Number=SeqID_93034
  Gene Ontology: Mol. function=RNA-directed DNA polymerase activity; Cellular component=riboflavin synthase complex; Biological process =RNA-dependent DNA replication
  Pfam annotation: Domain name=G-patch; Domain location=36-80; Score =8.2; E_value=0.018; Accession=PF01585.13; Description=G-patch domain
MWKPQKESLETTFQSFEVVSNASIESLPMQSHMSGMTMMVARVMLGHGYEPRMGLGKNNDGMAGLVDIKGNHGRFGSDDESCEGTNTEDPTIDFEQEASRAEDEEDEDIGFFQELERIITQEDREMKLHQEETEIVNLGVGDGRKEVKMGTHMTTPIRDELVALLWDYQDVFAWSYQDMPGLSRDIAQHRLLLNPGCSLVKQKLRRIKPEMYLKIKEEVKKQFDVGFLEVARKLEWVANIVPVPKKDGNMRMCVDYRDLN

SEQ ID NO: 209813 - protein, 176 aa, Glycine max
  Coding DNA Sequence Number=SeqID_93035
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=94%, HitCoverage=9%, E-value=5e-27, Identity=45%"; Hit description=RNase H, putative
MWDCIGRDSMEALLTTSKDWKVVSNDSSAASTYGIEKGQLTRTSSSPETMAKCPSTMNFIFWWSVGSYLNWDVDLPSYFSAIAIESLDHHGAWPQARAVVDEHLGHDVFHAFDRYMQSSIMPSSFGRNLLLGEGEVVVGCDVDDNPLEAFYGDVLGHMGLVQNLNQQCSVRLRAHE

SEQ ID NO: 209814 - protein, 93 aa, Glycine max
  Coding DNA Sequence Number=SeqID_93036
  Gene Ontology: Mol. function=RNA-directed DNA polymerase activity; Cellular component=intracellular; Biological process=RNA-dependent DNA replication
MDINPAYSFLLGQPWIHSVGVLPSTLHQKMKFMVEGHLAIVSGEEDVLVSCPFSMPYVEAAEESLETTFQSFEVGMAMSLEWVWARIMMAWPA

SEQ ID NO: 209815 - protein, 46 aa, Glycine max
  Coding DNA Sequence Number=SeqID_93037
MVIRCLCQTEASKPVDTQRPMWSLAHFRRRLNDAILPRLHNVGRVP

SEQ ID NO: 209816 - protein, 103 aa, Glycine max
  Coding DNA Sequence Number=SeqID_93038
MVNTASNVRQRETKARGQQIIISRPAQDVKEALLGGNLEMALKKLSTKRSRKDATGESSSATPGFDRHRFRSAKHQQRFEAIRGWSFHKERWVQLREDECPDF

SEQ ID NO: 209817 - protein, 128 aa, Glycine max
  Coding DNA Sequence Number=SeqID_93039
  Gene Ontology: Cellular component=mitochondrion
MEELKDGYISENGKLVDHFLQAIHAAEKRQADLDAYVSNEQKKLLKGNIWKEVERCSYQRTYARRGGCNVGQDIQDAHNLKTSSHVPQQMLTRHEGSSMELMVTPNDWGDEETTMTGHKMQCRAGGRR

SEQ ID NO: 209818 - protein, 177 aa, Glycine max
  Coding DNA Sequence Number=SeqID_93040
MKKILGLQAPMELTSLNVYRMRLSQPFLIAILRQSSSMAHKGYNGHTLFAIQRQSSLIAYVDTTWLSAPSSSRDGKSDDVWRPIMVICHLCQPEASEPVDQHAETTYGRLHPSYPKTTKIHLCHPKTIKSNDAQRLFFAYQRQSSLIACRDVMAIQFYHFQGTEVFADAPDALFCSF

SEQ ID NO: 209819 - protein, 166 aa, Glycine max
  Coding DNA Sequence Number=SeqID_93041
MSATSYIRDFIVTLGNLLAQRYVCLSLLSNFRGALLILDIGNSRQILIVIMVVQKCQKKVIRKRFKDGVLNWNSNLIARHAQLHFSFREIALLSYCFDDDYNHIVDVLAGEHSKLRLKRGFDNAIEDNHKTKSINAIVQDPIIVRSKGCGGTIQSTSGRSKRIIKC

SEQ ID NO: 209820 - protein, 254 aa, Glycine max
  Coding DNA Sequence Number=SeqID_93042
  Gene Ontology: Mol. function=site-specific DNA-methyltransferase (adenine-specific) activity; Cellular component=integral to membrane; Biological process=DNA methylation
  Homolog annotation: Hit_ID=Q8PUN8; Match level="QueryCoverage=99%, HitCoverage=31%, E-value=1e-112, Identity=80%"; Hit description=Type I restriction-modification system specificity subunit
  Pfam annotation: Domain name=N6_Mtase; Domain location=136-254; Score= -142.1; E_value=6.7e-06; Accession=PF02384.7; Description=N-6 DNA Methylase
MALKKSELYSSLWKSCDALRGGMDASQYKDYVLVLLFIKYVSDKYAGKPYQPLTIPRGASFADMVALKGKSDIGDQINKKIIAPLVDKNPQLSLSDFPDFNDAAKLGTGKEMVGRLTDLVAIFENKALDFSKNRADGDDILGDAYEYLMQHFATESGKSKGQFYTPAEVSRVIAATLGIANAPTTHQTTVYDPTCGSGSLLLKVADAAPTKVALYGQEKDAATSGLARMNMILHDQPTAEITQGNTLADPKFRD

SEQ ID NO: 209821 - protein, 121 aa, Glycine max
  Coding DNA Sequence Number=SeqID_93043
  Gene Ontology: Mol. function=transition metal ion binding; Cellular component=cytoplasm; Biological process=DNA integration
MIHDLGQESFQQAHASMYDTLQSDLKKPLYPGCKKSLTLLSAMLSLIHACPNDSILYKNEFKEMHNCPKFGVSRYKVKDDDECSSDENTKKGPPAKVLWYLPIIPRFKHLFTNADDAKDLT

SEQ ID NO: 209822 - protein, 134 aa, Glycine max
  Coding DNA Sequence Number=SeqID_93044
  Gene Ontology: Mol. function=small conjugating protein ligase activity; Cellular component=cytoplasm; Biological process=protein modification process
  Homolog annotation: Hit_ID=Q9SPB9; Match level="QueryCoverage=91%, HitCoverage=67%, E-value=9e-68, Identity=96%"; Hit description =Ubiquitin carrier protein 4
  Pfam annotation: Domain name=UQ_con; Domain location=1-127; Score =171.4; E_value=2.2e-48; Accession=PF00179.16; Description=Ubiquitin -conjugating enzyme
MSDYKVEMINDGMQEFYVQFHGPNDSPYHGGVWKVRVELPDAYPYKSPSIGFINKIYHPNVDEMSGSVCLDVINQTWSPMFDLVNVFEVFLPQLLLYPNPSDPLNGEAAALMMRDRPSYEQRVKGIDPFLFFIF

SEQ ID NO: 209823 - protein, 134 aa, Glycine max
  Coding DNA Sequence Number=SeqID_93045
MGPDGCRETRETGTRETTCKPRQDFSISKGKFRSSSRLLMLLFFSPSHPPLLPIKAPNFAHNFYSKLQKEAIFGVVKRTSTLWDFKFQVEKWEILRVREAKFGVSVNGSLKTCGKAWAEQMRKMSDQSESKSHF

SEQ ID NO: 209824 - protein, 123 aa, Glycine max
  Coding DNA Sequence Number=SeqID_93046
MDMNIGALISGQISLISQSNSSRLGFLALITALCKARGVTSDSLTYESLSPAINLAYIKKNYWNLDDPSVTFLGTHKSRARGSKSPSSSAAPAPPTFALPSTPAAPILPGPFVQSSKPFMSML

SEQ ID NO: 209825 - protein, 250 aa, Glycine max
  Coding DNA Sequence Number=SeqID_93047
  Gene Ontology: Mol. function=phosphoinositide phospholipase C activity; Biological process=intracellular signaling cascade
  Homolog annotation: Hit_ID=Q1T1F7; Match level="QueryCoverage=75%, HitCoverage=37%, E-value=9e-24, Identity=33%"; Hit description=IMP dehydrogenase/GMP reductase
MWSTLTLSRDLAHSGGYAWGFAALVHMYDQLDEACRTTTRQLAGYLTLLQCWIYEHFPSVHQCVTEDTYQETSPRASRWLTSKAHMKGITGAPYRARCDGLTVTDVSWLPYTEHRGVRAFQEISSFQGQLRWGPMIVTVRPERVVRQFGYIQSIPPPPVSARLSQDQIDDRWMEFADHLLPAGQPCLVPGQDDYEGYEAIAQRLERVLNLRIVTAGTELYDILQDCLTIARGGPSADGTVRARQRRRTDH

SEQ ID NO: 209826 - protein, 109 aa, Glycine max
  Coding DNA Sequence Number=SeqID_93048
  Gene Ontology: Mol. function=chitin binding; Cellular component =extracellular region; Biological process=chitin metabolic process
  Homolog annotation: Hit_ID=UPI0000612705; Match level="QueryCoverage =72%, HitCoverage=93%, E-value=9e-09, Identity=29%"; Hit description =UPI0000612705 related cluster
MDTSEPYIGAMKGTMREPQANLGASQNISPGGPLGTSTLTFRGLHTVAIRGLHALTFRGLHVLAFRGLHVLTFRVLHVLTFRGLHALAFRGLHALAFRGLHVLTFRGLH

SEQ ID NO: 209827 - protein, 84 aa, Glycine max
  Coding DNA Sequence Number=SeqID_93049
  Gene Ontology: Mol. function=O-methyltransferase activity; Cellular component=cellular_component; Biological process=melatonin biosynthetic process
  Homolog annotation: Hit_ID=P58630; Match level="QueryCoverage=99%, HitCoverage=42%, E-value=3e-32, Identity=79%"; Hit description=Maf -like protein yhdE
MAQQFAGFHQRQSHYGVITSIDAAHKVAAQALNTVRAGFIHRLAAGDIVRNFLCRDSAECHVCGHQAIQFTLRIGQRHGRHDLM

SEQ ID NO: 209828 - protein, 76 aa, Glycine max
  Coding DNA Sequence Number=SeqID_93050
MFPFDSRHVAELHGLLNDGCQVPRSGEDGSTPGNGASADAGTGDWAVKLSLSPTKEDKSAKAGSRAEVEDVGMPTI

SEQ ID NO: 209829 - protein, 175 aa, Glycine max
  Coding DNA Sequence Number=SeqID_93051
  Homolog annotation: Hit_ID=Q67UP1; Match level="QueryCoverage=69%, HitCoverage=18%, E-value=8e-28, Identity=54%"; Hit description =Hydroxyproline-rich glycoprotein-like
SLSKLKKTLHKTVSKDKKDFPPTVKFDELALAAKDMQAMRDCYDSLLSAAAATQNSAYEFAESLQEMGTCLLEKTALNDDEENGKVLGMLGSVQLELQKLVDSYVSFYLGRSHIVLTITNPSESLLNELRTVETVLLTRDDKRMQDEWGEWDNGTGGKKLCGPTALSKNVMPVST

SEQ ID NO: 209830 - protein, 51 aa, Glycine max
  Coding DNA Sequence Number=SeqID_93052
MMIYIQELQQEQISRPPYWQQMNPKQFMVVGIAEGENEEGMGAGVGLGVWS

SEQ ID NO: 209831 - protein, 555 aa, Glycine max
  Coding DNA Sequence Number=SeqID_93053
  Homolog annotation: Hit_ID=Q9LW21; Match level="QueryCoverage=92%, HitCoverage=64%, E-value=4e-53, Identity=35%"; Hit description =Arabidopsis thaliana genomic DNA, chromosome 3, P1 clone: MDJ14
  Subcellular localization annotation: CTP_CleavageSite=77; ConfidenceScore=5.07e-01
MGLPQIPPNETAEKVALVGAALTSSPQFSDASPSAIGSMNSVNTGGLAGCTLGSSFDDFPKNASLEISNVSDSTFYRGAMEVTSNVHSLKIGSADRSTPFAPKSGRNVHIPASRVVGFESGRTNTSTDGLTDVSAVNLHSSVFTNFPANDTESASSLVRKRLLSPLSSMLSPSHFKGDPLDIGCRSNETESLVKNDNFRNSIAQDNKKANIGSKSSYTVSSWSLTSCLEQRTVPHSTESFFQSDGPLKENRGLLSQGSLPTAGIDHFSELSQVRPQSGIISISPKTVSSPLSLSPLGRKFSERIKTAGGCRNVVEEINNWNITSRSIEQSLDNSNSRLMSNCKDDNSRVARKSFDEVEFLCKDFCPSSLDDIAEMSWPLCQESAPTSHSMRFTRSLSGLSVRRSLVGSFEESLLSGRFLSGNNSKKIDGFLAVLSITGGNFSPKSQKLPFSVTSVDGDCYLLYYASIDLAGNSSSNKLRGQLLKRGFGKDDSQIVKSRLRIPMKGRIQLEKCGILSIKDKWGGGGGYTAYRPVHMAHKAAQAQVGVNWAIKLVPT

SEQ ID NO: 209832 - protein, 244 aa, Glycine max
  Coding DNA Sequence Number=SeqID_93054
MGCGISTPGVEDASFTQHTKGRHHVIVSPVVDKKKDFENGDKDDVTLLHRNNNNNKDVVMVMKPLGDDEGNDGRSNRKKLKDKSVVETNNINKEEERVFGNGRKEKHNGGDDKYCENNNIEEKHEDHDDNFIVGPGSPSFREYCNDYDYGDRSSVEDSNDYDSMESIKNGSEDSSINKNKSKNEKSINSKKDLEKKERRGRGFKNVINKGKVRGKRNLLNFACYNASSESHVEGSFNKIAPKTA

SEQ ID NO: 209833 - protein, 74 aa, Glycine max
  Coding DNA Sequence Number=SeqID_93055
MDEFGIYFGHVHLNEQVNEALNDTMIEDVPIDEDDIVVNENDIVKLSEDSLLEMCIQIQTWIKNFEERGLDGRK

SEQ ID NO: 209834 - protein, 108 aa, Glycine max
  Coding DNA Sequence Number=SeqID_93056
  Homolog annotation: Hit_ID=UPI0000D9F4C6; Match level="QueryCoverage =55%, HitCoverage=34%, E-value=5e-08, Identity=43%"; Hit description =PREDICTED: similar to zinc finger, CCHC domain containing 13
  Pfam annotation: Domain name=zf-CCHC; Domain location=51-68; Score =23.2; E_value=0.00015; Accession=PF00098.13; Description=Zinc knuckle
  Pfam annotation: Domain name=zf-CCHC; Domain location=71-88; Score =27.8; E_value=2.5e-05; Accession=PF00098.13; Description=Zinc knuckle
  Pfam module annotation: Pfam domain module=zf-CCHC::zf-CCHC; Domain location=51-68::71-88
  Subcellular localization annotation: CTP_CleavageSite=32; ConfidenceScore=5.43e-01
MKNNMNGPQHQGKPYLTSPKQYGNPPNNRRTIAMGFASGSGRKPTTFSTHITCYKCGKPRHISANCAYKGTTCFNCRQKGHIQRDCPYPKKEQNDGGLNDQTGHLKAT

SEQ ID NO: 209835 - protein, 151 aa, Glycine max
  Coding DNA Sequence Number=SeqID_93057
  Gene Ontology: Mol. function=molecular_function; Cellular component =cellular_component; Biological process=biological_process
  Homolog annotation: Hit_ID=Q1FBL2; Match level="QueryCoverage=92%, HitCoverage=66%, E-value=2e-10, Identity=42%"; Hit description =Serine/arginine repetitive matrix 2
MREPFGPALFHLLSSRGGGPDDMREPFGPALFYLLSSRGGAPDDMREPFGPVLFHLLSSRGGAPDDMREPFGPVLFHLLSSRGGGPDDMREPFGPAHFYLLSSRGGGPDDMREPFGPTLFYLLSSRGDGPDDMRRQIMVICTLFLFVRLDE

SEQ ID NO: 209836 - protein, 101 aa, Glycine max
  Coding DNA Sequence Number=SeqID_93058
DRARKTPSGPGEVQQGLRVSSSDYGTLSVLQSARHPQQGHQASINRAFIKKYCTPRQAEGETPQHPRDGQQQATNAPPPPPEPLSSSTKRLEYCLRHMADQ

SEQ ID NO: 209837 - protein, 258 aa, Glycine max
  Coding DNA Sequence Number=SeqID_93059
  Homolog annotation: Hit_ID=Q1SKD7; Match level="QueryCoverage=60%, HitCoverage=40%, E-value=3e-07, Identity=25%"; Hit description =Ankyrin
MFDEFLQELRRCRWDQVLTRLSEKRIDVALVKEFYSNLYDLEDHNPRFCRVRGQVVRFDADTINDFLDTPVILEDGEEYPVYTRYLNTHPDPNTIPATLCTPGGRFVLNADGLPWKLLRKDMTTLAQTWSVLSYYDLAPTSHTYDVNLDKARLIYSLVSRMDMDVGNFISQQISQIAQSSTSRLGFPTLITALCDIQGVVSDTLIFESLSPTINLAYVKKNCWNPADPSITFPGARWTRTRAPASISEAPPTSQPSSQ

SEQ ID NO: 209838 - protein, 111 aa, Glycine max
  Coding DNA Sequence Number=SeqID_93060
  Homolog annotation: Hit_ID=Q8TGM5; Match level="QueryCoverage=36%, HitCoverage=61%, E-value=5e-08, Identity=70%"; Hit description =Uncharacterized protein ART3
MASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 209839 - protein, 65 aa, Glycine max
  Coding DNA Sequence Number=SeqID_93061
  Subcellular localization annotation: CTP_CleavageSite=50; ConfidenceScore=5.16e-01
MIKVFEKGKALFHVSKFGTKTRHGSNESRGKKWYSTRTTVSQSPRSFEILATDAKGSEKVRISYF

SEQ ID NO: 209840 - protein, 206 aa, Glycine max
  Coding DNA Sequence Number=SeqID_93062
  Homolog annotation: Hit_ID=Q33UY6; Match level="QueryCoverage=26%, HitCoverage=7%, E-value=2e-07, Identity=45%"; Hit description =Oligopeptidase B
MGAKPEGESKSIVADIIAAPEKTVESIKAAVADVKIPGMETKPEGESKSIVADIIAAPEKTVESIKAAVAYVKIPGMGAKPEGENKSVIAGLGVAAAATATAAAAAIGVAIPGMKKESTETVVSAAAETGVEPALASSKAAATLDALKPPVAKKIPIQHEYHGVKYSDDYHWLKDQSPKNKKPEIIEYLEAENAYSKAFHYDKTKS

SEQ ID NO: 209841 - protein, 58 aa, Glycine max
  Coding DNA Sequence Number=SeqID_93063
MPNIVNLMCFNFNFSEACALSESHALSEALSPLSELGEYGGESEKHLCTQRGVCLFLR

SEQ ID NO: 209842 - protein, 66 aa, Glycine max
  Coding DNA Sequence Number=SeqID_93064
MGVKHFEVVKQKSHADKQWSPEEIKEMAPRKLPAKRSRKDTIGKGSSAAPQADMDFDRHRFWSVEH

SEQ ID NO: 209843 - protein, 114 aa, Glycine max
  Coding DNA Sequence Number=SeqID_93065
MAQLISNAIYQIAGIAPTRHLVDPEKVSVAPNKLIRPPINRTFIEKYCMPRQAQGQAPEQQPEEGQQQAATDTPPSPPKSTSTHLRRLECCIRHVADQQAANHRGQVWLNESFY

SEQ ID NO: 209844 - protein, 191 aa, Glycine max
  Coding DNA Sequence Number=SeqID_93066
MTSVALASLRQADDESLHKFMDRCQGSEVRSDMPDKSMIKGSKIGLHRSDKRHKQDKRQPFPKGPRYSTTKELPLITLIDKDFKGINPINQDDPMSLLTKEAPQKYFCGSNDFQDYFDDAKESRVKQVPKNQESTSFKNQVSKNQDSRTIMFQDSRFKNNQVSRIKIQEQSRSRFKTQDSRIKRRLNQDKY

SEQ ID NO: 209845 - protein, 43 aa, Glycine max
  Coding DNA Sequence Number=SeqID_93067
MSDCRYPLLGEHKEGPAKQRTPMLKWCVHAPVSGLIWKADMHI

SEQ ID NO: 209846 - protein, 242 aa, Glycine max
  Coding DNA Sequence Number=SeqID_93068
  Homolog annotation: Hit_ID=Q1SPB9; Match level="QueryCoverage=42%, HitCoverage=18%, E-value=4e-07, Identity=38%"; Hit description =Transposase
MEKMNVHKTQGGPLRVHISHSNIKKNKTNQRSHEEHRTRNNVGFDHGHNWVEPQLHFLFFLLILSQFSQYPSMLSLGTLPQLPFTPIYSKKRHLGPWQLAQASCSSRTPIVAHKGEQGNKKEKKDHCIMDHYANEFPDELQEYILDIIDVQADGNLWLQDNCCDQEESWSLICEDLIQELQTWNSVYVQLFGSEERLLELITSLYVEHGSIPYEKQMTILDVGYAIASRYNVVLVHLSRLYN

SEQ ID NO: 209847 - protein, 88 aa, Glycine max
  Coding DNA Sequence Number=SeqID_93069
MKGGVPPQCHWCMASQHEATTGMISPVTMKLTGEMNNEALKEKKKKHGKEEEEEIKREKKCDRVREHGLPGDPSFFSNVVAKWRDVIG

SEQ ID NO: 209848 - protein, 71 aa, Glycine max
  Coding DNA Sequence Number=SeqID_93070
MILGSIIEQEEKRFVYRVHFSSNENNRRRKWRKESEYPEPQSAVGFYSKNPCASSMVPPFERVIENFNRLK

SEQ ID NO: 209849 - protein, 93 aa, Glycine max
  Coding DNA Sequence Number=SeqID_93071
  Homolog annotation: Hit_ID=Q69S84; Match level="QueryCoverage=79%, HitCoverage=16%, E-value=2e-17, Identity=52%"; Hit description=Kelch repeat-containing F-box-like protein
MPIDMGEGWPARQAGTKSSVTVDDDLYALDPSNSVDSAKIKVCDYEGDTWKVAAGDVPIHDFTELESTYLFTRLLEKLHDDMQNEHVESAFSQ

SEQ ID NO: 209850 - protein, 203 aa, Glycine max
  Coding DNA Sequence Number=SeqID_93072
  Pfam annotation: Domain name=Sgf11; Domain location=91-202; Score= -35.1; E_value=0.0049; Accession=PF08209.2; Description=Sgf11 (transcriptional regulation prote
MAPPPEITSNGGTQRGKRLWKVGKSAKILEVYLNLICGLISVSTLLSTIPCDLSLSFSLFLSQSSLAVVQISEQDPKALLGQDSFMSVPNEENLSSHSQLSSHFFLDLLDSIIVDVASECHRVARLGLDSNLEEEDEELKLSAQARVRVADPSNSNEANGKYVVDIFGQTHPPVANEIFDCMNCGRSIMAGRFAPHLEKCMGK

SEQ ID NO: 209851 - protein, 52 aa, Glycine max
  Coding DNA Sequence Number=SeqID_93073
MVGGVRCGGVDRDDAKLGVTGEVHETEVVSGTTRGLREHGDDLARGGGGRGR

SEQ ID NO: 209852 - protein, 186 aa, Glycine max
  Coding DNA Sequence Number=SeqID_93074
  Gene Ontology: Mol. function=transporter activity; Cellular component= outer membrane; Biological process=transport
  Homolog annotation: Hit_ID=UPI00003CCE76; Match level="QueryCoverage =99%, HitCoverage=26%, E-value=5e-72, Identity=68%"; Hit description =COG1629: Outer membrane receptor proteins, mostly Fe transport
GSEVGVRSEWIPGLQSSLAVWQLDIDSELLFVGDAGETEPSRASRRYGVEWNNHYVVNDWLLLDMDLALSKARFTHKDPAGQYIPGAINKVASMGATVTNWGNWFGSVQLRYFGPRPLIEDNSVRSNSTFLTYARLGYRYNPHTTLTLDVFNLFDRKASDIDYYYESQLAGEATPVNDKHFHPVEP

SEQ ID NO: 209853 - protein, 148 aa, Glycine max
  Coding DNA Sequence Number=SeqID_93075
  Gene Ontology: Mol. function=helicase activity; Biological process =protein amino acid phosphorylation
  Homolog annotation: Hit_ID=Q9ZQR0; Match level="QueryCoverage=62%, HitCoverage=7%, E-value=6e-16, Identity=47%"; Hit description =Putative helicase
LPINADEQKTIYHRIIQAVNNNEGGMFFLYGFRGTGKTFIWRTLASSLRAENQIVIIVASSGIASLLLPGGRTAHSRFKIPILSDEDKTKSKGKDPLEGLGRPMTRARARKAKEALQQVLSILFEYKPKFQGEKSKVVSCIMAQMEED

SEQ ID NO: 209854 - protein, 96 aa, Glycine max
  Coding DNA Sequence Number=SeqID_93076
MIRKCTDIGEHFTREDDLLFYWGGSWNLDTTEDVQPAPINPIDPANKMWAAKVTQKCHVPRYYHGPASQGISMSTLPKHHVYARDDYSKLYAKRSK

SEQ ID NO: 209855 - protein, 76 aa, Glycine max
  Coding DNA Sequence Number=SeqID_93077
MKPLQKLLSSSLLRDEQEGVIRKYGRKPTRRKTLEATGTNGRPNGPGGRAPALPPWAPTLLCWPISTSLVDHAPPT

SEQ ID NO: 209856 - protein, 213 aa, Glycine max
  Coding DNA Sequence Number=SeqID_93078
  Gene Ontology: Mol. function=nucleic acid binding; Cellular component= cytoplasm; Biological process=cytoskeleton organization and biogenesis
  Homolog annotation: Hit_ID=Q9XEQ1; Match level="QueryCoverage=99%, HitCoverage=18%, E-value=3e-98, Identity=84%"; Hit description=TNP2 -like protein
EEEYIEHIKKSFAQMVEAEGVEAVSRRKEFNDVDQANDLSIIMVTRNWMYNVDRRSEEFINGVHYFLSVAESNKRDGFMCCPCAVCKNLTEYSNSRTLHSHLLKSGFVPNYICWTKHGESGIIMDEGEEEEEEELDHANIIAQYGGFNDVAMGGDNEEEVAAEDDRSDDAFGDAICDAQRECDSDKEKAKFERMLEDHRKSLYPTAEEGQKKL

SEQ ID NO: 209857 - protein, 66 aa, Glycine max
  Coding DNA Sequence Number=SeqID_93079
MDPEKQVNKSNQHVHVWRMNDAWGKIEMFLAILSRIRSRIFLGDSGDGNGWIYVDAYFQSRSSMYE

SEQ ID NO: 209858 - protein, 46 aa, Glycine max
  Coding DNA Sequence Number=SeqID_93080
MVKVYPNTEIRSCLNACVSLRHGTTAETLEFIFAQGRAKVKLGGAC

SEQ ID NO: 209859 - protein, 581 aa, Glycine max
  Coding DNA Sequence Number=SeqID_93081
  Gene Ontology: Mol. function=RNA-directed DNA polymerase activity; Cellular component=mitochondrion; Biological process=RNA-dependent DNA replication
  Pfam annotation: Domain name=RnaseH; Domain location=37-165; Score =19.0; E_value=9.9e-07; Accession=PF00075.14; Description=RNase H
  Pfam annotation: Domain name=rve; Domain location=348-477; Score =58.8; E_value=1.7e-14; Accession=PF00665.16; Description=Integrase core domain
  Pfam module annotation: Pfam domain module=RnaseH::rve; Domain location=37-165::348-477
MSETLTYAPRKAIKSQALVDFVAEWTDSQLPPTQVQAELWTMYFDGSLMKTGAGAGLLFISPLGVHMRYVIRIHFAASNNVAEYEALVNGLKIAIELGVRRLDVRGDSQLVIDQVMKTSSCHDPKMEAYCKEVRRLEDRFHGLELVHVARRYNEAADELAKIASTRGTVPPDAFSKDLHEPSVDLGTGAGVDTTIAQPTNAVDALLMEEEVMEIERRPGRPFDWRTPFLDCLIRGELPEDKTEARRIARRAKSYVIYGEDNELYRRSPTGILQRCITVEEGRKLLDDLHSGACGHHAAPRTLVGNAFRQGFYWPTAVADAIELVRSCHGCQFYAKQTHLPAHALQMIPITWPFAVWGLDLVGPLQKAKGGYTHLLVAIDKFSKWIEARPITNIRSEKFLDFCDQHHIRVNWSAVAHPRTNGQVERANGMILQGLKPRIYNRLKKFGKRWVEELSSVLWSLRTTPSRATKYTPFFMVYGSEAILPTDLEYGSPRLKAYNEQSNKEAQENAIDQLEEARDMALLNSARYQQKLRRYHDKHVRKRDLNIGDLVLRRRQSNQGRHKLTPPWEGPYVVAEVLKPGT

SEQ ID NO: 209860 - protein, 109 aa, Glycine max
  Coding DNA Sequence Number=SeqID_93082
MKRCMMQSRNMSEDYQQQCITKIGKLKMRLHYYQASQRPSMTTNRPPLLVAHIDPGIGPNISMCVQGVGVIKTKKTKVYGFFKGGFEVVYVQRRVDKGVALAPTYSQVG

SEQ ID NO: 209861 - protein, 118 aa, Glycine max
  Coding DNA Sequence Number=SeqID_93083
MVGIAHTALLPYVEPIGIIEISSSLSSLDMPEYVSGPPYVEEDFPQYVPRPPHADENSEHTVTTSLTLAHVSGDEIEEDLKMLEHFVYRGKLPQGGARWLTEESSKEDPYKDIWDVSS

SEQ ID NO: 209862 - protein, 297 aa, Glycine max
  Coding DNA Sequence Number=SeqID_93084
  Gene Ontology: Mol. function=oxidoreductase activity; Cellular component=apical plasma membrane; Biological process=L-ascorbic acid biosynthetic process
  Homolog annotation: Hit_ID=Q1SVN8; Match level="QueryCoverage=98%, HitCoverage=85%, E-value=1e-121, Identity=73%"; Hit description =Aldo/keto reductase
  Pfam annotation: Domain name=Aldo_ket_red; Domain location=33-294; Score=381.0; E_value=1.8e-111; Accession=PF00248.11; Description =Aldoketo reductase family
PSVGLGTWQAEPGVVAKAVTTAILNTNSTEEYFSTGFSFSYDLSLVLILVGYRHIDCAQAYNNQAEIGSALKKLFDDGVVKREDLWITSKLWCSDHASEDVPKALDKTLQDLQLDYLDLYLIHWPVRMKSGSVGFKKEYLDQPDIPSTWKAMEALYDSGKARAIGVSNFSSKKLQDLMNIARVPPAVNQVELHPGWQQPKLHAFCESKGVHLSGYSPLGSPGVLKSDILKNPVVIEIAEKLGKTPAQVALRWGLQTGHSVLPKSTNESRIKGNFDVFDWSIPEEVMDKFSEIKQASS

SEQ ID NO: 209863 - protein, 161 aa, Glycine max
  Coding DNA Sequence Number=SeqID_93085
MTVGGHFRPWYNGNALIEWFCHTSGRIAKSTLWKQNHKLNIVIPKDSQASEHTSGTKHHLMANQVRESSRLNIINKSKDFIHILWCETANLLSPSELSLLQHDPPHYSLEEYLNIPSRVHACMHISQAHYSLGENILTTQNKVLVNSGTRARVLVTTTHKV

SEQ ID NO: 209864 - protein, 198 aa, Glycine max
  Coding DNA Sequence Number=SeqID_93086
MEKKGKLDHIEERLRAIEGGGDYAFADMANLYLVSDVIIPPKFKDLMVAFIRQYQYNSDMTPNRMQLQSMCKKEHESFKEYALRWRDLATQVAPPMTDKEMITMIVDTLPVVYYEKIVGYTPSNFADLVFASERIEVGLKRGKFDYPTLINKRPGENRVNEKEGGTYVVTAIPTWPNSSLAQQYQCFSLPTTLPVKNT

SEQ ID NO: 209865 - protein, 89 aa, Glycine max
  Coding DNA Sequence Number=SeqID_93087
MSSVIYAFKSCLAPVVAQSERFFDVLEKNAENTQKQWQKGHFYNFSGSWLAWATRKLRADVTGSPGRAKLLLEEATSSPGRAELAWASC

SEQ ID NO: 209866 - protein, 138 aa, Glycine max
  Coding DNA Sequence Number=SeqID_93088
MNFKITSLIKGIIFGKTYAQAHKDYEDLKNSKHDIWVEYENCKMSVKFLNDKFLNNEVLKDQPQDAIKLNEEIDTLKTTLAKFVGGTANLDKLLRYSKCSTNKFNHRKDTSIMVLEQWSPTTHDRRKVYVPMLDLYPW

SEQ ID NO: 209867 - protein, 56 aa, Glycine max
  Coding DNA Sequence Number=SeqID_93089
EKRRRRWLIEAWTARQTKANGMRPKKIETESESESGRSAKTKPGVLRMPPHEQHLN

SEQ ID NO: 209868 - protein, 111 aa, Glycine max
  Coding DNA Sequence Number=SeqID_93090
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=65%, HitCoverage=13%, E-value=5e-31, Identity=94%"; Hit description=NADH -plastoquinone oxidoreductase subunit 2
MRLLRNIYSWCWGKLFYSGSWFLLAIWSSGGEIELQEIVNGLINTQMYNSPGILIALLFITVGIGFKLSPAPSHQWTPDVYEGVRCYIVGSHPSETTSIIGASVNKRITLR

SEQ ID NO: 209869 - protein, 40 aa, Glycine max
  Coding DNA Sequence Number=SeqID_93091
MGSVMTWMPPLLPAGKLVPPLTTAGTRIPPLATAGLSLNR

SEQ ID NO: 209870 - protein, 144 aa, Glycine max
  Coding DNA Sequence Number=SeqID_93092
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=Q8S2G5; Match level="QueryCoverage=66%, HitCoverage=19%, E-value=2e-33, Identity=72%"; Hit description =Glycerol-3-phosphate dehydrogenase-like protein
MFIYRHQAWIRKEDSPIGKFIELEANKALEISFQGLCLCTVGSIMGLVSNEYSNGSVQSCNGLEEKLDDLRGLVGKADGDPLRIVSVGAGAWGSVFAALLQDTYGQFRDKVQIRIWRRPGKTVDRATAEHLFEVINSREYVLRR

SEQ ID NO: 209871 - protein, 156 aa, Glycine max
  Coding DNA Sequence Number=SeqID_93093
  Gene Ontology: Mol. function=oxidoreductase activity; Cellular component=membrane; Biological process=electron transport
  Homolog annotation: Hit_ID=Q43078; Match level="QueryCoverage=51%, HitCoverage=14%, E-value=8e-25, Identity=76%"; Hit description =Cytochrome P450 97B1
MTHNWKLWSKYSQLVQDRMILKFNKLLEGKGSDGPNSIELDLEAEFSSLALILFCLVCSTLTLVLSPKNLQLLRQSMALFLKLNIDPLSTFHIGKFLKFKGCKSFAFPAELDMHLDVVHGLDHTLMERIIGNWFCWKGLSEGVQIFLFIQKGIVLP

SEQ ID NO: 209872 - protein, 73 aa, Glycine max
  Coding DNA Sequence Number=SeqID_93094
MTYQVFSIHCLKGLPELLSFMVGYTSQRCDQLTQTPQRIMSSLAIKFEIEVCHGSSKYIVHQPYVFKQQLLGG

SEQ ID NO: 209873 - protein, 212 aa, Glycine max
  Coding DNA Sequence Number=SeqID_93095
  Homolog annotation: Hit_ID=Q9LTY0; Match level="QueryCoverage=38%, HitCoverage=12%, E-value=2e-19, Identity=45%"; Hit description =Arabidopsis thaliana genomic DNA, chromosome 5, TAC clone:K9P8
MAHCQWAPRKVLDVVSHDIWLKHPWLDVNGCNPYNIDKRKDLNPQNSVQLYRDDGDGTIENEGFPGQTYYTWSVSDVSAYSGELWVSISGSCIIETGRCLSLEPSVVLIMDKIAEPSDILVSLDEFSTLCTRISDDSRFACKVGDVLVEPSTRWQNMLKGSSLYQKFLNSVFIIILAMHGIHYVLLVKPGAHDSESCLKAAICLPLGGYKCQ

SEQ ID NO: 209874 - protein, 137 aa, Glycine max
  Coding DNA Sequence Number=SeqID_93096
  Subcellular localization annotation: CTP_CleavageSite=41; ConfidenceScore=5.23e-01
MTSSLRNGCVASKPPARLATSPKVDFATSTGELASGVQATRCSSAGYDAVSHAEALTDFVTRHQYWRFACSNNFWAIKQRETTAPLCMHSFLLFGSLPFTTFLSSPLIHTSSALVSSLPTTGEAFDLVCPTLFGCFS

SEQ ID NO: 209875 - protein, 139 aa, Glycine max
  Coding DNA Sequence Number=SeqID_93097
MSIDQDYFSLHFVNQRQGISLTHRDKYGHLHPFVEDSLSIDRDYFSHHFINQRQESLLTSIDKYGLLHPFIEDSMSVDRDYFSLHFVNQRQVIPLTCCSLPASAPNRASSIKWSKKAGLLLLRTLHRSGNQAYVVLFYA

SEQ ID NO: 209876 - protein, 73 aa, Glycine max
  Coding DNA Sequence Number=SeqID_93098
MAEENEQLTVQTFIAFIRQKFGYTITYGKAWLAKQWVLEKTCIDAFAFCKPMIQITGTWLYGPYKGTFLIAIT

SEQ ID NO: 209877 - protein, 124 aa, Glycine max
  Coding DNA Sequence Number=SeqID_93099
MKVILSKPTRKGRKWYLNLTYQGNPCGVYPDLSSFTGCGVIQTSVACIKQSAPTQVHINARQDSCLDTVQTLFMAITIKDDEDIDEMFDVYNRHECISCFELFVQYGQPFSTTNVETTNPSPQI

SEQ ID NO: 209878 - protein, 92 aa, Glycine max
  Coding DNA Sequence Number=SeqID_93100
MKNLMLEDTGTQRSGVEGVTEDAPVSPASLARKRHESGFWRFQHLNKIDINSKNKPAKWASANGWSEADDGWDIISLNEKFQDRHTKNSLRP

SEQ ID NO: 209879 - protein, 72 aa, Glycine max
  Coding DNA Sequence Number=SeqID_93101
MQLRSRSTSARANEVKRILIHKTQQKLTDPVTKNSIISDQNAPCANETLFEGEVVQWWSKGRSSNNNSCKGK

SEQ ID NO: 209880 - protein, 74 aa, Glycine max
  Coding DNA Sequence Number=SeqID_93102
MEATSFEFVSGATNSKSSILIKTCICLVELPGLPLLSPVKDSDKNRDLLGAYWDKLSVEEAKEVVSFKNVMLEI

SEQ ID NO: 209881 - protein, 86 aa, Glycine max
  Coding DNA Sequence Number=SeqID_93103
MRDFFEDQAAEQFYSDLRDLTQRVIKFGVSDSAVFLPQLIASITAIIQLAEVIGEFGQPLTRGTGETSAIGDLSSTGLASLTGELS

SEQ ID NO: 209882 - protein, 196 aa, Glycine max
  Coding DNA Sequence Number=SeqID_93104
  Homolog annotation: Hit_ID=Q1SR77; Match level="QueryCoverage=42%, HitCoverage=10%, E-value=3e-35, Identity=90%"; Hit description=AMP -dependent synthetase and ligase
MTLTLSQATVEEYTMHAGMSPFEMQDILLPSGTNGVKDLHISVSHSSSLALFASLGKKLSVLSLDSGNLVVNYDLQFNRGTSAMQHYVATRPMFIDVEIMNADTKLVLGDLAGQASPSNVARGLSSLYKEITDTVHKEAATITAVFPSPSEVMSILVQSKCSSLASWQLSSRTFDSINFMYLTHLRRADCNAKVHP

SEQ ID NO: 209883 - protein, 157 aa, Glycine max
  Coding DNA Sequence Number=SeqID_93105
  Homolog annotation: Hit_ID=Q84TY3; Match level="QueryCoverage=97%, HitCoverage=30%, E-value=5e-23, Identity=40%"; Hit description =Putative XS domain containing protein
  Pfam annotation: Domain name=zf-XS; Domain location=44-88; Score =90.8; E_value=4.3e-24; Accession=PF03470.5; Description=XS zinc finger domain
MAHSSSENDTDISESEISEYKDKTYQELKSGSQKVKNLDETFTCPYCPKRRKRDDYSYKELLQHASGVGRSSSKKRKARDKANHLALVKYLEKDLVSVDIPAEVSKPEDESGTSVNSDEQFVWPWIGIVVNIPTRLTGDGHSVGESGTGLRDEYKSR

SEQ ID NO: 209884 - protein, 144 aa, Glycine max
  Coding DNA Sequence Number=SeqID_93106
  Homolog annotation: Hit_ID=Q9LHB1; Match level="QueryCoverage=92%, HitCoverage=21%, E-value=4e-20, Identity=36%"; Hit description =Transcription factor X1-like protein
MKNIYGEHLQKMCDVKTISQLMEEEARRQDKLVSTLTNVIQVKNQHIKEIEVKCHETTHKMDLAMMEKDKLIQAYNAEIKKIQSSATDHLKKIFTDHEKLKLQLKSQKNELELRKVELEKREAHNESERKKLTKEIMECFQGRN

SEQ ID NO: 209885 - protein, 193 aa, Glycine max
  Coding DNA Sequence Number=SeqID_93107
  Gene Ontology: Mol. function=ferric iron binding; Biological process =aromatic compound metabolic process
  Homolog annotation: Hit_ID=Q7F761; Match level="QueryCoverage=89%, HitCoverage=31%, E-value=2e-33, Identity=40%"; Hit description =Putative transcription factor
  Pfam annotation: Domain name=XH; Domain location=115-190; Score=-3.3; E_value=5.3e-06; Accession=PF03469.5; Description=XH domain
MKLAEDQKRQKEQLHAKIIQLQKQLDKKQELELEIQQLKGSLNVLKHMDDYEDAEVLKKVDTLQKDLRDKEQSLQDLDELNQALIIKERESNDELQEARQALVDGIKELSSHGNICLKRMGELDTRPFLEAMKKRYNEEEAEERTADMCSLWEELLRNPDWHPFKVIMVEGKEKGVFGSWVLEGKEWEGKFLF

SEQ ID NO: 209886 - protein, 45 aa, Glycine max
  Coding DNA Sequence Number=SeqID_93108
  Homolog annotation: Hit_ID=O48937; Match level="QueryCoverage=82%, HitCoverage=5%, E-value=6e-07, Identity=68%"; Hit description=NADPH cytochrome P450 reductase
MVATIGLEGSEKGKGWLQNLHYGVFGLGNRQYEHFYKVIKVGVAD

SEQ ID NO: 209887 - protein, 145 aa, Glycine max
  Coding DNA Sequence Number=SeqID_93109
  Gene Ontology: Mol. function=nucleic acid binding; Biological process= DNA integration
  Homolog annotation: Hit_ID=Q1RWN2; Match level="QueryCoverage=97%, HitCoverage=10%, E-value=5e-45, Identity=62%"; Hit description =Peptidase S8 and S53, subtilisin, kexin, sedolisin; Integrase, catalytic region; Zinc finger, CCHC-type
MSSENFVQPAIPHFDGHYDHWSMLMENLLQSKEFWQVVADGVTTPSDDVALTDSQQKEYKVMKLKDLKAKNYLFQAIDRSILETILCKDTSKEIWDSMKKKYQGSSRVKRAQLQVLRRDFEFFQMKERESVTDYCSRTMGIANNM

SEQ ID NO: 209888 - protein, 491 aa, Glycine max
  Coding DNA Sequence Number=SeqID_93110
  Gene Ontology: Mol. function=nucleic acid binding; Cellular component= chromatin; Biological process=DNA integration
  Homolog annotation: Hit_ID=Q1RWN2; Match level="QueryCoverage=81%, HitCoverage=37%, E-value=2e-97, Identity=40%"; Hit description =Peptidase S8 and S53, subtilisin, kexin, sedolisin; Integrase, catalytic region; Zinc finger, CCHC-type
  Pfam annotation: Domain name=rve; Domain location=223-376; Score =38.7; E_value=2e-08; Accession=PF00665.16; Description=Integrase core domain
  Pfam annotation: Domain name=zf-CCHC; Domain location=63-80; Score =19.3; E_value=0.00065; Accession=PF00098.13; Description=Zinc knuckle
  Pfam module annotation: Pfam domain module=rve::zf-CCHC; Domain location=223-376::63-80
MEEHALKASTNTHSNNSRGRGRGRGRGRGCGDRGNRDFNNNSKDNNDQFQGNGRGRDHDKSKVQCYKCHKFAHYASNCYTRLLNLKEKGESSNFIKEKEVETLFMVVEDTKDSEAEIWYVDTGCSNHMSGKTISSVLYVTDLKSNLLSAGQLQEKGYEIFINKGTCEIFDPIRGAIAIIKMNSNRLFSLKIESIHSSLMAKDIVSTWLWHYRYGHLSFNGLKTLEQKNMVIGLPQITIPSQVCEECVVSKQHHSQFPNGKSWRAKCVLELIHSDICGSINPSSNGDHDGEYCSDEFSTFCVNHGIWMELTTTTYTPQQNGVSETKNRTILNMVRCLLTKSGVSKEFWPEVVNWSVHILNRNPTFVVKNMTPEEVWSGRKLTVDHFRIFGCIAYAHIPDKKRYKLDGKGEKCIFLGVSDQSKAYKLYNPTTKKIIISRDVVFDEERFWENNIDETKKILENFDEDNEDEELQTRVLEEQRIPAIIVEDERPQ

SEQ ID NO: 209889 - protein, 179 aa, Glycine max
  Coding DNA Sequence Number=SeqID_93111
  Gene Ontology: Mol. function=DNA binding; Cellular component=proton -transporting two-sector ATPase complex; Biological process=DNA integration
  Homolog annotation: Hit_ID=Q1T2W1; Match level="QueryCoverage=98%, HitCoverage=25%, E-value=4e-57, Identity=55%"; Hit description =Integrase, catalytic region; Asp/Glu racemase
MHLLAAKRILRYLQGTREFELFYKRGEEFNLLGFTDSDYVGDSDDRKMISWSSRKQPIVTLSTTETEFVVASACACQAIWLRNILEEVHFKQQGPTLIYCDNSSTIKLSKNPIMHGRSKHIDVRFHFLRDLSKEGIIDLIYCKSEEQITNIMTKPLKLSAFQKLRNLLGVCMLNDSHLN

SEQ ID NO: 209890 - protein, 59 aa, Glycine max
  Coding DNA Sequence Number=SeqID_93112
  Gene Ontology: Mol. function=electron carrier activity; Cellular component=mitochondrion; Biological process=electron transport
  Homolog annotation: Hit_ID=Q75LJ3; Match level="QueryCoverage=81%, HitCoverage=13%, E-value=2e-18, Identity=95%"; Hit description =Putative flavoprotein alpha-subunit, having alternative splicing products
  Pfam annotation: Domain name=ETF_alpha; Domain location=1-44; Score =15.8; E_value=4.1e-06; Accession=PF00766.10; Description=Electron transfer flavoprotein alpha subunit
MVTTPIVAPTTKVGQTGKIVAPELYMAFGVSGAIQHLAGMRDSKVIVAVNNDADAPIFQ

SEQ ID NO: 209891 - protein, 45 aa, Glycine max
  Coding DNA Sequence Number=SeqID_93113
MTTLGSACKSDLGSPNNKTLGLLGSKGCVRVSVGCLRMPPDSWVT

SEQ ID NO: 209892 - protein, 115 aa, Glycine max
  Coding DNA Sequence Number=SeqID_93114
  Homolog annotation: Hit_ID=Q5W7C9; Match level="QueryCoverage=48%, HitCoverage=21%, E-value=6e-21, Identity=83%"; Hit description =Unknow protein
MEARDYNSAVECHLDVVEVISSSLIIPKPNARGITRGVGGLYFWERTPVEYEAPGYKLCIGMEENSESALSTNKEAISNATRNLMESSILAQDERWRHALHMQVGREVVFPVADG

SEQ ID NO: 209893 - protein, 209 aa, Glycine max
  Coding DNA Sequence Number=SeqID_93115
  Homolog annotation: Hit_ID=Q0KIN0; Match level="QueryCoverage=70%, HitCoverage=8%, E-value=4e-12, Identity=30%"; Hit description =Integrase core domain containing protein
  Pfam annotation: Domain name=zf-CCHC; Domain location=126-143; Score =10.9; E_value=0.016; Accession=PF00098.13; Description=Zinc knuckle
MKVTALKQTSHDMIAHIGKARAAVEELKRFLVAESLEEVNRKLDKFYMVLILRSLHSDFDHVRDQVLAGDQVPSMDSLITRLLRVPHALKEENPADVVETSAMAAPRGRGGGRNSRGGRGGRGGRPQCTYCKRMGHTQETCYSLHGFPDKVAQLKSEKSSSQTSSSSVPCYSTACISQSIDGPSPWILDSGASDHISGTWHGSIDWRRT

SEQ ID NO: 209894 - protein, 263 aa, Glycine max
  Coding DNA Sequence Number=SeqID_93116
KESALWHPYRTRAKDKVMSEIEEVQEHMKANIEAMKEQLTKMMEVMMSMRKMMEVNTATVVAASTATEMDPTHPSGLNQVNPPASGMVGQGGKALGSKDVPRFVQVQNKHSFPPYGLPPNYTPPNVAHAPDENVDNSTLITIESQHPKSGHAQVPQPIGETHEYHPQPQPFHFAVGRVPPAMVEREKFDHIEEKLRVIEGGINYSFDDMVELCLVPDMVIPSKFKVPNFDKYKGTTFPKNHLNMYCRKMGTYVKDKKLLMHFF

SEQ ID NO: 209895 - protein, 134 aa, Glycine max
  Coding DNA Sequence Number=SeqID_93117
MDAWESLVDCPLEHQFHDYLKNFEIACSPWPVFVYYVNETWIIPHKEKFVTTWTNKNQELSKFQRIRSQKASRIKVHRIKIQEQSSFKIQDSRTIKFQESRFKNIQDQDSRLKIKESREDSIKISTKKVFQNIE

SEQ ID NO: 209896 - protein, 103 aa, Glycine max
  Coding DNA Sequence Number=SeqID_93118
MANKNISSNETYSPTLIPKTIPKLQNSLRVGKGNIGSKGISKELIQGRLIWLEAYKNKIPKSSPNMHVKQEVSTRVKPRLLCKQSMGQNTSNKIDDGSNSHQG

SEQ ID NO: 209897 - protein, 61 aa, Glycine max
  Coding DNA Sequence Number=SeqID_93119
MYMTDCPLHHEYGPRCFASRAELTRIVENHVNKVNVRIVIVGFKSNDFVLSLLKTAFALEL

SEQ ID NO: 209898 - protein, 133 aa, Glycine max
  Coding DNA Sequence Number=SeqID_93120
  Homolog annotation: Hit_ID=Q9AVH2; Match level="QueryCoverage=35%, HitCoverage=16%, E-value=3e-20, Identity=97%"; Hit description =Putative senescence-associated protein
MARHKVTRTHTHTHSRRHKAEEGLGPRPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 209899 - protein, 99 aa, Glycine max
  Coding DNA Sequence Number=SeqID_93121
  Subcellular localization annotation: CTP_CleavageSite=47; ConfidenceScore=5.42e-01
MASASTFGASFRVFSITTFIAFSADFHSLAKPFCQLSEPFAESNTPSAEREEESRRRMSCACLVSESCAKRANTNKAAYLSRKSEMEREFWKFSKLLHV

SEQ ID NO: 209900 - protein, 75 aa, Glycine max
  Coding DNA Sequence Number=SeqID_93122
  Homolog annotation: Hit_ID=UPI00005100BF; Match level="QueryCoverage =74%, HitCoverage=12%, E-value=5e-09, Identity=55%"; Hit description =COG2723: Beta-glucosidase/6-phospho-beta-glucosidase/beta- galactosidase
  Subcellular localization annotation: CTP_CleavageSite=28; ConfidenceScore=5.48e-01
MAPGAESSHPTSTSRSRMTPDSARPSLPAGLRWSAATSAFQIEGSRPTGLTGRSIWDDFLEVPGAIRDGSTAEPA

SEQ ID NO: 209901 - protein, 135 aa, Glycine max
  Coding DNA Sequence Number=SeqID_93123
  Gene Ontology: Mol. function=structural constituent of ribosome; Cellular component=ribonucleoprotein complex; Biological process =translation
  Homolog annotation: Hit_ID=Q6AEB3; Match level="QueryCoverage=63%, HitCoverage=100%, E-value=3e-24, Identity=68%"; Hit description=30S ribosomal protein S20
MPADTSLTTKKARTGDGRAFFRRFESERRDLLGESRLAVRRLVLVQDTLADGLVELDGGLLQGGFGCGLVTGGDGSAGRADEGLELALDGLVALASLLVGLVALDLRLDVCHVWTLSVQDCSECRSQKRAAARRS

SEQ ID NO: 209902 - protein, 91 aa, Glycine max
  Coding DNA Sequence Number=SeqID_93124
MKEGLRASFFTESLRWILDILLQLKHSSLCGGPMTSNGGSWRPPMVMGGGGGGLGFWILLSELVSLSEIQLLALSVTSCAERITSLSWNCA

SEQ ID NO: 209903 - protein, 84 aa, Glycine max
  Coding DNA Sequence Number=SeqID_93125
DDKKCGAVDKSEAFAPTFPQFEMRNSDLRSSSLHDVRITGRCLHMLPGSWVMIAKGVVIDKSGAFAPTYPQLVMRKSDLRSSCL

SEQ ID NO: 209904 - protein, 389 aa, Glycine max
  Coding DNA Sequence Number=SeqID_93126
KVEIYHTKLDEFKGELERHNFHKRLTNLADSSIGLPLVKKFYTNHYSSKGPAPKQLKIRGHLIRIDADNLNAFLETLVVLVEGESLPDYSRYCRMPTNTKEIKAALCIPDQGFILNAKGHPGKILVKDLTTLAQVWSVLSYSNLAPTSHTSDLTVDRASFSSLSSFSIPLPFIFQEAKESIDEEDPRPTSSNGAYITRRPRARLVETPSTSAAPHPASTLVAPPPTRITEAPSTPLPARFQCFKAMLRSIHQGQIILLQSLQLVAPLDSIPTVEKFNEWVAWPGTQPPLHRDDEDPAAQVPHQPSDESSKSSTPEPLIRKRRVVVTQEAAATPKKSSEATLEPPAPLADTTSPQQAADPSMPEVQTTPVLSPNTSPVATLVLHLTDEEE

SEQ ID NO: 209905 - protein, 365 aa, Glycine max
  Coding DNA Sequence Number=SeqID_93127
  Homolog annotation: Hit_ID=Q1T4Y8; Match level="QueryCoverage=94%, HitCoverage=78%, E-value=2e-95, Identity=54%"; Hit description=Amino acid/polyamine transporter II
MAKNENKEKIMIFPWINEEEQDIEAIGYHSDNDSDQCGRDSEGNRRTEPLSSSSQIWPQTYGEATDSYSISAAPNLESIIRAPSVIYSSFIGGGGFGSKSYLEHDERTSFLSGEELTNRGISRRQSTWWEKASIQMQIPEELPVVYGCSLSQTIFNGMVLHEWIILERFILLFQGINVMAQVGLLSTPYTVKQAGWAADLMRHCFESREGIISYPDIGQAAFGRYDRLIVSSYCVEFIILEGDNLTRLFPGTSLHWGSFQLDSKHLFGILTALVILPTVWLRDLRIISYLSANTYSITCDDSAAGGVISTALITMCVFLVGTSDSVGFHLTGPLVKWSGMPFAFGTLSQITLNLPPNAFASKVAL

SEQ ID NO: 209906 - protein, 45 aa, Glycine max
  Coding DNA Sequence Number=SeqID_93128
MSSLSTLHMICTRLLATQLADGLLVKPRGLAPPLAKLIALALLQD

SEQ ID NO: 209907 - protein, 64 aa, Glycine max
  Coding DNA Sequence Number=SeqID_93129
MPLERVPERRVQLRDGDYVEFHEEISKRQWTQLVSPMAKYDSEIVMEFYANAWPIEEGARDKHS

SEQ ID NO: 209908 - protein, 85 aa, Glycine max
  Coding DNA Sequence Number=SeqID_93130
  Homolog annotation: Hit_ID=O80667; Match level="QueryCoverage=87%, HitCoverage=47%, E-value=4e-14, Identity=53%"; Hit description =Expressed protein
KRRGDDDTNKKPLAKAEFQEIMQNLVKTSGFTGIGAKEAILCIFGVPLAALLIKQRVMPEVVRDEFFIPGVTSATVFTLAALNKI

SEQ ID NO: 209909 - protein, 47 aa, Glycine max
  Coding DNA Sequence Number=SeqID_93131
MGRGEAILHPNSSPNFQKPKCSWESRIQQPPSPYCAFIPTGLSWVLV

SEQ ID NO: 209910 - protein, 756 aa, Glycine max
  Coding DNA Sequence Number=SeqID_93132
  Gene Ontology: Mol. function=phosphatidylinositol phosphate kinase activity; Cellular component=plasma membrane; Biological process =phosphatidylinositol metabolic process
  Homolog annotation: Hit_ID=Q2HW52; Match level="QueryCoverage=99%, HitCoverage=99%, E-value=0.0, Identity=68%"; Hit description =Phosphatidylinositol-4-phosphate 5-kinase
  Pfam annotation: Domain name=MORN; Domain location=102-124; Score =29.2; E_value=1.4e-05; Accession=PF02493.10; Description=MORN repeat
  Pfam annotation: Domain name=MORN; Domain location=125-147; Score =29.9; E_value=8.8e-06; Accession=PF02493.10; Description=MORN repeat
  Pfam annotation: Domain name=MORN; Domain location=148-170; Score =31.3; E_value=3.4e-06; Accession=PF02493.10; Description=MORN repeat
  Pfam annotation: Domain name=MORN; Domain location=171-193; Score =30.3; E_value=7e-06; Accession=PF02493.10; Description=MORN repeat
  Pfam annotation: Domain name=MORN; Domain location=194-216; Score =24.8; E_value=0.0003; Accession=PF02493.10; Description=MORN repeat
  Pfam annotation: Domain name=MORN; Domain location=218-240; Score =10.4; E_value=0.29; Accession=PF02493.10; Description=MORN repeat
  Pfam annotation: Domain name=MORN; Domain location=79-101; Score =36.4; E_value=9.6e-08; Accession=PF02493.10; Description=MORN repeat
  Pfam annotation: Domain name=PIP5K; Domain location=473-752; Score =401.2; E_value=1.5e-117; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=102-124::125-147::148-170::171 -193::194-216::218-240::79-101::473-752
MIGKDSGVMKAWEATMRKTHAVAKKRANSIFGTISLAHVVDEEENNNNDDYDDDNEENGKNETFDVYIEEKVLPNGDYYTGEWANNFPHGLGKYLWTDGCMYVGEWFKGKTKGKGRFSWPSGATYEGDFKSGFMDGNGTYTGCNGETYKGQWVMNLKHGHGFKSYANGDWYDGEWRKDLQDGEGRYVWKDESHYVGEWRNGTIWGKGSFVWAENGKVFEGFWEDGLPKGKGTSSGLMGVFMREILVKMVRIKMVHTTIHASHHQMVKKGIVNYGILKICPGEKVQVMPSHKRLAVWRSTKTGESAKNRRISLDGRVSIGLEKPSDRLQIWDGGESDASGAKTPTMGSDLDEDLMGLRVDDGGESLGQLQPIKAPKKSKRQGETICKGHKNYELMLNLQLGIRHSVARPAPTASLDLKPSAFDPKEKVWTRFPPEGSKYTPPHPSCDFKWKDYCPVVFRTLRKLFKVDPADYMLSICGNEALRELSSPGKSGSFFYLTNDDRYMIKTMKKAEVKVLLRMLPSYYNNFRDHQNTLLTKYYGLHCVKLNGPIQKKVRFIIMGNLFCSEYITHRRYDLKGSSLGRFSDKPETDISETTILKDLDLNFIFRLEKSRFEEFCRQVDKDCELLEQEGIMDYSLLLGIYFKDISPDGEIIPLQSRTPVGDSENEANPHTSCEDTDQPPSDPSREFEDIRWVEWVREKKRGGKVADILQDYDISKKLEHAYKSIQYDPTSISAVDPIQYSRRFRDFIFRIFTEDS

SEQ ID NO: 209911 - protein, 51 aa, Glycine max
  Coding DNA Sequence Number=SeqID_93133
MEGAIDDTQHHVSEDWLQIWNMKTPPRVKMLTWRICRDIILLQLGLDFARK

SEQ ID NO: 209912 - protein, 122 aa, Glycine max
  Coding DNA Sequence Number=SeqID_93134
MVQKGERRIHGDPPVEYWNDLKSALRKRHIPPYYERELMDNSKGLNKGHIASQCPTKKTMIMRGQDIYSSQEETTSCPSSSGSEDEVRGEESSEEVYPHEEGDLFKGQGEGKRGKGFLQEDC

SEQ ID NO: 209913 - protein, 33 aa, Glycine max
  Coding DNA Sequence Number=SeqID_93135
MDCGGKDCNQGHRHLATMNIGLQATMYTGDPNG

SEQ ID NO: 209914 - protein, 130 aa, Glycine max
  Coding DNA Sequence Number=SeqID_93136
MNHKHMGSVNLILQILLCDDKVGTSLSCEVSICYSIISLKESDIIKTDTLLHQIGQIVIAIQVDPSVTKAQHTFISTPVLLLFNMALFVFFTSRGQAEEEKGMLRVSQQSEGRGEGDTQQSEGLEGEVSK

SEQ ID NO: 209915 - protein, 204 aa, Glycine max
  Coding DNA Sequence Number=SeqID_93137
MAPKNFSTKRSRRDAATEGTSAAPEFDSLRFRSVEHQQCFKAIKGWLFHRERRVQLRDDEVYANAWPTVEGVWDIRSWVRGQWIPFDADALSQFLGDPLVLEEGQECEFSQTRNRADGFDEEAIAQLLCIPGQDFARTAARRRVQIMRTSMTTLTQMWMTLLLSNVLPSDHNSDLPLPKCQLVYHPPDTLWTRICLTGPWGFQP

SEQ ID NO: 209916 - protein, 95 aa, Glycine max
  Coding DNA Sequence Number=SeqID_93138
  Gene Ontology: Mol. function=translation elongation factor activity; Cellular component=cytoplasm; Biological process=translation
  Homolog annotation: Hit_ID=Q1S824; Match level="QueryCoverage=98%, HitCoverage=14%, E-value=2e-33, Identity=61%"; Hit description =Elongation factor Tu, domain 2; Translation elongation factor G
  Pfam annotation: Domain name=EFG_C; Domain location=7-72; Score=8.4; E_value=8.2e-05; Accession=PF00679.14; Description=Elongation factor G C-terminus
MLTAKPRLLEPVYLVEIQAPDQALDGAYSVLNQKRGHVFEECQRPGTPLHNVKAYLPPSDPLEPVTPAAARVAEIRRKKGFDVEMRPLSEFEDRL

SEQ ID NO: 209917 - protein, 320 aa, Glycine max
  Coding DNA Sequence Number=SeqID_93139
  Gene Ontology: Mol. function=transferase activity; Cellular component= endoplasmic reticulum; Biological process=biosynthetic process
  Homolog annotation: Hit_ID=Q1S823; Match level="QueryCoverage=87%, HitCoverage=61%, E-value=1e-123, Identity=77%"; Hit description=Myb, DNA-binding; Glycosyl transferase, group 1
  Pfam annotation: Domain name=Glycos_transf_1; Domain location=57-258; Score=12.9; E_value=0.00023; Accession=PF00534.10; Description =Glycosyl transferases group 1
MADASLCVTKAMLHELAQNWGIKLNEDLFQPLGVRDCVSNGTSLIASHRQNETLFTTEFGSNIYLKPNRPALVVSSMSWTPDKDFAILLEAAVMYDRRVAAIIGEDDSVDEEVMWKEISDAKQCLYPRLLFIITGKGPEKEKYEATIKGMKLKRVAFRTMWLSADDYPLLLGSADLGVCLHMSSSGLDLPMKVVDMFGCGLPVRAVSYSCIRELVRLDKNGLLFSSSSELADELLLLFKGFPDDCEALEVLKYGALETGSSARWATEWEEQAKPLITEASSFCNAMHYLIIRSSTLVVVCLSDQFPIYRNRQNLQVDRIF

SEQ ID NO: 209918 - protein, 135 aa, Glycine max
  Coding DNA Sequence Number=SeqID_93140
  Gene Ontology: Mol. function=DNA binding
  Homolog annotation: Hit_ID=Q1S822; Match level="QueryCoverage=91%, HitCoverage=50%, E-value=2e-31, Identity=64%"; Hit description=DNA -binding HORMA
MMERRQNQTPQGQIARVLVEFFGGGYYCCCFSQRGLSFWLLLANKYCKLIGIHFCGRGKGAFERRRYMNVVIQRALHRQLRYYMHATVSGLLPSMQKLGMVERVAVIFFNADNVPLEKFVFKLTMNQTKFRGGRG

SEQ ID NO: 209919 - protein, 58 aa, Glycine max
  Coding DNA Sequence Number=SeqID_93141
MLETLLHTYFVQDYKVCMQSAHSTSQLSTGSGQQLDPIILLEKLKMSSKNQQCVKILT

SEQ ID NO: 209920 - protein, 93 aa, Glycine max
  Coding DNA Sequence Number=SeqID_93142
MEREREESIFFDGKLASVPKALAKRGWVPNTVPSLDGIHNVVTAEIDEAKARVTRKYMTLEQPLAAKKVVDLSIGGYDGSTKVEVGLGEGGYN

SEQ ID NO: 209921 - protein, 86 aa, Glycine max
  Coding DNA Sequence Number=SeqID_93143
  Gene Ontology: Mol. function=translation elongation factor activity; Cellular component=ribosome; Biological process=translation
  Homolog annotation: Hit_ID=Q1S824; Match level="QueryCoverage=98%, HitCoverage=10%, E-value=2e-28, Identity=74%"; Hit description =Elongation factor Tu, domain 2; Translation elongation factor G
  Pfam annotation: Domain name=GTP_EFTU; Domain location=1-86; Score= -54.4; E_value=0.0027; Accession=PF00009.17; Description=Elongation factor Tu GTP binding domain
MAALHVTDGALVVVDCVEGVCVQTETVLRQALGERVKPVLVVNKMDRCFLELHLDAEEAYLTFQRVVESANVIMATYEDAALGDIQ

SEQ ID NO: 209922 - protein, 346 aa, Glycine max
  Coding DNA Sequence Number=SeqID_93144
  Gene Ontology: Mol. function=oxidoreductase activity; Cellular component=proton-transporting two-sector ATPase complex; Biological process=ATP synthesis coupled proton transport
  Homolog annotation: Hit_ID=Q1SCC5; Match level="QueryCoverage=98%, HitCoverage=94%, E-value=1e-98, Identity=51%"; Hit description=2OG -Fe(II) oxygenase
  Pfam annotation: Domain name=2OG-FeII_Oxy; Domain location=197-296; Score=137.2; E_value=4.6e-38; Accession=PF03171.10; Description=2OG -Fe(II) oxygenase superfamily
MAVTSIDELEEGTVGVQGLVENGATKVLRMFYCERTNDSEGSTSEPNSKFSIPTIDLTGIRDDPVLRDGACEKWRFFQVIKREIPSDVLDEMIKGSGRFHQQDVKVRKEYYTCDPNRKVAYVSNYSLYHDPAANWRDTLGCVMAPHPPEAEELPAICRDIVVEYSKRVKAFASTLFELLSEALGLNRFHLEKIGCAEWFLLLCHYYPACPEPELTMGNRKHTDNDFITILLQDQIGGLQVLHDNQWVDVTSIHGALVINIGDLLQLLTNDKFISVKHGLLANHPGPRISVASLFRTDGDDSLVYGPIKELLSKENLPLYRDVSLKEYLTYYYAKGIGTSGLSHFKL

SEQ ID NO: 209923 - protein, 186 aa, Glycine max
  Coding DNA Sequence Number=SeqID_93145
  Gene Ontology: Mol. function=oxidoreductase activity; Cellular component=proton-transporting two-sector ATPase complex; Biological process=ATP synthesis coupled proton transport
  Homolog annotation: Hit_ID=Q1S826; Match level="QueryCoverage=77%, HitCoverage=75%, E-value=8e-27, Identity=60%"; Hit description=2OG -Fe(II) oxygenase
MTFLRAQSTVELNPLIAQAFDDSKADLSEVGQEPSSRQDGSGCEPWHPCDGSRGLERWGAKMRPFVYNSNYYLYGSPALNWPRDTFLCYLAPNPPKPEDLPVLITNDRFKSVEHRVLANLKGPRILSIACFFSAGLKSSPKLYGPIKELLSEDNHPKYRETTVAEYVRHFNAKGLGGTSALQHFRI

SEQ ID NO: 209924 - protein, 75 aa, Glycine max
  Coding DNA Sequence Number=SeqID_93146
MRSKILCPNVTLIRACLYHQLSLSVSIMDSSYDGSPETKWQSAQTQTHTRMKNLVGRLGVHDRTCLTMGKSGQSH

SEQ ID NO: 209925 - protein, 109 aa, Glycine max
  Coding DNA Sequence Number=SeqID_93147
  Gene Ontology: Mol. function=L-ascorbic acid binding; Cellular component=proton-transporting two-sector ATPase complex; Biological process=ethylene biosynthetic process
  Homolog annotation: Hit_ID=Q1T6A6; Match level="QueryCoverage=90%, HitCoverage=47%, E-value=2e-23, Identity=37%"; Hit description=2OG -Fe(II) oxygenase
MVATSTDELVSSYDRKSEIKAFDDSKVGVQGLVENGVTKVTNHGIPTHILDEMIKGTRRFHEQDAKVRKEYYTRDMSRKVIYLSNFSLYQDPSTDWRDTLAFFWAPNPP

SEQ ID NO: 209926 - protein, 50 aa, Glycine max
  Coding DNA Sequence Number=SeqID_93148
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process =ethylene biosynthetic process
  Homolog annotation: Hit_ID=Q1SCC5; Match level="QueryCoverage=100%, HitCoverage=13%, E-value=1e-15, Identity=70%"; Hit description=2OG -Fe(II) oxygenase
MGTSRHTEGNFMTILLQDQIGGLQVLHENQWIDVPAVHGALDMNIGDLLQ

SEQ ID NO: 209927 - protein, 92 aa, Glycine max
  Coding DNA Sequence Number=SeqID_93149
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1SCC5; Match level="QueryCoverage=92%, HitCoverage=23%, E-value=4e-20, Identity=55%"; Hit description=2OG -Fe(II) oxygenase
MGAEARKLVTNDKFISVEHRVLANHLGPRTSIASFFRIGDQLPESLSKVFGPIKELLSEHNPPVYRKASLKDYLAHQYTKSIGASSLSLFRL

SEQ ID NO: 209928 - protein, 36 aa, Glycine max
  Coding DNA Sequence Number=SeqID_93150
MAATNTDQLEAGIVSSYDRTSELMALDDSNAGVPGL

SEQ ID NO: 209929 - protein, 47 aa, Glycine max
  Coding DNA Sequence Number=SeqID_93151
MAEPRLRVTELIQRTNTLLLGVHPVDKRRTVSEYRNIFPAIDFSLLL

SEQ ID NO: 209930 - protein, 44 aa, Glycine max
  Coding DNA Sequence Number=SeqID_93152
MAYGVVMRGTVGRGATYVSNLLYATNRNFETAPMDVVCLGKTKN

SEQ ID NO: 209931 - protein, 759 aa, Glycine max
  Coding DNA Sequence Number=SeqID_93153
  Gene Ontology: Mol. function=glutamate synthase (ferredoxin) activity; Cellular component=chloroplast; Biological process =nitrogen compound metabolic process
  Homolog annotation: Hit_ID=Q43860; Match level="QueryCoverage=44%, HitCoverage=98%, E-value=1e-156, Identity=77%"; Hit description =Glutamate synthase
  Pfam annotation: Domain name=GATase_2; Domain location=24-308; Score =396.8; E_value=3.2e-116; Accession=PF00310.11; Description=Glutamine amidotransferases class-II
  Pfam annotation: Domain name=Glu_syn_central; Domain location=587 -758; Score=89.1; E_value=1.4e-23; Accession=PF04898.4; Description =Glutamate synthase central domain
  Pfam module annotation: Pfam domain module=GATase_2::Glu_syn_central; Domain location=24-308::587-758
MHVHSGKGKRGQEKDNEPQYKGLEVYVRRRKKVAQEELVLGWRPVPVNTSVVGYYAKETMPNIQQVFVKIVKEENVDDIERELYICRKLIEKAVSSESWGNELYFCSLSNQTIIYKGMLRSEVLGYSTNTSPRWPLAQPMRLLGHNGEINTIQGNLNWMQSREPSLKSPVWRGRENEIRPFGNPKASDSANLDSAAELLIRSGRSPEEAMMILVPEAYKNHPTLSIKYPEVVDFYDYYKGQMEAWDGPALLLFSDFKNLRSSTLVRKGWFLETDSDGKTVGACLDRNGLRPARYWRTSDNMVYVASEVGVVPVDESKVVLKGRLGPGMMITVDLPGGQVYENTEVKKRVALSSPYGNWIKENLRSLKPGNFLSASVLDNEALMWDYTSTLEAAIKAALKRPHPRRARVLVMDLRVENRFGRKSQDRISRTNWCQIKGEKQWSLYQSYGEIAWGGNRKCKWYLGQDGQRDLGRWLKKLLVNQKVDDLWVKNLGGERYQKGFEQELLMGYTNPLAPKVPREILSKARKKKAVCIAYIQAINDMFERVTTGMGVQDRITTGPIVQNNEEIEGDLKLRIQEGWIMGGTEECFGAFGYSSEDVQMVIESMAAQGKEPTFCMGDDIPLAALSQKPHMLFDYFKQRAKLLISLHLDHVTNPAIDPLREGLVMSLEVNIGKRRNILETGPENASQVMLSSPVLNEGELESLLKDSYLKPQVLPTFFDISKGIEGSLEKALNKLCEAADEAVRNGSQLLILSDHSEAL

SEQ ID NO: 209932 - protein, 143 aa, Glycine max
  Coding DNA Sequence Number=SeqID_93154
  Homolog annotation: Hit_ID=Q1T693; Match level="QueryCoverage=73%, HitCoverage=7%, E-value=2e-29, Identity=63%"; Hit description =Integrase, catalytic region; Zinc finger, CCHC-type; Peptidase aspartic, catalytic
MATHLRAHNIWSFVETGLTEGANDIAKRRYQLVYGEDILNNKIVDKILQTLPMKFDHVVTTIIESHDTNTMTIEKLYGSIESHVSRILEKTKKENEEALKSQVNLNNVAETSRSAENRAYGNFNSGGRGNFKGRGRGNYNGRG

SEQ ID NO: 209933 - protein, 260 aa, Glycine max
  Coding DNA Sequence Number=SeqID_93155
  Gene Ontology: Mol. function=nucleic acid binding; Cellular component= endoplasmic reticulum membrane; Biological process=DNA integration
  Homolog annotation: Hit_ID=Q1RSG2; Match level="QueryCoverage=91%, HitCoverage=29%, E-value=2e-79, Identity=76%"; Hit description =Integrase, catalytic region; Zinc finger, CCHC-type
MDVKYAFLNGIMEEEVYVEQLARYVFRGKEDKIYRLKKALYRLKQALRAWYTKIDSYFVQHGFKRCPFEHTLCVKFVDLEDILIVCLYVDDLIFIDNNSKMIAECREAMISYFEMTDLGLMSYFLGIKVIQQDNVIFISQKKHASDILKEFKMENSKPISTLVQEKLKLTKEGDEKMINATQYRSLIGNLRRSKHIDIRCHKIWKLIVDKEMWINYCPIENQIVDIFTKPLKMELFHKFAVKLMQLLSQYMIYQYEHQLR

SEQ ID NO: 209934 - protein, 83 aa, Glycine max
  Coding DNA Sequence Number=SeqID_93156
MVKIKKEFGSVRQPCDHPRHKEVSKNDPLQPKMRLLQRETHQAVNHALITRIRLSIAQTWIQSSSHGVSYITAAALVPNLYLF

SEQ ID NO: 209935 - protein, 125 aa, Glycine max
  Coding DNA Sequence Number=SeqID_93157
MPISPCGCISWSVSSRHRDHARKTPVDLEKSNRVLGFPALIMSLCQFYGVPVTPNKVIRPRINRAFIKKYCAPKQAQGETPQQHWDGWQQATGAPPPPLEFTSAHPQKRLEHCLRHMADQVQSQR

SEQ ID NO: 209936 - protein, 65 aa, Glycine max
  Coding DNA Sequence Number=SeqID_93158
MALSEHSSVITGRKREECTWKSVPCMRDPPKQWDDPLGDRPLRGMVRTIAVFRWKKARYALCTCW

SEQ ID NO: 209937 - protein, 80 aa, Glycine max
  Coding DNA Sequence Number=SeqID_93159
  Gene Ontology: Mol. function=molecular_function; Cellular component =cellular_component; Biological process=biological_process
  Homolog annotation: Hit_ID=O80327; Match level="QueryCoverage=81%, HitCoverage=33%, E-value=4e-12, Identity=53%"; Hit description =Thaumatin-like protein 1 precursor
LLPYKVRERVPEASVSSIRDAGGIAPASLHGISPEPQSAPPHVNFPEGSLEQKMKTWMHGSSKPVDDNCGLPAAVKEVTL

SEQ ID NO: 209938 - protein, 273 aa, Glycine max
  Coding DNA Sequence Number=SeqID_93160
  Gene Ontology: Mol. function=protein-tyrosine kinase activity; Cellular component=integral to membrane; Biological process=protein amino acid phosphorylation
  Homolog annotation: Hit_ID=Q1SXM9; Match level="QueryCoverage=97%, HitCoverage=52%, E-value=1e-100, Identity=46%"; Hit description =Protein kinase
  Pfam annotation: Domain name=LRRNT_2; Domain location=22-68; Score =37.1; E_value=6.1e-08; Accession=PF08263.3; Description=Leucine rich repeat N-terminal domain
  Pfam annotation: Domain name=LRR_1; Domain location=119-141; Score =5.3; E_value=30; Accession=PF00560.23; Description=Leucine Rich Repeat
  Pfam annotation: Domain name=LRR_1; Domain location=143-165; Score =13.7; E_value=0.67; Accession=PF00560.23; Description=Leucine Rich Repeat
  Pfam annotation: Domain name=LRR_1; Domain location=186-210; Score =11.6; E_value=1.9; Accession=PF00560.23; Description=Leucine Rich Repeat
  Pfam annotation: Domain name=LRR_1; Domain location=212-233; Score =12.9; E_value=1.1; Accession=PF00560.23; Description=Leucine Rich Repeat
  Pfam annotation: Domain name=LRR_1; Domain location=235-258; Score =12.7; E_value=1.2; Accession=PF00560.23; Description=Leucine Rich Repeat
  Pfam annotation: Domain name=LRR_1; Domain location=71-94; Score=0.5; E_value=2.3e+02; Accession=PF00560.23; Description=Leucine Rich Repeat
  Pfam annotation: Domain name=LRR_1; Domain location=96-117; Score =1.1; E_value=1.8e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=22-68::119-141::143 -165::186-210::212-233::235-258::71-94::96-117
ATRKGMQAIWFMLLLLVAIALGNSDIDSLLEFKKSIQNDPSGLVVNSWDSRSLDSDGCPKNWHGIVCSEGSVISITLDNAGLVGEFNFLAISGLTMLRNLSAVNNHFTGDLLYIATIESLEYADLSLNKFNGPLLSNFTQLRKLIYLNLSSNELGGTLPIEFHKLEQLKISGTPDLGLADESFLSSIQYLNISHNSLSGELFAHDGMPYLDNLEVFDASNNQLEGNLPSFTFVVSLRILRLACNQLTGLLPEALLKESSMMLSELDLSQNKLE

SEQ ID NO: 209939 - protein, 85 aa, Glycine max
  Coding DNA Sequence Number=SeqID_93161
MEYNQGVIVGKGMLLNRREKKKDRRQLPAQRRRKMTSASSFLSNMGNQIQSNPIQKTMIAHCFDAALTSTVPIPKCYVPRKFISH

SEQ ID NO: 209940 - protein, 95 aa, Glycine max
  Coding DNA Sequence Number=SeqID_93162
  Gene Ontology: Mol. function=RNA-directed DNA polymerase activity
  Homolog annotation: Hit_ID=Q8S798; Match level="QueryCoverage=54%, HitCoverage=16%, E-value=3e-16, Identity=73%"; Hit description =Putative retroelement
MRIVKAGNARFIENGEISGSTIPREVEIKEVRVQVPLACSSSRLPKGCKRVGCKWVFKTKPDSHGNFEHYKVRLVTKGFTQKDDIDYKETFSPVS

SEQ ID NO: 209941 - protein, 102 aa, Glycine max
  Coding DNA Sequence Number=SeqID_93163
MEGFLVSGKYVALQICDDKDVETMLESFQQQDQMSVLELYIEKDVVGGSMFHSANSLTSCGNNLSNNEVQPPRNVSRAIYIVMKMMMMMMIILCLTHTLKSL

SEQ ID NO: 209942 - protein, 338 aa, Glycine max
  Coding DNA Sequence Number=SeqID_93164
  Gene Ontology: Mol. function=protein binding; Cellular component =membrane; Biological process=defense response
  Homolog annotation: Hit_ID=Q8GZF0; Match level="QueryCoverage=98%, HitCoverage=29%, E-value=1e-150, Identity=76%"; Hit description =Resistance protein KR4
  Pfam annotation: Domain name=LRR_1; Domain location=135-154; Score =0.9; E_value=2e+02; Accession=PF00560.23; Description=Leucine Rich Repeat
  Pfam annotation: Domain name=LRR_1; Domain location=158-177; Score =7.0; E_value=14; Accession=PF00560.23; Description=Leucine Rich Repeat
  Pfam annotation: Domain name=LRR_1; Domain location=178-201; Score =12.8; E_value=1.2; Accession=PF00560.23; Description=Leucine Rich Repeat
  Pfam annotation: Domain name=LRR_1; Domain location=18-41; Score =11.6; E_value=1.9; Accession=PF00560.23; Description=Leucine Rich Repeat
  Pfam annotation: Domain name=LRR_1; Domain location=275-295; Score =10.8; E_value=2.7; Accession=PF00560.23; Description=Leucine Rich Repeat
  Pfam annotation: Domain name=LRR_1; Domain location=298-331; Score =3.3; E_value=70; Accession=PF00560.23; Description=Leucine Rich Repeat
  Pfam annotation: Domain name=LRR_1; Domain location=97-125; Score =3.0; E_value=78; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=135-154::158-177::178 -201::18-41::275-295::298-331::97-125
MKAWEKWECEAVIGAFPCLQYLDISKCPKLKGDLPEQLLPLKNLEIRECKQLEASAPRALELYLNDFGKLQLDWAYLKKLIMVGPSMEALLLEKSDTLEELEIYCCLQLGIFCNCRMRDDGCDSLKTFPLDFFPTLRTLDLNDLRNLQMITQDQTHNHLEFLTIRRCPQLESLPGSTSLKELRIYDCPRVESFPEGGLPSNLKEMRLIRCSSGLMASLKGALGDNPSLETLSITELDAESFPDEGLLPLSLTCLTISDFPNLKKLDYKGLCQLSSLKKLILDDCPNLQQLPEEGLPKSISYLEIEDCPKLKQRCQNPGGEDWPKIAHIPTLNISQWLC

SEQ ID NO: 209943 - protein, 225 aa, Glycine max
  Coding DNA Sequence Number=SeqID_93165
  Gene Ontology: Mol. function=transcription factor activity; Cellular component=nucleus; Biological process=regulation of transcription
  Homolog annotation: Hit_ID=Q1SA40; Match level="QueryCoverage=94%, HitCoverage=94%, E-value=4e-82, Identity=75%"; Hit description =TAFII55 protein conserved region
  Pfam annotation: Domain name=TAFII55_N; Domain location=1-158; Score =204.1; E_value=3.2e-58; Accession=PF04658.4; Description=TAFII55 protein conserved region
MEEQFILRVPPNVAERIERLLNENNASSSEDKSLDLSFREDGRSGTFMIGNEQFPASLLDLPCVVESYKTYDDNSLIKTANIGQMIMVRESGDAAPDVIEYRHGLTPPMRDARKRRFRREPDLNPELVSRVEKDLLKIMAGGTADNLDILTSFCPPDSGNKLNFGYFLDRNSHVETAEQEEGDENARGANKKSAPKPAPKHDIPENLTNAGEADRSDSEESDDSV

SEQ ID NO: 209944 - protein, 72 aa, Glycine max
  Coding DNA Sequence Number=SeqID_93166
MSLYGSSPTRYKFGYGVVAFGVGGVFAAAFGVGEMAMVVEERSRKSEKEKRVACFIFQFPSQALWMALMILD

SEQ ID NO: 209945 - protein, 104 aa, Glycine max
  Coding DNA Sequence Number=SeqID_93167
MGAKYLEVVKRGSHPNNGWSPDEIRYRHIILILSNSFLLFDTRRKMTIIFLCVAFGHDRAWAARRRMTIICLCVPPDTIASGWQKGVRNDHNLSPPTSRLTVPE

SEQ ID NO: 209946 - protein, 320 aa, Glycine max
  Coding DNA Sequence Number=SeqID_93168
  Gene Ontology: Mol. function=oxidoreductase activity; Cellular component=intracellular; Biological process=electron transport
  Homolog annotation: Hit_ID=Q8LJU3; Match level="QueryCoverage=99%, HitCoverage=74%, E-value=1e-142, Identity=73%"; Hit description =Ascorbate oxidase
  Pfam annotation: Domain name=Cu-oxidase; Domain location=2-70; Score =3.9; E_value=0.00011; Accession=PF00394.12; Description=Multicopper oxidase
  Pfam annotation: Domain name=Cu-oxidase_2; Domain location=159-296; Score=158.8; E_value=1.4e-44; Accession=PF07731.4; Description =Multicopper oxidase
  Pfam module annotation: Pfam domain module=Cu-oxidase::Cu-oxidase_2; Domain location=2-70::159-296
MDHKLVVVEADGNYVKPFIVDDIDIYSGESYSVLLTTNQDPKKNYWISVGVRGRPPNTPQGLTILNYKTISASVFPTSPPPITPQWDDYNRSKAFTYKILALKGTEQPPQHYDRRLFLLNTQNLVDGYTKWAINNVSLALPTTPYLGSIRFNVNGAFDPKSPPDNFSMDYDILKPPLNPNAKIGSGVYMFQFNQVVDVILQNANVMKGKNSEIHPWHLHGHDFWILGYGDGKFKQGDDSKFNLKNPPLRNTAVIFPHGWTALRFKADNPGVWAFHCHIEPHLHMGMGVIFAEAVQNVTSTIPRDAFACGILKKFLNKEHN

SEQ ID NO: 209947 - protein, 174 aa, Glycine max
  Coding DNA Sequence Number=SeqID_93169
  Gene Ontology: Mol. function=protein binding; Cellular component =integral to membrane; Biological process=signal transduction
  Homolog annotation: Hit_ID=Q1SXM4; Match level="QueryCoverage=85%, HitCoverage=62%, E-value=7e-63, Identity=82%"; Hit description =Leucine-rich repeat, plant specific
  Pfam annotation: Domain name=LRR_1; Domain location=40-62; Score =18.3; E_value=0.028; Accession=PF00560.23; Description=Leucine Rich Repeat
  Pfam annotation: Domain name=LRR_1; Domain location=64-86; Score =20.3; E_value=0.0068; Accession=PF00560.23; Description=Leucine Rich Repeat
  Pfam annotation: Domain name=LRR_1; Domain location=88-110; Score =14.8; E_value=0.31; Accession=PF00560.23; Description=Leucine Rich Repeat
  Pfam module annotation: Pfam domain module=LRR_1::LRR_1::LRR_1; Domain location=40-62::64-86::88-110
MYQIGCMKKMKVWVLHRLLPDLGNSNLSGHLVPELGKLEHLQYLELYKNNIQGTIPPELGNLKSLVSLDLYNNNISGTIPPSLGKLKNLVFLRLNDNRLTGPIPKELAAVSSLKVVCVLSKSLNIHFIFRDVSNNDLCGTIPTSGPFEHIPLNNFENNPRLEGPELLGLDLNLR

SEQ ID NO: 209948 - protein, 197 aa, Glycine max
  Coding DNA Sequence Number=SeqID_93170
  Gene Ontology: Mol. function=oxidoreductase activity; Cellular component=membrane; Biological process=electron transport
  Homolog annotation: Hit_ID=O24093; Match level="QueryCoverage=81%, HitCoverage=28%, E-value=8e-79, Identity=82%"; Hit description=L -ascorbate oxidase precursor
  Pfam annotation: Domain name=Copper-bind; Domain location=48-151; Score=-19.8; E_value=0.082; Accession=PF00127.11; Description=Copper binding proteins, plastocyanina
  Pfam annotation: Domain name=Cu-oxidase_2; Domain location=45-151; Score=-15.1; E_value=0.022; Accession=PF07731.4; Description =Multicopper oxidase
  Pfam annotation: Domain name=Cu-oxidase_3; Domain location=38-155; Score=220.4; E_value=4.1e-63; Accession=PF07732.5; Description =Multicopper oxidase
  Pfam module annotation: Pfam domain module=Copper-bind::Cu-oxidase _2::Cu-oxidase_3; Domain location=48-151::45-151::38-155
MSKSNNNIMSFKALTLWCILLSLLQLSLGAVRHRIRFNVEYMYREPDCHEHVVMGINGQFPGPTITAEAGDTLEILLTNKLSTEGTVIHWHGIRQYGTPWADGTAAISQCAIAPGETFNYTFTVDRPGTYFYHGHFGMQRAAGLYGSLIVNLPKGKKEPFHYDGEFNLLLSDWWHKSTHSQEVGLSSMPFRWINEPQ

SEQ ID NO: 209949 - protein, 207 aa, Glycine max
  Coding DNA Sequence Number=SeqID_93171
  Gene Ontology: Mol. function=protein binding; Biological process =proximal/distal pattern formation
  Homolog annotation: Hit_ID=Q2HW56; Match level="QueryCoverage=65%, HitCoverage=28%, E-value=2e-56, Identity=79%"; Hit description =BTB/POZ
  Pfam annotation: Domain name=BTB; Domain location=15-158; Score=40.5; E_value=5.7e-09; Accession=PF00651.21; Description=BTBPOZ domain
MSLEESLRSLSLDYLNLLINGQAFSDVTFSVEGRLVHAHRCILAARSLFFRKFFCGPDAPCGLDPAGPRGVNSSRSGVIPVNSVGYEVFLLMLQFLYSGQVSIVPQKHEARPNCGERGCWHTHCTSAVDLALDTLAAARYFGVEPLALLTQSYVSWALGIRTVTASGSGLVLGTGNGGSVIWMRILGSEFVLQSFPSGVIPAVRSIL

SEQ ID NO: 209950 - protein, 155 aa, Glycine max
  Coding DNA Sequence Number=SeqID_93172
MTTLTQIWMTFLLSNILPSDHNAYLPLRKDHAHKTPSGPEGVQQGPGVSSFGYGPLSVLQGARPPSKGCAHKTPSGFGGVQQGPGVSSSDYGPLSVLWSARHPQQGQDTITAWGWLAAGNRHIAATSRAPQLIYKGWSVAYGPWPTSRRPSPKPK

SEQ ID NO: 209951 - protein, 54 aa, Glycine max
  Coding DNA Sequence Number=SeqID_93173
MEGPYWIWMMDGAEKTLLWSLGIDGIHCPSDFSALDLWLFKWSPFEVRFHGRLG

SEQ ID NO: 209952 - protein, 163 aa, Glycine max
  Coding DNA Sequence Number=SeqID_93174
  Homolog annotation: Hit_ID=Q1SXM4; Match level="QueryCoverage=39%, HitCoverage=29%, E-value=4e-25, Identity=81%"; Hit description =Leucine-rich repeat, plant specific
  Pfam annotation: Domain name=LRRNT_2; Domain location=95-135; Score =58.1; E_value=3e-14; Accession=PF08263.3; Description=Leucine rich repeat N-terminal domain
  Subcellular localization annotation: CTP_CleavageSite=17; ConfidenceScore=5.59e-01
MKRGRACHVLLLCVIPKADTSFSKLRPPSASFFLSCSAIAASSSNKSSLLVNPNTAATRGVRLKLRSAMAAATRTSLRFLLSVSVTLTLAHLAASNSEGDALYTLKRSLSDPDNVLQSWDPTLVSPCTWFHVTCNQDNRVTRVYASPLSDPPRGCGIHQITCH

SEQ ID NO: 209953 - protein, 87 aa, Glycine max
  Coding DNA Sequence Number=SeqID_93175
MKKKKVATVGISLSETYALSEQHPLSEALSELSELGESRRESVKHAPAQRAINAPTFWKKAIEIYVRGATEENRAREYQKPQLSRGF

SEQ ID NO: 209954 - protein, 426 aa, Glycine max
  Coding DNA Sequence Number=SeqID_93176
MSHDRSRFTSLEAWERYTDIVVPRKILLERNVVIYHTKFDDFKEELKRRNWHEELTSFEEGSIDVAIVREFYANLYDPEDKSPKQVKVRGHLVKFDEDALNTFLKTPVIIEEGETLSAYSRFALLRPDPQELAAKLYIPGKGFELNVDGLPLKILIKNLTTIAKTWSKMDMNVGCLISHQISMIAQHDSSRLGFPSLIIALCRARGVTYDSRMLESLRPAINLAYVKKNCWNLDDLTVTFRGPRKAKGKRSETLPSSEIPSSATPSIIAPASSTPSPSAPASSLPTPASAPTPLPVLAAVSTGLSSFTSKTLFAMLQSLHKGYIIIVQCLQSSVLQPMMSMEEFLSKMAWPGVQPSPSGGGEASTAQEPVPEEDEPIPPEPFVYETDPVSAQEEVASPAPVPVSPAPITDDYHPSAPALEQEQPIP

SEQ ID NO: 209955 - protein, 86 aa, Glycine max
  Coding DNA Sequence Number=SeqID_93177
MLPTFENGPRWVQRNTRNWNQRGGMQTEAGFQHPKRSNFFSFVAEYEVKSKEKASIEAPNSSSFLPQIARKSHFRSRGAYLYFVGV

SEQ ID NO: 209956 - protein, 77 aa, Glycine max
  Coding DNA Sequence Number=SeqID_93178
MQKPETQGNQPPPASLLCVAVGFVKNAAELQFKIRELYRHINNDCYCFFLRLLAFDFSGFHQAYVVSLLPIPVIALL

SEQ ID NO: 209957 - protein, 196 aa, Glycine max
  Coding DNA Sequence Number=SeqID_93179
MPLWTLSNILSNFLENFSSWHYGSYALFWGTTRQNGVFIIGIIKGKEVVILPTNIVVASSYAEEGLVFDKDWEKEITQKIVDIMLYGTPRPITDEKKTMINFLRTVNLTYGLRDYLSDMDKFCRFNPKVKKNLVPFGMLFTQIMRNVGVNVSGMEASARASQLKGVTFLKMGIAKKSQNMLRNTSRRNPRKNHNLW

SEQ ID NO: 209958 - protein, 136 aa, Glycine max
  Coding DNA Sequence Number=SeqID_93180
  Gene Ontology: Mol. function=DNA binding; Biological process=DNA integration
  Homolog annotation: Hit_ID=Q1SG63; Match level="QueryCoverage=82%, HitCoverage=8%, E-value=8e-15, Identity=48%"; Hit description =Integrase, catalytic region; Zinc finger, CCHC-type
MGDQLAKFDSKVDKGFFLGYFDTSKAFKVINSRTLVMEESIHVKFNDGLTTYRKLSDLENDFVDMQIGSFVEPKIDKNHKLNNLRLRTKNLLTITLKIRSLENKLKESKPDHHSKILCVVYEIKSKMIDKTLLVDD

SEQ ID NO: 209959 - protein, 250 aa, Glycine max
  Coding DNA Sequence Number=SeqID_93181
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q1WAB6; Match level="QueryCoverage=100%, HitCoverage=49%, E-value=1e-101, Identity=74%"; Hit description =Lycopene beta-cyclase
  Pfam annotation: Domain name=DAO; Domain location=89-248; Score= -34.3; E_value=0.001; Accession=PF01266.14; Description=FAD dependent oxidoreductase
  Pfam annotation: Domain name=Lycopene_cycl; Domain location=89-250; Score=-82.9; E_value=9.4e-08; Accession=PF05834.3; Description =Lycopene cyclase protein
  Pfam module annotation: Pfam domain module=DAO::Lycopene_cycl; Domain location=89-248::89-250
  Subcellular localization annotation: CTP_CleavageSite=55; ConfidenceScore=5.02e-01
MDTLLKTPNKLEFLHPLHGYSEKLSSSGSSRVQNQYFGFGSKKPTVRWGKCGNLRASSSALLELVPEFKKENLDFELPLYDSSKGAMVDLAVVGGGPAGLAVAQQVSEAGLSVCAIDPNPRLIWPNNYGVWVDEFEAMDLLDCLDTIWSGAVVFIDDKTKKDLDRPYGRVNRKLLKSKMLQKCISNGVKFHQAKVIKVIHEEAKSLLICNDGVTVHATVVLDATGFSRCLVQYDKPYNPGYQVAYGILAE

SEQ ID NO: 209960 - protein, 41 aa, Glycine max
  Coding DNA Sequence Number=SeqID_93182
MTDGRPIGDQVQGQRTHLVAHDPRNLNKTSANSKGSKIPWI

SEQ ID NO: 209961 - protein, 90 aa, Glycine max
  Coding DNA Sequence Number=SeqID_93183
MKFPHIAKEWVRITIRMTKLGLCLSSGPPPLDDKRVRITVRMTKLGLCLSSGPPPLDDKRVRITIRYLRVSWVQNDQTWSLLVIGPAASG

SEQ ID NO: 209962 - protein, 83 aa, Glycine max
  Coding DNA Sequence Number=SeqID_93184
MGEVEEVQEQIEADMEAMKEQMATMMEAMMSMKKIMEANAVAVAATSAVAKVNPTSPSDINQMKHPTSDMVGKDLGSMNGPMM

SEQ ID NO: 209963 - protein, 1616 aa, Glycine max
  Coding DNA Sequence Number=SeqID_93185
  Homolog annotation: Hit_ID=Q5JJP6; Match level="QueryCoverage=41%, HitCoverage=73%, E-value=7e-23, Identity=24%"; Hit description =Adenylyl cyclase-like
  Pfam annotation: Domain name=GYF; Domain location=547-602; Score =50.7; E_value=4.9e-12; Accession=PF02213.6; Description=GYF domain
MGDGKVNLPDDLFSAKPSDSLRDEASGGHGGEKGIGALLDDSKDQLLSDNSIPLSPQWLYSKPVDAKTTSNPVGVNSTDPILKDSWRLEGSQDKKDWRRTAPDVDISRRWREEERETSLLGRRDRRKEDRQNTSTSENRSLPSDRWHESRGSGHDSRRENKWSSRWGPEDKEKDSRNEKRNDVEKEDGHSEKPSPGVGNRIGSDRDTDSRDKWRPRHRLEAQAAGVSTYRAAPGFGLEKGRIEGSNVRFSPGRGRANNNGNLQIVRPPIGSGAGSALVDRNKTILGKSSLGADSYYYPRGKLLDIYRKQKVDPNFVSLPSEMDHASPITQHGSVEPLAFVAPAAEEESVLKEIWKGKITSSEVSGYSFRGRDGVSNDDISGPGIANEGKQPSIGSGAKVISGSDVSDDSDQILISSASTAGGLLRNIVEEVATFQEGKQKHMATIGVHGRDESSVNCIGEGSIPGNQVAESADFDNHQGQASGFREHANRNGVESIAASEVSSNLPDDSRSLFDFSSLHQTSCTNQQDFKINEKTYPPESVIALEELSLCYLDPQGEIQGPFLGIDIILWFEQGFFGMDLPVRLSDAPEGSPFHELGDIMPHLKVKSGLGSGSNRVIQSEPTDAIGRNLKVDVHNFDYDGSSVSDDQPWSSSRPDTTSSVGIPSQIPNQGYHSEVKFSDDQCFSNIVAHDEDITLSKLAGSINEKPMTRPMDFNASYSHPTGKPVANEVPVNDTHNNEADKLHPFGLLMSELRDGSHLRRAQSSNSSLRLGDQGHFLDPLIDRDAAFADQSSVGGMANQPPFRETWADEYGLNRHFNGNPHVGSLEDQFLSHMGPKFNNFDVAEQLMLQKLQKERLQQQSSISNHFPAHHNGSDLERFPGFALSQNKSPNIQQMMQNSGSDFERILELQIQQRQLELQQQQDMHHQQLLHQQMKLQPQQQSQVQQLLLEQFMHQQIPDPNFGQSKHDISRDNLLDQVQLRRYVHELQQNPHSLRHPDPSMEQIIQANMGINAAQGRQADLADLLLQARHGNILPSEQQLHFQQDQLQAQQLSLALRRQLGLDGERHFGRSWPMNETGQMARNPATHQLGHSAGFNVSDIHKQQQRLVSQEEQLNYLGRNLPEQNQRGFYDNPMMFERSAPISQGRELHDRHRYLHPGDQMGSLSSHHLQSSDDLFGHHPDAFKSSLHGNNGHVENSWIDPRVQIQQHLEAVRQRRELGDTVTSADLNIPASAGAHEESSARGFMERLHQKLGVQSTQPSTVDKWHPLSSRSDKSWHVPEASSIMHPFEHPSDQQVHLNDPFLERTQSANSNALIHDHLTNMHMTDQYNNLGNTERMPLRSRSGSLVEEQSLLSANKDTLHPNYRIPFQIGKSSMEKDLLELEANKGQRHDYMGTMSNLVPGMSDMSEQVESIMNSMELPTIAHSRHSSLSSAGGDGGSFGREMGLNNSRGDEVSGDRIPPSTKGFDNAFHKRPHVTRVLSSPDVQSDQPSVPHVNQNNLINLTSGEGRRETSGNSSMSSMTEASGKKEVRFRSSSFSEGAVSETSFIDMLKKPVLPEVVVDSHAASGIGSESSDAAQAGRSGKKKGKKGKQIDPSLLGFKVSSNRIMMGEIQRPED

SEQ ID NO: 209964 - protein, 161 aa, Glycine max
  Coding DNA Sequence Number=SeqID_93186
MQASIFDYVKVMPTSELSMSEVIKELKLEEIDGRSVWGPCVKSLLDDIIVKWHVAMEIMMLGLYIDILKTRRITQPEKGVATLGERGDEDLNHVKQVEVEVMDLGSSWRWVQAVYPVGGVVVQATMWKKLTLERKIVGVQEDEEGDEGQVIVVAKEHILLP

SEQ ID NO: 209965 - protein, 190 aa, Glycine max
  Coding DNA Sequence Number=SeqID_93187
  Gene Ontology: Mol. function=protein binding; Cellular component =cytoskeleton; Biological process=cell motility
  Homolog annotation: Hit_ID=Q9ZSS8; Match level="QueryCoverage=85%, HitCoverage=41%, E-value=6e-84, Identity=89%"; Hit description=Actin related protein 2
  Pfam annotation: Domain name=Actin; Domain location=1-190; Score= -50.5; E_value=1.3e-11; Accession=PF00022.9; Description=Actin
MDSKNVVVCDNGTGYVKCGFAGENFPTSVFPCVVGRPMLRYEESLTEQALKDIVVGEGCADLRHQLDISYPVNNGIVQNWDDMCHVWDHAFFNELKINPQDCKILLTDPPLNPSKNREQMVETMFEKYNFAGVFIQIQAVLTLYAQGLLTGLVIDSGDGVTHVKYHVEWQSLLESWYWMSLLDSKLLDAH

SEQ ID NO: 209966 - protein, 100 aa, Glycine max
  Coding DNA Sequence Number=SeqID_93188
  Subcellular localization annotation: CTP_CleavageSite=54; ConfidenceScore=5.53e-01
MFSHSQLHSKNTVLKVPGVKKTLGIPEIPVAPPTTTSATQSPFSIFPALKQATSATTNGSSSIPDEVSKYSNKKISSASVIRQRLRSLEKQVKGRKKNKK

SEQ ID NO: 209967 - protein, 181 aa, Glycine max
  Coding DNA Sequence Number=SeqID_93189
  Gene Ontology: Mol. function=protein binding; Cellular component =Arp2/3 protein complex; Biological process=cell motility
  Homolog annotation: Hit_ID=Q6Z256; Match level="QueryCoverage=62%, HitCoverage=24%, E-value=2e-42, Identity=76%"; Hit description =Putative actin related protein 2
MIQSNLPVWLPCYDFISVTRPALHEFSSVFCHSLLKYYKSLKQFLPLMYSLSVNTKGLFGLNEKHFILLYQHIVLSGGSTMYPGLPSRLEKEILDRYLDVVLKGNRDGLKANSLFPYSHLFCSDGDQKLRLRIEDPPRRKHMVYLGGAVLAGIMKDAPEFWINREDYLEEGIACLSRCGQA

SEQ ID NO: 209968 - protein, 101 aa, Glycine max
  Coding DNA Sequence Number=SeqID_93190
MDDLHQPTQLPLPPPPQARVASRYHDTNRYASRDKPTIQDSSGALIGVRSKKNDDDVVEGGDRSQMLEMDISHGIKDEQGKQGVSLYFGIANLEGKNYLPK

SEQ ID NO: 209969 - protein, 687 aa, Glycine max
  Coding DNA Sequence Number=SeqID_93191
  Gene Ontology: Mol. function=transcription factor activity; Cellular component=nucleus; Biological process=regulation of transcription, DNA-dependent
  Homolog annotation: Hit_ID=Q2R3Q8; Match level="QueryCoverage=83%, HitCoverage=76%, E-value=1e-144, Identity=49%"; Hit description=GRAS family transcription factor containing protein
  Pfam annotation: Domain name=GRAS; Domain location=300-595; Score =417.7; E_value=1.6e-122; Accession=PF03514.5; Description=GRAS family transcription factor
  Subcellular localization annotation: CTP_CleavageSite=73; ConfidenceScore=5.64e-01
MMNSLCGSSVSLKSENNNSRTKVQQPTTPSNDSVMQSKKNNATQSSGDLDQTSLTPPSLNLPSLKFDLDGDVEVQSPDSSMWESFFADHNLDGDFMISSPVRTPQASSYNCNYNYAQGMQGQSLSGCSPPRFSSSQIGAFNSNKGKGLSPLHRVFNSPNNQYMQHVENLSLPAIEFLEDYQLGYSSSTTNKMCCSDHNNIASSSECFDLSMSHQIPSSMLDGLALHNSSSRYHRGSVVVDEESSVHGGGAGGFSQLSEESDIYHQMGSMASASLSQALQQEHYQEKQQAQQLQQQQQQQQQHQQENLMVPIPIGVEQEQDSGLQLVHLLLACAEAVAKEEYMLARRYLHHLNRVVTPLGDSMQRVAACFTDSLSVRLNSTLTPKPTTPSKPLTPSNSLEVLKIYQIVYQACPYVKFAHFTANQAIFEAFETEERVHVIDLDILQGYQWPAFMQALAARPAGAPFLRITGVGPSIDTVRETGRCLTELAHSLRIPFEFHAVGEQLEDLKPHMLNRRVGEALAVNAVNRLHRVPGNHLGNLLTMLRDQAPSIVTLVEQEASHNGPYFLGRFLEALHYYSAIFDSLDATFPAESAQRAKVEQYIFAPEIRNIVACEGPERFERHERLEKWRKMMEGKGFKGVVLSPNAVTQSKILLGLYSCEGYRLTEDKGCLLLGWQDRAIVAASAWRC

SEQ ID NO: 209970 - protein, 251 aa, Glycine max
  Coding DNA Sequence Number=SeqID_93192
  Subcellular localization annotation: CTP_CleavageSite=55; ConfidenceScore=5.11e-01
MIKLPIQTSTLMHSTPRLISTPTTTQSDVEFFQCPSNGYGGLPPRSIDSFDTLVECFSSQYATSWNLNPEVALHSMLLALRHGLETRSDKLDKSQIKGKEVPRPNHASRTKGISRTSVNLSQGDPGARPERHQEDQHRNHDRRREREEDRGITNKDTNNNLSKNKKKSSPNKSKENAERTRSLPKLAEKVKPFYKLLRKNEPFLWDEASTLDDREGSTDTHNLGPMPKVVFPKSPSDGQDGLPHQAGVVKA

SEQ ID NO: 209971 - protein, 117 aa, Glycine max
  Coding DNA Sequence Number=SeqID_93193
MEVYINADALAYMTWNLIQVLLSLDNTAFEDEERADVSKTWISRPNPSFAAAREISTMPHGRSKITIISEKTCKKLFVFQGSKQPNNKKRKLARNPQKECSNNQEKGKHKPNQTQDE

SEQ ID NO: 209972 - protein, 78 aa, Glycine max
  Coding DNA Sequence Number=SeqID_93194
MDKEREGGNGYRERVSPIRDAQALGVLNREFRVSGDHALSAIMSGLSEVVTLLARDFTLNVPLGFFVGLFYAKLEFAR

SEQ ID NO: 209973 - protein, 60 aa, Glycine max
  Coding DNA Sequence Number=SeqID_93195
MATNRNLTALRAFGKGSKIFIPHMAKGQGELRLWKLSGRLTIKDDVVADLPFQALDFIFV

SEQ ID NO: 209974 - protein, 687 aa, Glycine max
  Coding DNA Sequence Number=SeqID_93196
  Homolog annotation: Hit_ID=Q00M75; Match level="QueryCoverage=6%, HitCoverage=7%, E-value=3e-08, Identity=77%"; Hit description=PPR -repeat containing protein
MGEGCCTQPYPCIGKEAVSGFEPMTNKSPRHNFTAAPGLALKLILKKLRTPLPSCFRYDLKNKPYALFMLNRYYSAKEGDDILAGPYLKSKQIFEGFDVGKMDSTISCIKLELPSIRRIRGGTCKIKDFDVQMDSTISCVELELPSIRRTRGETCKTKDSDVQHHVTCHVPFVDIGQYISPPISESACWRKKLSDVKGDCLVSRLSREDMFFVLLVESVVSVGECIKDKHFVCLSLRAVQRTYVTLAYVSLEEWACTGDTGTRHEASESELFSFERLVDSRHAGGARWSDDGDVRVFPRNRRSHNARLLSSSPIIVGYKWLTWKIGWVSLNSVSKKLFEFDSNVFRCFKNCFFKVLMNDVVANELPLDMLTLVEKIDKAILEQLDARDILSLPSANNPLATLHGKIFYLVSFVSDARLASGVMPLSTVKPPTTRVDPNDDEVVEVTPNVSFSVLAKRKCDEGARVLGRKKSRTSFSFCALKEVVGLMSGSGRPSTAGLHDLPSAPLVVQAVAHVPSTPFSLPAQEVFVSPFTMTSLIVPLVAPVVVSASTIVMPLLSADGDDCSLAILEENGQRHQKALSKLAFLEAKIANLRATARTVWRVERPKVVNAIVTFVEDLQRGKNDLAGKVESIVDEKDELAKGVVDLGVADVLEGGCGDVKDDELIDEEEIVVAEENVDKGQDDGANV

SEQ ID NO: 209975 - protein, 81 aa, Glycine max
  Coding DNA Sequence Number=SeqID_93197
  Gene Ontology: Cellular component=membrane; Biological process =protein modification process
  Homolog annotation: Hit_ID=Q9LSD8; Match level="QueryCoverage=52%, HitCoverage=35%, E-value=2e-13, Identity=72%"; Hit description =Membrane-anchored ubiquitin-fold protein 4 precursor
MPEEEVVELKFRLYDGSDIGPFRYSPASTIAMLKDRIFADWPKGLRLRHLELPLNSLLSASLNFFVVVQTNTALTTVFFGK

SEQ ID NO: 209976 - protein, 74 aa, Glycine max
  Coding DNA Sequence Number=SeqID_93198
MVHDDDVEGEENTIWKHMKSSSLAWVTHSCEYGMRFGRQNESACVKCTSMLLGLTLGHRGAQWWLGTRVMVAGE

SEQ ID NO: 209977 - protein, 101 aa, Glycine max
  Coding DNA Sequence Number=SeqID_93199
  Subcellular localization annotation: CTP_CleavageSite=37; ConfidenceScore=5.45e-01
MRGYVMVTRTFRQPGANKPVDAQRLTLSPAPFVVLTREVSKSGGRRRYLMVIRAFRQPRGTNSTKHSSPTKREIFLCWAGMIECNGKGKCRGCPTLSFSRH

SEQ ID NO: 209978 - protein, 266 aa, Glycine max
  Coding DNA Sequence Number=SeqID_93200
  Gene Ontology: Mol. function=DNA binding; Cellular component=proton -transporting two-sector ATPase complex; Biological process=DNA integration
  Homolog annotation: Hit_ID=Q1SA33; Match level="QueryCoverage=84%, HitCoverage=23%, E-value=8e-61, Identity=50%"; Hit description =Integrase, catalytic region
MKTPMHPTTHLRLDKESTKVDKTQYRAMIGLLLYLTVSQPDIMFNVCLCARFLKEPREVHSTVVKRIFRYLIETPNLGLIFKRRESFKTHKLLRCELCWWQLSHLDMQEAGLNYIVEVEYMSATSCCAQLLWIKNQLEDDNVYESKIPIFCDNRAVISLLKNPILHSKAKHIEIKHHFIRDHVQNGTVDLQFVPTDDQLVDILTKPLTKERLILLRSQLGMIFVNDWLNFYMSSTSASKDMLTTGPYHTLTTFNIWMTYHAFYSNT

SEQ ID NO: 209979 - protein, 188 aa, Glycine max
  Coding DNA Sequence Number=SeqID_93201
MDISSSQYNSAGESGWTHYLDHSSLSESYFQIRGGIEDHGGKGARVEEEEEDLSMISDASFGPQHYHEDDGQHYCKKASFLGNEAVENALDFPPCFLGTKIKKKSKFQKHFSFFERSLGGKQASEEPGVDNALMQQQPNTMTIIVPQHRQQGQEIAKVRFFSHILSNHDLGFLQISFIGGHPYFRLRE

SEQ ID NO: 209980 - protein, 274 aa, Glycine max
  Coding DNA Sequence Number=SeqID_93202
  Gene Ontology: Mol. function=transcription regulator activity; Cellular component=nucleus; Biological process=regulation of transcription
  Homolog annotation: Hit_ID=Q9C670; Match level="QueryCoverage=57%, HitCoverage=42%, E-value=2e-07, Identity=29%"; Hit description=BHLH transcription factor GBOF-1, putative
  Subcellular localization annotation: CTP_CleavageSite=41; ConfidenceScore=5.09e-01
MVKHLVKEGMPLSLGTSTSLNSTMAEFSADPGFAEKATKLCCFGSRSFNGMTTQLCLNIAELAQRSSPLENNNSPLQDLMEVANSQEESAISEQTANGDTGEKPSPYLAKTNAKRNKPNKGEGNENGQVKAEEESKGRNNHNANDEKQSKSNSKPPEPPKDYIHVRATRGQATNNHSLAERYTLNTNFFNTKEQKAENTKEHKCLSSTWTNGFAYCNTMSMVSVVRHDNSEKGNYVACAVARQDETLDTRQCTTPFGRGHWGATMQANSRGHCE

SEQ ID NO: 209981 - protein, 72 aa, Glycine max
  Coding DNA Sequence Number=SeqID_93203
MSPHQTHREGEAGWFLDPVVQGWFCSGHEAGVRSNIEFRFGQSGICACFWHLVSGGGTQQGGGRGDDGCMWG

SEQ ID NO: 209982 - protein, 73 aa, Glycine max
  Coding DNA Sequence Number=SeqID_93204
MVKGCGYWSIPNLQWHGGAGGGTPTTLSEGAVWVEVCKGIPLLTNLSITWVRLTQGMMRLFQIATSNINGIWL

SEQ ID NO: 209983 - protein, 205 aa, Glycine max
  Coding DNA Sequence Number=SeqID_93205
MKNGHEIDHGNIMEALWKRLGLDFSSSFSFSSLISPLTPIYRKIRGGGCMTARPGELLASPLSFLMGPESSSDFEAMFAQVFLASFGSLLKVLGVPKWMTQVGDPEVVEEVFLIVGSGRANLNPLPVLRPPLKEAPDSSEWRRKRDRRCHFKEKMSLEEAHCHSRPWIRAWRKKEMNEGRGREEHEILCSKRALKSKIQFSNDQT

SEQ ID NO: 209984 - protein, 206 aa, Glycine max
  Coding DNA Sequence Number=SeqID_93206
  Gene Ontology: Mol. function=calcium ion binding; Cellular component =mitochondrion; Biological process=protein amino acid phosphorylation
  Homolog annotation: Hit_ID=Q1PFC5; Match level="QueryCoverage=98%, HitCoverage=43%, E-value=4e-62, Identity=64%"; Hit description =Pentatricopeptide repeat-containing protein
  Pfam annotation: Domain name=PPR; Domain location=130-164; Score =23.5; E_value=0.00073; Accession=PF01535.11; Description=PPR repeat
  Pfam annotation: Domain name=PPR; Domain location=59-93; Score=58.4; E_value=2.3e-14; Accession=PF01535.11; Description=PPR repeat
  Pfam annotation: Domain name=PPR; Domain location=94-128; Score=18.2; E_value=0.03; Accession=PF01535.11; Description=PPR repeat
  Pfam module annotation: Pfam domain module=PPR::PPR::PPR; Domain location=130-164::59-93::94-128
MELPGFRCPPDTFTYSILISSYCRHGILTGCWKATRRRIYEAGRLFRLMLFRKLVPDVVTYNALIDGCCKTLRMERALELFDDMKRSGVVPNRVTYGCFVSYYCAVNEIDKGVEMLREMQRLGDGVASSSLYTPIIHALCEAGRVVEACGFLVELVEGGSMPREYTYGLVCDARPGRVVCSRMVMVMVMGCTRELRMGYGIVTPRN

SEQ ID NO: 209985 - protein, 188 aa, Glycine max
  Coding DNA Sequence Number=SeqID_93207
  Homolog annotation: Hit_ID=Q1PFC5; Match level="QueryCoverage=82%, HitCoverage=39%, E-value=1e-34, Identity=50%"; Hit description =Pentatricopeptide repeat-containing protein
MERAFAKFPTRQSAWIRCFVGEALFTEEFDEARDGGGGHVRGVFEEVPEGFEGGGAGEEAGEFAARGLGVGEVEAGFEPVEELEGFEWAQVVGFVGVEVGRGAQEEGVIAELAVFEVEVALTERGAVAEGVLAADGARKLECVVGDGTENFCEGFVCPGRGDGGGGGASNGRSLITNTRAWFARCLGK

SEQ ID NO: 209986 - protein, 755 aa, Glycine max
  Coding DNA Sequence Number=SeqID_93208
  Gene Ontology: Mol. function=transmembrane receptor activity; Cellular component=exocyst; Biological process=exocytosis
  Homolog annotation: Hit_ID=Q9FFX6; Match level="QueryCoverage=84%, HitCoverage=89%, E-value=1e-159, Identity=48%"; Hit description =Putative leucine zipper protein
  Pfam annotation: Domain name=Exo70; Domain location=141-743; Score =352.2; E_value=8.7e-103; Accession=PF03081.6; Description=Exo70 exocyst complex subunit
MPDLKSYVSNLNRSLFSITRSTEISRGNITVNVTSSPSSSIIMENHDNLAEKENSATNITEETLPSSPSITDHEEADPKPDDDHGAEATAQAEPSSPKKDEEEAEAEKKEETASPPPSLEKVSEEIDLFLVTLPKKNDDENAAEKNFEIPGFFERYTDLVEKKIAKYDAEGKAKWGEVAEEDSWLLETANRVSKLMMLLNHHHHHLVEPEEEEKENDGGNGKGKGKDSLVNRVASIHQRVMSYLEEDFRFLMEECRIPIELDPGGNNNNNDTKGKQQQQQQVSSSEQEEVKKDQEGEIDESFPGYSEETIASLSKIAGEMLPGGYESECCQVYIISRRNAFEEVRKKLGLERISIDDMVLKVQWETLAANMIPAWINTLKQCAAVYFPGERRLAEAVFASSPSVSAGLFGSLSRGVVIQLLNFAEGAAMTKRAAEKLFKLLDMYESLREVIPKVNGLFPDESVEELKTEMNVAKSRLGEAAIFIFSDLENQIKLETAKSAVPGGAVHPLTRYIMNYLSVAGDYKETLEQVFKDHSKIERADSTSRPHSENDGVPEKQASSPFAGQVLRVMDLLDSSLEGKGRLYKDVALSNFFMMNNGRYILQKIKGSSEMSQVMGDTWIRKKSSELRTYHKNYQRETWNRVLQFLNPEGLNVNGKVHKPVLKERFKSFNALFDEIHRTQSSWVVKDEQLQSELRVSISGVVVPAYRAFIGRFAQIFDPGRQTEKYIKYQPEDIETYIDELFEGKPHQSIARRRT

SEQ ID NO: 209987 - protein, 54 aa, Glycine max
  Coding DNA Sequence Number=SeqID_93209
MGRGHRSSGCCNGLLGHKLNSFKGKTKRLKEKDKKSLKIKKSTLDNGRENELFF

SEQ ID NO: 209988 - protein, 489 aa, Glycine max
  Coding DNA Sequence Number=SeqID_93210
  Homolog annotation: Hit_ID=Q9LSE0; Match level="QueryCoverage=98%, HitCoverage=99%, E-value=1e-151, Identity=52%"; Hit description =Genomic DNA, chromosome 3, P1 clone: MOJ10
MRYGGGRKRRMLLQPFLVLCATVTGLGLFMLALRPLDPPITVDFPKKIELGDSNSSSLNGGGEKPCAAVEEMGKDFEAGVVGKETLRVRRIIEDHFDLNGASRIRDLPPEQFCSHGFVLGKTAEAGFGNEMYKVLTAAALSIMLNRTDDFEKPAQTNVLCSNWKEWKQPIIWFQGTTDAVAAQFFLKNIHSQMRIAAFDLFGDPQVLGSQPNVFGELLRVLISPSKDVEAAVNWVIGGEENPDISLHMRMLMNRSIRAVQAALHCIKKVIESQHLTSRPKVVVVSDTPSLVKSIMPNISEFAQVLYFDYEKFKGNIFEGLPKLDFRVKDWGPAPRWVAFVDFFLASRAKYAVVSGAHRRVGTTYAQLIAALAATRNLGDNSSSSSFSFLSSFQSTMLTEGLKNQVGWGHVWNRYAGPLSCHNQTNQCAFTPLLPPGWWDGLWQSPIPKDISRLAAYGIKLSGLGTVDYDSLQNYCSTRKNVERTVTFNL

SEQ ID NO: 209989 - protein, 263 aa, Glycine max
  Coding DNA Sequence Number=SeqID_93211
  Gene Ontology: Mol. function=zinc ion binding
  Homolog annotation: Hit_ID=Q6Z1H3; Match level="QueryCoverage=47%, HitCoverage=30%, E-value=1e-43, Identity=69%"; Hit description =Putative DHHC-type zinc finger domain-containing protein
MASEETTIWKAMIKTPASIVLIIYTFISMWFVGGLTAFHLYLISTNQTTYENFRYRYDRRANPYNKGVLNNFKEIFCISISPSKNNFRAMVPREPALPTRSVGGGFMNQNIGKAGEDIEMGRKTVWDMGAGMDDNGAPINDDRVTIKDGELSPEIRTTVDDSDRAGMHPRRSSWGRKSGSWEMSPEVLALAARVGEPNRVGGGSSSLMHENSHVHLQGVCKCFFRHSASKKKLFGVLRLSLWLNASDLEYWEFVQEEINGGSS

SEQ ID NO: 209990 - protein, 246 aa, Glycine max
  Coding DNA Sequence Number=SeqID_93212
  Gene Ontology: Mol. function=zinc ion binding; Cellular component =integral to membrane; Biological process=sporulation (sensu Fungi)
  Homolog annotation: Hit_ID=Q6Z1H3; Match level="QueryCoverage=75%, HitCoverage=45%, E-value=6e-64, Identity=62%"; Hit description =Putative DHHC-type zinc finger domain-containing protein
  Pfam annotation: Domain name=zf-DHHC; Domain location=141-197; Score =73.7; E_value=5.7e-19; Accession=PF01529.11; Description=DHHC zinc finger domain
MYVVPPPQRSDPGSGSGDLRVYQAWKGSNKFFLQGRFIFGPDVRSLALTIILIVAPVAVFCVFVARKLMDAFSDHWGISIMAVAVVFTVYVLVLLLLTSGRDPGIIPRNAHPPEPEGLDSNLDVGAGQTPQLRLPRFKEVEVNGIPIKVKYCDTCMLYRPPRCSHCSICNNCVERFDHHCPWVGQCIGLSSLTPLLSVTEMVFESALNLLKVVVKSTTLDVFKRPGSSIEFPNPKTMPLIINPSCL

SEQ ID NO: 209991 - protein, 168 aa, Glycine max
  Coding DNA Sequence Number=SeqID_93213
  Gene Ontology: Mol. function=nucleic acid binding; Biological process= DNA integration
  Homolog annotation: Hit_ID=Q1SRN1; Match level="QueryCoverage=75%, HitCoverage=8%, E-value=1e-26, Identity=53%"; Hit description =Integrase, catalytic region
MKSDNPWKLTGRQPREFSDTQPLVHAFYLDPNLNSWWSKKHTLVVKSSAEAEYRSLLAAASEIHVPCLANFMFLALPLASTATIKAQLLFSHNPILPSRIKHMELDIAREKVLDNSLTVTHVPALDQTADILTKPLSQLRFSTVRDKLRVISTFQPPVFEGGMLEYTL

SEQ ID NO: 209992 - protein, 85 aa, Glycine max
  Coding DNA Sequence Number=SeqID_93214
MGEFGDPFGQSFRRAQRVRAGRRQGKRGLVGRRRITQPEEVLSEKENYVKEKFISLDRKLVMRLRHTSLFCERMNVKKIGGSKSK

SEQ ID NO: 209993 - protein, 162 aa, Glycine max
  Coding DNA Sequence Number=SeqID_93215
MITKDDDKGDDKKLKGQSKNEFKIFKIESRTLQDSRGKLISRDQDFKNQDSRDQHSRLKIQESREGLIKIKIQVVGMSPPPLGPHNHSQTHLKLSGRLPLPALVSADLHTTYSLKLSRTWTFLSLELSDYAEVSRNGPNSLQKSDFRLKYVALFMLMRLAQF

SEQ ID NO: 209994 - protein, 129 aa, Glycine max
  Coding DNA Sequence Number=SeqID_93216
MGNREPSSNTDDKYFPLESIKAYYTYSHIYLPSWKRRMEILIMRRNEYELRITAETASITSSYDNRVIEKSMKFTRRTIPLTMHRSSKLPLKMREILADSVSYRLLISGEDMKHKLSKCAGGSRQQKPE

SEQ ID NO: 209995 - protein, 77 aa, Glycine max
  Coding DNA Sequence Number=SeqID_93217
MKVTVPLLVIAFASAKAGAFQAKIDPLKLALKQANALASTDQAQPLAIAEAHARLATAVSGCQCPFCTQMRLVNTGL

SEQ ID NO: 209996 - protein, 357 aa, Glycine max
  Coding DNA Sequence Number=SeqID_93218
  Gene Ontology: Mol. function=transferase activity; Cellular component= membrane; Biological process=phosphate transport
  Homolog annotation: Hit_ID=Q6U5T1; Match level="QueryCoverage=99%, HitCoverage=87%, E-value=1e-153, Identity=73%"; Hit description=CobW
  Pfam annotation: Domain name=CobW_C; Domain location=217-332; Score =123.8; E_value=4.9e-34; Accession=PF07683.4; Description=Cobalamin synthesis protein cobW C-ter
  Pfam annotation: Domain name=cobW; Domain location=1-172; Score =167.2; E_value=4e-47; Accession=PF02492.9; Description=Cobalamin synthesis proteinP47K
  Pfam module annotation: Pfam domain module=CobW_C::cobW; Domain location=217-332::1-172
MSEVNIDAALVREGGAALSRTDEKLVEMSNGCICCTLREDLLLEVNRLAKEGRFDHLVIESTGISEPLPVAETFTFADEEGQSLSTVAALDTMVTVVDGYNFLRDYDSSESVRSSGESLGNEDERTVVDLLIDQIEFCDVLILNKTDLIDTAEQTRLTAILHSLNPRARIIRAQFGQVALDQVLNTGLFDFDAAAQAPGWLKELRGEHTPETEEYGIRSFVFRARRPFHPQRFYQVITQHMQGVVRSKGYFWLATRPRHAGSWSQAGGVTRQGLAGMWWACVPEDRWPQDADTLHYIRENWHEGTGDARQEMVIIGIDMDETVLRQQLHRALLTDEEMALGPDGWAQLPDPFQPWFD

SEQ ID NO: 209997 - protein, 94 aa, Glycine max
  Coding DNA Sequence Number=SeqID_93219
  Gene Ontology: Mol. function=protein-tyrosine kinase activity; Biological process=protein amino acid phosphorylation
  Homolog annotation: Hit_ID=Q9FIL1; Match level="QueryCoverage=78%, HitCoverage=15%, E-value=4e-37, Identity=96%"; Hit description =Protein kinase-like protein
MKWAMRLRVALYLAQALEYCSSKGRALYHDLNAYRVLFDQDGNPRLSCFGLMKNSRDGRSYSTNLAFTPPEYLRTVYAFLIVLKGGVQCYKKAV

SEQ ID NO: 209998 - protein, 86 aa, Glycine max
  Coding DNA Sequence Number=SeqID_93220
MMQEKDPSPGGSENPTIDFVDKDVVQNEKLMNTRCHEASSHPPCHVPPYTVTYDTASIYYYALRALCQFMYSTTTTYHEYATTNVA

SEQ ID NO: 209999 - protein, 63 aa, Glycine max
  Coding DNA Sequence Number=SeqID_93221
MGSETVSNGHIKERVCPSPMYKNITSYGLPSKTSVVGNENKDWGAGESDGEEGRGKVTYGSVE

SEQ ID NO: 210000 - protein, 379 aa, Glycine max
  Coding DNA Sequence Number=SeqID_93222
  Homolog annotation: Hit_ID=Q9LSD5; Match level="QueryCoverage=79%, HitCoverage=85%, E-value=1e-50, Identity=45%"; Hit description =Genomic DNA, chromosome 3, P1 clone: MOJ10
  Pfam annotation: Domain name=TCP; Domain location=90-275; Score =161.1; E_value=2.9e-45; Accession=PF03634.4; Description=TCP family transcription factor
MGCTNTKDIMKELNCLLPIVTKVVKPAVKVAFKIHIWLGSKQQPQQSQEVVPNFLSLPQQQQGNTNNNNMGENKPAEVKDFQIVVAENKEESKKQQQQLAPKRSSNKDRHTKVEGRGRRIRMPALCAARIFQLTRELGHKSDGETIQWLLQQAEPSIIAATGTGTIPASALAAAGNSLSPQAASLSSSLHQHQQKIDELGGSGGSSSRASWQMVGGNLGRPHLGVGVATAAGLWPPHVSGFGFQTPPTTTTPTTTTSSSGPSNATLATESSNYLQKIAFPGFDLPTSATNMMGHMSFTSILGGGGGGGAQHMPGLELGLSQDGHIGVLNQQALNQIYQQMNQAGRVHHHQHQHHHQHHQQQQHHQQTPAKDDSQGSGGQ

SEQ ID NO: 210001 - protein, 68 aa, Glycine max
  Coding DNA Sequence Number=SeqID_93223
MDIDYAIRKDEPPAITDERSLADVALYERWERFNWLSVMFIKTKISAGIRGSVDQHEKVRDLLKAIDD

SEQ ID NO: 210002 - protein, 68 aa, Glycine max; identical to SEQ ID NO: 128905
  Coding DNA Sequence Number=SeqID_93224

SEQ ID NO: 210003 - protein, 160 aa, Glycine max
  Coding DNA Sequence Number=SeqID_93225
  Gene Ontology: Mol. function=nucleic acid binding
MMTTPREQNMGELAIRKGVEVYQPIRPLPKYIRSTFLHGCTTTYITISLWDPLVKNLMGEVKEKFLNYSFPETRVEAIRENIVNFRQFATESLFDVWEKYKALLRSYPSHGYSRYSEISMFLKWITHEYRRMVNFVGKGNFLNKTLTEVKKIIKDLAASD

SEQ ID NO: 210004 - protein, 186 aa, Glycine max
  Coding DNA Sequence Number=SeqID_93226
MREEGDEEKEESKEMGGKVLSTKTNNQLAKEDRREILIASVKDIPYPLDLVTKKGKYINNESIMVEAYCSAVIQRILPQKFKDPGSVAIPCSIVEVSVGLPIHFFGGLYDYGYRSGLRYSSDARSSIHAYCNREMSVVDMGNDNLEMSIEDQKVTFNLFKAMKHPSDSKACFRVEAIEQEVDLIVQ

SEQ ID NO: 210005 - protein, 195 aa, Glycine max
  Coding DNA Sequence Number=SeqID_93227
  Gene Ontology: Mol. function=RNA-directed DNA polymerase activity; Biological process=RNA-dependent DNA replication
MFSTTTKENPKGHCNAIRTRSGLVIPDRVAEKEKDQIERGEKNQKRAMKRWLMTHQRAKDKEKHYARFLELFNQLNIIIPFLEALEQMTVYSEYMKDLLTMKMSIRDESMGTLKAGYSAIIHKSLSIGNAFLDLGASINLMPLSMLERIRNVEVNETYITVQLADCSIRIPHGVVDNMLVDVGNSHCRITLSLWI

SEQ ID NO: 210006 - protein, 43 aa, Glycine max
  Coding DNA Sequence Number=SeqID_93228
MSIDIVYDCITSCGLTKSIDDNIGVRDLTAYAMDSCVQECKNK

SEQ ID NO: 210007 - protein, 95 aa, Glycine max
  Coding DNA Sequence Number=SeqID_93229
MHIIMIYQSHNYYNLHKKLSNFTSNAESEYGCYSQLAVTLSRRGAIPASCSCLIFSSKDQAADLFTKALLPAPFSMVDLHQTIRLRGGNTRVIHS

SEQ ID NO: 210008 - protein, 294 aa, Glycine max
  Coding DNA Sequence Number=SeqID_93230
  Gene Ontology: Mol. function=DNA binding
  Homolog annotation: Hit_ID=Q2HW76; Match level="QueryCoverage=99%, HitCoverage=100%, E-value=1e-16, Identity=30%"; Hit description=HMG -I and HMG-Y, DNA-binding
  Pfam annotation: Domain name=WRC; Domain location=104-148; Score=4.2; E_value=0.071; Accession=PF08879.1; Description=WRC
MRIRKNAKLSPLLFSSSSCLQGGSVPLETHVCQLNQSPWDVIPFDSDSIQFQLDHSFAAGNNNGSAENSFGAVESVASMMDADKTSYHSTLVVDVAPINIDATTNMTNPCQFNDKGWPCMNEVRQGQSFCEQHLSYSLLTPHHHTSKKPQAQAQPSAPGTRRGKPRGAAGKKAAAGAGASSNPYEFYYYSGFGPLWGKRRGDRNGGEGSKNSSVGVENSTMVESKNGVGGADDGINDNVASVEVGPSVSEMEHEGIIDYVDDDEEEEGEEEGVDDSGKKRMRKPVKARSLKSLM

SEQ ID NO: 210009 - protein, 88 aa, Glycine max
  Coding DNA Sequence Number=SeqID_93231
MTKHKHWFVGHTGMKRVAANLCSRSDEQKRNEATVKMQSLNLYEANRITYFIFASYILGEPNHTKNSTNSQKTSKLFTSAVGTISRIS

SEQ ID NO: 210010 - protein, 229 aa, Glycine max
  Coding DNA Sequence Number=SeqID_93232
  Gene Ontology: Mol. function=naphthoate synthase activity; Cellular component=chloroplast; Biological process=menaquinone biosynthetic process
  Homolog annotation: Hit_ID=Q8GYN9; Match level="QueryCoverage=92%, HitCoverage=62%, E-value=1e-100, Identity=83%"; Hit description =Putative enoyl-CoA hydratase/isomerase
  Pfam annotation: Domain name=ECH; Domain location=2-150; Score=119.3; E_value=1.1e-32; Accession=PF00378.10; Description=Enoyl-CoA hydrataseisomerase family
MAMFTFCVNQCGIDADAILMLQGTEAFCSGGDQALRTDNGYSDNGSFSSLNVLDLQVQIRRLPKPVIAMVAGYAVGGGHVLHMVCDLTIAADNAIFGQTGPKVGSFDAGFGSSIMSRLVGPKKAREMWFLTRFYDAVEAEKMGLVNTVVPLENLEKETIKWCREILRNSPTAIRVLKSALNAVDDGHSGLQEIGGNATLIYYGTEEAKEGKTAYLQRRRPDFSKFNRRP

SEQ ID NO: 210011 - protein, 61 aa, Glycine max
  Coding DNA Sequence Number=SeqID_93233
MSESNKISNMIYTLKVTLVGKNMSSENIRAWLTMCLRLDLNTRPLDEAGPDTTAETIPPKN

SEQ ID NO: 210012 - protein, 196 aa, Glycine max
  Coding DNA Sequence Number=SeqID_93234
MKLTGKIDFVSLNNVSKKLFEFDSNIFRRFKDHFIKVLSIDVVDDGLPLMFNRDEEPHFPFYWQSDPTREGRKNYFGVAAVSLDVRTILSLPSVSDPLVALDGIMGGFAYRPLVKQVGHAGRDVPLSAIATVVGEGGQPISEVGPIAIVVEVTPNALSSILEKRKRDEVLGRLVEATPTTIEVSVPVTLAGSVVAT

SEQ ID NO: 210013 - protein, 136 aa, Glycine max
  Coding DNA Sequence Number=SeqID_93235
MAQDFKSSHHCLTIWVKLRSHSQVLKEVFTPTSLNDQLVGVLRARQFHLALKRSNTRYQGEKGLVFQNVIHHPLIASNGRCGQQRPNAMATLHTGICRDISIVALSSHTPKEIRRRITVTRTGSSAATEGCALSRG

SEQ ID NO: 210014 - protein, 161 aa, Glycine max
  Coding DNA Sequence Number=SeqID_93236
  Homolog annotation: Hit_ID=Q00M75; Match level="QueryCoverage=30%, HitCoverage=7%, E-value=6e-10, Identity=71%"; Hit description=PPR -repeat containing protein
MKVKEEKLEMKPGFIATEVEDEETLVQKCESGDSDNGNSDSNNNGSNDSDDDDVKVVVTMVIMMMMASPGAAVKLCLGDLLVMGSNPETASLHMQGTPALTFLKHSSSHIFKTLKLSCQNPQTSLALVVVVQSSLSCSHHHRAAIDVEVVNPSTNVLSSLE

SEQ ID NO: 210015 - protein, 104 aa, Glycine max
  Coding DNA Sequence Number=SeqID_93237
MGAKHLTRTKHKLHVINKGPRTKLGVAGDHKIPPHQKNVYTDNHSGISARQRDSNVSMTDLVSAEDDVNLRVSTGLSAAIDEGRRMTIICLCVPSDTTVSEWQK

SEQ ID NO: 210016 - protein, 55 aa, Glycine max
  Coding DNA Sequence Number=SeqID_93238
MVTMEEKGATVVSVSNGGSMEGNLRIFENKECLVLIMSENMPDITKTLAKQVKFD

SEQ ID NO: 210017 - protein, 445 aa, Glycine max
  Coding DNA Sequence Number=SeqID_93239
  Gene Ontology: Mol. function=amino acid binding; Biological process =metabolic process
  Homolog annotation: Hit_ID=Q1S8K5; Match level="QueryCoverage=99%, HitCoverage=100%, E-value=0.0, Identity=89%"; Hit description=ACT domain, putative
  Pfam annotation: Domain name=ACT; Domain location=117-189; Score =42.0; E_value=2e-09; Accession=PF01842.15; Description=ACT domain
  Pfam annotation: Domain name=ACT; Domain location=256-327; Score =23.3; E_value=0.00087; Accession=PF01842.15; Description=ACT domain
  Pfam annotation: Domain name=ACT; Domain location=28-95; Score=24.6; E_value=0.00036; Accession=PF01842.15; Description=ACT domain
  Pfam annotation: Domain name=ACT; Domain location=334-400; Score =36.1; E_value=1.2e-07; Accession=PF01842.15; Description=ACT domain
  Pfam module annotation: Pfam domain module=ACT::ACT::ACT::ACT; Domain location=117-189::256-327::28-95::334-400
MDDEYAKLIRRMNPPRVVIDNNACENATVIQVDSVNKHGILLDVVQVISDMNLVITKAYISSDAVWFMDVFNVIDHNGNKIRDKEVIDYIQRRLENNPSFAPSLRESVGVVPTEEHTVIELTGTDRPGLLSEICAVLTDLHCNVVTAEIWTHNTRAAAVVHVTDDSSGCAIKDPSRLSTIRDLLSNVLRGSNDPKTARTTLSPPGVTNRDRRLHQIMFADRDYERIERAGRGGLRDRDKRPLPHVTVVDCVEKDYTVVTMRAQDRPKLLFDIVCTLTDMQYVVFHGVVKTLRTEAFQEFYIRHVDGFPISSEAERERLVQCLEAAIERRASEGMELELCTEDRVGLLSDITRIFRENSLCIKRAEISTEEGKARDTFYVTDVTGNPVDPKIIDSIRRQIGDKVLKVKHNSNLSPKPSQPTTIGFLLGNFFKARSFQNFKLIRSYS

SEQ ID NO: 210018 - protein, 523 aa, Glycine max
  Coding DNA Sequence Number=SeqID_93240
  Gene Ontology: Mol. function=transporter activity; Cellular component= integral to membrane; Biological process=transport
  Homolog annotation: Hit_ID=Q13TD8; Match level="QueryCoverage=58%, HitCoverage=74%, E-value=9e-99, Identity=59%"; Hit description=Major facilitator superfamily (MFS) transporter
  Pfam annotation: Domain name=Hydrolase; Domain location=3-187; Score =92.2; E_value=1.5e-24; Accession=PF00702.16; Description=haloacid dehalogenase-like hydrolase
MSVECIFFDCDGTLVDSEVICTQSYVNTFARYGIELSLQQMFEQYKGVKLYDIIRDVTAQHQVTLPLAEVESAYRAEVARLFDLDLQPIAGARALVERVKVPMCVVSNGTVKKMEHSLGLTGMLPYLSGRLYSGYDINHWKPDPELMYHAAEQMQVPIEKCILVDDSEAGARAGIAAGIPVFYYCADAHNPVIDHPLVTRFDDMAQLPALWRARGWDLEQRSDNIQQVNQRQQRNRSGERNMRGQHADHQRTETADAAAEVKQHILRSGARLRWESVRDQRAVAANHAVNKHPHDGTGKQHHRRVAQLGVNHHHRHGTKLVQQENLPARKAVRQHAEQPDAECHAHHRNGRPQAGFGQAEAKAGREIAWHPYHQAVIAKILHRTKNQNAEAGFTGGAIGKQQFNARGKGELRGFFHMAGEGFRLAHAAANHKRHQRRQQANQEHTAPANHAQQRRRDKGRQQYAELPADTHPRRGAVTLLLRPGFGNQRHADAKLTAQSHAGQRTIRQQIPVALRHGAQPGEQ

SEQ ID NO: 210019 - protein, 647 aa, Glycine max
  Coding DNA Sequence Number=SeqID_93241
  Gene Ontology: Mol. function=transferase activity; Cellular component= mitochondrion; Biological process=metabolic process
  Homolog annotation: Hit_ID=Q1SZV4; Match level="QueryCoverage=88%, HitCoverage=77%, E-value=9e-40, Identity=23%"; Hit description =Pentatricopeptide repeat
  Pfam annotation: Domain name=PPR; Domain location=150-184; Score =27.4; E_value=5.2e-05; Accession=PF01535.11; Description=PPR repeat
  Pfam annotation: Domain name=PPR; Domain location=221-255; Score =21.9; E_value=0.0022; Accession=PF01535.11; Description=PPR repeat
  Pfam annotation: Domain name=PPR; Domain location=360-394; Score=2.5; E_value=3.8; Accession=PF01535.11; Description=PPR repeat
  Pfam annotation: Domain name=PPR; Domain location=395-429; Score =42.0; E_value=2e-09; Accession=PF01535.11; Description=PPR repeat
  Pfam annotation: Domain name=PPR; Domain location=430-464; Score =26.1; E_value=0.00012; Accession=PF01535.11; Description=PPR repeat
  Pfam annotation: Domain name=PPR; Domain location=465-499; Score =39.3; E_value=1.3e-08; Accession=PF01535.11; Description=PPR repeat
  Pfam annotation: Domain name=PPR; Domain location=500-534; Score =18.7; E_value=0.022; Accession=PF01535.11; Description=PPR repeat
  Pfam annotation: Domain name=PPR; Domain location=80-114; Score=2.8; E_value=3.5; Accession=PF01535.11; Description=PPR repeat
  Pfam module annotation: Pfam domain module=PPR::PPR::PPR::PPR::PPR::PP R::PPR::PPR; Domain location=150-184::221-255::360-394::395-429::430 -464::465-499::500-534::80-114
MSVRESGARGLSKAVISASKKRGRWGPEVEERLHRLGWRQRLSPSLVGNVIDPFLKSHHSLALGFFNWASQQPGFSHTPFTFHSLLKSLSHTNHFSAIHSLLKQAKALNFPIQPSLFSSIIASHVARNRARQAFSLYCGVGSLSAEIGVATSNSLLAALASDGCLESARRVFDEMSERGVGFSTLGFGVFVWRVCGEGDLEKVVSLLDEVGECGSGINGSVVAVLIVHGLCHASKVSEALWILDELRSRGWKPDFMAYWVVAAAFRSMGNVADEVKVLKMKRKLGVAPRSSDYRDLILGLVSERRIYEAKEVGEVIVGGNFPVEDDVLNALIGSVSSVDPGSAIVFFNFMVEKERFPTILTISNLSRNLCGHGKVDELLEVFHVLNSHNYFKDVEGYNVMVSFLCKAGRVREGYSVLQEMKKKGFRPNVTSYNYIMEACCKEDLLRPARKLWDEMFSSGCCGNLKTYNILIQKFSEVGQAEEAHMLFYHMLDKGVEPDVTSYTLLLEGLCQEDKLEAAFELYNKSVKQDIILARDILSSFISSLCRKGHLMAASKLLCSLNHDIGCAESHVILLESLANAQEIPIAIEHLKWVQEKSPSILQDICTGLLASLSSATCPEPILQFLKRIQDVFNFPYLEGYLQPIITM

SEQ ID NO: 210020 - protein, 254 aa, Glycine max
  Coding DNA Sequence Number=SeqID_93242
  Gene Ontology: Mol. function=phosphopantetheinyltransferase activity; Biological process=macromolecule biosynthetic process
  Homolog annotation: Hit_ID=P0ADM8; Match level="QueryCoverage=93%, HitCoverage=94%, E-value=3e-38, Identity=40%"; Hit description =Hypothetical protein yieE
MASHFVRWVVNPPLTPETMRVPQDVMTSAGHLPDKRRGRFLAARALLAQLMLRVYGIRDLPPLIASSSGRPCFADPNLPDFSISYAGNMVGVLLAEEGGRAGLDMEIVRAHSRQAQDALTQGLSSGEKAWINAQQDFMEAVTQIWTLRQSILKLTGEADSGIDALRLHPAAGRLRSSVYPDIQAVCDAEPTLVWSCALSPGTERLRLWEIDAQQQWQSLRDVEMSKPNIGPRTLRLTSLPGERVASQPEVRHPG

SEQ ID NO: 210021 - protein, 436 aa, Glycine max
  Coding DNA Sequence Number=SeqID_93243
  Gene Ontology: Mol. function=protein binding
  Homolog annotation: Hit_ID=Q7MXZ9; Match level="QueryCoverage=99%, HitCoverage=99%, E-value=1e-174, Identity=68%"; Hit description=HipA protein
  Pfam annotation: Domain name=HipA_C; Domain location=250-333; Score =137.1; E_value=4.9e-38; Accession=PF07804.3; Description=HipA-like C- terminal domain
  Pfam annotation: Domain name=HipA_N; Domain location=151-239; Score =81.5; E_value=2.6e-21; Accession=PF07805.3; Description=HipA-like N -terminal domain
  Pfam module annotation: Pfam domain module=HipA_C::HipA_N; Domain location=250-333::151-239
MTELDVYMNGYRTGVFSRAATGAHTFRYYESWLNQPGSRPISLSMPLRHQPYKGAEVYNFFDNLLPDNPEIRARILSRYQASSTQPFDLLAKVGSDTIGALQLLPPDSKPHTVRTIDYRRLSDSELEKILSGYQSGAPLGMLEELTDFRISLAGAQEKTALLRIDQQWCLPQGNTPTTHILKLPIGNIQSHSHRIDLSDSVENEWLCTLIAREFGLAVPPCFIVNTGKIKALAVERFDRRYASDGQWIMRLPQEDFCQVLNVPAAGKYESHGGPGISAIMDYLLNSVNAEQDRYDFMKAQVLFWLLAATDGHAKNFSIFIEAEGRFRLTPFYDILSIYPVIGGAGLHIRDAKLAMGLNGSKGRKAAIEHIFPRHFIETAKTTKFALTAMAHILDEFRARTPEVIQRVQEQIPAAFPLRVSQTILNGFKARAARLQQ

SEQ ID NO: 210022 - protein, 175 aa, Glycine max
  Coding DNA Sequence Number=SeqID_93244
  Gene Ontology: Mol. function=oxidoreductase activity; Cellular component=intracellular; Biological process=electron transport
  Homolog annotation: Hit_ID=Q11FQ5; Match level="QueryCoverage=88%, HitCoverage=94%, E-value=6e-36, Identity=47%"; Hit description =Flavin reductase-like, FMN-binding
  Pfam annotation: Domain name=Flavin_Reduct; Domain location=27-175; Score=172.4; E_value=1.1e-48; Accession=PF01613.8; Description =Flavin reductase like domain
  Subcellular localization annotation: CTP_CleavageSite=65; ConfidenceScore=5.05e-01
MHVGVVMSVTSLARQESISLDEFRHGMRRLTAGVSLVTTSSSGEKFGLIATSVSSLAAEPPSLLVCVNRSASSHDAILQAGYFAVNVLREQHDDLCAQFSSPTRRAERFQSGEWQTLNTGAPVLADALVSFDCQLEKTVEWNTHSVLLARIVGIALPGEATAPMVYFNSGFHSLG

SEQ ID NO: 210023 - protein, 67 aa, Glycine max
  Coding DNA Sequence Number=SeqID_93245
GQKAPATAIRGSHPRRSQGGSSAEGRIIAQSASEIFPFYTVLIHFIHRVSRHASVYAVCGKSERGSG

SEQ ID NO: 210024 - protein, 809 aa, Glycine max
  Coding DNA Sequence Number=SeqID_93246
  Gene Ontology: Mol. function=sugar binding; Cellular component =integral to membrane; Biological process=protein insertion into membrane
  Homolog annotation: Hit_ID=Q6CYR0; Match level="QueryCoverage=64%, HitCoverage=95%, E-value=0.0, Identity=77%"; Hit description =Putative membrane protein
  Pfam annotation: Domain name=60KD_IMP; Domain location=352-527; Score= 374.8; E_value=1.4e-109; Accession=PF02096.11; Description=60Kd inner membrane protein
  Pfam annotation: Domain name=MMR_HSR1; Domain location=773-809; Score= 0.2; E_value=0.00095; Accession=PF01926.13; Description=GTPase of unknown function
  Pfam module annotation: Pfam domain module=60KD_IMP::MMR_HSR1; Domain location=352-527::773-809
  Subcellular localization annotation: CTP_CleavageSite=53; ConfidenceScore=5.16e-01
MDSQRNLFLIAFLFVSFMIWQAWQTDHAPQPQQTQTTQNTSSAAGDAASSGVPASGQGKTITVKTDVLSLNINTRGGDIEQAQLLTYPDKLGSDAPFQLLETTPAFVYQAQSGLTGRNGPDNPNNGARPLYTASQDHFEMADGQTELRVPLSWTGENGVVYTKTFVFKRGEFAVNVDYNINNASQQPLEVAMFGQLKQTIDLPKHRDTGSNNFALHTFRGAAYSTSDAKYEKYKFDTIADNENLNTTTSNGWVAMLQQYFATAWVPRTQGNNTLYTSNLGNGVAAIGYKSAPVTIAAGAQQDLGATLWVGPEIQDKMAAIAPHLDLTVDYGWLWFISQPLFKLLKFLHSFIGNWGFSIIVITFIVRGIMYPLTKAQYTSMAKMRMLQPKIQAMRERLGDDKQKQSQEMMALYKAEKVNPLGGCLPLVIQMPIFLALYYMLSGSVELRHAPFVLWIHDLSAQDPYYILPVIMGITMFFIQKMSPTTVTDPMQQKIMTYMPVIFTVFFLWFPSGLVLYYIVSNLPRQEESVTPGNAEQDATSPGAAFMPPCFFWKKVLMSHSDTIVAQATPPGRGGVGILRISGGKAAEVAQAVLGKLPKPRYADYLPFNDADGSVLDQGIALWFPGPNSFTGEDVLELQGHGGPVILDLLLKRIVALPGVRIAQPGEFSERAFLNDKLDLAQAEAIADLIDASSEQAARSAVNSLQGAFSLRVNALVEALTHLRIYVEAAIDFPDEEIDFLSDGKIEAQLNAVIGDLNGVRAEARQGSLLREGMKVVIAGRPNAGKSSLLNALAGREAAIVTDIAGTTRD

SEQ ID NO: 210025 - protein, 186 aa, Glycine max
  Coding DNA Sequence Number=SeqID_93247
MAPQKDNSMASTYEQNKCVYTQDLEKKLRRKDTQPPTTTRPSSSKKNDGLSVSITHRKGSLTPKDEEDGNRPKKVTNIGWKNVFQPPMVNDPMKVEILGPSKIGSSLEIYGGEDLTCHFSLVTKEVWLSQPSLFMHKLQEIGDEAGNDFFVVTKEEIRKVVIVGPCGLNNLQGVNYFSTNKFLTPF

SEQ ID NO: 210026 - protein, 85 aa, Glycine max
  Coding DNA Sequence Number=SeqID_93248
MNALVIYKYCFGPALFGPDGCRETRGTGTREAARKPRRKGDLPFGERATRGLRVRLPWEENAWSRHQRLFEENVRKTGKGVVYEL

SEQ ID NO: 210027 - protein, 57 aa, Glycine max
  Coding DNA Sequence Number=SeqID_93249
MMQISQGCVVPQTMMAMADTTMIVVSGHEVMSTGKRKLRAEKKVFDECGEKSRVWGF

SEQ ID NO: 210028 - protein, 90 aa, Glycine max
  Coding DNA Sequence Number=SeqID_93250
MRVTSISSPKHRQELFCAESGNLDKCKSCRSAKSGVSDECSAPRCSCIHVTHGVGTYWRRGTWVSGVASWCKILGHHFSFRQLPMSRVSR

SEQ ID NO: 210029 - protein, 101 aa, Glycine max
  Coding DNA Sequence Number=SeqID_93251
MGGYLADKDGVDDTVCEKYDINKEKWTQFCLIRKDPSWEDVQKKAQAIQKQNIVLPVLSRGGYENLENKLMEEKKKKQMEEAAKSESIDTVIDPLSPINDT

SEQ ID NO: 210030 - protein, 85 aa, Glycine max
  Coding DNA Sequence Number=SeqID_93252
  Homolog annotation: Hit_ID=Q1SR77; Match level="QueryCoverage=32%, HitCoverage=3%, E-value=4e-07, Identity=89%"; Hit description=AMP -dependent synthetase and ligase
MLNFWVTSAMQHYVATRPMFIDVEIMNADTKLVVYFIVFTKTNVLIILHAESFRVVNHCPFGQTVRETISCQFTFRGGRWAPINE

SEQ ID NO: 210031 - protein, 324 aa, Glycine max
  Coding DNA Sequence Number=SeqID_93253
  Homolog annotation: Hit_ID=Q1PDY7; Match level="QueryCoverage=34%, HitCoverage=40%, E-value=7e-20, Identity=43%"; Hit description=RNA recognition motif-containing protein
  Pfam annotation: Domain name=RRM_2; Domain location=211-324; Score =65.6; E_value=1.6e-16; Accession=PF04059.3; Description=RNA recognition motif 2
MVSPLNPEALEYLPRHNHKLQQQQQQVLQPQPLPCSTFPPTSIFTPHCNFLLLFSSFPSRHPYNPFYYPTLTLPPLPPSSIPLALEADQPTRFHEIKNGSDSDSDSNPVEAHAVNKKKDQMVIAEEPKTGCGSIGFVKKRAFKAYINGRCLESWRQKSYPPRRKVEENGQRKSVDFLRNRKVFRHHPANEPFRGFPKRNRFNPSLPVRDGETTVMIRNIPSKYTRELLVKFLEDHCLKVNRTTENEACKEKGEEESIGLAFDFVYLPIDFKSRMNKGYAFVNFTKPQAARKFRNTASRLKWDMFQSNKIREVVSARLQVWSHTH

SEQ ID NO: 210032 - protein, 33 aa, Glycine max
  Coding DNA Sequence Number=SeqID_93254
MAFVLSRLWLFKEAKLFDGQAYMYKTCGNWKTS

SEQ ID NO: 210033 - protein, 165 aa, Glycine max
  Coding DNA Sequence Number=SeqID_93255
  Pfam annotation: Domain name=zf-GRF; Domain location=18-52; Score= -2.2; E_value=0.057; Accession=PF06839.3; Description=GRF zinc finger
MMNEKGGSSSSSLSLAMVKCKCECEPSGRRFWRCPHRNESSSCRFFQWIGDTEANNNVTVEGSELVLYVQENEELKLKLASLMEEAKASVEERTNLRKNIVAQQEECWASLVEVVQLKSKSGRKKNNLVIERNKVKLSGFAVVLQVFISLLSIVIAMNVGGHRRN

SEQ ID NO: 210034 - protein, 169 aa, Glycine max
  Coding DNA Sequence Number=SeqID_93256
MDMWPVTEFDVIQPPKYKKGPDRPKKLRKREPDEDPNRTRLRKDPTPYKCNRCRAISHNTKRCPLPPLVVPKEENEEPSGVAEGVVEGAAQVEGGTKEAAKAGTEGATQDGNEGALVGGKGVQQSGHCGHNRSINEKKYRNLLLNARHQQQAKNLKVVNYQLLRKRLSW

SEQ ID NO: 210035 - protein, 136 aa, Glycine max
  Coding DNA Sequence Number=SeqID_93257
MELSLFSCLFTFKISFSYLIVYCQVDSSIFVYKLTINLIDPAYLQHLHCAQICYPEPSLTSFATAHCCPPLTKIDSRSFDDNKDDDKNLKSQDHFMITKMMTFKNEFKIESRTLQRSRGNLISRIKNQDSRFKIQE

SEQ ID NO: 210036 - protein, 158 aa, Glycine max
  Coding DNA Sequence Number=SeqID_93258
STPLGRSATLITALCGARGVTSNSLTYESLILAINLAYIKKNCWNVDDLTINFRGARKVAWPRTLPSAVREGEGPSAQVPQQVQDASSEATIPRAFEFLGAGVGMKPDEVVLPEPIVPVIHKTLEARESQLRQEAATPERTPQTSKDPLSPRMDLSFA

SEQ ID NO: 210037 - protein, 179 aa, Glycine max
  Coding DNA Sequence Number=SeqID_93259
  Gene Ontology: Mol. function=zinc ion binding
  Homolog annotation: Hit_ID=Q2HT04; Match level="QueryCoverage=77%, HitCoverage=34%, E-value=1e-08, Identity=41%"; Hit description=Zinc finger, RING-type
  Subcellular localization annotation: CTP_CleavageSite=59; ConfidenceScore=5.08e-01
MEGKTESHMTSAATFVEGGSRSLSLIASMSSTCSAFLNVSDHGRPHFLVYSTQPSAPPSAAGGGSEPAAIAVGSPSTPLTFDGNEQSSLQQIPYVQTRSSSLTSASTAATTNLQGVHSNDRSFASHSFPASQDRAHPSEQSLSDSLRSRFNAVSMRYDFLETLYTKNQFRRAQGDGRRG

SEQ ID NO: 210038 - protein, 140 aa, Glycine max
  Coding DNA Sequence Number=SeqID_93260
  Gene Ontology: Mol. function=calcium ion binding; Biological process =response to abscisic acid stimulus
  Homolog annotation: Hit_ID=Q9FLN9; Match level="QueryCoverage=63%, HitCoverage=53%, E-value=3e-28, Identity=65%"; Hit description =Embryo-specific protein 1; Ca2+-binding EF-hand protein-like
  Pfam annotation: Domain name=Caleosin; Domain location=1-117; Score =41.9; E_value=2.2e-11; Accession=PF05042.4; Description=Caleosin related protein
MTCAFFNNMYPSSTLTIMVSSTYWTHIWTWLPSPFFPIYIKNIHRAKHGSDTGTYDTEGSKYAREVPDKLTLKELWHMTEGNMVAYDFFGWSSIFLIQLFASRIQFMGDFFVNKLQGCQLDGEVRLLNKYDTLVSTWFTR

SEQ ID NO: 210039 - protein, 59 aa, Glycine max
  Coding DNA Sequence Number=SeqID_93261
MGRERKEEEEKYKNKTPLSSQEGNDDGGWGQGGRQKSLLVAAGEINMGREEESSIEDVG

SEQ ID NO: 210040 - protein, 286 aa, Glycine max
  Coding DNA Sequence Number=SeqID_93262
  Gene Ontology: Mol. function=ubiquitin-protein ligase activity; Cellular component=ubiquitin ligase complex; Biological process =protein ubiquitination
  Homolog annotation: Hit_ID=Q681N2; Match level="QueryCoverage=97%, HitCoverage=47%, E-value=2e-74, Identity=43%"; Hit description=Arm repeat containing protein
  Pfam annotation: Domain name=Arm; Domain location=122-162; Score =13.3; E_value=0.26; Accession=PF00514.13; Description=Armadillobeta -catenin-like repeat
  Pfam annotation: Domain name=Arm; Domain location=163-203; Score =22.7; E_value=0.0014; Accession=PF00514.13; Description =Armadillobeta-catenin-like repeat
  Pfam annotation: Domain name=Arm; Domain location=204-244; Score =12.2; E_value=0.36; Accession=PF00514.13; Description=Armadillobeta -catenin-like repeat
  Pfam annotation: Domain name=Arm; Domain location=81-121; Score=43.1; E_value=9.6e-10; Accession=PF00514.13; Description=Armadillobeta -catenin-like repeat
  Pfam module annotation: Pfam domain module=Arm::Arm::Arm::Arm; Domain location=122-162::163-203::204-244::81-121
MGKTMIAPNPVPKSTCCFCLIEEWCDNNNFKLPKKYNSSHQETYPIDSKEEIPALVESLSSIHLEEQTIAMEKIHMLSKEIQENRVFVAEHGGIPPLVQLLCYPDSKIQEHAVTTLLNLSIDEGNKSLISTKGVIPTIIEVLENGSYVAKENSAVALLSLLMLDEIKDIVGQSNGFPPLVDLLRNRTITRKKDVVTAIFNLSINHATKVLHIRAGIIAPLLQLLKDPNLRMIDEAPSILLLLISNSEAREEIGQISFIETLVEFMREGSTWGECNPENLKSMKENS

SEQ ID NO: 210041 - protein, 87 aa, Glycine max
  Coding DNA Sequence Number=SeqID_93263
MVHINCSDAVWQKPPVGFLKCNIDASIYNDQFGVTAIIRDHLSQFILAKSACFNGSMDHPARNRSNNSLRPSTRFRVRICKICYLRI

SEQ ID NO: 210042 - protein, 143 aa, Glycine max
  Coding DNA Sequence Number=SeqID_93264
  Gene Ontology: Mol. function=monooxygenase activity; Cellular component=membrane; Biological process=electron transport
  Homolog annotation: Hit_ID=Q1S498; Match level="QueryCoverage=98%, HitCoverage=27%, E-value=7e-70, Identity=84%"; Hit description =Cytochrome P450
MQMKWVMNEVLRLYPTAPNVQRQAREDIQVDNLTVPNGTNMWIDVVAMHHDPALWGKDVNEFRPERFMNDVNGGCNHKMGYLPFGFGGRMCVGRNLSFMEYKIVLTLLLSRFSFKVSPGYNHAPSIMLSLRPTYGLLLIVQPL

SEQ ID NO: 210043 - protein, 106 aa, Glycine max
  Coding DNA Sequence Number=SeqID_93265
  Gene Ontology: Mol. function=protein serine/threonine kinase activity; Biological process=protein amino acid phosphorylation
  Homolog annotation: Hit_ID=Q6RC06; Match level="QueryCoverage=57%, HitCoverage=12%, E-value=3e-15, Identity=73%"; Hit description =Serine/threonine protein kinase
MEKFNRVTKVDGSDVAGADATEEVDVAEGEGGLAEEGGRADGGVGEVGGATRLDGETLRRGREEIEGETAETGAANALAAHGAFKCGRIHGLQTHLRITFTTTTTP

SEQ ID NO: 210044 - protein, 347 aa, Glycine max
  Coding DNA Sequence Number=SeqID_93266
  Homolog annotation: Hit_ID=Q38888; Match level="QueryCoverage=76%, HitCoverage=97%, E-value=2e-91, Identity=63%"; Hit description =OBP32pep
  Pfam annotation: Domain name=DUF220; Domain location=180-279; Score =142.4; E_value=1.2e-39; Accession=PF02713.5; Description=Domain of unknown function DUF220
  Subcellular localization annotation: CTP_CleavageSite=54; ConfidenceScore=5.03e-01
MGDSEMTKFGLKVGKNGFPRGLDPAISKFFVQLQIVVKSQLSRLAKQDGMSLMRSVQRKGGSFSYSEAELNEQLQAWRENPSWVDKPPLIKVTVPKGSLCNLDVEVDVGLPPDAVYNIVIDPDNRRVFKNIKVALSQFSATQLGDVFLCKEVVSRKVLVDQGHRQVVDLDQAAIWKFLWWSGTISINVLVDQNRKDHSMKFMQTKAGFMKKFEGCWRVEPLFVDEAMCHPFKPVTKEDYNACTRGKGRIGSKVSLEQILQPSIVPPPPLSWYLRGITARTTEMLINDMLAETARIRGGYEAEKSKAEELQVKPGENVDLVSNTSDIKESWKLRRKNAKQSHRSLLTK

SEQ ID NO: 210045 - protein, 230 aa, Glycine max
  Coding DNA Sequence Number=SeqID_93267
  Gene Ontology: Mol. function=pantothenate kinase activity; Cellular component=cytosol; Biological process=coenzyme A biosynthetic process
  Homolog annotation: Hit_ID=O80765; Match level="QueryCoverage=88%, HitCoverage=53%, E-value=9e-86, Identity=75%"; Hit description =Pantothenate kinase 1
  Pfam annotation: Domain name=Fumble; Domain location=1-226; Score =271.7; E_value=1.4e-78; Accession=PF03630.5; Description=Fumble
MNSGSQPQENPGSQSIAIKATGGGAYKYADLFKERLGIIFDKEDEMDCLVAGANFLLEVVHQEAFTYMGDQKQFVQIDQNDLYPYLLVNIGSGVGMIKVEGEGKFERVSGTSIGGGTFWGLGKLLTECKSFDELLDLSYRGNNRAVDMLVGDIYGGMDYSKIGLSSTAIASSFGKAISDNKEREDYKPEDIARSLLRMISNNIGQNLGRTTPQKLAIVVSPRPYEPHIGI

SEQ ID NO: 210046 - protein, 109 aa, Glycine max
  Coding DNA Sequence Number=SeqID_93268
  Homolog annotation: Hit_ID=Q1SEE1; Match level="QueryCoverage=43%, HitCoverage=3%, E-value=4e-12, Identity=68%"; Hit description =Integrase, catalytic region; Zinc finger, CCHC-type; Peptidase aspartic, catalytic
MAAMDLSLGNPLYRKSSWWWVQAACPADGAACGVKFPCVVARDPPIGISGSLLSLEEAVGVMALEEGNVKIENFDGRDFNFWKMQDYLYQKKLYQPLSGDKPNDMKQEE

SEQ ID NO: 210047 - protein, 238 aa, Glycine max
  Coding DNA Sequence Number=SeqID_93269
  Gene Ontology: Mol. function=transition metal ion binding
MGFTLVDLNKVYYKEEPFIMAEQARQVFYIQDLCDSRLLVVLQGRPIGITEENDHATLDICETPPFSTKMPSICEQPKVDDVYAIRNDHDEGSWEHRQGSLRNHMPRPTVTVDPAIGKGFGLEKQKFHRYLCVIAREKLSIVHSNWKDVSKNLKNLVWDDILSKFDMPKASKAKKKKQDPSIKYGMDQETWDAFAASRKTPTWEGPVTKAMSKRLQEDWARAVEEGSRVLMNLRGSIM

SEQ ID NO: 210048 - protein, 125 aa, Glycine max
  Coding DNA Sequence Number=SeqID_93270
MTEDFESYESEDFESSEGEEFESSQGKDFESYEGEDFEFFEGEDFEPPKGEDFESSKDFESSEGEDFEFSKARTLSPMKDFDPSKGEDFESSKGEPKGTSTKGLNLMRKQEIDSLRGPLIPNSKV

SEQ ID NO: 210049 - protein, 87 aa, Glycine max
  Coding DNA Sequence Number=SeqID_93271
MSTICLSLIVMRTRRILVILGVDELELSRDISRLRPDRVLTVGEKRPRGKFNCDPTVGTKCTYQNLELTDVIGDVAWMGSTISHIKL

SEQ ID NO: 210050 - protein, 88 aa, Glycine max
  Coding DNA Sequence Number=SeqID_93272
MACTSIEADSCSNIDLSTFSPRVNKSSSKDLKLMGSDVEKRSQNLKGPHHGPTIRVELRRDYVQVFKHSTLVLTKIQSCPMSGWTWLR

SEQ ID NO: 210051 - protein, 52 aa, Glycine max
  Coding DNA Sequence Number=SeqID_93273
MARVRGLKEKLGTKGSMPFVGGEDLLQFQQVVSEPPLLLDYWDLKFFGSYYT

SEQ ID NO: 210052 - protein, 221 aa, Glycine max
  Coding DNA Sequence Number=SeqID_93274
MAPKNLPAKKAMKTATGEGSSTTPLVDIEFDGRRFQSEEHQCHFELDEPIAKYDPEVVMEFYAYAWPTEEGIMDKRSRVRGQWIPYDTNAINQFLGHPLHHDPDQCLCGTAYLRCHPLVCRYCPSKTPSGPTEVQQGTGIFGIDYKSLPILRSTSALTKLIQPPINRSSIEKYCMPRQVLQMLKELPKGTQVELRMMETRQICLISSLEEAELPDHDLLNL

SEQ ID NO: 210053 - protein, 92 aa, Glycine max
  Coding DNA Sequence Number=SeqID_93275
MLIDVGNALACACCVCSWGALCTDLPGSLALLFGHVHTLDVVYDRGGHCALTFQGACHLVGNTFGSQADHLWEGGCYMHNRVVSTNSAQFPK

SEQ ID NO: 210054 - protein, 92 aa, Glycine max
  Coding DNA Sequence Number=SeqID_93276
MPSAPASELKQPIPQDSPAAQENIIHKKRGSKQICPKSGGVIIKLHSVTEESSRASISRSLAKPEISALSTAVVFNQAQRTTGSKLKFTYSR

SEQ ID NO: 210055 - protein, 83 aa, Glycine max
  Coding DNA Sequence Number=SeqID_93277
  Gene Ontology: Mol. function=adenylate cyclase activity; Biological process=cAMP biosynthetic process
  Homolog annotation: Hit_ID=Q1SH04; Match level="QueryCoverage=72%, HitCoverage=30%, E-value=3e-11, Identity=55%"; Hit description =Adenylate cyclase
MAWVLLHAADTVHQHRPCLQRSNAALVVAVEAEAKDDTMHGDLRCVTVEEEVLLERRESAVRVYAERLMRWALEEGSLPPRSS

SEQ ID NO: 210056 - protein, 37 aa, Glycine max
  Coding DNA Sequence Number=SeqID_93278
MEKNLVFATRDDVLHCARSIAYDIGFVAMVMKSDTNT

SEQ ID NO: 210057 - protein, 206 aa, Glycine max
  Coding DNA Sequence Number=SeqID_93279
MFGPFSLINVVGGIEEFDDAGQSRKNMVEVATVMKIIKNCFKGHFLRSSNWVIHTDIYVCVIDGLMQHSWSIICDNCRVQASKQGKELCMRKRFERVSAPQTGASTEHATRGTARRTRQQQGSAPDEGASGSALPLGATGGAQRVGTTGHAPNAGATQAPSPHTPKPLPTPPPPGLFLSHPPASSQTPQSLLLTPPSLFPHPPPQN

SEQ ID NO: 210058 - protein, 195 aa, Glycine max
  Coding DNA Sequence Number=SeqID_93280
  Homolog annotation: Hit_ID=Q1SPB9; Match level="QueryCoverage=68%, HitCoverage=27%, E-value=5e-13, Identity=34%"; Hit description =Transposase
MVSRYALNQIAAKFERVNYVDIYNSRCGCIMRTTHGLPCVCELARYVLGSIPLDTIHMFWWKRSFLDQGLSEPEVNITKKIEVISKWFEELDVCGKVTLKSQTKGAQKKQISKQQRSTKRYPSYWEYVDALHEDSWSLVRNHLLKELAQSDEYMHLLGGIDRYKELKRSLLISMVTMDKWMNITDMGYVIASRYF

SEQ ID NO: 210059 - protein, 83 aa, Glycine max
  Coding DNA Sequence Number=SeqID_93281
MMQKGSRGVGSDALTSYESLRPVINLAYITRNCWNMNDQKVNFPGARKTRLRAADAPSSSVPIAGVPSSSTRAPPPVSADPTA

SEQ ID NO: 210060 - protein, 165 aa, Glycine max
  Coding DNA Sequence Number=SeqID_93282
  Homolog annotation: Hit_ID=Q1RX21; Match level="QueryCoverage=25%, HitCoverage=13%, E-value=3e-09, Identity=72%"; Hit description =Fibrillarin
  Pfam annotation: Domain name=GRP; Domain location=1-94; Score=-27.0; E_value=0.044; Accession=PF07172.2; Description=Glycine rich protein family
MDAAKPNMVNLCDVKIVKKLCNIVDDTEHLKGRGGFGGSGRFRGSGKGDRGRGRGGGGRGGDRGTPFKARGGGGNGGGRGGGRGGNRGGMKGGSKVMVQPYRHDGFFIAKDKKDAIVKNLVLSEAVYNEKRITVQVSFLSHHYFFFFLSIEPWMHDVATYPSAGG

SEQ ID NO: 210061 - protein, 252 aa, Glycine max
  Coding DNA Sequence Number=SeqID_93283
  Gene Ontology: Mol. function=nucleic acid binding; Biological process= DNA integration
  Homolog annotation: Hit_ID=Q1S7C5; Match level="QueryCoverage=99%, HitCoverage=24%, E-value=2e-21, Identity=28%"; Hit description =Integrase, catalytic region
MRAVTLDGKTIEEYLQKINGFVDELAGVGVPVRHEEYVNALLEGLPSDCASVIEALLYGHETRLMRYNKEAQVMNSASINYTQGYLYPNTYKIGDSGGSRNAYGCGGSRGAFSDCGAGHGGGGSGRGHGGGRFANFQCQICLKFWYMANVCHFRSDVTFHPHESLTFIDPTTLRVQPIPYSIGSVRTSNTWVNLNSKNFGPSHSQPSAMLTSSTSQGNWQVGTTWIPDFGASFHVTGDSQNIKQFTHFDGPD

SEQ ID NO: 210062 - protein, 59 aa, Glycine max
  Coding DNA Sequence Number=SeqID_93284
MVRSCILISFRFVSPRRHWVTTYYGGHVWLTAASCVTKDIKELGFRRKYLVQIFLEAWQ

SEQ ID NO: 210063 - protein, 434 aa, Glycine max
  Coding DNA Sequence Number=SeqID_93285
  Gene Ontology: Mol. function=DNA binding; Cellular component=oxygen evolving complex; Biological process=DNA integration
  Homolog annotation: Hit_ID=Q1SD84; Match level="QueryCoverage=74%, HitCoverage=26%, E-value=1e-96, Identity=67%"; Hit description =Integrase, catalytic region
MDFLLEGNGTRDQVLLGMRALYSCYIASFHSGDERACLTKVGSVAVRRGVANGLIDCDQIWKGKVYMRRNKEVEDAQTLQHNHESEPRENLVSGIGKPSSSNSNDQDNPSEMNIPIALRKGVRSCTKHPLSKFVSYSNLSSSFAAFTSRLSCVETYGIDYSETFAPVTKLNTVRILLSLVANLDWPLHQLDVKNAFLNDDLEEEVYMDSPLGFEHRFGTKSLRAWFEKFTQSVKKQGYSQGQADHTLFTKFSSKGKIAALIVYVDDIILTRDDEVQLARLKKNLTAEFEIKDLGSLRYFLGMEVSHSKRGIVVSQQKHILDLLEETRMSGCRPADTPMDPKGKLWEIGSVPVDVGRYQRLVGKLIYLSHTRPDIAFSVSVGDQSGSQCLARMLQPCGIDTCLKEHSNRVTLKAYIPKSPLGPLPPDSGPTQKTF

SEQ ID NO: 210064 - protein, 282 aa, Glycine max
  Coding DNA Sequence Number=SeqID_93286
  Gene Ontology: Mol. function=nucleic acid binding; Cellular component= nuclear pore; Biological process=DNA integration
  Homolog annotation: Hit_ID=Q1T4S3; Match level="QueryCoverage=99%, HitCoverage=26%, E-value=1e-74, Identity=54%"; Hit description=Zinc finger, CCHC-type
MLTIALTHHWSIQKIDVNNAFFYGYLEEEVYITQSPGFVDSDKSMAKMVDAKPIFTPLPSDLKLTKHGTTKLVSVPVVDDATLYRPEVSYNVNNVCQFMSEPMEEHWKAVKRILRYLKGTIDYGLSLKSAPHGELYTLEAFCDADWGMDIVDRGSISRECIFFGPNFVSWWSKKQSSIARSTTEAQYRSLDVSASELLWIQSLLRELCIKITTPAVYCDNLSTVALSHNPVLHSRTKHMELDIFFVREKVLDKSLLVCLVPAYAQLADVLTKPLAKQSFLNL

SEQ ID NO: 210065 - protein, 97 aa, Glycine max
  Coding DNA Sequence Number=SeqID_93287
MEEHEESCSHLFLTCREVDFIWKYCFGWLNYSSVLAAKYQLHSVVMADPKTLANPSTNDASVLEHLWGMKFDPFGYIILLGIGVKLSCWKVSSILKY

SEQ ID NO: 210066 - protein, 115 aa, Glycine max
  Coding DNA Sequence Number=SeqID_93288
MGLGMGLDPLVDPTEAVVVDHYSYCGVIVRQLVFQQAHNGDHAMVEHTLERFPLKVKFSVGEDLEPYDSAFTSHPTRSSSVKGGRSMIGKTQITEQGYKENIQQRCRIWKSPKGE

SEQ ID NO: 210067 - protein, 128 aa, Glycine max
  Coding DNA Sequence Number=SeqID_93289
MWWQLGSNPCLSGPPFASPYLGRKGSIITEATDSPVTDNVPTSNDEEMLCQTLDYGALDLGELAQSQTIKSKCSSHFGVQAAQVKVGGYTLIVDAFVLDLGCVDLIPGHYDQSVRASPSRPLQNNRII

SEQ ID NO: 210068 - protein, 954 aa, Glycine max
  Coding DNA Sequence Number=SeqID_93290
  Gene Ontology: Mol. function=RNA-directed DNA polymerase activity; Cellular component=chromatin; Biological process=chromatin assembly or disassembly
  Pfam annotation: Domain name=RVP_2; Domain location=358-467; Score= -33.2; E_value=0.00039; Accession=PF08284.2; Description=Retroviral aspartyl protease
  Pfam annotation: Domain name=RnaseH; Domain location=835-949; Score= -32.2; E_value=0.057; Accession=PF00075.14; Description=RNase H
  Pfam module annotation: Pfam domain module=RVP_2::RVT_1::Retrotrans _gag::RnaseH; Domain location=358-467::588-774::99-189::835-949
MTEPPPSSADKLEELLVRLTHQQLSLTSKIDDLIHHVSPLIPPAPSFSSPLPRQFPVPVTHHRMKLDVPRFDGTDPLGWIFKINQFFEYHGTPEYERLTIASFYMEGRALSWFQWMTSNGHLTSWPVFLQALQSRFAPSQYEDPTRALCKLMQKGTVAAYQAEFEDLSNRVSGIPPAVLLSCFISGLLPDIRREVQAHQPLTLSQAAGLARLQEEKLIDHRPPPPPPPHRPRPPPPSPSNPISLRPNPLPPLLTPSPRPPPPPPPFKRLTFDEIASRRERGLCFSCDEKYHRGHRCASQVFLLLAEEEDNPNPPLIEPLDHIPEPAPDPPDTHDPYPAQLSLNSLAGHLAPETLRFVATISDRDVVLLVDGGSTHNFIQLQLVSQLGLRPMSTSPLRVMVGNGQQLECNLLCSAVPITIQTTTFHVDLYVLPISGANVVLGVHWLKSLGPVLTDYNHLTMQFFYEGNLIHLQGDMDAALSSLSSLQFRRLSRKNRDGLYYHITLLPNVDTSTQDLPPSILTLLTKYDTLFHPPNTLPPTRDTDHHIHLLPQAPPVNVRPYRYPHYQKQEIESQVDSMLQKGLIQPSSSPFSSPVLLVKKQDGSWRFCVDYRALNALTVRDRFPIPTIDELLDELGGARYFSKLDLLQGYHQICMHPPDIPKTAFRTHHGHYEFKVMPFGLCNAPSSFQATMNAIFRPYLRQFLIVFFDDILIYSNSLDVHVHHLELTFQEQVEYLGHLVSHRGVEPLPSKVDAIQQWPTPRTVKTLKSFLGLAGFYRRFIKGYATIAAPLVKATTSDALRWTADTQTAFDRLKHALSSAPVLALPDFTLPFTVETDAYGVGMGAVLSQQGHPIAYFSKPFSAKLLRSSTYVRELFAITAAIKKWRQYLLGHHFIIVTDHRSLKELLTQVIQTPEQHTYLARLLGYDYEIQYRAGAHNQAADALSRLPETTASLW

SEQ ID NO: 210069 - protein, 435 aa, Glycine max
  Coding DNA Sequence Number=SeqID_93291
  Gene Ontology: Mol. function=RNA-directed DNA polymerase activity; Cellular component=chromatin; Biological process=chromatin assembly or disassembly
  Pfam annotation: Domain name=Chromo; Domain location=351-403; Score =38.5; E_value=2.3e-08; Accession=PF00385.14; Description='chromo' (CHRromatin Organisation MOdifier
  Pfam annotation: Domain name=rve; Domain location=80-240; Score=16.6; E_value=0.00024; Accession=PF00665.16; Description=Integrase core domain
  Pfam module annotation: Pfam domain module=Chromo::RVT_1::rve; Domain location=351-403::64-225::80-240
MYVGVKSVTQGASPTCACNHSINLQPGTIPINVRPYFYAYHHKDEIEKQVRELLDNGVIHHSISPFSGPVILVKKKDYSWRMCVDFRVLSKITILDKYPIPTIGELNDEFHGSHYFFKLDLKSRFHQIRIVESDIPKDVFRTYEGYYKRRPSFICSIINDHDPLLLSKFWGELFRLQGTKLRMSTTYHPQTDSQTEVVNRCLETYLRCFTSEQPSKWHLWLSCTLHLIRPQLKHPLRFFMGDPHHPSCVSFPARCKWTLSLLFYLTAMNLFTSLIKLRYIMCRINPKLSPRYFGPFHILSHVGEVAYKLQLPDSAKVHSVFHVSQLKKSLAPASSASALPPGLLSDDPDAPVPEAVLASREGKTAGQTEWLVLWRSQPVEEATWEAADSIHAKFPTFSLENKADLTDGGIVRKCTSKWEKPFKVYSHRPKTKLMS

SEQ ID NO: 210070 - protein, 112 aa, Glycine max
  Coding DNA Sequence Number=SeqID_93292
MSVENLPWVISDGHGDRKFFMDHFRWIFASQIFVGNESVYVGHLLADHLSASHLLGPGDGPDVVGEAVNLCSIFSAPGRSLRVLLEAVTSSFVRSKGVSWDLPTLDAASDLA

SEQ ID NO: 210071 - protein, 278 aa, Glycine max
  Coding DNA Sequence Number=SeqID_93293
  Gene Ontology: Mol. function=RNA-directed DNA polymerase activity; Cellular component=intracellular; Biological process=RNA-dependent DNA replication
MRERRVVMRSSSLRPRVSWLGRDKCRRPESNLQLEQEADLAAQHLTIHSSLEKALINAIDCLTNEGEKDLRACLEDLDRLKEILSWEYAFEKLKKDNTIEKPKVKLKVLLVHLKYVFLEENEVKLVVISNDLSSDEEARLVEVLNKHKATIGWHIFYLKGISPSYCMHKIMIDDEYRPMRQPQRRLNPSMKEEVRKEVLKLLEAGLIYPISNSAWVSPVQVVPKKGKMTVVRDEKNDLISTWTVTGWRMCIDYRKLNDATRKDHFPPAIHGSDVGAVR

SEQ ID NO: 210072 - protein, 280 aa, Glycine max
  Coding DNA Sequence Number=SeqID_93294
  Gene Ontology: Mol. function=chitin binding; Cellular component =extracellular region; Biological process=chitin metabolic process
  Homolog annotation: Hit_ID=UPI000044A8F0; Match level="QueryCoverage =68%, HitCoverage=99%, E-value=3e-26, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLYALTFKGLHVLPIRGLYVLAFRGLHALTFRGLHLHALAFVGLHALTFRGLLVLTIGGLHTLAFSGLHALAFRGLHVLAIRGLHVLAFRGFHVLTFRGLHTFVFVGLHVLTFRGPHALTFRGLHVLAFRGLHVLAIRGVHAFTFRGLRVLAIRGLQILTFRGLHALAIRGLHVLTLRGLHALTFRGRHVLAIIPGPPPDPRGGRTVRAQLEEEAITQLLCIPGQDFTCASAKRRVWIMHTNMTTVTQIWMTLLLRNILPSDHNADLPLRKYQLVCAIMA

SEQ ID NO: 210073 - protein, 241 aa, Glycine max
  Coding DNA Sequence Number=SeqID_93295
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-22, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSTFEVFLSFSFCFMSTFRGLHVLAIRGLHALTFRGLHVLTFRGLHVLAIRGLHALTFRGLHVLPSEDYTSSPLEDYTSSPSEDYTSSPSEGNTPSYLEDYIGLHVLGIRGLHVFTLRGLHALAIRGPHVLAFRGLHVLAFGGLHVLTFKRLHVLSFKGLHILAFRGLHVLAIRGIDALTFRGLQVLAIRGQHVLTFRGRHIIAIRGLHTLTFRGLHVLAIRGLHVLAIRALHAFTFRGLH

SEQ ID NO: 210074 - protein, 61 aa, Glycine max
  Coding DNA Sequence Number=SeqID_93296
MHRGHAADPPSVVTVQEWYAFYDSHKARTDVEWYPIYDGHEAKTNVEWYPIYNGPTHHRPM

SEQ ID NO: 210075 - protein, 85 aa, Glycine max
  Coding DNA Sequence Number=SeqID_93297
MSNIVNLMCFNFNFSEACALSENHALSEALSPLSDAPSSLNGYSLTRAKRENGAKQAFEDRKPFLRLKLENSRIGMIERGLERRE

SEQ ID NO: 210076 - protein, 92 aa, Glycine max
  Coding DNA Sequence Number=SeqID_93298
  Gene Ontology: Mol. function=RNA-directed DNA polymerase activity; Cellular component=intracellular; Biological process=RNA-dependent DNA replication
MVEKCIEVFMDDCSVFGPSFDDCLTNLELVIRCCVEANLEGIVLGHKISGRGIEVEKAKIDVIEKLPPPVNVKGIRSFLGHAGFYRWLIKDF

SEQ ID NO: 210077 - protein, 218 aa, Glycine max
  Coding DNA Sequence Number=SeqID_93299
MGVLSIYYLSLTKIGQGGGALGSTGGPHVVHSKNSFPPYGLPSNYTPPDAAHTLDENVKNSTPILIESQRPQPDHAHVSQPMGETHEAPRDHNLADFEPHLGYAAKGRAFCGVPLPNTLGGPQYHPQPQPLHFEVGRVPPTMVEREKFNHMEERLRAIEGGGDHVFADMEELFLVPNMVITSKFKMPDFNKYKRDTCPKNHLKMYYQKMGAYAKDEKL

SEQ ID NO: 210078 - protein, 135 aa, Glycine max
  Coding DNA Sequence Number=SeqID_93300
  Subcellular localization annotation: CTP_CleavageSite=81; ConfidenceScore=5.25e-01
MTLLLSKHSAQRPQCQSPPAKVSVGLCRPDMGIAPTKTPSGPEEVQQGPGVSSSGSACRPQQGHQVPPTNRAFIKKFCVSRQAQGETPQQPGDGRQRATDAPPSPLEFTSAHPQKGLSIAYTTWPTNRRPSPKPK

SEQ ID NO: 210079 - protein, 54 aa, Glycine max
  Coding DNA Sequence Number=SeqID_93301
QEAICLLNCEFPKNKGKGSLEMSEVIKRNFTMLVEISSGLLEDSMSAQEVAEPG

SEQ ID NO: 210080 - protein, 87 aa, Glycine max
  Coding DNA Sequence Number=SeqID_93302
  Gene Ontology: Mol. function=endonuclease activity
  Homolog annotation: Hit_ID=Q1S9P8; Match level="QueryCoverage=89%, HitCoverage=30%, E-value=2e-11, Identity=57%"; Hit description =Endonuclease/exonuclease/phosphatase
MDTTGFKLWYTKKVRGKNGEGVMMDKVWKESVVDEKNWRQNLSLKINGGTRDFQCHQLIKVEAQDRRLISFCSKSICGKADKLQIQG

SEQ ID NO: 210081 - protein, 183 aa, Glycine max
  Coding DNA Sequence Number=SeqID_93303
  Gene Ontology: Mol. function=microtubule motor activity; Cellular component=microtubule associated complex; Biological process =microtubule-based movement
  Homolog annotation: Hit_ID=Q69UI4; Match level="QueryCoverage=95%, HitCoverage=27%, E-value=4e-55, Identity=55%"; Hit description =Kinesin 1-like
  Pfam annotation: Domain name=Kinesin; Domain location=9-182; Score= -20.2; E_value=6.9e-13; Accession=PF00225.13; Description=Kinesin motor domain
MSSITVCARFRPSNSKEKQNGNDSGCIRNIDTETFICKDEKDEEFVFSFDRVFYEKSEQADVYQFLALPIVRDVVVDAFNGTVITYGQTGAGKTYSMEGPGILECEEQNKGLLPRVVEGLFDSINSLDKEKTYSIKLSMVEIYMEKVRDLFDLSKDNIQIKEIKSRGIILPGVTEAYGLMYKY

SEQ ID NO: 210082 - protein, 177 aa, Glycine max
  Coding DNA Sequence Number=SeqID_93304
  Gene Ontology: Mol. function=zinc ion binding
  Homolog annotation: Hit_ID=Q1S821; Match level="QueryCoverage=99%, HitCoverage=53%, E-value=2e-31, Identity=50%"; Hit description=Zinc finger, RING-type
MEKVRMEIDEKRKRQARRFIEAIEVGVMKKLKAKEEEIEKIGKLNWALEEKVKHLCMENQVWRNLAEANEATANALRCNLEQVLAQCGGIAAEEDRGGATVCGGAEMDDAESCCGSTEEDCEGKKVGWRTLAGCAGVKDKDEGGESSNGRVVRADFAVPASVFVYCVWVFTPHLSYM

SEQ ID NO: 210083 - protein, 255 aa, Glycine max
  Coding DNA Sequence Number=SeqID_93305
  Gene Ontology: Mol. function=nucleoside-triphosphatase activity; Biological process=defense response
  Homolog annotation: Hit_ID=Q1SI25; Match level="QueryCoverage=62%, HitCoverage=17%, E-value=3e-47, Identity=60%"; Hit description=NB -ARC domain, putative
MVNTPTSDGDGCLLPGDSYPDWLTFNSEGSSVTFKIPQVKGRNLKKMMCHVHYSSPENITSDGLKNLLVINHSKAIIQLYKRNALVSFEDDEWHGVLSKIEPGNKVQIVVVFWSKLTVYKTTIYLIYEPMNEKIEHSHAPNKNVMDSSGDENECVVGTISLQVESIYKPTNDIMEHCHASNKNAIVSSSDENACVVRPSSPQVESIDDLRLVATINALNLIAKEWILGEGPLVLGSWFLRESNLSLILMPLILIL

SEQ ID NO: 210084 - protein, 124 aa, Glycine max
  Coding DNA Sequence Number=SeqID_93306
MQTIHAPPVDSRVSYDDIHDRWMHYDDHIVLASEPRVIPQAPQTNIHRVPEPGASSTSAEEPRHAVEVCDDIAERLERHLSLGVVTPGSSTHEVIEECLRLTRSVTQDHLVYVRCRRRRHTDQA

SEQ ID NO: 210085 - protein, 324 aa, Glycine max
  Coding DNA Sequence Number=SeqID_93307
  Pfam annotation: Domain name=Transposase_23; Domain location=30-100; Score=0.7; E_value=0.00096; Accession=PF03017.5; Description =TNP1ENSPM transposase
MASFSQMQSQMQSQGLALPLEPLVGNDPETGDSDRCGLYIEANPDRLVTLWRVYEGSTVVHNTPLLPSQVKVGVEEVKDADAPVPVPTDEVSLVRQAIHTFFAWLTHLVKSLSQQAVVSPAKPPQKSDLEVDDPLYLMTLTISDLFLRPYQVTWDATVFGVFNPDLPLYIKHEDLSKITHGGQCLTISVLQLWIFMRAGNSDIYGFLKPQSIQRSGQLQFETESYLKSWMQSAKRDVYLRAYLNGGHWQMVVIVPKEHLVVWFCSLHNRPDNYLKGIINSALKGLHDAPQPKSKAPARWIVVKYFNDARPLEPEGLKVLRIQWA

SEQ ID NO: 210086 - protein, 85 aa, Glycine max
  Coding DNA Sequence Number=SeqID_93308
  Gene Ontology: Mol. function=binding
  Homolog annotation: Hit_ID=Q10L89; Match level="QueryCoverage=89%, HitCoverage=42%, E-value=1e-24, Identity=67%"; Hit description =Tetratricopeptide repeat protein 11, putative, expressed
MDAKFGSLFESIGNFFTGGEQIPWCDRDVIAGCEREVAEAANGDSEERKNESIMRLSWALVHSRQKEDIQRGIAMLEICHSDLLL

SEQ ID NO: 210087 - protein, 61 aa, Glycine max
  Coding DNA Sequence Number=SeqID_93309
  Gene Ontology: Mol. function=binding
MACLGYYTYTSMIAPDWRQALSLKKIVEDRIAKDGVIGIGITATAVGLIVGGIATALARRN

SEQ ID NO: 210088 - protein, 202 aa, Glycine max
  Coding DNA Sequence Number=SeqID_93310
  Gene Ontology: Mol. function=DNA-directed RNA polymerase activity; Biological process=transcription
  Homolog annotation: Hit_ID=Q9LKX4; Match level="QueryCoverage=64%, HitCoverage=58%, E-value=5e-39, Identity=58%"; Hit description=RPB5d
  Pfam annotation: Domain name=RNA_pol_Rpb5_N; Domain location=32-122; Score=92.6; E_value=1.2e-24; Accession=PF03871.5; Description=RNA polymerase Rpb5, N-terminal domain
MAATEIGLLEWVRVGGEEEEAEQAKGCLSKFVDNGSVESHRYYLSRRTTLEMLKDRGYSIPSHEIDLSLSDFRDMHGQFPDPDRLRLSLTHATNSSKRILVIFCGPGVVKVTAIRNIAGQIINRDTLTGLILIVENHITSQALKAVNLFSFKVEIFQRYCVAEFLGSAILTLSAIAATMSVVVAACILLSSLASLQPIELWG

SEQ ID NO: 210089 - protein, 191 aa, Glycine max
  Coding DNA Sequence Number=SeqID_93311
MENVYVVGHEEGGLCAYKDKLLKPLTGSILWIGDVEMNVEENLLEGIPKDVVLNLCKLCDGQMIPLSEEELVSWISPWRIMLVVNVLGKRWNKKCKSGIHGRISEIEWKKKVRQDATIKGGVGTRFLILQKKDNVEPIFGNVYNGSLMLNESGSIMIESKRATVMENKGNVYVCHLEGLNKNVIAHDSSPK

SEQ ID NO: 210090 - protein, 132 aa, Glycine max
  Coding DNA Sequence Number=SeqID_93312
MQMMFFHLQGEHTVYFNKHEDLDEVINKISVPNQCSHSRMVANQVFPKAKNLKYAQFVLNDKDLETKKKRSYHWKLIWVPPSTAPLELVGLGSSSSIDSFASWKMNGSGMEKEEREETPLQGEDESRRRSPP

SEQ ID NO: 210091 - protein, 251 aa, Glycine max
  Coding DNA Sequence Number=SeqID_93313
  Gene Ontology: Mol. function=protein disulfide oxidoreductase activity; Biological process=cell redox homeostasis
  Subcellular localization annotation: CTP_CleavageSite=51; ConfidenceScore=5.82e-01
MGCSASRTITIVANNNNQEDPSPSASLASSSSSFSSSSASHKSINSASSPAAAPVRRRTLSLPMPLVHHPPIKKGDSHHLVSLTSTTYGSLLPIDQKDSNFTQKNQPHITKTSNQTDPEHSLSPDSVINTWELMDGLDEEQEQEQEIANAKKLPYASILDKPSSCRYTAFDGSARKKLLDSFESMKTSQTAMEKDLNSSSSTSPAPTTKKPLWQHLSEEALLAKLDPSVAWSYRRALSSRNLDRNILSRDV

SEQ ID NO: 210092 - protein, 193 aa, Glycine max
  Coding DNA Sequence Number=SeqID_93314
  Homolog annotation: Hit_ID=P53780; Match level="QueryCoverage=43%, HitCoverage=18%, E-value=2e-27, Identity=70%"; Hit description =Cystathionine beta-lyase, chloroplast precursor
  Pfam annotation: Domain name=Cys_Met_Meta_PP; Domain location=92-193; Score=-261.3; E_value=0.00056; Accession=PF01053.10; Description =CysMet metabolism PLP-dependent enzyme
  Subcellular localization annotation: CTP_CleavageSite=33; ConfidenceScore=5.07e-01
MFSSAISPKPFLRSLVIDRYAQSTTTATRCECLGFNKSENFSTKRELCAEGFKLNCLVENREMDVESSSSSSLVDDASLSLSEEDLGEPSISTLVMNFESKFDPFGAISTPLYQTATFKQPSAIENGPYDYTRSGNPTRDALESLLAKLDKADRALCFTSGMAALSAVVRLVGTGTFSFFSVKNSDPSSLLII

SEQ ID NO: 210093 - protein, 313 aa, Glycine max
  Coding DNA Sequence Number=SeqID_93315
  Homolog annotation: Hit_ID=Q60CZ4; Match level="QueryCoverage=83%, HitCoverage=67%, E-value=8e-18, Identity=31%"; Hit description =Uncharacterized plant-specific domain TIGR01589 family protein
MCRPLGFRESVRQQKRRSREMGMGFQNLKDVSSKLEMCNPDWDNVARLKVWQKLEEENEEFFKAYYARLVLKQQIMQFNKLLDQQVQLMQLHSSAVASLPMSNGSHIPAVTSLPNSNGSHIPAIPENPACYTSDRTQTSLKPENMQHAVDSRLSNVFNNGGSSLHTSMPAAVDMSVHGNRINGPASVLSAQSANMGLIQGMNGGGMIKSEPGYSGCSPYMFSTEGNVLETRPTIGGASVTSFTNVESNSHSLNEAVLDPDTSSFGFLGQIPRNFSLSDLTADFSQSSDILETYSRSPFLATDNENFLDRGEQG

SEQ ID NO: 210094 - protein, 65 aa, Glycine max
  Coding DNA Sequence Number=SeqID_93316
MALDAALWIVKMTWIALSGWISSCLTVADEFASSLRSGDIGPFHRVVLGVGGECVCCEIDWISLN

SEQ ID NO: 210095 - protein, 150 aa, Glycine max
  Coding DNA Sequence Number=SeqID_93317
  Gene Ontology: Mol. function=RNA-directed DNA polymerase activity; Cellular component=chromatin; Biological process=RNA-dependent DNA replication
SNNGVCFEDMDALFVWSKFDVFNDHKNLKYPFDQKKLNVNVVVDTRGRKVIHMSGLMVKALELVEKFRDLNVVLDCDCVRCGMLKVTNIFLNMVKKKQLLDLELCKKKLLRIDKAVEFRLGDDDVLKFKGCVCTPRDQEIKKLLLEEIHK

SEQ ID NO: 210096 - protein, 63 aa, Glycine max
  Coding DNA Sequence Number=SeqID_93318
MDMETGGWWKRVDEDGFCLLHPHIQLLTFSPLSPNGMMNPRHVPQVRISLPCLQGEEVEEHCA

SEQ ID NO: 210097 - protein, 212 aa, Glycine max
  Coding DNA Sequence Number=SeqID_93319
  Gene Ontology: Mol. function=double-stranded RNA binding; Cellular component=intracellular
  Homolog annotation: Hit_ID=Q8GUP8; Match level="QueryCoverage=71%, HitCoverage=55%, E-value=4e-16, Identity=32%"; Hit description=DsRNA- binding protein
  Pfam annotation: Domain name=dsrm; Domain location=2-66; Score=24.1; E_value=0.00049; Accession=PF00035.15; Description=Double-stranded RNA binding motif
  Pfam annotation: Domain name=dsrm; Domain location=85-151; Score =35.4; E_value=1.9e-07; Accession=PF00035.15; Description=Double -stranded RNA binding motif
  Pfam module annotation: Pfam domain module=dsrm::dsrm; Domain location=2-66::85-151
MYKTRLQDFTSKSGIQFPVYHTINEGHIPKFRSTVWVAEMRYTSPSTFSQKKVVEQDVARLALEGILHRTRDEGLSLVDQISPIFKSIMNEYAHKLHVEQPTYNNDKQLLGGVLPAFITSLVFNGTSYTGGPAGTKKDVEQSAAKAAILSIMSILSCMLYYIFPVDFRWQCAYLLNDYLIQGRRKGMLDYPVSQDADENIQDYLSGLWENVF

SEQ ID NO: 210098 - protein, 63 aa, Glycine max
  Coding DNA Sequence Number=SeqID_93320
MRVRLASFFTGAAAASFLGLYTLHKDYKVPHQSFTQQMCIFRLLIDGVRTVQREADCISRSCF

SEQ ID NO: 210099 - protein, 89 aa, Glycine max
  Coding DNA Sequence Number=SeqID_93321
MYVADGCRSAPPDNYATDINYSRKEEGTKRKRKRNRFVSILSHFESVAATVDQIEFHMNALSGCDLGLSLLPQIRIPCFTCSHVVLVKP

SEQ ID NO: 210100 - protein, 281 aa, Glycine max
  Coding DNA Sequence Number=SeqID_93322
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=17%, E-value=6e-73, Identity=50%"; Hit description=Chromo
  Pfam annotation: Domain name=Chromo; Domain location=166-220; Score =21.0; E_value=0.0032; Accession=PF00385.14; Description='chromo' (CHRromatin Organisation MOdifier
NKCLEMFLRYFTFHNPKAWYKALNWAEFWYNTSFHTSIGMTPFKALYGRDPPALTRYNPQASDPVTLQEQLIIRDRTLQQLKQHLEKAQVYMKNQADKKRTDVSFTIGDLVIVKLQPYKQHSVTLRRNQKLGMIYFGPFPVVAKIGIPQEKCMPLPLTTTDTGPVIAPIDILQTRSIKKGSNFIPQVLVQWDNTTPLEVAWEDVNEMLDNFPNFNLEDKVAINGDGITMKKNRKGAFSAKSAKGDPHGDKGNNVVSSGPKMMGQRKGMRNRMTSTKQTPLY

SEQ ID NO: 210101 - protein, 58 aa, Glycine max
  Coding DNA Sequence Number=SeqID_93323
AVAAAAQQLWYVKFLLVDKLHKIEQIVAHHASNLASETVVSHLWVVATHGLPEPYYYP

SEQ ID NO: 210102 - protein, 270 aa, Glycine max
  Coding DNA Sequence Number=SeqID_93324
  Gene Ontology: Mol. function=protein dimerization activity; Biological process=regulation of transcription, DNA-dependent
  Homolog annotation: Hit_ID=Q1SR56; Match level="QueryCoverage=63%, HitCoverage=77%, E-value=7e-38, Identity=50%"; Hit description=HAT dimerisation
  Pfam annotation: Domain name=hATC; Domain location=159-245; Score =84.2; E_value=3.9e-22; Accession=PF05699.5; Description=hAT family dimerisation domain
MYSYIHRINVADAIFKCLKTWEIEEKVFSVSVANASYNDSCLKNLKENLSLSTKLVMNEDLIHVRCRAHILNLLVRDELVSIQLLICILQKFGGSSNDLQQLYDEYVALSNEESSSNERNVGGINSLTVHVPNTSAMTRFDQLMSLMHEKEIIPPMKSELDAYLEKKNTYIPNNGNSSFIALEWWRNNNFKYKILSKMARDTLVVPVSIVASESTFRAGGRVIDEYRSRLNEESIEALICGGDWICYNYNLKRKTKVDDQPLEEITLKIS

SEQ ID NO: 210103 - protein, 228 aa, Glycine max
  Coding DNA Sequence Number=SeqID_93325
  Gene Ontology: Mol. function=RNA-directed DNA polymerase activity; Biological process=RNA-dependent DNA replication
  Homolog annotation: Hit_ID=Q1T251; Match level="QueryCoverage=75%, HitCoverage=65%, E-value=7e-17, Identity=29%"; Hit description =Multicopper oxidase, copper-binding site
MWSWHFSWRWSWFQWEMRIVQQLKEALEGWEPKVGKEDSWLWKNNDVKTFMVKEVYASLITYGLEDVKGLLWRVRHNRIQTKDNLRIRNVLQDGTSLNCVFCNLSMESAKHLLFECCFSHEHWQRCYVWLGKIKVSHAECKEHYSQHFRILRGAKARRVWGVMCVAVIWLLWNRRNYIIFNEARLDAEKALDSIKYQAWSWCNAYVKDFKLSLYIRHLDLPNCHMQIR

SEQ ID NO: 210104 - protein, 112 aa, Glycine max
  Coding DNA Sequence Number=SeqID_93326
MTVVIGGGGGDNNDILNNNDSGGGDDNDTNDGYVDGGGDNDSTNMIFTIAATTTRDHVGGDDNNQVVMVEITVTTVMMVVAIDDGCSGTHDSCDKNSHDSSDDYDGDKFEIF

SEQ ID NO: 210105 - protein, 93 aa, Glycine max
  Coding DNA Sequence Number=SeqID_93327
MERFSGQDPDNDILVWDSLGILYSMDETPKLVGESKSTKATKMGKIKGKSLEEELKELDSSLSAQSRLTGKFKLRHAISLNAQSRLNVKKTHK

SEQ ID NO: 210106 - protein, 72 aa, Glycine max
  Coding DNA Sequence Number=SeqID_93328
MVAAVEVVAAHLRLAAAGPINGRPDKLGGSNRQPIKLAEARDQGWKSQCPVGLLRVHWVSGRRDPCKLIDDI

SEQ ID NO: 210107 - protein, 96 aa, Glycine max
  Coding DNA Sequence Number=SeqID_93329
MYFFVSQAEFDIPEAFDLRKKKKILQTIDHTEGEDDKVREKYDISKEKWNWFCQSYIDPSWEYFTDPRPLEAERMKAICIQWARYYLKFKNETLSV

SEQ ID NO: 210108 - protein, 67 aa, Glycine max
  Coding DNA Sequence Number=SeqID_93330
  Subcellular localization annotation: CTP_CleavageSite=23; ConfidenceScore=5.02e-01
MGEVVSLFLNSSNAYLQGYSSTKSMSFWRSLDNGRESQPTLRREGDTRAHGCVFQGRKARGVATNVG

SEQ ID NO: 210109 - protein, 98 aa, Glycine max
  Coding DNA Sequence Number=SeqID_93331
PCCKIENSILELTDPTELESQFVSITADHDRSMLGSSEPIELESQSVSVIGDHDPLLRIPLTPTKRVSSDELDNERKNFQISLAEVSSNKLAKHSQPE

SEQ ID NO: 210110 - protein, 120 aa, Glycine max
  Coding DNA Sequence Number=SeqID_93332
  Gene Ontology: Mol. function=strictosidine synthase activity; Biological process=biosynthetic process
  Homolog annotation: Hit_ID=O81484; Match level="QueryCoverage=46%, HitCoverage=14%, E-value=7e-12, Identity=51%"; Hit description =Putative strictosidine synthase
MRRQQLHFAAVVAAIVVTAWVAHMRGGVGQSEAKGWQFEAVPIDGAVGPESFSFDPRGEGPYTGVSDGRIIKWHQTQNRWLNFSAIASSSHWCAFSLFLSLHFKNWKPTGEVDCLPYLNL

SEQ ID NO: 210111 - protein, 155 aa, Glycine max
  Coding DNA Sequence Number=SeqID_93333
  Homolog annotation: Hit_ID=UPI0000E44EB7; Match level="QueryCoverage =26%, HitCoverage=30%, E-value=1e-13, Identity=83%"; Hit description =Hha protein
  Pfam annotation: Domain name=HHA; Domain location=66-111; Score=71.5; E_value=2.7e-18; Accession=PF05321.2; Description=Haemolysin expression modulating protein
MEGKKMDEYSPKRHDIAQLKFLCENLFDEIMESIPRIFNGGNVQQNAYLICLPKSALISSNPAIPFSIRVRPNKYELPDDELAVFYSAADHRLAELTMNKLYDKVPGSVWKQAKECRYGAVPHCAQGFCMGRNGGGPASYIPAHASPAAAASFRT

SEQ ID NO: 210112 - protein, 290 aa, Glycine max
  Coding DNA Sequence Number=SeqID_93334
  Gene Ontology: Mol. function=strictosidine synthase activity; Cellular component=integral to membrane; Biological process =biosynthetic process
  Homolog annotation: Hit_ID=O81484; Match level="QueryCoverage=93%, HitCoverage=73%, E-value=5e-77, Identity=53%"; Hit description =Putative strictosidine synthase
  Pfam annotation: Domain name=SGL; Domain location=3-223; Score= -104.6; E_value=0.011; Accession=PF08450.2; Description=SMP -30GluconolaconaseLRE-like region
  Pfam annotation: Domain name=Str_synth; Domain location=68-156; Score= 139.8; E_value=7.5e-39; Accession=PF03088.7; Description =Strictosidine synthase
  Pfam module annotation: Pfam domain module=SGL::Str_synth; Domain location=3-223::68-156
DEECGGPCDEHSKKEHVCGRPLGLCFSTLSNDLYIADSYKGLVVVGPHGGTTRRLVSTIEGEPLAFTNGLDVDQRTGAVYFTSSSSKYPRRNYMSLILSRDKTGMLMKYEPQSEQVSVLLKNLSYANGVALSKDGEYILIIETTTCRVLRYWLETPKTGTLEVFADLPGFPDNIKRSPRGGFWVGIYSRREKIIQWILSYPWIGKVLLRLPLDIPKAYSYLAKLKRSNGMAIRLSEQGDILEIVNEKNGSIGRSISEVEERDGILWVGSIDAPFVVKRKWMRALAIILYM

SEQ ID NO: 210113 - protein, 76 aa, Glycine max
  Coding DNA Sequence Number=SeqID_93335
MDLEGKGRGICFGTIINFGTNICWLWKRFATPQAPPRKVQNCYSSQVAQDHTSSSDDLSNQDYRCWSKDYIVVVEV

SEQ ID NO: 210114 - protein, 156 aa, Glycine max
  Coding DNA Sequence Number=SeqID_93336
MAELYLVPDVVIPPKFKVPNFDRYKGTTCPKNHLKVYYRKIRAYANDEKLLMHFFQESLTGAAVTCDFVNKYCFIVKVVSRIFPLDLMMKFVQFQWAKHASTTKHRFSVLSATEESGRASISRSHAKHEISALSAIVVFSQTQRTTGAKLKSTYSR

SEQ ID NO: 210115 - protein, 130 aa, Glycine max
  Coding DNA Sequence Number=SeqID_93337
RKYWHITKPALEPVSDFVELEGINEETEDDKEEETPIKEKEKERIKEEEKEKEKKLKNEKQKEKVVDDEMRKGKSEANIDKKKDTTPNEGKEVPYPLVPSWKEKERHLARFLDIFKKLEITLPFGETLQQ

SEQ ID NO: 210116 - protein, 133 aa, Glycine max
  Coding DNA Sequence Number=SeqID_93338
  Gene Ontology: Mol. function=phosphoglycolate phosphatase activity; Biological process=metabolic process
  Homolog annotation: Hit_ID=Q1T1G8; Match level="QueryCoverage=68%, HitCoverage=35%, E-value=3e-35, Identity=79%"; Hit description =Haloacid dehalogenase/epoxide hydrolase
MATIAARILGSNSRPAVALRRLRWPAYSSASAVVAEPETTEVKDYADYRRSLYGQITHKALLVDAVGTLVLPSQPMAQIYRKIGEKYGVEYSEDEILFRYRRAYGQPWGKSRLRTCIVRICLCQKQSLIFVGL

SEQ ID NO: 210117 - protein, 107 aa, Glycine max
  Coding DNA Sequence Number=SeqID_93339
  Gene Ontology: Mol. function=structural constituent of ribosome; Cellular component=ribonucleoprotein complex; Biological process =translation
  Homolog annotation: Hit_ID=Q85FI6; Match level="QueryCoverage=68%, HitCoverage=78%, E-value=4e-20, Identity=66%"; Hit description =Chloroplast 50S ribosomal protein L14
  Pfam annotation: Domain name=Ribosomal_L14; Domain location=25-106; Score=26.0; E_value=3.9e-07; Accession=PF00238.10; Description =Ribosomal protein L14pL23e
  Pfam annotation: Domain name=Ribosomal_L16; Domain location=1-76; Score=-36.3; E_value=0.0067; Accession=PF00252.8; Description =Ribosomal protein L16
  Pfam module annotation: Pfam domain module=Ribosomal_L14::Ribosomal _L16; Domain location=25-106::1-76
MSRNVRRGGQIWVRIFPDKPVTVRPTETRMGSGKADNSGARELMCIRILGASNRRYAYIGDIVVAVIKQAVPNTNLERSEVIRAVILSLIKKEIQKELESFVQSPGN

SEQ ID NO: 210118 - protein, 296 aa, Glycine max
  Coding DNA Sequence Number=SeqID_93340
  Gene Ontology: Mol. function=transcription regulator activity; Cellular component=nucleus; Biological process=regulation of transcription
  Homolog annotation: Hit_ID=Q1T1G4; Match level="QueryCoverage=72%, HitCoverage=84%, E-value=4e-58, Identity=60%"; Hit description=Helix- loop-helix DNA-binding
  Pfam annotation: Domain name=HLH; Domain location=62-114; Score=51.1; E_value=3.7e-12; Accession=PF00010.16; Description=Helix-loop-helix DNA-binding domain
MVALFSPPVFSTKGWLLEEDPLSYDVSSEYSFPYQFYSPQTQIELEIERSTSPSPEDPAMVKKLSHNASERDRRKKVNHLVSSLRSLLPVADQTKKMSIPTTVSRVIKYIPELQQQVEALSKKKEDLLCRISRQLQGDAVNKDSQRRISHHNSDFVVSTSRLNDCEAVVHISSYEAHKAPLSEILQCLENNGLLLLNASSSETFGGRVFYNLHFQELKKECCINIIVFTTHMILVTKDILSNNLRNINNWLLNFGAPASTATTFLIFAMLCEQRQWSCSPMSRCTMGISDINRSLM

SEQ ID NO: 210119 - protein, 37 aa, Glycine max
  Coding DNA Sequence Number=SeqID_93341
MAKLTLNAGVPTKPARKFKTYEPMLTTAVCSTLISSC

SEQ ID NO: 210120 - protein, 747 aa, Glycine max
  Coding DNA Sequence Number=SeqID_93342
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=96%, HitCoverage=97%, E-value=0.0, Identity=60%"; Hit description =Putative endo-1,4-beta-xylanase
  Pfam annotation: Domain name=CBM_4_9; Domain location=203-361; Score =88.8; E_value=1.7e-23; Accession=PF02018.8; Description=Carbohydrate binding domain
  Pfam annotation: Domain name=CBM_4_9; Domain location=32-185; Score =74.4; E_value=3.7e-19; Accession=PF02018.8; Description=Carbohydrate binding domain
  Pfam annotation: Domain name=Glyco_hydro_10; Domain location=400-691; Score=236.6; E_value=5.3e-68; Accession=PF00331.11; Description =Glycosyl hydrolase family 10
  Pfam module annotation: Pfam domain module=CBM_4_9::CBM_4_9::Glyco _hydro_10; Domain location=203-361::32-185::400-691
MGGCGPLASQAESPTFTPTKTTSKGCVSSEDESIIINPQFDDGLNNWSGRGCKIALHDSMGDGKILPKTGKVFASATERTQSWNGIQQEITGRVQRKLAYEVTAVVRIFGNNVTTSDVRATLYVQAPDLREQYIGIANVQATDKDWVQMQGKFLLNGSPSKVVVYLEGPAPGTDILVNTFVIKHADKTPPSTPPDCEGAAFGVNIIENSNLANGTNGWFPLGNCTLSVGTGSPRIIPPMARDSLGPHESLSGRYVLVTNRTQTWMGPAQMITEKLKLFLTYQVSAWVRIGNGSSGPQNVNVALSVDNQWVNGGQVEVADDRWHEIGGSFRIEKQPSKVMVYIQGPASGVDLMLAGLQIFAVDRHARFKYLRRQTDKIRKREIILKFSGLDSIGNLGTLVRVKQVQNDFPIGSCISRSNIDNEDFVDFFVKHFNWAVFGNELKWYWTEPQQGNLNYKDADEMLDLCQKNKIDTRGHCIFWDVDNTVQQWIKSLNKTDLMTAVQNRLNGLLTRYKGKFKHYDVNNEMLHGSFYQDRLGKDIRANMFKTAHQIDPSATLFVNDYHVEDGCDTRSSPEKYIQHILDLKEQGAPVSGIGIQGHIDSPVGPIVCSALDKMGTLGIPIWFTELDVSSTNEYVRADDLEVMLRESLAHPAIDGVMLWGFWELFMSRENSHLVNAEGELNEAGKRYLALKQEWLSHSHGYVDEQGQFSFRGFSGTYNVEVVTLAKKVTKTFVVDKGDSSLVVSIDL

SEQ ID NO: 210121 - protein, 49 aa, Glycine max
  Coding DNA Sequence Number=SeqID_93343
MDGGNGRKVTRVGRWSAAWNNAIMPSRVSINNHNPHRKGFFTKQYPYLG

SEQ ID NO: 210122 - protein, 59 aa, Glycine max
  Coding DNA Sequence Number=SeqID_93344
MHLNVHATFDKPQATITEDESPNEGTVADIELPRIGKEMKEQGLQEERFVLNFEGYLNV

SEQ ID NO: 210123 - protein, 89 aa, Glycine max
  Coding DNA Sequence Number=SeqID_93345
  Subcellular localization annotation: CTP_CleavageSite=37; ConfidenceScore=5.02e-01
MLGSVEGEKAKKKRTTKMKTGTKRSNKGGGGRGGNTKGSNKMDKVRRAKINTERREKESRKEEEGMKRGDGEEEGFYWYRKGQGSVVKS

SEQ ID NO: 210124 - protein, 82 aa, Glycine max
  Coding DNA Sequence Number=SeqID_93346
MREFTERENAETKYPKSSNCECNCCYTHLSSFRHSRLADRCAKRARETFGWLSARIRLLSERSMCLADKDSLSAHIAARNSA

SEQ ID NO: 210125 - protein, 103 aa, Glycine max
  Coding DNA Sequence Number=SeqID_93347
  Subcellular localization annotation: CTP_CleavageSite=27; ConfidenceScore=5.21e-01
MNTHPLAESLSPGNFDKFFVDSRALSRAFLSQAVFVAAFVELSEPRLLISQYLVKFLNCMVVATYPSTGGRRGARGCVFQERSTRGIATNVYLRKTSEKPEKT

SEQ ID NO: 210126 - protein, 258 aa, Glycine max
  Coding DNA Sequence Number=SeqID_93348
MARKKLSAKRSRKDATGEGSNEHAINQFLGHPLVLEEGQHCEFSQRRSQAFDFDEEAISHWLCVLRQNFARSVTGRRVSVHVAQLISDSIYQFAGITPLRHPVNSKKSNRALGFPALITRLCQFYGVVITPTKLIWPPISRDFIEKYCIPRQVQGQEPKQPVADVPSSPLEEVPSLRSISDHLWRIELQMHRYMQHVTSQQVANHKGQVQLNEKFYRYNMHQQNETDFETWVGLVGAPRDDGEAQEDDDMADVLDFFT

SEQ ID NO: 210127 - protein, 54 aa, Glycine max
  Coding DNA Sequence Number=SeqID_93349
MSRKNLDSNINVDNVIRGTKQALGVCRMIVDPVEVEYPFLKSWSYIEHFFRKNA

SEQ ID NO: 210128 - protein, 43 aa, Glycine max
  Coding DNA Sequence Number=SeqID_93350
MVLGSNILDWNRMTVLQKGPMQSTRVPMYSEAKGSFHKMLQSR

SEQ ID NO: 210129 - protein, 250 aa, Glycine max
  Coding DNA Sequence Number=SeqID_93351
  Gene Ontology: Mol. function=chromatin binding; Cellular component =chromatin; Biological process=chromatin assembly or disassembly
  Homolog annotation: Hit_ID=Q1SAV4; Match level="QueryCoverage=80%, HitCoverage=50%, E-value=2e-42, Identity=42%"; Hit description =Integrase, catalytic region
MHKRPFSWGKFLNYVEWSYNTSKHSGLGLTPYEVTFGKKPPTIMQYVVGNSNVEAVDDFLTSQEVVFLELRKKLLKAQEHMKKCANNNCREVKFENGDWVMVRLRPQRQTSIIGSSAAYDKLVKRYYGPYQVMTRIGGATYKLQLPVEAQIHPIFHCSLLKPFYSMDNTFTSLPLPAKTTENQLTITTIVILSTRWDSIETESRMKEEGLIEGRNRSGKVQKENSSTNALQGLRVVDNIKCLAGLKSCLP

SEQ ID NO: 210130 - protein, 79 aa, Glycine max
  Coding DNA Sequence Number=SeqID_93352
MEQSPPSPSFRTKVVGLGLVWSWIAGCTVADNRQRLTGLGHRHRSSRAGLKRERGLRNSTCNYANGLEDQQHPQDQGKN

SEQ ID NO: 210131 - protein, 338 aa, Glycine max
  Coding DNA Sequence Number=SeqID_93353
  Gene Ontology: Mol. function=transition metal ion binding; Cellular component=nucleus; Biological process=regulation of transcription
  Pfam annotation: Domain name=Transposase_21; Domain location=130-265; Score=64.3; E_value=4.3e-20; Accession=PF02992.5; Description =Transposase family tnp2
MQRGSQSQPFDVEIGDCLEDMICDLGQESFQQTYAPIYTLQSDSKKPLHSGCNKSLMLLSVVLSLVNVKARYEWSDKSFSSLLQKIHACSNDCILYKHEFEEIHKCPRCGVSRYKVKDDDECNSDKNSKKDPQQRCCGIFRSFQVEEVDHLYPDFGKEAINLRLELATNGMNPYVSLSTQHSSWPILLVIYNLPPWLCMKRKYMMLSMMISGPRQPGNDIDVYRSPLNEDLEKLWDEGFSCLMEHENARIPLTGQQVLKQIEDMNTIFGKNQKKGKKVKLEYGRKDMMQAPLELVGLGSSSSMDSFASWKMNGSGMEKEEREETPLQGEDESRRSSPP

SEQ ID NO: 210132 - protein, 343 aa, Glycine max
  Coding DNA Sequence Number=SeqID_93354
  Gene Ontology: Mol. function=RNA-directed DNA polymerase activity; Cellular component=chromatin; Biological process=chromatin assembly or disassembly
  Subcellular localization annotation: CTP_CleavageSite=52; ConfidenceScore=5.10e-01
MANKGQLTSWVIFLNTLQSRFTPSQYDDPTRALVTLTQRGTINSYLSKFEMLANQIAGLPPPFLLSCFIFGFTLKIHREVQALQSLTLAQVVGLAKLQEEKFLDLHRSLHGRSLLFYSSPPPATSSNPTSLPLLLPSPPKPPPPLPVKRLTLEIASRQEQGLCFNCNEKFCRGHQCASKIFLLIVDEEHDSALDTPFLDSTIKHMANVVLGMQWFQSLGPVLTNYKALTMKFIREGHTVELKGDTNSSLHAITPFQLRCLIITDAVGDFFHLQIVPKELPLTQTTSPTFPPEILSLITKFDTLFQTFTLLPPSRPTNYNIYLIPSVDPSVSVLTGIPISKNKK

SEQ ID NO: 210133 - protein, 224 aa, Glycine max
  Coding DNA Sequence Number=SeqID_93355
  Homolog annotation: Hit_ID=Q8LQQ4; Match level="QueryCoverage=26%, HitCoverage=14%, E-value=8e-07, Identity=46%"; Hit description=DNA cross-link repair 1B-like protein
MTRRKIIDKIGVGVVKVNNVNNGNVSERVAKHVPRLGCSLVHGIPPELPGVEDATEVWVQERFWVGKVVAEQGLGHMRRRNYTGVRRWAYAIAVVDLLTLITKLPLPYILRRFFLTTLECATPPLQKKLTELQGAIPGSEGMDMHTLFQSIEQFILQLEAKVTILRVKIRLTPLDARAAMSRATIRCGAPSQLRMVNLPDEGTTERMRKDTTTEVTKGGNVVNG

SEQ ID NO: 210134 - protein, 92 aa, Glycine max
  Coding DNA Sequence Number=SeqID_93356
MPVLPWRRQQESAQGGQIHQITESQASGEGHGKWKKAMVKLSSVTESVIGHDNESTKLLGAKTRMANTTRNKHRVTSIRALVLPPESKRDRK

SEQ ID NO: 210135 - protein, 211 aa, Glycine max
  Coding DNA Sequence Number=SeqID_93357
DGVPFEGTIDEDWKFDFSSHDARRLVCTNQANMTGRLLVGSLAFECRIMHYLIVRILLPRSSNLAQALRSNTPLPYPHLIILFLHHFNVPLDSEPFVQVKISFSIGAGAVSSFGYRKKRDGSWVKKDAQPQAADDRSPSPPPQMDDSSSLMQNILDKLDGLHTFAGERFDSLDSCIDAIDARFARMDTRITQLEEDVSFSHQCFDLPPLPS

SEQ ID NO: 210136 - protein, 65 aa, Glycine max
  Coding DNA Sequence Number=SeqID_93358
MKKMNEGLDCEGGGGGGDGDDDGGVVGGDGNDTYISWRVVAYEEECGCDYGDAGGFDDRGEERVE

SEQ ID NO: 210137 - protein, 214 aa, Glycine max
  Coding DNA Sequence Number=SeqID_93359
MGSRSREVVGSGQGKKGVEKSGLGSSGSEVVLSAMNKRTRPLQRWVSGWCCGLVLEEGDWPDAGDSSHTTYLLGVWRGPLLAAGRLVEEPILLGGFSEGANRDSNACKKPDQEVMNPLWNIHCYQLRAAPSSDYDWALVGGSDRESNTLCRKVQSTIGEVAWSAMAAAAGRTSVRAEVVSVDACSLEAVVRSRSLACTHVLWLSFWTFLDWTLD

SEQ ID NO: 210138 - protein, 141 aa, Glycine max
  Coding DNA Sequence Number=SeqID_93360
  Pfam annotation: Domain name=AT_hook; Domain location=33-45; Score =14.9; E_value=0.061; Accession=PF02178.9; Description=AT hook motif
MVENRLRWFGHVERRPVDSVVRRVDQMERRQTIRGRGRPKKTIREVIKKDLELNDLDRSLAMAVSNLLVGQLESLRLLAKWSKLAALKLDTLMGVIIRFSMWKRTQNSSQDKCIPESREIHDIFVGILKTGEHTHLVFFLP

SEQ ID NO: 210139 - protein, 159 aa, Glycine max
  Coding DNA Sequence Number=SeqID_93361
  Gene Ontology: Mol. function=RNA-directed DNA polymerase activity; Cellular component=chromatin; Biological process=RNA-dependent DNA replication
MESAGCSWLPEKWRAYCISRTTLRDIRSALDGPKRSLLNVGFMHGDLVESLSEDWGGIWTRTLLDKACGEEFRDFFSLFQTFESVGSDMAVLQLGEQGFNYGNRVDLRSRTEPLPTNTWRGEVEELSDARLKEVVGAAAIDEDSEASMVNDVEEEKDFR

SEQ ID NO: 210140 - protein, 269 aa, Glycine max
  Coding DNA Sequence Number=SeqID_93362
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=66%, E-value=4e-74, Identity=52%"; Hit description =Integrase, catalytic region
  Pfam annotation: Domain name=Chromo; Domain location=210-259; Score =10.7; E_value=0.053; Accession=PF00385.14; Description='chromo' (CHRromatin Organisation MOdifier
MSIAYHPQTDGQTEVMNRILEQYLRSFVHSQPANWFRYLTLAEWSYNTSLHSGSGFTPFEIIYSKLLLAIPQYLQGTSTNEDVDSLISSHQAIQEALQRRLSKAQAAMKKQADTKREDVTFNVGQWVYVKLCPFRQHSVGELVHPKLSKRFFGPFQVIDCEGQVAYHLRLPDNARIHPIFHCSLLHAHHGPLLSPSDAWPLQIIKQKPVPRPLCFLDSKLNNYMSPPTCLVLTQWLGQPPEDTTWEPWQELRDTYYLEDKVVFEDWRYC

SEQ ID NO: 210141 - protein, 293 aa, Glycine max
  Coding DNA Sequence Number=SeqID_93363
  Homolog annotation: Hit_ID=Q9LKA4; Match level="QueryCoverage=46%, HitCoverage=42%, E-value=9e-26, Identity=43%"; Hit description =Similarity to RNA-binding protein
MKELESPLNMQDVPCAHSRSACNTRLARKRPMKHTLSAKAYAKLEVRADSLLLSPVLEIENHIESLSLGSLLLELRAESSFLNRYIGSNLTTLDSSFAHASTSRSNYRHLKHQSQSDIPLKPPIPHQQTKLHIPHPISTVHSKSNAPQSTSGEVHDFFNFAVHGEVYKKLVHVVVWWHVGGVDLTDSQVSEAIVEALDELIEGEKRTIDVAKGDEAIALGLVDGLVRMTTTSLRLLKAVDEELTLGDIGVRNNMHDEKDVWVVCQHVLEDLKELVAGEALNELVGFGGRDLEG

SEQ ID NO: 210142 - protein, 117 aa, Glycine max
  Coding DNA Sequence Number=SeqID_93364
MFGTGYSVRPRGRTGCLSVPETKATRKGQNSHFLEVSDPKQATHQGKLQLAHSSPIQMTFSLNSHVGGEFKGFRKRKQRKKHRRKRRREVKLRRYRIVIVDHFLCHFSCYSCALRND

SEQ ID NO: 210143 - protein, 114 aa, Glycine max
  Coding DNA Sequence Number=SeqID_93365
MVDVPAIIIPEPPINDIPQSSDNLNHSISESDKAHQLCNQYAYDIGEIESSTEEDRTKIIQAREGFQKAKENLMLIQGPIMRLKNLNMIGSRKRKIFWPNLNQSKTNSKLFERS

SEQ ID NO: 210144 - protein, 38 aa, Glycine max
  Coding DNA Sequence Number=SeqID_93366
MDVVLTLGREDTNSVDETKMTEDTIVTEEAPEKLGGCS

SEQ ID NO: 210145 - protein, 417 aa, Glycine max
  Coding DNA Sequence Number=SeqID_93367
MTLWFPLVSCKLLICLCNIFPFIAGFDSRDRRKSKYLSYPYIGPKQKDLPAETDDLKTPCPSQKAGASSVTTNPLNGSSSYAKLGSKRFRNSWYKKFISCNTMSSHNKFMNSSAEELLSGLYSTAVDCMFPVGNKSFDLVERFFCRYRVSNYHDEAELATSQVNAKEEKLGKSVCNDLLDTKSKKRKNNKIENAVRRKRKSLSGLSDVNVSTSNSDSQKPGRKLKQKRKVEEVTSVHQPQNVEINLIGNSSKYSSTPQASQNLCCLASEGKAVHKQREKIEAQEHQSAQINSEYADAKRLNCSSLVIDLQFTSPPIPVDIPERNRSQNKEELVLLASNLESHVSQEGHVGSITDHSLLVSTKAEVGTVMVNKTWLKNSMGKATRVHLNTKPAVGVPLNSMGKAAGVHLNTKLAVEKK

SEQ ID NO: 210146 - protein, 285 aa, Glycine max
  Coding DNA Sequence Number=SeqID_93368
  Homolog annotation: Hit_ID=Q47522; Match level="QueryCoverage=17%, HitCoverage=62%, E-value=1e-21, Identity=94%"; Hit description=LacZ protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIGRRGRAVQRQHRLRAAGPRPAHARPVARRLARVPGGLRPAVRLLRDQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 210147 - protein, 50 aa, Glycine max
  Coding DNA Sequence Number=SeqID_93369
AYQEARHPLINEFLHEQLLAENEVLVNEFLHDHCSHPGTNTKHRCLASLA

SEQ ID NO: 210148 - protein, 163 aa, Glycine max
  Coding DNA Sequence Number=SeqID_93370
  Gene Ontology: Mol. function=transition metal ion binding; Cellular component=cytoplasm; Biological process=proteolysis
MGDRLEDMIRDLGQEFFQQAHAPMYDTLQTDSKKNLYPRCNNSLTLLSAVLSLVNVKARYGWSDKSFSTLLQVVHDMLPNGNTLSKSYYQAKKLLCLMGMEYQKIHVFPNDYILYRHEFEEIHKCPRCGVSWYKVKDDDECSSDENSGKGPPAKVLWYLPIIP

SEQ ID NO: 210149 - protein, 65 aa, Glycine max
  Coding DNA Sequence Number=SeqID_93371
MLDALKQREQQFGGLRAFVMKEKEEELALFLVMKKREKEHNDLLLNSSEEFYAPLGFASLQCLVY

SEQ ID NO: 210150 - protein, 656 aa, Glycine max
  Coding DNA Sequence Number=SeqID_93372
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=100%, HitCoverage=91%, E-value=1e-130, Identity=44%"; Hit description =Putative SCARECROW gene regulator
  Pfam annotation: Domain name=GRAS; Domain location=326-634; Score =456.1; E_value=4.5e-134; Accession=PF03514.5; Description=GRAS family transcription factor
MDPNFIISGNDFDESKQWDLNGHYTNLLNDPLSDVGPLGFSHNSILNSEPFVSSSASAAAASSSTATVADPSPEEDTDFSETFKFISQILLEENFEQKPCMCYDPLTLQHTEKSFYEALELEPSLLLSPNQHPLESPDGNSSNSTTDSANSHDLKPSSPNTPASDALHSSSHAPSLVVPPHALTKINDGTVDLDSSVTKLLAENIFSDADSMLQFKRGLEEASKFLPQGPQLFTGLESPTVSSEPKGRGVALKMENSFGVKNRKNHARQDDEEERSNKQSAVSAVCVEEESEISEIFDRVLLSVENVPLCAENNGSVAVGDSNTKLIEKSSLSDGGKVRSKRQGRKKETVDLRTLLVLCAQAVSSSDNRTANELLKQIRQHSSALGDASQRLAHYVANALEARLVGDGTATQIFYMSYKKFTTTDFLKAYQVLISACPFKKFAHFFANKMIMKTADGAETLHIIDFGILYGFQWPILIKFLSGRRGGPPKLRITGIEYPQPGFRPTERIEETGCRLAKYCKRFNVPFEYKAIASRNWETIQIEDLKIERNEVLAVNCLVRFKNLLDESIEVNSPRKAVMNLIRKMKPDIFVHCVVNGTYNAPFFLTRFREALFHYSSMYDMFDTLVSRENEWRLMLEREFLGREIMNVVACEALER

SEQ ID NO: 210151 - protein, 254 aa, Glycine max
  Coding DNA Sequence Number=SeqID_93373
  Gene Ontology: Mol. function=helicase activity; Cellular component =membrane; Biological process=viral genome replication
  Homolog annotation: Hit_ID=Q1SN45; Match level="QueryCoverage=98%, HitCoverage=11%, E-value=1e-55, Identity=58%"; Hit description=AAA ATPase
  Pfam annotation: Domain name=DUF889; Domain location=21-168; Score =34.5; E_value=7.6e-14; Accession=PF05970.5; Description=Eukaryotic protein of unknown function (DUF889)
MAINKSQGLLLSMVGLYLPKPVFTHGQLYVALLRVNSTKGLKILIHDDEQKSMNSTTNVVFKEVEYLSSDSVDKSETNEDSYFQSITTKFLNSLNTSGLPTHSIKLKIGSPIMLLRNLDQNQGLCNGIRLVVTKMTKHVIAAEIISGKNIDLAVYIPRMSMSPSQSPWPFKLLKRQFPIMLSYAMAINKSQGLLLSMVGLYLPKPVFTHGQLYVALLRVNSTKGLKILIHDDEQKSMNSTTNVVFKEVFRNIKR

SEQ ID NO: 210152 - protein, 606 aa, Glycine max
  Coding DNA Sequence Number=SeqID_93374
  Gene Ontology: Mol. function=protein-methionine-S-oxide reductase activity; Cellular component=nucleus; Biological process=regulation of transcription
  Homolog annotation: Hit_ID=Q1PCS0; Match level="QueryCoverage=98%, HitCoverage=87%, E-value=1e-151, Identity=49%"; Hit description=GRAS1
  Pfam annotation: Domain name=GRAS; Domain location=210-513; Score =424.2; E_value=1.8e-124; Accession=PF03514.5; Description=GRAS family transcription factor
MEFTKYSNPILRYISDILMDEEDDLECKPCMLQECLRLQAAEKSFHDALLHQNPSPFRDENTCITDSDEIFGRIPSFVSSGSCTTDNSCESDLLNGVSEFNSSFLQLQTPLVDSPEDGYFHDGTWNLFQSHTKPLMVEEGTPASALREKRSHGMDGHASHEKEGRRGSKVSAIFSDDSEPREILDEVLLYQTGGSQPLYSAPTEPSQRVDLGRSNGKATRLRSKKVSTNMETTVDLWTLLTQCAQAVANYDQRNANELLKQIRQHSSPFGDGLQRLAHYFANGLETRLAAGTPSYMPLEVATAADMLKAYKLFVTSSPLQRLTNYLTTKTIISLVKNESSVHIMDFGICYGFQWPCLIKKLSDRHGGPPRLRITGIDLPQPGFRPAERVEETGRRLANFCKKFNVPFEYNCLAQKWETIRLADLKIDRNELTVVSCFYRLKNLPDETVDVKCPRDAVLKLIRKINPNVFIHGVVNGAYSAPFFLTRFREALYHFSSLFDVYEANVPREDPQRVMLEKGLFGRDAINVVACEGAERVERPETYKQWQVRNLRAGFKQLPLDPQLVNDAKDIVKREYHKDFVVAENDKWVLLGWKGRILNAISAWTLA

SEQ ID NO: 210153 - protein, 130 aa, Glycine max
  Coding DNA Sequence Number=SeqID_93375
MNLMLDGSVAEQDGVIAVRDFVAMAVTVTTVGAKGGGANVGAVVGGGLGGDGDGVDAVKVSTGGGASIGNELGGKGVGMRADNWSRMTSSLAVIARVLVVISKVWVVMEDNFRVRWYTTFSRRSRVVWWL

SEQ ID NO: 210154 - protein, 269 aa, Glycine max
  Coding DNA Sequence Number=SeqID_93376
  Gene Ontology: Mol. function=ubiquitin-specific protease activity; Cellular component=proteasome complex (sensu Eukaryota); Biological process=ubiquitin-dependent protein catabolic process
  Homolog annotation: Hit_ID=Q8LB95; Match level="QueryCoverage=95%, HitCoverage=96%, E-value=1e-65, Identity=49%"; Hit description =Putative ubiquitin fusion-degradation protein
  Pfam annotation: Domain name=UFD1; Domain location=4-134; Score =198.7; E_value=1.4e-56; Accession=PF03152.5; Description=Ubiquitin fusion degradation protein UFD1
MAYYRDDRFATFEQFYRCYPVSFIEKLSCLPQPLIALMMENMLLQEGDIVKVKNTNLAKGTYVKLQPHTKDFLDISNPKAILETTLRSYSCLTTGDTIMVPYNNKKYYIDIVETKPSPAVSIIETDCEVDFAPPLDYKEPEKQAKPVVFDRKRPKVEDEPPTKIARLTPFTGSGRRLDGKPSAPSVEQTSSPELKQRQTDKEIKGSDSKSSNTVSRRHSGKLVFGSNATTSDIQTTPKVSQENTSQEKSQKEEEPKFKAFTGKKYSLKS

SEQ ID NO: 210155 - protein, 646 aa, Glycine max
  Coding DNA Sequence Number=SeqID_93377
  Gene Ontology: Mol. function=protein-methionine-S-oxide reductase activity; Cellular component=nucleus; Biological process=regulation of transcription
  Homolog annotation: Hit_ID=Q00LP5; Match level="QueryCoverage=90%, HitCoverage=88%, E-value=1e-135, Identity=45%"; Hit description=GRAS4
  Pfam annotation: Domain name=GRAS; Domain location=290-553; Score =313.2; E_value=4.8e-91; Accession=PF03514.5; Description=GRAS family transcription factor
MSCNFLVEFNMNSLVQNFSGPITEFSNQNQVEKGFDFEFDDSSSSLSSGASSGGESTEVTKYSNQILRYISDILMDEEDDLERKPCMLQECLRLQAAEKSFHDALLHQPSSRFRDESVSITDSDENYGRNASFESNGSCTTDNSCESVLVNGVGEFDSSFLQLQTPLVDSPHDPSGESPGVGFFHDPFVKSQAAGYFHDGTWNLFQSQSQTKKPLMVEEGFSASAPREKRSHGMDDYAFHEQEGRRGSKVSAVFSDESESPEILDEVLLCQSGRSQSLLCAAAEPSQSVNLGGSNGKGTRSRSKKVSTKAGTAVDLWTLLTQCAQAVASFDQRNANDLLSQIRQHSSAFGDGLQRLAHYFANGLETRLAAGTPSYMPLEGTTSADMLKAYKLYWPCLIKKLSERHGGPPRLRITGIELPQPGFRPAERVEETGRRLANYCKKFNVPFEYNCLAQKWETIKLADLKIDRNEVTVVSCFYRLKNLPDETVEVKSPRDAVLKLIRMINPNMFIHGVVNGTYSAPFFLTRFREALYHFSSLFDMFEANVPREDPERVMLEKGLFGRDAINVIACEGAERVERPETYKQWQVRNQRAGFKQVRFDPQLVNHEKEMVKKEYHKDFVVAEDGKWVLLGWKGRILNAISAWTPA

SEQ ID NO: 210156 - protein, 302 aa, Glycine max
  Coding DNA Sequence Number=SeqID_93378
  Gene Ontology: Mol. function=hydrolase activity; Cellular component =cytosol; Biological process=metabolic process
  Homolog annotation: Hit_ID=Q1SUR0; Match level="QueryCoverage=81%, HitCoverage=95%, E-value=1e-99, Identity=66%"; Hit description=HAD -superfamily hydrolase subfamily IA, variant 3
  Subcellular localization annotation: CTP_CleavageSite=50; ConfidenceScore=5.33e-01
MGGLRKKRSPLFTPQSLSLDSILHISLSPSPFSTICFFLLTVCNTLSLLESEMKNGDQFQEISKGKYDCLLFEYMLQKLGIPEAKVPESCFSLYKTYGTTMAGLKAIGYDFDYDDFHAFIHGRLPYDMLKPDPVLRGILLSLPVPKIVFTNSDKVHASRVLHRLGLEDCFERVISFETLNSSNEDGNEYKPSSTGIFDFYEYIRRPDSDILLPRTPVVCKPFQDAFEKVFDMADIDPQRTLFFDDSLRNLQTGKSLGLHTVMVAASRRATGVDHALESIHNMKEAFPELWEANEKPESVECS

SEQ ID NO: 210157 - protein, 187 aa, Glycine max
  Coding DNA Sequence Number=SeqID_93379
  Homolog annotation: Hit_ID=Q9LTI4; Match level="QueryCoverage=95%, HitCoverage=96%, E-value=1e-28, Identity=43%"; Hit description =Arabidopsis thaliana genomic DNA, chromosome 5, BAC clone:F2O15
MARRELSSTLKNLKFMQRAALREEKTKKEEEIRPDVSVGTSTAVTRKCVVIMEGDPHPGAPKGRMSFQSFNPSVDKLNEEEARLHQPAAETTMSRNQNANINIRENSSSVEGPECANMDKKSVEVNGNVKRKQSEVICEAQYPNKSPKNDHDDKQSLPNNSLGTLKKPSGDKLDWKVLRPSSVKQSR

SEQ ID NO: 210158 - protein, 207 aa, Glycine max
  Coding DNA Sequence Number=SeqID_93380
  Gene Ontology: Mol. function=oxidoreductase activity; Cellular component=intracellular; Biological process=lignin catabolic process
  Homolog annotation: Hit_ID=Q1SGI4; Match level="QueryCoverage=95%, HitCoverage=54%, E-value=4e-54, Identity=65%"; Hit description =Copper-resistance protein CopA
  Pfam annotation: Domain name=Cu-oxidase; Domain location=2-82; Score=- 13.8; E_value=0.0026; Accession=PF00394.12; Description=Multicopper oxidase
  Pfam annotation: Domain name=Cu-oxidase_2; Domain location=107-204; Score=43.3; E_value=8.5e-10; Accession=PF07731.4; Description =Multicopper oxidase
  Pfam module annotation: Pfam domain module=Cu-oxidase::Cu-oxidase_2; Domain location=2-82::107-204
MDDTFSLKVKPGKTYLLRLINAAMNTELFFSIANHSMTVAEADVTYVKLRHHPHWAIDRSFFFFTETCEGPNNRTKLSASMNNISFALPSVAILQQHFSGKGNNGVYTTDFPAVPLRAFNYTGTPPKNTIVKRGTKVVVIPFNTRMQLVSQDTSILSAESHPLHLHDTAKFNLVDPVERNTFGVPSGGWFAIRFLADNPGDFTSKFK

SEQ ID NO: 210159 - protein, 293 aa, Glycine max
  Coding DNA Sequence Number=SeqID_93381
  Gene Ontology: Mol. function=oxidoreductase activity; Cellular component=intracellular; Biological process=translation
  Homolog annotation: Hit_ID=Q1SGI4; Match level="QueryCoverage=89%, HitCoverage=50%, E-value=2e-82, Identity=55%"; Hit description =Copper-resistance protein CopA
  Pfam annotation: Domain name=Cu-oxidase; Domain location=5-112; Score= 18.8; E_value=7.4e-06; Accession=PF00394.12; Description=Multicopper oxidase
MVGQKRNSILARTPLVVKGSSAWTPRHPHAGVKAGKSYLLRLINAAVNTGLFFSIANHIITVFEADATYIKPFDSDIILIGQGQTTNRGHFSLARAPSNNSTLAGILEYDDDNDTPASNRPMLKPTLPDINDTSFVSNLNTKFRSLNSAKHPANVPETVDKSFFFTIGLGSMLCPRNQTCEGPNNRTKFSASMNNISFPLPSVAILEKHFSGQEQDNNGVYYTTDFPVVSLRAFNYTGTPPNNTMVKSGTKVQRVIRYIFMGSTCFVVSQGFGNFDPIKDPAKFNLVGPVQRN

SEQ ID NO: 210160 - protein, 344 aa, Glycine max
  Coding DNA Sequence Number=SeqID_93382
  Gene Ontology: Mol. function=zinc ion binding; Biological process =cell redox homeostasis
  Homolog annotation: Hit_ID=Q2HS43; Match level="QueryCoverage=75%, HitCoverage=83%, E-value=1e-103, Identity=66%"; Hit description=Zinc finger, RING-type; Thioredoxin-related
  Pfam annotation: Domain name=DUF1117; Domain location=216-325; Score =47.0; E_value=6.4e-11; Accession=PF06547.3; Description=Protein of unknown function (DUF1117)
  Pfam annotation: Domain name=zf-C3HC4; Domain location=153-193; Score= 44.7; E_value=3.2e-10; Accession=PF00097.15; Description=Zinc finger, C3HC4 type (RING finger)
  Pfam annotation: Domain name=zf-RING-like; Domain location=153-193; Score=9.4; E_value=0.013; Accession=PF08746.1; Description=RING-like domain
  Pfam module annotation: Pfam domain module=DUF1117::zf-C3HC4::zf-RING- like; Domain location=216-325::153-193::153-193
MNSDTTSYWCYSCTRFVHIHDQNDVVCPRCHGGFVEKVTAGQSARQGFRRRRRNAGSHSPFNPVIVLRGPGEDEESSFELYYDGFDGEGLRPLPSTMSEFLLGSGFDRLLEQVSQIEINGLGRPENPPASKAAIESMPTLEITESHVASETTCAVCKEAFELGELAREMPCKHLYHSDCILPWLSMRNSCPVCRHELPSEQAAPETRVAGQIEEEAVGLTIWRLPGGGFAVGRFAGESPLPVVYTEMESGGNSNEGSRRISLAVGGGRVRESRGGFGRIFRNLFGRIGALTRSRSLSTSLFNRRRTANSLMKGDIDRYYSKIQQNKREYRICVPYSRHSFYSWS

SEQ ID NO: 210161 - protein, 342 aa, Glycine max
  Coding DNA Sequence Number=SeqID_93383
  Gene Ontology: Mol. function=metal ion transporter activity; Cellular component=membrane; Biological process=metal ion transport
  Homolog annotation: Hit_ID=Q9AWG7; Match level="QueryCoverage=96%, HitCoverage=98%, E-value=1e-137, Identity=74%"; Hit description=Zinc transporter
  Pfam annotation: Domain name=Zip; Domain location=51-339; Score =205.1; E_value=1.7e-58; Accession=PF02535.12; Description=ZIP Zinc transporter
MVSSVASLKMKNLVSTFLVVCLLASLLYPIKAHGGGGGGSDSGDLYSRGLILVKLWCLIILLVTTFAGGVSPYFFRWNDTFLVLGTQFAGGVFLGTSLMHFLSDSDETFRELTTKAYPFAFMLASSGYLLTMFGDCVVNFVTSNSQKKPKVVELEGGKAPQEQHDQARDHCAVETTNPALLKTSSVGDTILLILALCFHSLFEGIAVGVAGTKAEAWRNLWTISLHKIFAAIAMGIALLRMLPKRPLLTTAVYSFAFAVSSPIGVGIGIAIDATTQGSTADWMFAITMGVACGVFIYVAINHLISKGFKQQAGTTSSFDTPWFRFLAVLSGVAVIAVVMIWD

SEQ ID NO: 210162 - protein, 95 aa, Glycine max
  Coding DNA Sequence Number=SeqID_93384
MAGTPHPYLKIGIISKPCHYGSKLLGGRPQERIGVLAPLVLGVPVEALIQLYLAPVISRLLASHMLDVRVHLKLYPPQAMLMRGRISLAGVTDTL

SEQ ID NO: 210163 - protein, 197 aa, Glycine max
  Coding DNA Sequence Number=SeqID_93385
MKNLPLFILYNLHPLFHLKVLEIPFLNSRLFPHADDPLLQETPSELAEHRSGVGIEGYIELHPPHSGEQSSLPITRRSDQVSSIRVGDAVASCTITHPNISVVAFVGGITAKERPHPYSGMCLIPVEDEAESSQLNPPQNVIDLDSEAMTIQVILGYLMQSYPPRALDRRLQEDWAKDAREGPRILMSLRVDFGPMG

SEQ ID NO: 210164 - protein, 100 aa, Glycine max
  Coding DNA Sequence Number=SeqID_93386
MASYATERFCFYFAVGDHEAQKLPTTNPKGSFSRLRRVQEAQQLEPRCTIDQLIHAWQGICVFRACFIKDFYYVFVLVAGEVPAELSALPRFWSVDKGSS

SEQ ID NO: 210165 - protein, 357 aa, Glycine max
  Coding DNA Sequence Number=SeqID_93387
MGAKYLEVVKRGSHPNNGWSLDEIRVGLVGDDVPHFAIEPPIGEEGQHVTRVGLNDGEVVEVTPNVPPFVLSKRNHDNGATTIVAPAPPTPPSLPAQEVFISLFTVVVAQVPLVAPIMALPSITVMPLLCASVATVITSVVPHSFSLASPVPTPAFLLSVLPSSSSCSSLPSEEFCDSGGEWIEDPKVVNATIVFVEALGLTTGCHPGSAMLLLSCCALDWTVTRCGDTVAEKEELAIESAKEVSIELEEELLTFKKEAVERHEKGFYKDVRKLEFFTKGLELGLFDPFKDGYLLEGRRLTKDRPWVFRALKICQGLPKEDLGFVEPWRFVEAHQGRTLGLSSLGDLSRLTKDGPWV

SEQ ID NO: 210166 - protein, 66 aa, Glycine max
  Coding DNA Sequence Number=SeqID_93388
  Subcellular localization annotation: CTP_CleavageSite=11; ConfidenceScore=5.12e-01
MAPSKLYPNSRAMVKVFEVMCPFFNIRPSMSVFLYFFQMKLTGKIGWMSLNSVSKKLFEFDLNIFH

SEQ ID NO: 210167 - protein, 157 aa, Glycine max
  Coding DNA Sequence Number=SeqID_93389
  Gene Ontology: Mol. function=RNA-directed DNA polymerase activity; Cellular component=mitochondrion; Biological process=RNA-dependent DNA replication
MYHIPRESNTRADLLSKLVSMKRTRHLKTIIQETIQALTIDTNEVMEGEEEESDWMAPYKNFLIENVPRTPPNNHHSLSSTWPIAIWGMDILKPLPKALGVVKFLLVTIDYFTKWIEARPLQEISVREVEKFTWKHLIYRYGLPYAIITGNGTQFKA

SEQ ID NO: 210168 - protein, 212 aa, Glycine max
  Coding DNA Sequence Number=SeqID_93390
  Gene Ontology: Mol. function=nucleic acid binding; Biological process= DNA integration
  Homolog annotation: Hit_ID=Q2HSF6; Match level="QueryCoverage=99%, HitCoverage=12%, E-value=3e-21, Identity=37%"; Hit description =Glycoside hydrolase, family 1; Zinc finger, CCHC-type; Polynucleotidyl transferase, Ribonuclease H fold
MGELKFFLGLQITKTSNGIYIHQTKYVKEKLKKFNMNNAKEMKTPMHPTTYLGLEEESTKARLTGASSKGGKCAESPPTFICGKRRKNRGKPVMKNIPDSGVVFTFEEGISTSHVDKSGALAPTYPPSKRKSNLRSSFLRMNQAISFTWNVIAQQRVPSTSKRATKGCMPSNKDKVERKSTSGSCHFIGGNLVTWICKKKGLTALSTIEAEY

SEQ ID NO: 210169 - protein, 164 aa, Glycine max
  Coding DNA Sequence Number=SeqID_93391
VALGEFKNKHVLLFISGLDHIDNEIQLLKSINAKLKEEPNELEGYRKEDFKILWIPIVSVWDEEQKKKLDVTKVEWYVVKEFNFQTGIDLIKEVFNYKGNPIIMLISPEGKVENSDAKQIISKWGIDGFPFRTSDHTRLTQQWNWFWNEMITLSPIIRELRVPQ

SEQ ID NO: 210170 - protein, 75 aa, Glycine max
  Coding DNA Sequence Number=SeqID_93392
MRATGRVFCNTNLWCHWQHKRKYATLTKNKGGYCDRVAGRWIRVTKNKRGWAVAWWQPASLNEASTTIEQSKSVL

SEQ ID NO: 210171 - protein, 53 aa, Glycine max
  Coding DNA Sequence Number=SeqID_93393
MEESRSPLSQRSFCTFFKPVLRYPSLKSYTYLRKCHCFTYYIDFHTTGVKSTL

SEQ ID NO: 210172 - protein, 158 aa, Glycine max
  Coding DNA Sequence Number=SeqID_93394
  Homolog annotation: Hit_ID=Q2HVF5; Match level="QueryCoverage=58%, HitCoverage=22%, E-value=1e-14, Identity=44%"; Hit description =Cyclin-like F-box; F-box protein interaction domain; Galactose oxidase, central
MRKYNRGDSWCKLFTLEESRELRSFKCVRPLGYSSNGNKVLLKHDRKRLCWYDLRKKEVTLVRIQGLPNLNEAMICLGTLVTPYFLPREICRKLRTLGCEHPSICTDKDFTLTFNYRLTCMVMVESNDGSATVAAPGESVTESLKTNCGHWMVACPRR

SEQ ID NO: 210173 - protein, 168 aa, Glycine max
  Coding DNA Sequence Number=SeqID_93395
MLNRDLRSRLWGRVVSFYQCLGRPLILEERPTMLAQPERETIAQLLCIPGQDFTRAAAKRRVRIVRTNMTTLTQICMTLQHSNILPNNRNADLPLRKDRAHKTPGGAQQGPRVSSSGYRPLLVLDRARKTPSGPEEVQQGLRVANSDYGPLSVLRSACRPQQGHQAPY

SEQ ID NO: 210174 - protein, 84 aa, Glycine max
  Coding DNA Sequence Number=SeqID_93396
MDLENSNRVLGFLALITGLCQFYKVLVAPSKVIRPPTNRAFIKKYCAPRQAQGETPQQPEVDQQRATGTPPPPLEFTSAHPQKG

SEQ ID NO: 210175 - protein, 60 aa, Glycine max
  Coding DNA Sequence Number=SeqID_93397
MEEVHWFVMPYAYENRVDDHGDDKEGGSGAMGASDGPWCRWAAAAEEVDEPFLFFDDSAI

SEQ ID NO: 210176 - protein, 100 aa, Glycine max
  Coding DNA Sequence Number=SeqID_93398
MPLRGRIASPLIQGLQVVPSMVRLMKQANVFPPKKTLKKFILWGINNGKGILKEDFQAFSRVPIINKDSIGHTLVTNSTKTKMDLRIGQSNKGPTFSRGR

SEQ ID NO: 210177 - protein, 83 aa, Glycine max
  Coding DNA Sequence Number=SeqID_93399
  Homolog annotation: Hit_ID=Q53JS6; Match level="QueryCoverage=88%, HitCoverage=17%, E-value=6e-08, Identity=43%"; Hit description =Transposable element protein, putative
MDSSKDNSIISCTELLGVGSHLLNQIPSLNKSHITKSSTTSSINHTPHHVAKSLIEILKKELLRNLVMRTASSPCCYSKWIIF

SEQ ID NO: 210178 - protein, 59 aa, Glycine max
  Coding DNA Sequence Number=SeqID_93400
  Gene Ontology: Mol. function=GTP binding; Cellular component =intracellular; Biological process=small GTPase mediated signal transduction
  Homolog annotation: Hit_ID=Q10CA9; Match level="QueryCoverage=68%, HitCoverage=21%, E-value=6e-15, Identity=100%"; Hit description=ADP -ribosylation factor, putative, expressed
  Pfam annotation: Domain name=Arf; Domain location=4-56; Score=-77.0; E_value=0.0008; Accession=PF00025.11; Description=ADP-ribosylation factor family
MGLTFTKLFSRLFAKKEMRILMVGLDAAGKTTILYKLKLGEIVTTIPTIVTTCRTILVK

SEQ ID NO: 210179 - protein, 55 aa, Glycine max
  Coding DNA Sequence Number=SeqID_93401
  Subcellular localization annotation: CTP_CleavageSite=24; ConfidenceScore=5.23e-01
MAQPKPSAGLKGKPHQHALTFMPSCISKKQRLGPPRPKSCFGIYPNFRKLSASQK

SEQ ID NO: 210180 - protein, 134 aa, Glycine max
  Coding DNA Sequence Number=SeqID_93402
PKSDRLSLAHQWAKRASIAKRAEATLSATEESGRASTSRAHTKHEINALSAADSRAHRSVYFGKRALEAARGATFAKIPRIHNVGYNVQDILPENTGIAKSIEAAGSTMSDTMSRTSCPKILELLKALKLQDPR

SEQ ID NO: 210181 - protein, 50 aa, Glycine max
  Coding DNA Sequence Number=SeqID_93403
  Gene Ontology: Mol. function=chromatin binding; Cellular component =chromatin; Biological process=chromatin assembly or disassembly
MHERAKVIGDSHVQRSATEFEKLSPKRTDEDWITVGDKVARYSMEFANHV

SEQ ID NO: 210182 - protein, 199 aa, Glycine max
  Coding DNA Sequence Number=SeqID_93404
  Gene Ontology: Mol. function=RNA-directed DNA polymerase activity; Cellular component=chromatin; Biological process=RNA-dependent DNA replication
DSLSSHLHHLELIFHVLLQGIFYLKCSKCLFAQHQLEYLDHIISSKGVEPEQSKIKVMLDWPVPSNQKDLRRFLGLPCIYRKFIKGLAMGVVLMQQGHPIAFFNKLFGPRMKSTFTYICKPHTNTTVVRKWRQYLLGHQFTIPTNHKSLKDLMSWVIQTPEQQFYLTKLFGYDYLIQYKSGKSNVMADALSRIEPILAN

SEQ ID NO: 210183 - protein, 104 aa, Glycine max
  Coding DNA Sequence Number=SeqID_93405
  Gene Ontology: Mol. function=protein serine/threonine kinase activity; Cellular component=nucleus; Biological process=protein amino acid phosphorylation
  Homolog annotation: Hit_ID=P93101; Match level="QueryCoverage=60%, HitCoverage=21%, E-value=5e-12, Identity=57%"; Hit description=Cell division control protein 2 homolog
MLEIPKGSLSDMLDWKMLPSCYLAALKNLVATYKKVVKIGEGTYDIVSKAREGITNVTIALKKIRLEQKDEGVPNTTIVRFLSSKRCNIGTLLEILSKETNLKW

SEQ ID NO: 210184 - protein, 183 aa, Glycine max
  Coding DNA Sequence Number=SeqID_93406
  Homolog annotation: Hit_ID=P16181; Match level="QueryCoverage=19%, HitCoverage=22%, E-value=2e-09, Identity=80%"; Hit description=40S ribosomal protein S11-1
  Subcellular localization annotation: CTP_CleavageSite=36; ConfidenceScore=5.62e-01
MEFVSTTYRLRSKKTRKGKSPGKGTPGRCSSFSFCLSSSLSQTGLRFRDCNDIVEFVFVEFVSATYRLRSKKTRKGKSPGKGGNRFWKSIVLGFKTPREAIEGYNHWNISTSMSVRRQEAIKVFNVMEQENLPESEVIFLRWLTKEEMGFDDVSCGGTFAVCEFWKSVLLLILVLGLLSGNLV

SEQ ID NO: 210185 - protein, 163 aa, Glycine max
  Coding DNA Sequence Number=SeqID_93407
MSFINVEFLQDVRKKAQAIQKQNTAPHMLSRGGYEYLEKTLMAEKTKKKLEEAAQSGSIETVIDPPSPIRQHVKWKMARTKKIGQMTSKAAKEITKKIEQPSQGSFVAHGRQDVLTDAIGQQEHLGRVCGSNAFQGYFDDAKESRVKQIPKIQESSFKNQEKT

SEQ ID NO: 210186 - protein, 385 aa, Glycine max
  Coding DNA Sequence Number=SeqID_93408
  Gene Ontology: Mol. function=hydroxymethylbilane synthase activity; Cellular component=chloroplast; Biological process=tetrapyrrole biosynthetic process
  Homolog annotation: Hit_ID=Q43082; Match level="QueryCoverage=98%, HitCoverage=92%, E-value=1e-156, Identity=77%"; Hit description =Porphobilinogen deaminase, chloroplast precursor
  Pfam annotation: Domain name=Porphobil_deam; Domain location=42-259; Score=431.1; E_value=1.5e-126; Accession=PF01379.11; Description =Porphobilinogen deaminase, dipyromethane cofactor binding domain
  Pfam annotation: Domain name=Porphobil_deamC; Domain location=302 -378; Score=112.4; E_value=1.3e-30; Accession=PF03900.6; Description =Porphobilinogen deaminase, C-terminal domain
  Pfam module annotation: Pfam domain module=Porphobil_deam::Porphobil _deamC; Domain location=42-259::302-378
METLCSALVFPSFRITTSAFSKCGIRASIAVEQQTSQTKVALLKIGTRGSPLALAQAYETRDKLMASHPELAEEGAIQIVIIKTTGDKILSQPLADIGGKGLFTKEIDEALINGDIDIAVHSMKDVPTYLPDKTILPCNLPREDVRDAFISLSAASLADLPSGSVVGTASLRRKSQILHRYPSLNVEENFRGNVQTRLRKLSEGIVQATLLALAGLKRLNMTENVSSILSIDDMLPAVAQGAIGIACRSNDDKMVHVWFLAVVNQVRAISEIKTCVNSLASVPIRPSNKAEYLASLNHEETRLAVSCERAFLEKLEGSCRTPIAGYASRNEDGNCLFRGLVASPDGTRVLETSRIGSYAFEDMIKMGKDAGEELLSRAGPGFFSR

SEQ ID NO: 210187 - protein, 327 aa, Glycine max
  Coding DNA Sequence Number=SeqID_93409
  Gene Ontology: Mol. function=hydrolase activity, hydrolyzing O -glycosyl compounds; Cellular component=vacuole; Biological process =carbohydrate metabolic process
  Homolog annotation: Hit_ID=O49012; Match level="QueryCoverage=71%, HitCoverage=98%, E-value=1e-131, Identity=99%"; Hit description=Beta- 1,3-glucanase 3
  Pfam annotation: Domain name=Glyco_hydro_17; Domain location=17-326; Score=571.8; E_value=6.6e-169; Accession=PF00332.9; Description =Glycosyl hydrolases family 17
MSKSLIIIVKIKVAQSIGVCYGVLGNNLPSRQEVVDLYKTNGIGRMRIYYPDEEALQALRGSGIELIMDVAKETLQSMTDPNAATDWVNKYVTAYSQDVNFKYIAVGNEIHPNTNEAQYILSAMTNIQNAISSANLQIKVSTAIDSTFIAPPSYPPNDAVFTSDAEPYVKPIIDFLVRNEAPLLANVYPYFAYANDQQNSIPLAYALFTQQGNNDAGYQNLFDAMLDSIYAAVEKVGASNLQIVVSESGWPSEGGGTGASIDNAGTYNANLISHASGGSGTPKRPGGSIETYLFAMFDENQKQDAETERHFGLFRPDKSPKYQLNFN

SEQ ID NO: 210188 - protein, 732 aa, Glycine max
  Coding DNA Sequence Number=SeqID_93410
  Homolog annotation: Hit_ID=Q43082; Match level="QueryCoverage=7%, HitCoverage=18%, E-value=2e-09, Identity=70%"; Hit description =Porphobilinogen deaminase, chloroplast precursor
MAIAWLRNLQNLWPFRVDELRDSKQLVKKLSIPQDTKQFVFALRDPQTQSIIYILSSLNLSERSASDATCLIKEIKPDAVLVQAGVSPFSELQSEEDSVPVPTSSFGVIKRCFLDKIGRDMYENVAGNFVLREIFGTSFHGPLLAAKRAAEDVGSSFLVIESPSCWGNSNSDSNSNNSDSHSDRDSHFRSLVNSLVPKQHAASWAPSALKRFSLDKELRMMLAKALSGSLDPLLLSSANASSVLEKGNEETQPSSCYETPGFARSIYPLLEDLYSIFGDLPSLGKALAHVQKMLLDVNRGEVLDKRTVSEVYTFRIAVEGLRIALNNKGLRPINRKSAAKSDKIEFSELPVDDKSHALFAQAIRSQTDKFKTIVAVVDASALAGLRKHWDTPLPVEVKELVGELITNSEGKGVTLNHSEKKRLLTDKPMVAVGAGATAVLGASSLTKVVPASTLVKVVTFKIPTSLKIGLSQMQKVLAFAFGPSKVAAPGIATSGVKTSGIMKAAASAEKIRAVAHGVIASAEKTSISVMRTAFYEIMRKRKVRPVGFLPWATFAGSIGTCTSLLLYGDGIECAVESLPAAPSIASLGRGIQHLHEASQADVRDAFIFLSAVSLADLPSGTVVGTAFTQMKVTDTPQISISKCKLDGHTMVALVCGQNGMAVFCSILLFLVPLLHAEYIASLSQKKRWKGLAALLLQAMLAETRMAIALLEASRIGYYAVEDMMKMGKDAGR

SEQ ID NO: 210189 - protein, 240 aa, Glycine max
  Coding DNA Sequence Number=SeqID_93411
  Gene Ontology: Mol. function=hydrolase activity, hydrolyzing O -glycosyl compounds; Cellular component=vacuole; Biological process =carbohydrate metabolic process
  Homolog annotation: Hit_ID=Q1SBY3; Match level="QueryCoverage=93%, HitCoverage=89%, E-value=2e-57, Identity=45%"; Hit description =Glycosyl hydrolases family 17
  Pfam annotation: Domain name=Glyco_hydro_17; Domain location=14-238; Score=256.3; E_value=6.1e-74; Accession=PF00332.9; Description =Glycosyl hydrolases family 17
MSAILLLVEILSYITGKEVVDLYKTNGIGRMRIYYEKALQALRGSGIELIMDVAKDTLQSLTNANAARDWVNKYVTPYSRDVNFKYIVVGNEIGPNTNEVGPIHSTCYDQHSKSNFISQFAWPTQGIDNAGYQNLFDAMLDSIYAAVEKVGAPNLKIVVSESGWPSEGGDGASIENARTYYSNLIDHVSSGNGTPKRRGPIETYLFAMFDENQKSGKETERHFGLYRPDKSSKYQLRFNN

SEQ ID NO: 210190 - protein, 1035 aa, Glycine max
  Coding DNA Sequence Number=SeqID_93412
  Gene Ontology: Mol. function=heat shock protein binding
  Homolog annotation: Hit_ID=Q01G83; Match level="QueryCoverage=40%, HitCoverage=51%, E-value=2e-27, Identity=27%"; Hit description=[O] KOG0548 Molecular co-chaperone STI1
  Pfam annotation: Domain name=DnaJ; Domain location=963-1035; Score =54.2; E_value=4.3e-13; Accession=PF00226.21; Description=DnaJ domain
  Pfam annotation: Domain name=TPR_1; Domain location=592-625; Score =24.1; E_value=0.00051; Accession=PF00515.18; Description =Tetratricopeptide repeat
  Pfam annotation: Domain name=TPR_1; Domain location=626-659; Score =6.4; E_value=0.92; Accession=PF00515.18; Description=Tetratricopeptid e repeat
  Pfam annotation: Domain name=TPR_1; Domain location=853-886; Score =34.9; E_value=2.9e-07; Accession=PF00515.18; Description =Tetratricopeptide repeat
  Pfam annotation: Domain name=TPR_1; Domain location=887-920; Score =5.1; E_value=1.3; Accession=PF00515.18; Description=Tetratricopeptide repeat
  Pfam annotation: Domain name=TPR_2; Domain location=592-625; Score =13.2; E_value=0.93; Accession=PF07719.7; Description=Tetratricopeptid e repeat
  Pfam annotation: Domain name=TPR_2; Domain location=626-659; Score =13.4; E_value=0.85; Accession=PF07719.7; Description=Tetratricopeptid e repeat
  Pfam annotation: Domain name=TPR_2; Domain location=853-886; Score =22.6; E_value=0.0014; Accession=PF07719.7; Description =Tetratricopeptide repeat
  Pfam annotation: Domain name=TPR_2; Domain location=887-920; Score =9.0; E_value=3; Accession=PF07719.7; Description=Tetratricopeptide repeat
  Pfam module annotation: Pfam domain module=DnaJ::TPR_1::TPR_1::TPR _1::TPR_1::TPR_2::TPR_2::TPR_2::TPR_2; Domain location=963-1035::592 -625::626-659::853-886::887-920::592-625::626-659::853-886::887-920
  Subcellular localization annotation: CTP_CleavageSite=64; ConfidenceScore=5.93e-01
MENASDNINRFSNPNANANATATTSTSGFTFSTPSVSGLSRPRFVKVRKPNNAPAFNPSRNGAAAAANVNAAFATTDFASRIADPFRNLKIDAKGEFAFATNDSSRVDENSVSEQINNLKIVTDNDDSDDLRNELKKKLSIKEGGGSNAAVAENSANEVLYQMKKLNMNDAISSSNVHNSAGHVEPSLENVTTFRNRETEAAEDLLRKFDKLNIVKEKKEDCDKPNLCNPFVEGIHPRVASGGAQVASEDFGMSQGAASALASVSVFFQPAGVGKREEFVFTGKQDISGSSFVEFKTPAPQIGKEGKLKEKGSKVRMNKSREKPKHYSSAPPWHGQSFVLKESVPQDELQGSPMDVSQYQEKLAENERSRENSLTSNESFSVDNNNTVNDSEPTSSIDPIDEDLIGAAESLNINGGDVAHRDTKEESSEDQMCENSYVEDPKDESVSGVETESFKSANDEVDITSDASGVSAETEAHDSDRMLHLDSALSSRNVNVSGFTFAAASSAEAQSSSPKRLHKKKNVGHDPYNYTPNIKVPYSSSSVAFSPFSGTSSLFTSGQSLKPEVSSPPPKTSDSDENQEKGIKEAQEGCERWRLRNLAATHMSLGRMRDALEDCKMAAEIDQNFLKVQLRAANCYLALGEVEGASQYFKRCLQSGTDVCVDRKIAVEASDGLQKAQKVSDLINHSAQLLQRRTASDAERALEHINKALIISSYSEKLLEMKAEALLMVIQLCGKTLDSAEKNACPLDAGCKVTDLDNSQLSKGFYFRIWRCSMMLKAYIHLGKFEEGLSLLEKQEEKMSAINKSGSKVLDSLIPLAAIIREPLHHKAGRHAEAVEYYTSALSCNVESRPFAAVCYCNRAAAYKALGQITDAIADCSLAIALDGNYLKALSRRATLFEMIRDYAQAASDLRRLVSLLSKGVEDNANQLGISDKSIHYTNDLKHSRVRLLEMEEEARKEIPLDMGVEPSVSISEIKKAYRKAALRHHPDKAGQSLTKSDNGDDQIWKVIAEEVHRDADRLFKIIGEAYAVLSDPAK

SEQ ID NO: 210191 - protein, 425 aa, Glycine max
  Coding DNA Sequence Number=SeqID_93413
  Gene Ontology: Mol. function=hydrolase activity, hydrolyzing O -glycosyl compounds; Cellular component=vacuole; Biological process =carbohydrate metabolic process
  Homolog annotation: Hit_ID=Q6S9W0; Match level="QueryCoverage=73%, HitCoverage=92%, E-value=1e-171, Identity=95%"; Hit description=Endo- 1,3-beta-glucanase
  Pfam annotation: Domain name=Glyco_hydro_17; Domain location=24-318; Score=528.2; E_value=8.9e-156; Accession=PF00332.9; Description =Glycosyl hydrolases family 17
MSAILLLLGILSSTGVEFTGAQSVGVCYGGNGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGAPNVKVVVSESGWPSEGGVGATVQNAGTYYRNLINHAKGGTPKRPSGPIETYLFAMFDENQKDGPEIERHFVNNGGPLLVNVYLYYTYVNDKDISLDYVLFRQQGTDDNGLPSYDADGASTDNADTYYGNLISHASVGVELQREGLFCQTETYGELREVDFHGIIGKQNKMECISNKGECK

SEQ ID NO: 210192 - protein, 248 aa, Glycine max
  Coding DNA Sequence Number=SeqID_93414
  Gene Ontology: Mol. function=hydrolase activity, hydrolyzing O -glycosyl compounds; Cellular component=vacuole; Biological process =carbohydrate metabolic process
  Homolog annotation: Hit_ID=Q6S9W0; Match level="QueryCoverage=85%, HitCoverage=60%, E-value=8e-96, Identity=84%"; Hit description=Endo -1,3-beta-glucanase
  Pfam annotation: Domain name=Glyco_hydro_17; Domain location=1-237; Score=315.7; E_value=8e-92; Accession=PF00332.9; Description =Glycosyl hydrolases family 17
MQAVVDLYKSNRIDKIRLYHPDEGALQALRGSVLPALENIQNAISAANLQCQVKVSTAIDTTLLGYSYPPNVAVFSSSASSYIRPIVNFLARNGAPLLANVYPYFAYVNDQQSISLDYALFTEHGNNEAGYQNLFDALLDSLYAALEKVGAPNVTVVVSESGWPSEGGAVAATVQNAGTYYRNLISHAKGGTPKRPNGPIEIYLYAMFDENQKQGQEIQQHFGLFRLDKSPVPTFEIMRPNPKFKLNF

SEQ ID NO: 210193 - protein, 167 aa, Glycine max
  Coding DNA Sequence Number=SeqID_93415
MVLNLTAITMPLGHCCCDDVEVYVFRQPSTEIIPPIEPKVAPSGALVNIKGSCVDPSGQDPNMRGLYVDDDPPRLVSLGRIYEGSTIVHHVPLGNDLVKDKQVPKGSMKPINRLEPDDDLIYQMTLMIPQLFLKPMQELWDATMFGVYNDNVSLYIKHEDLREIAHG

SEQ ID NO: 210194 - protein, 209 aa, Glycine max
  Coding DNA Sequence Number=SeqID_93416
MALSHLTIHHESLPSKHSNLASKVKTFLDYLNHLTIVSMTPTLPLPSPRPHIKLEVLRFDGHDPLVMQSYPARALDRRIQVDWAKDAREGPRVLMSLRSTKFRALLFLSLHSSSSSSKLLSMASYGEAKESIDEEDPRPTSSNGAYITWDGSLRSPNSLSTREHPSRSALSSCCSTWMVLPSIGFNGHIGTALSPRGLDFFRRWNHDLL

SEQ ID NO: 210195 - protein, 57 aa, Glycine max
  Coding DNA Sequence Number=SeqID_93417
MDCSSTSLIFYPAEVGKKYCLIITSTPTAWTRPKVLWSLNGSNQYILMSMGYKATLH

SEQ ID NO: 210196 - protein, 383 aa, Glycine max
  Coding DNA Sequence Number=SeqID_93418
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=25%, E-value=1e-122, Identity=53%"; Hit description =Chromo
  Pfam annotation: Domain name=Chromo; Domain location=262-316; Score =44.8; E_value=3e-10; Accession=PF00385.14; Description='chromo' (CHRromatin Organisation MOdifier
  Pfam annotation: Domain name=rve; Domain location=1-147; Score=94.1; E_value=4.3e-25; Accession=PF00665.16; Description=Integrase core domain
  Pfam module annotation: Pfam domain module=Chromo::rve; Domain location=262-316::1-147
MDFITGLPPSFGYTTIMVVIDRLTKFAHFVPLKSDYSSKTVAEAFMNYIVKLHGIPKSIVSDRDKVFTSDFWKRLFEIQGTTLAMSSAYHPQSDGQSEILNKCLEMFLRCFTFENPKAWYKALTWAEYWYNTAHHTSIGMTPFKALYGRDPPALTRYRPQPNDPITVQEQLGERDRTLQQLKSNLERAQVYMKNQADKKRRDLELQVGDWVLVGVVAYKLQLPEEAKIHSVFHVSQLKPFKGGTTEQYMPLPLTMTDIGPIVLPAKVLAARVIQQGELKIPQVLIQWTNMPPDESTWEGLEDMKANYPSFNLEDKVVLNGDGIVIRQIKEKEIDVAESSIQVCKGPHGMQEDNSVMQDPELQGMRKSTRARKANNQLKDFVTS

SEQ ID NO: 210197 - protein, 1160 aa, Glycine max
  Coding DNA Sequence Number=SeqID_93419
  Homolog annotation: Hit_ID=Q7XAM9; Match level="QueryCoverage=20%, HitCoverage=58%, E-value=2e-88, Identity=68%"; Hit description =Putative 30S ribosomal protein S9
  Pfam annotation: Domain name=Ribosomal_S9; Domain location=1040-1160; Score=165.3; E_value=1.6e-46; Accession=PF00380.9; Description =Ribosomal protein S9S16
GSIYERFWNGLEWVFAPHDLPISAGHAVAVFIINQMILALSESGNLYEMHLQLGETSQPVWVEFSYTLNQITDNDQEKNSLILMKSGVVSDDGTRGYFCTKNGTLVELDAVESPRWTNHGQPAGANVAAIAVVASKREVVYTISSAGDLYEYDRKSKPSWKKHIWQEKTAKVSPLLPSKGCILHGLSGDHSESLFLLTKEGTLVERRLHQRKWKWVVHGSPEHQTLTSITLALQDESSETFISLFFPTSTGSVFEYQMPKQLGTVPNNQFPGAWGSHEHPLHAKAARGIAGLPLQVGRILFALDDGRLAELHLAGLGGETSGPSVPQNFRRKASTKYVWTILDVPESEGWNAEYCTEERGPRNCMAGTKDESNDSGISSVTGRRKQSQAQNYYLLLGTSGEPNKSSEEYNLPDDWIRSNFRLRLLYEGKSFFLITNDGLVFEYVCIENVWVWLRHDSSSTMNGIVGSYNGSLFMADTFGSLFLREWSDNEIAWRNCTAMRKGRSIVGGQPWDRLPGKARRATTEDSIFFVSKNGRLLQFMVYMREFKWKDCKNPQNVKVASIVDQELFRENIVFVTGRNGRLYQYNKVTDLWHEHYQSQHLILSEFPGTVISPSTKSLSGSLFMLSREGGLVEYQWNTWYGWNWVEHGTPYKGVILVGSPGPSFEGNQLLLIGSDGNVHLRYMDKNAWKWKDCGFPSMGNKIGEAHIGGGVHEEKPVRIDENCASGLNKDQDNLADLNLNCEPKVASTRPIPFSEGSVIFELRDGRPSHAPANPYFTVVVPKHFSTNRGGGNNDGDGKDPFSSRVWKDFRETEEKLDAFFEEEEEEESGSLVRMNDDGGSSGGRRRDERGWLQEEEQGWLQQKGLDDADEDAIFKGIDEESGGEAGGGGFDESNFGVGAGEDFKPWSMKEEEDKEDVFDFKDDVGHAGDITALDIKPKVDVEQLEKEEQALTAIVKGPKRAFGDLIAASGITDEMLDSLIALKDFDGVHGLPPLSVIEDMRYEKNTRKSTRGEMERLKQEEAAKARVKQVDDKGRAYGTGRRKCSVARVWVQPGNGQFVVNDKEFDVYFPMLEHRATLLRPFSETKTLGLWDVSCTVKGGGVSGQVGAIRLGISKALQNWEPDLRPALRNAGFLTRDSRVVERKKPGKAKARKSFQWVKR

SEQ ID NO: 210198 - protein, 1086 aa, Glycine max
  Coding DNA Sequence Number=SeqID_93420
  Gene Ontology: Mol. function=isoleucine-tRNA ligase activity; Cellular component=soluble fraction; Biological process=tRNA aminoacylation for protein translation
  Homolog annotation: Hit_ID=Q9SV89; Match level="QueryCoverage=99%, HitCoverage=99%, E-value=0.0, Identity=57%"; Hit description =Isoleucine-tRNA ligase-like protein
  Pfam annotation: Domain name=tRNA-synt_1; Domain location=18-632; Score=820.9; E_value=6.7e-244; Accession=PF00133.12; Description =tRNA synthetases class I (I, L, M and V)
  Pfam annotation: Domain name=tRNA-synt_1g; Domain location=49-656; Score=-215.8; E_value=2.1e-06; Accession=PF09334.1; Description=tRNA synthetases class I (M)
  Pfam module annotation: Pfam domain module=tRNA-synt_1::tRNA-synt_1g; Domain location=18-632::49-656
MDDVCEGKDFTFPKQEEKILDFWSQIDAFHTQLSLTQDKPEYIFYDGPPFATGLPHYGHILAGTIKDIVTRYQSMTGHHVTRRFGWDCHGLPVENEIDKKLGIKKREDILKLGIDKYNEECRAIVTRYVSEWETVITRTGRWIDFKKDYKTMDLNFMESVWWVFAQLFKKKLVYKGFKVMPYSTGCKTPLSNFEAGQNYKDVSDPEVFITFPVVGDQDDASFVAWTTTPWTLPSNLALCINANFTYVKVRNKYSGKVYIVAESRLSAIHNPKEKPKEAVVNSSNNVPKNINAKTKGASGGKTENVLDSFEVLEKFSGATLVGTKYEPLFDYFKELSDTAFRIVADNYVTDDSGTGVVHCAPAFGEDDFRVCIDNQILSKDKLTVAVDDDGCFTEKITDFSGCYIKHADKDIIEAVKDKRFHNWLENARDWAISRSRFWGTPLPIWISEDEEEVVVIDSVAKLEELSGVKVFDLHRHNIDHITIKSDSGRVLRRVDDVFDCWFESGSMPYAYIHYPFENVELFEKNFPGHFIAEGLDQTRGWEGGTPTYYKVGGHYASNYMFYTLMVLATALFGKPAFRNLICNGLVLAEDGKKMSKSLKNYPSPTEVINDYGADALRLYLINSPVVRAEPLRFKKEGVYGVVRDVFLPWYNAYRFLVQNAKRVEVEGLAPFVPFDQATLLNSTNVLDQWINSATQSLIHFVRQEMDGYRLYTVSSASAERIEQSVSRMMTIIDLARNIRERHNKPLKTPLREMVIVHPDADFLDDINGKLKEYVLEELNVRSLVPCNDTLKYATLRAEPEFSVLGKRLGKSMGIVAKEIKAMSQENILAFENAGEVVIANQCLKLTDIKCGDEGSLIELNEVLVFSELGVCDDGMGLVLRDFKRPDGMTEKEVDAAGDGDVLVILDLRPDESLFEAGAAREIVNRIQKLRKKVALDPTDMVEVYFESLDDDKSVSQRVLHSQESYIRDAIGSQLLPNSLMPAHAVVLGEERFHGIASMSFGITLTRPALMFNQKAILSLFTGDAKSAYKLQTYLLSRDHLKLKSEFQDGNGKKIVDSIEQLPAVEVVLGQHVFFTVGDYSLAGKSD

SEQ ID NO: 210199 - protein, 478 aa, Glycine max
  Coding DNA Sequence Number=SeqID_93421
  Gene Ontology: Mol. function=protein serine/threonine kinase activity; Cellular component=beta-catenin destruction complex; Biological process=protein amino acid phosphorylation
  Homolog annotation: Hit_ID=Q1SPP5; Match level="QueryCoverage=66%, HitCoverage=77%, E-value=1e-139, Identity=71%"; Hit description =Protein kinase
  Pfam annotation: Domain name=Pkinase; Domain location=5-329; Score =195.1; E_value=1.6e-55; Accession=PF00069.15; Description=Protein kinase domain
  Pfam annotation: Domain name=Pkinase_Tyr; Domain location=1-298; Score=-40.2; E_value=5.3e-10; Accession=PF07714.7; Description =Protein tyrosine kinase
  Pfam module annotation: Pfam domain module=Pkinase::Pkinase_Tyr; Domain location=5-329::1-298
MAECIVGTGSFGIVFLAKCLETGEPVAIKKVLLDKRYKNRELQLMRLMDHPNVISLKHRFFSTTSADELFLNLVMEYVPESMYRVSKFYSNTNQSMPLIYVKLYMHQIFRGLAYIHTVPGVCHRDLKPQNILVDPLTHQVKICDFGSAKVLAVLVFDIALFRAFWVIHPLLCVLEVKGEANISHICSLFYRAPELMFGATEYTTSIDIWSAGCVLAELLLGQPLFPGENALDQLVEIIKVLGTPAQEEVSCTNPTYNDFKFPQLEACAHPFFDELREPNAHLPDGRPFPPLFNFKQELSGASPELIDKLIPDHVKRQIGIQHAHLTGFLEHDVKLSKDQDLGSGLLQLIHHSSQHLYSTGTPKLEPYTYRMRHRGAPEEPPQPKPSFPHQKKKRKCRATATATVGSTSVSSETSHTNGPNQLNTHIHDVAVACEKSKAIVVGDDFRFGELRQNESGWVENVWLERSEQCLLRGKTESE

SEQ ID NO: 210200 - protein, 52 aa, Glycine max
  Coding DNA Sequence Number=SeqID_93422
MSVEKYQSGLFKDRCQEMFDRRHPVILFILDIDRSSFLADVNYHLFFINIGE

SEQ ID NO: 210201 - protein, 832 aa, Glycine max
  Coding DNA Sequence Number=SeqID_93423
  Gene Ontology: Mol. function=RNA-directed DNA polymerase activity; Cellular component=membrane; Biological process=RNA-dependent DNA replication
  Pfam annotation: Domain name=Exo_endo_phos; Domain location=16-248; Score=14.5; E_value=0.0015; Accession=PF03372.13; Description =EndonucleaseExonucleasephosphatase family
  Pfam module annotation: Pfam domain module=Exo_endo_phos::RVT_1; Domain location=16-248::510-778
MQKAGKKIITDTGGSARMISWNIRGLNKVGKTIEISSRLKSLNPTIIVLLETRVRKNKALTVRNKLNLNMKYLDNYDKHENGRIWFIWDDSKVMIKHICSTSQLIHCGVYNPNGDFLHWCTAIYALNHLDDRRKLWKDIEDLRVQQADPWCLLGDFNNVLKAEDRIGGRDVTESEYVDLREMMSRVGLYEMDTCGDFFTWTNKQADNTIYSRIDRFLGNLNWLQMHIDSTLQILTPSISDHALMFLSCKDQSSRLRGRFKYRNSLARLNGFHDEVKKNWNLGVHGNPMYKLWTKLSRLQSVLKNLSSPLNGLREKIDEARRNLQQAHEDLCRDRFNVDNINRVKDRTSELLQLNELEDSDLRQKAKINWIRQGDGNNSYFHATIKGRYKHNAIRSLIKEDGSCITSHEDIEEEVLKFYSALLGSSESNLAGLNIPAIRNGNTLNQFQRDMLIGPVSNAEIDTAIKGMDVNKTPGIDGYGVGFFKDAWSIVGSDVREAILDFFLRNRLHKGFNSSVVALIPKHKEAKMIKDFRPISCCSTVYKIISKVLTNRLSKVIDTLVGKNQAAFVPGQQLHDHVLLAFELLRGYERKHGTPKCMLQIDIQKAYDTVHWDALEHILRELGFPDQFIKWIMIAVRSVTYVFNINGRFTRRLEARRGIRQGDPISPLLFILVMEYLNRILSQLDKIPNFNYHSKCEKMKITNLCFADDLLLFSRGDIGSVQIMLDKFNTFLRSMGLHVNPSKCNIYCGSVDINVKEQLLLISGFKEGKMPFRYLGIPLSSKKLNIKHYQVLIDKIVGRITHWSAGLLSYAATFLGSLQLLGKKSAVQRLMVV

SEQ ID NO: 210202 - protein, 164 aa, Glycine max
  Coding DNA Sequence Number=SeqID_93424
MDGSRVAQSLDSLWFYTNILTCRDEPEASLVESAPLIQAKECPKRDLQKPITPLQHESQNVENLSPRCHKFEEVMKTMVPSRETKKRETRKRRKWHKLGLYETNVVHGGLDLRFDFDVFDVESWEYQIQMLNIQRQTKMPPFDNDVAMKQHLKSWAYAVACTVR

SEQ ID NO: 210203 - protein, 70 aa, Glycine max
  Coding DNA Sequence Number=SeqID_93425
MAVDNDEGIAAIVVDGGDDHGVGIEYVLDWMLKFRQKTNWLWPYVKDLDVVAYCGVPYSKGTIIRGKANI

SEQ ID NO: 210204 - protein, 375 aa, Glycine max
  Coding DNA Sequence Number=SeqID_93426
  Homolog annotation: Hit_ID=Q6DXT6; Match level="QueryCoverage=93%, HitCoverage=98%, E-value=1e-97, Identity=52%"; Hit description =Putative G-protein beta
  Pfam annotation: Domain name=WD40; Domain location=10-49; Score=18.8; E_value=0.019; Accession=PF00400.22; Description=WD domain, G-beta repeat
  Pfam annotation: Domain name=WD40; Domain location=100-138; Score =8.9; E_value=3.3; Accession=PF00400.22; Description=WD domain, G -beta repeat
  Pfam annotation: Domain name=WD40; Domain location=268-309; Score =38.3; E_value=2.6e-08; Accession=PF00400.22; Description=WD domain, G-beta repeat
  Pfam annotation: Domain name=WD40; Domain location=54-92; Score=4.3; E_value=12; Accession=PF00400.22; Description=WD domain, G-beta repeat
  Pfam module annotation: Pfam domain module=WD40::WD40::WD40::WD40; Domain location=10-49::100-138::268-309::54-92
MAEKDATKLKLKPRRLKGHDDSTTCCIASRERSHLIVTSGDDGRVCWFDLRCPDEPRLVMDVSVEPVSSLCFKSGMEDMIYVSSGKEIKCFDVRLAAAQWKPLENYNYNKEEINKVVCNSKSSFLAAADDNGEVKICSTVEFLPWRSWEVISGGLDSMLMLWDFSKGRPYKVVDFATFDVSSGIAGRCVNPAFVHAIAIPEVDMLDKLDKICAVARGDGAIDVINIETEMAATKSKSSSNSRKGSHSRSKDGSSSSNTDADQNGKKRLHLDYTLGGHTAAVSSLAFSLFGERGKFLISGGNDKLVKVWNLSCYPDAGLSDDNNNNILHLNIEVPRKVNWLCTTSADTDNLVVCDTSKVVKIALLTGNVLMAQGLA

SEQ ID NO: 210205 - protein, 336 aa, Glycine max
  Coding DNA Sequence Number=SeqID_93427
  Gene Ontology: Mol. function=molecular_function; Cellular component =membrane; Biological process=auxin mediated signaling pathway
  Homolog annotation: Hit_ID=Q9LI65; Match level="QueryCoverage=90%, HitCoverage=88%, E-value=2e-89, Identity=49%"; Hit description =Nodulin-like protein
  Pfam annotation: Domain name=DUF6; Domain location=177-307; Score =38.5; E_value=2.3e-08; Accession=PF00892.11; Description=Integral membrane protein DUF6
  Pfam annotation: Domain name=DUF6; Domain location=18-130; Score =22.5; E_value=0.0015; Accession=PF00892.11; Description=Integral membrane protein DUF6
  Pfam module annotation: Pfam domain module=DUF6::DUF6; Domain location=177-307::18-130
MKNCDEWKPFLVMIAIDFSLTMVNILLKKVLQEGMNHLVFITYRLSVATIFLAPIGYFKERASVTQYFFLLGIQYTSATFACAFVNMVPVITFIMALPFGLETVNIKCKGGKAKILGTFVCIGGALLLTLYKGKALFDGSHHQSAVAMRSAMDQASSTTRTTQKWTIGVIALIMGTLFWSFWFILQSKIGKRYPCQYSSTAIMTFFGAMQAAILGFSTGSSNLSSWVLKDKIQIITVLYSGIVGSSVCYVGMSWCVKKRGPVFTAAFSPLVQIMSGMIDIPFLHEQLHLGSVVGSMLVMIGLYILLWGKSKDMMQNNGATKFAQEVEETKEQEPQV

SEQ ID NO: 210206 - protein, 739 aa, Glycine max
  Coding DNA Sequence Number=SeqID_93428
  Gene Ontology: Mol. function=cellulose synthase (UDP-forming) activity; Cellular component=membrane; Biological process=cellulose biosynthetic process
  Homolog annotation: Hit_ID=Q2IB43; Match level="QueryCoverage=96%, HitCoverage=73%, E-value=0.0, Identity=85%"; Hit description =Cellulose synthase 1
  Pfam annotation: Domain name=Cellulose_synt; Domain location=23-734; Score=1655.7; E_value=0; Accession=PF03552.5; Description=Cellulose synthase
MDIPLVDGSNAKFRPTEAAAAAPLSVVIPMSKSKIAPYRTVIIMRLIILGLFFHYRVTNPVESAFPLWLTSIICEIWFAFSWVLDQFPKWSPINRQTFIDNLSARFEREGEPNELAAVDFFVSTVDPLKEPPLITANTVLSILAVDYPVDKVSCYVSDDGAAMLTFESLVETADFARKWVPFCKKFSIEPRAPEFYFSQKIDYLKDKVQPSFVKEPRAMRDYEEYKVRVNAMVAKAQKTPEEGWTMQDGTPWPGNNSRDHPGMIQVFLGHTGARDIEGNELPRLVYVSREKRPGYQHHKKAGAENALVRVSAVLTNAPFILNLDCDHYVNNSKAVREAMCFLMDPEVGRDVCYVQFPQRFDGIDRSDRYANRNTVFFDVNMKGLDGIQGPVYVGTGCVFNRQALYGYSPPSMPSLPRSSCCCFPSKKSTNDVSDFQRNAKREELEAAIFNLKELDNYDEHERSMLISQMSFEKTFGLSTVFIESTLMENGGVPEAADPSMLIKEAIHVISCGYEEKTLWGKEIGWIYGSVTEDILSGFKMQCRGWKSIYCMPLRPAFKGSAPINLSDRLHQVLRWALGSIEIFLSRHCPLWYGFSGGRLKWLQRMAYINTIVYPFTSLPLVAYCSLPAICLLTGKFIIPTLSNVASVLFLGLFLSIIITSVLELRWSGVSIEDLWRNEQFWVIGGVSAHLFAVFQGLLKMLAGVDTNFTVTAKAAEDSEFGELSKVDYSLDSSNNSYHC

SEQ ID NO: 210207 - protein, 211 aa, Glycine max
  Coding DNA Sequence Number=SeqID_93429
  Gene Ontology: Mol. function=protein binding; Cellular component =integral to membrane; Biological process=protein amino acid phosphorylation
  Homolog annotation: Hit_ID=Q6DXT5; Match level="QueryCoverage=99%, HitCoverage=45%, E-value=1e-61, Identity=60%"; Hit description =Putative leucine-rich repeat family protein
  Pfam annotation: Domain name=LRR_1; Domain location=100-127; Score =1.2; E_value=1.7e+02; Accession=PF00560.23; Description=Leucine Rich Repeat
  Pfam annotation: Domain name=LRR_1; Domain location=28-50; Score =12.4; E_value=1.4; Accession=PF00560.23; Description=Leucine Rich Repeat
  Pfam annotation: Domain name=LRR_1; Domain location=4-26; Score=17.7; E_value=0.043; Accession=PF00560.23; Description=Leucine Rich Repeat
  Pfam annotation: Domain name=LRR_1; Domain location=52-74; Score =11.3; E_value=2.2; Accession=PF00560.23; Description=Leucine Rich Repeat
  Pfam annotation: Domain name=LRR_1; Domain location=76-95; Score=8.2; E_value=8.5; Accession=PF00560.23; Description=Leucine Rich Repeat
  Pfam module annotation: Pfam domain module=LRR_1::LRR_1::LRR_1::LRR _1::LRR_1; Domain location=100-127::28-50::4-26::52-74::76-95
MLENLQVLNLSSNGLKGEIPSSIGDLISLKNLSLAFNSFSGDVPDSLSAIPGLLHLDLSSNQLNGTIPTFISEMRNLKHLNLANNLLHGVVPFNSSFIDKLEVLKVGGNGNLCYNRSVLSSKFIMKLEIAPCDKFGRPVSPPPSKRSNSADDGSDGDYDYDDGDGGGGGGSVRHMKEHHHGPNKVVLGVAIALSSIVFLVVFLILCSKCCR

SEQ ID NO: 210208 - protein, 355 aa, Glycine max
  Coding DNA Sequence Number=SeqID_93430
  Gene Ontology: Mol. function=hydrolase activity; Cellular component =intracellular; Biological process=protein amino acid phosphorylation
  Homolog annotation: Hit_ID=Q1SZI6; Match level="QueryCoverage=74%, HitCoverage=25%, E-value=1e-112, Identity=67%"; Hit description =Tetratricopeptide-like helical
  Pfam annotation: Domain name=PPR; Domain location=140-174; Score =12.7; E_value=0.24; Accession=PF01535.11; Description=PPR repeat
  Pfam annotation: Domain name=PPR; Domain location=3-37; Score=33.6; E_ value=6.9e-07; Accession=PF01535.11; Description=PPR repeat
  Pfam annotation: Domain name=PPR; Domain location=38-72; Score=1.2; E_ value=5.4; Accession=PF01535.11; Description=PPR repeat
  Pfam module annotation: Pfam domain module=PPR::PPR::PPR; Domain location=140-174::3-37::38-72
DMILWTVMIAGYGMHGFGKEAISTFDKIRIAGIEPEESSFTSILYACTHSEFLREGWKFFDSTRSECNIEPKLEHYAYMVDLLIRSGNLSRTYKFIETMPIKPDAAIWGALLSGCRIHHDVELAEKVPEHIFELEPEKTRYYVLLANVYAKAKKWEEVKKLQRRISKCGLKKDQGCSWIEVQGKFNNFVAGDTSHPQAKRIDSLLRKLRMKMNREGYSNKMRTVRVTKNLRVCGDCHEMGKFMSKTTGREILLRDSNRFHHFKDGLCSCRGFWTHYRLGYKVMAKKVYVEVIAIVSVESVIEATVFVVTSEATLCPNFVCEVMLFMDDLSKHLYLDWKNIAAEICKWGSDVTFFL

SEQ ID NO: 210209 - protein, 291 aa, Glycine max
  Coding DNA Sequence Number=SeqID_93431
  Gene Ontology: Mol. function=binding; Cellular component =intracellular; Biological process=protein amino acid phosphorylation
  Homolog annotation: Hit_ID=Q1SZI6; Match level="QueryCoverage=98%, HitCoverage=50%, E-value=1e-121, Identity=35%"; Hit description =Tetratricopeptide-like helical
  Pfam annotation: Domain name=PPR; Domain location=130-164; Score =17.4; E_value=0.051; Accession=PF01535.11; Description=PPR repeat
  Pfam annotation: Domain name=PPR; Domain location=216-250; Score =50.3; E_value=6.5e-12; Accession=PF01535.11; Description=PPR repeat
  Pfam annotation: Domain name=PPR; Domain location=251-285; Score=6.2; E_value=1.4; Accession=PF01535.11; Description=PPR repeat
  Pfam annotation: Domain name=PPR; Domain location=60-94; Score=25.5; E_value=0.00019; Accession=PF01535.11; Description=PPR repeat
  Pfam annotation: Domain name=PPR; Domain location=95-129; Score=0.5; E_value=6.5; Accession=PF01535.11; Description=PPR repeat
  Pfam module annotation: Pfam domain module=PPR::PPR::PPR::PPR::PPR; Domain location=130-164::216-250::251-285::60-94::95-129
MLCTQRKSLEDGKRVHSIITSDGMAIDEVLGAKLVFMYVNCGDLIKGRRIFDGILNDKVFLWNLLMSEYAKIGNYRETVGLFEKLQKLGVRGDSYTFTCILKCFAALAKVMECKRVHGYVLKLGFGSYNAVVNSLIAAYFKCGEAESARILFDELSDRDVVSWNSMISGILHAYGVKVGFSGDAMFNNTLLDMYSKCGKLNGANEVFVKMGETTIVSWTSIIAAHVREGLHDEALRLFDKMQSKGLSPDIYAVTSVVHACACSNSLDKGREVHNYIKKNNMGSSLPVSNLS

SEQ ID NO: 210210 - protein, 170 aa, Glycine max
  Coding DNA Sequence Number=SeqID_93432
  Gene Ontology: Mol. function=motor activity; Cellular component =myosin complex
  Homolog annotation: Hit_ID=Q1T0L3; Match level="QueryCoverage=90%, HitCoverage=17%, E-value=2e-45, Identity=53%"; Hit description=IQ calmodulin-binding region; Myosin head, motor region; Myosin, N- terminal, SH3-like
MKNHIEVVNDEANVALLMGCSSHELMEVLSTHRIQASKDTITKTLTLERVIDARDALAKFIYASLFDWLVKQVNKSLEVGKCRNGRSICILYIYGFKSFQKPLGLLPLLNKESNFPKASDPTLANKLKQQLHDNPCFKGERGRAFSVCHYVEELIPLSEKRLGQAGAQCL

SEQ ID NO: 210211 - protein, 221 aa, Glycine max
  Coding DNA Sequence Number=SeqID_93433
  Pfam annotation: Domain name=zf-H2C2; Domain location=72-113; Score =6.2; E_value=0.055; Accession=PF09337.1; Description=His(2)-Cys(2) zinc finger
MAPDFSASFILETNTSNTTMGAILVQQGKPISFFSHPFTILMNHRSLKDLMTLVIQFNDYNTFIPALLTEFHTTPRCGHLGVAKTIHRIQASFIWDHLERDVKSFIQKCPTCQQIKHKGVHFGTLPLHFTTFKDATMFLDMVYKQHGKPPAEVTYNKPSPSIPGYILDSSPNEDSKHWHDNFEVGRWVYVKLRPYRQVLVLSSMARTLTRRDFIGSMEDSV

SEQ ID NO: 210212 - protein, 103 aa, Glycine max
  Coding DNA Sequence Number=SeqID_93434
MVPDCNDIESTIIYTHLPTTVFLLHQKHGGRERAMDIDRAGGGGKRDMVDYMSRWGNGRGGEEDGGKFGNEVLDFGYGVRQFWARVWVVSGLEGKMEEGGRGG

SEQ ID NO: 210213 - protein, 75 aa, Glycine max
  Coding DNA Sequence Number=SeqID_93435
  Gene Ontology: Mol. function=protein serine/threonine kinase activity; Biological process=protein amino acid phosphorylation
  Homolog annotation: Hit_ID=Q6KC54; Match level="QueryCoverage=63%, HitCoverage=9%, E-value=7e-17, Identity=87%"; Hit description =Calcium-dependent protein kinase 8
MLTNDAFQETSVLWNSKMFYMILDGRISYEEFAAMMKAGTDWRKASRQYSRERFSSLSQKLIKDGSLKLNNDDGR

SEQ ID NO: 210214 - protein, 42 aa, Glycine max
  Coding DNA Sequence Number=SeqID_93436
MALEQEKIGLVCPQDSIGQLEFGTTCQSNSKYHALLRVKARH

SEQ ID NO: 210215 - protein, 270 aa, Glycine max
  Coding DNA Sequence Number=SeqID_93437
  Gene Ontology: Mol. function=nucleoside-triphosphatase activity; Cellular component=integral to membrane; Biological process=lipid transport
  Homolog annotation: Hit_ID=Q9C8K2; Match level="QueryCoverage=88%, HitCoverage=34%, E-value=1e-107, Identity=79%"; Hit description =White-brown complex homolog protein 12
  Pfam annotation: Domain name=ABC_tran; Domain location=67-257; Score =129.9; E_value=6.9e-36; Accession=PF00005.17; Description=ABC transporter
  Pfam annotation: Domain name=SMC_N; Domain location=41-232; Score= -128.1; E_value=0.031; Accession=PF02463.9; Description=RecFRecNSMC N terminal domain
  Pfam module annotation: Pfam domain module=ABC_tran::SMC_N; Domain location=67-257::41-232
MEIELATTNEKGVTDYGDTVSENNNNTNNNRRGMYLVWEDLTVVVPNFGNGHTRRLLDGLSGYAEPNRIMAIMGPSGSGKSTLLDALAGRLSRNVIMSGNVLLNGKKRRLDYGVVAYVTQEDIMLGTLTVRETISYSANLRLPSTMTKEEVNDIIEGTIMEMGLQDCADRLVGNWHLRGISGGEKKRLSIALEILTRPSLLFLDEPTSGLDSASAYFVAQTLRNLGHDGKSTVISSIHQPSSEVFALFDDLFLLSGGQTIYFGPAQKAVE

SEQ ID NO: 210216 - protein, 444 aa, Glycine max
  Coding DNA Sequence Number=SeqID_93438
  Homolog annotation: Hit_ID=Q2RAM1; Match level="QueryCoverage=58%, HitCoverage=67%, E-value=3e-74, Identity=49%"; Hit description=SPRY domain containing protein, expressed
  Pfam annotation: Domain name=SPRY; Domain location=258-403; Score =28.6; E_value=2.2e-05; Accession=PF00622.18; Description=SPRY domain
MTLPPSLSEPPSLSDSFSPLNPTLAMDSLQATYKDEEEDDEDDPQPQPPPTTDADSLEAPPATTSTPSDTPTEPPNDARSEPDPSDDLSEDEAASDGSKKSPKSGREEGDGSDEDPPPKKQKQLSSLTADTKEEDGTNNAAATATPATNGSAPKKSKKKSNNVWATKSTRKGKKKTNRNNNNNNSNNNNNHHHHANGEDNVLITPVPRFPDKSDDTEEMKICLSKVYKAEKVELSEDRMSAGSTKGYRMVRATRGVVEGAWYFEIRVVKLGESGHTRLGWVDREGDIDGSKIHEALREKYGEEGYKEGDVIGFYINLPDGEQYAPKSSQLVWYKGQRYVYAQDSTQDPPKLVPGSEISFFKNGICQGVAFKDLQGGRYYPAASMFTLPNEPNCTVKFNFGPDFECFPEDFNERPIPRPMSEVPYLGFDNKVENEESNEKKSQKE

SEQ ID NO: 210217 - protein, 160 aa, Glycine max
  Coding DNA Sequence Number=SeqID_93439
MKKENTCSDEEDAQNKDEKKKSLKVRASRSLQSKFEEVKETSERKAKEKEVSYPFVEIFISEKVISKHIEKSSTEEKSISLMKTIIRMLIMRNTRKCPLRKWKKNIRRIFLRKRRIITNVLAKLRTADSRVEKESIEKREDKQEEPSKKAKKVEVAAKTI

SEQ ID NO: 210218 - protein, 139 aa, Glycine max
  Coding DNA Sequence Number=SeqID_93440
  Gene Ontology: Mol. function=NADH kinase activity; Biological process= metabolic process
  Homolog annotation: Hit_ID=Q56YN3; Match level="QueryCoverage=59%, HitCoverage=16%, E-value=2e-21, Identity=65%"; Hit description =NAD(H) kinase 1
  Subcellular localization annotation: CTP_CleavageSite=72; ConfidenceScore=5.59e-01
MNIYQSFICSCNHAFKTKDNQSPNISTASQGRVSHISCCLSSVTQQGNTSMPCSQGENGFVSSFSLFPEKVVQELLQSPVQGSDDHLIEFSEALRTVAKALRLVAEGKASAQAEATEWKRKYELERDRNLKFEHAGSNN

SEQ ID NO: 210219 - protein, 56 aa, Glycine max
  Coding DNA Sequence Number=SeqID_93441
MDTLISHLSGVGAEPVKRRLYIKGIPIHSSSSSSSLSFMAPNKLNSSVIIFPSSIF

SEQ ID NO: 210220 - protein, 255 aa, Glycine max
  Coding DNA Sequence Number=SeqID_93442
  Gene Ontology: Mol. function=zinc ion binding
  Homolog annotation: Hit_ID=Q1SZI5; Match level="QueryCoverage=92%, HitCoverage=76%, E-value=8e-86, Identity=66%"; Hit description=Zinc finger, RING-type; RINGv
  Pfam annotation: Domain name=zf-C3HC4; Domain location=181-238; Score= 18.4; E_value=0.002; Accession=PF00097.15; Description=Zinc finger, C3HC4 type (RING finger)
MDQAKSKGSGEILDHVDERVDEDFNQLVEGNAIDAGGGHSLGEGVNVSGEDGTSEEMCNDLRLNRELKEGSQEVNDQNMGDPQEINDTLHGVDQGTSYSSRNLVSWEVPETCVVVDPSTQIECVNGDNRKLEAKPNESGLNKVSMKVTNGVSETDKNSCVIDINCHSCDGFSENLEGEMICRICHLASGQPLEAADVGTASSATTNTDLIQLGCACKDELGIVHSHCAEAWFKLKGNRTLKNLKAVGWGWGKLYQ

SEQ ID NO: 210221 - protein, 250 aa, Glycine max
  Coding DNA Sequence Number=SeqID_93443
  Gene Ontology: Mol. function=NADH kinase activity; Cellular component= chloroplast; Biological process=metabolic process
  Homolog annotation: Hit_ID=Q56YN3; Match level="QueryCoverage=96%, HitCoverage=40%, E-value=1e-102, Identity=87%"; Hit description =NAD(H) kinase 1
  Pfam annotation: Domain name=NAD_kinase; Domain location=23-219; Score=38.3; E_value=2.6e-08; Accession=PF01513.11; Description=ATP -NAD kinase
MALSYGVSWLYDPFLYPPTCVHAYYLFYYNICFHFYLEAELNHPSDREQYKECLESILKGPISITLRHRLQCHVIRDAAKNEYETEEPILVLNEVTIDRGISSFLTNLECYCDNSFVTCVQGDGLILSTTSGSTAYSLAAGGSMVHPQVPGILFTPICPHSLSFRPLIFPEHVTLRVQVPFNSRSPAWASFDGKDRKQLAPGDALVCSMAPWPVPTACLDDSTNDFLRSIHEGLHWNLRKTQSFDGPRET

SEQ ID NO: 210222 - protein, 35 aa, Glycine max
  Coding DNA Sequence Number=SeqID_93444
MADSQYTSDEEHSHSMDVTITLGHIFYKGAVESFH

SEQ ID NO: 210223 - protein, 94 aa, Glycine max
  Coding DNA Sequence Number=SeqID_93445
  Subcellular localization annotation: CTP_CleavageSite=37; ConfidenceScore=5.30e-01
MASIIVVICSFMASVATYPSAKVRKGQIYRPKRLSPREKMSRVATNIYLRKTLEKPKRRRSVDFKNEGSGVVYAHGRVPLLLHILRCYEEFRPT

SEQ ID NO: 210224 - protein, 301 aa, Glycine max
  Coding DNA Sequence Number=SeqID_93446
MGETEKMQKQIKANLEAMKDQMATMIVAMMSMKKIMEVNTAVVAATSVVAKVDLTPTFGLNQINHVISDMVGQRGIELGSTGGPHFVHVQNKHSFPPYGLAPNHTPPNVAHTPNEDVDNSTPIPIESQQPQVDHAHVSQSTGETHEISHHNLTDFEPRLGYATKGQAVGGVPLPNTLEGPQFLLQPQPQPLHFTMGRILLAMAEKVKLDNIEERLGAIKGDGSYAFADMAELCLVPDIAIPPKFKVPDFNKYKGTTFPKNHLKVYCKKMRAYTKDEKLLMHFFQGRLTGATVTWYTNLEPS

SEQ ID NO: 210225 - protein, 110 aa, Glycine max
  Coding DNA Sequence Number=SeqID_93447
MAEDIASLEEKQFLAESVFAFHHLGFSHKPFFANTTYYPHPHTFSPLAKIQMPKAGKIIILFLNCTVHANFVILSCFGLSIKQLRLKRFSDPTWTPRLQVYVLGADNLDG

SEQ ID NO: 210226 - protein, 119 aa, Glycine max
  Coding DNA Sequence Number=SeqID_93448
  Gene Ontology: Mol. function=protein binding; Biological process=two -component signal transduction system (phosphorelay)
  Homolog annotation: Hit_ID=Q659H7; Match level="QueryCoverage=76%, HitCoverage=66%, E-value=9e-22, Identity=54%"; Hit description =Putative histidine-containing phosphotransfer protein 3
MDGFLDDQFNQLQKLQDESSPYFVMEVKGNVNYLYDLCREQKPVDFKSVDSNVHQFKGSSASVGVARVKDVCTNFRNICEAQNLEGRVVQSENSFSITFSPLPFLNMHFIALKCVYRIL

SEQ ID NO: 210227 - protein, 106 aa, Glycine max
  Coding DNA Sequence Number=SeqID_93449
MLKPIPTMFTIHGLWPQNNLPKPPPISIYSSCLEISTLNGINGSFFWHLMIIGFGSMSEANMERVHQNKFQQNAYLNLKLTYKRKIDLDLVAILARAYIVPHTIMT

SEQ ID NO: 210228 - protein, 391 aa, Glycine max
  Coding DNA Sequence Number=SeqID_93450
  Gene Ontology: Mol. function=protein binding; Cellular component =cellulose and pectin-containing cell wall; Biological process =protein amino acid phosphorylation
  Homolog annotation: Hit_ID=Q9ZT98; Match level="QueryCoverage=97%, HitCoverage=96%, E-value=1e-141, Identity=65%"; Hit description =Putative leucine-rich repeat protein
  Pfam annotation: Domain name=FNIP; Domain location=152-223; Score =7.8; E_value=0.098; Accession=PF05725.3; Description=FNIP Repeat
  Pfam annotation: Domain name=LRRNT_2; Domain location=23-64; Score =46.0; E_value=1.2e-10; Accession=PF08263.3; Description=Leucine rich repeat N-terminal domain
  Pfam annotation: Domain name=LRR_1; Domain location=120-142; Score =16.1; E_value=0.13; Accession=PF00560.23; Description=Leucine Rich Repeat
  Pfam annotation: Domain name=LRR_1; Domain location=144-166; Score =20.4; E_value=0.0064; Accession=PF00560.23; Description=Leucine Rich Repeat
  Pfam annotation: Domain name=LRR_1; Domain location=168-189; Score =11.7; E_value=1.8; Accession=PF00560.23; Description=Leucine Rich Repeat
  Pfam annotation: Domain name=LRR_1; Domain location=191-211; Score =8.4; E_value=7.8; Accession=PF00560.23; Description=Leucine Rich Repeat
  Pfam annotation: Domain name=LRR_1; Domain location=214-236; Score =13.3; E_value=0.89; Accession=PF00560.23; Description=Leucine Rich Repeat
  Pfam annotation: Domain name=LRR_1; Domain location=238-260; Score =12.4; E_value=1.4; Accession=PF00560.23; Description=Leucine Rich Repeat
  Pfam annotation: Domain name=LRR_1; Domain location=261-282; Score =4.5; E_value=41; Accession=PF00560.23; Description=Leucine Rich Repeat
  Pfam annotation: Domain name=LRR_1; Domain location=283-302; Score =8.5; E_value=7.3; Accession=PF00560.23; Description=Leucine Rich Repeat
  Pfam annotation: Domain name=LRR_1; Domain location=304-327; Score =12.3; E_value=1.4; Accession=PF00560.23; Description=Leucine Rich Repeat
  Pfam annotation: Domain name=LRR_1; Domain location=331-361; Score =6.6; E_value=17; Accession=PF00560.23; Description=Leucine Rich Repeat
  Pfam module annotation: Pfam domain module=FNIP::LRRNT_2::LRR_1::LRR _1::LRR_1::LRR_1::LRR_1::LRR_1::LRR_1::LRR_1::LRR_1::LRR_1; Domain location=152-223::23-64::120-142::144-166::168-189::191-211::214 -236::238-260::...
  Pfam module annotation: Domain location=261-282::283-302::304 -327::331-361
MDDVAFYSLLFLCFFQSVRGILDPNDFLALQSIRKSLHDVPGSNFFSSWDFTADPCNFAGVFCADDKVIALNLGDPRAGSPGLTGKLDPSISKLSALADFTVVPGRIYGPLPQSLSQLKNLRFLGLSRNFISGQIPSGLGQLRNLRTIDLSYNQLTGTIPPSIGAMPELTNLFLCHNRLSGSVPSFASSYSLTRLELKHNTLSGSFAEDSLPPSLQYLSLSWNRFTGPVDRLLTRLNRLNFLDLSLNQFTGPIPAQLFTFPLTNLQLERNQFSGPIQPVNEVTIQTVDLSYNRLSGEVSPMLASVQNLYLNNNGFTGQVPGSFVERLLAAGIQILYLQHNFLTGIAISPTAEIPVSSTLCLQYNCMVPPVQTACPFNAGKRKIRPAQQCNR

SEQ ID NO: 210229 - protein, 478 aa, Glycine max
  Coding DNA Sequence Number=SeqID_93451
  Gene Ontology: Mol. function=ligase activity; Cellular component =nucleus; Biological process=embryonic development ending in seed dormancy
  Homolog annotation: Hit_ID=Q2HRN6; Match level="QueryCoverage=94%, HitCoverage=87%, E-value=1e-158, Identity=61%"; Hit description =Pentatricopeptide repeat
  Pfam annotation: Domain name=PPR; Domain location=158-191; Score =16.8; E_value=0.076; Accession=PF01535.11; Description=PPR repeat
  Pfam annotation: Domain name=PPR; Domain location=194-228; Score =19.3; E_value=0.014; Accession=PF01535.11; Description=PPR repeat
  Pfam annotation: Domain name=PPR; Domain location=229-263; Score =28.2; E_value=2.8e-05; Accession=PF01535.11; Description=PPR repeat
  Pfam annotation: Domain name=PPR; Domain location=264-298; Score=5.6; E_value=1.6; Accession=PF01535.11; Description=PPR repeat
  Pfam annotation: Domain name=PPR; Domain location=439-473; Score=8.1; E_value=0.82; Accession=PF01535.11; Description=PPR repeat
  Pfam module annotation: Pfam domain module=PPR::PPR::PPR::PPR::PPR; Domain location=158-191::194-228::229-263::264-298::439-473
MDSQTPKPLPLGPRRLSHHRNLNSVPYACSDLIPLFTAKSCSSAKEDLINKASILKNELIRESSDSARVLSILDDNSDTLIQRHPDGSVLLRLMNQLNSNPSLALQVFSWRRKRSNVENPMDAYEYSKGIKAAGRSGNVDLAVKLFKEAAVKGIKTTSTYNALMGACMSNGLADNCQSLFCDLKRDPTCDPSIATYNILLSVFGRLMLVDHMEATFREIQKLTFTMNICTYNHMIAGYITAWMWDDMENVFQMLKRSPVEPNMKTYMLMLRGYANSGNLEKMEEIYSFITDRVDIKEISLIRCMICAYSRSSDADRLKKIELLLKFIPGKEYRPWLNVLLIKLYAKEDWLEKMENAINEAFEHGTSITTKGILRCIVATYYRYNAVEKLENFVRRAEISGWSICRSAYHCKLVMYGSQLPLMHNVLEEMEMVNLECTKKTLWIMYKAYMRNGQSSMVLKTLGQMFKHGYEVPLSAFPS

SEQ ID NO: 210230 - protein, 760 aa, Glycine max
  Coding DNA Sequence Number=SeqID_93452
  Gene Ontology: Mol. function=protein binding; Cellular component =nucleus
  Homolog annotation: Hit_ID=UPI00006604AC; Match level="QueryCoverage =53%, HitCoverage=45%, E-value=4e-31, Identity=27%"; Hit description =Homolog of Homo sapiens "Splice Isoform 3 of Breast carcinoma amplified sequence 3
  Subcellular localization annotation: CTP_CleavageSite=33; ConfidenceScore=5.52e-01
MKTGKGKNNGLLPNSLRIVSLCLKTVSTNATTVASTVRSAGASLAASISSSSEDHKDQVTWAGFDTLELDSSNLKRVLLLGYLNGFQVLDVEDASGFSELVSKRDGPVSFLQMQPLAVGCDGQEGFRKSHPLLLAVCGDDTSKVNHKSTSLSGVGRDGNVETQTRNNVNSSTVVQFYSLKSHSYVHVLRFRSTVCMIRCSSRIVAVGLATQIHCFDASTLENKLSVLTYPVTQLAGQGTTGVNVGYGPMALGRRWLAYASNSPLPSNLGCLSPQNFSASPGISPSTSPSSGSLVARYAMESSRHLAAGIIKYCQELLPDGSSSPVSSNSGVKVDRVTGIDADNAGMVVVQDFVSRSIISQFKAHTSPISALCFDPSGTLLVTASVYGNNINIFRIMPSFTCKSSATPSSNWNSSHVHLYKLHRGITPAMIQDICFSNFSQWIAIVSSKGTCHLFVLSPFGGDTGFQIISSQGEEPSLLPVVSLPWWYTPASIPYQPSLPPPAPAVLSVASRIKYSSFGWLNTVHNSSTNVTEKVFVPSGAIAAIFHNSLSHSQQPVNSKAKPLEHILVYTPSGHVVQHELLPSVGLGTTDSGLRNQSTSVLHMQEDEFRVKVEPIQWWDVCRRSEWPERGDSCCSTFDRQGGIEGVQEKISYSDFHGLDFVGSRDEAGEKMVKSSSENMQDRFHWYLSNAEVQGNFGRLPIWQKSKICFYSMSCAGASFSGTGEFEIEKVPANEVEIRRKELLPVFDHFHSIRSSWNERW

SEQ ID NO: 210231 - protein, 176 aa, Glycine max
  Coding DNA Sequence Number=SeqID_93453
MYNYHEKGRAPDLESVLADFMTYQASSKDYQWESEWQPYYHNEAEGVSNLDDLLMQFKGTVDSMQQAFKRAETQIGQLVDNMIKVVVRIEEEYAKIETHQESILQVNTIHHQLITKEEKDEVSIIPEYPCIATTGYVVGKDKGRLELSVEDQKISFDLFEAMKHPDISDACFEEEE

SEQ ID NO: 210232 - protein, 73 aa, Glycine max
  Coding DNA Sequence Number=SeqID_93454
  Homolog annotation: Hit_ID=Q9LEG2; Match level="QueryCoverage=50%, HitCoverage=7%, E-value=4e-10, Identity=70%"; Hit description =Putative sugar transporter
MAIKEDVEGGTQNGIREPATFCGSYEFGASIFPVNIKGLAGSVATLTNWFVAWLCSHTFNFLMSWYLHLLCSN

SEQ ID NO: 210233 - protein, 472 aa, Glycine max
  Coding DNA Sequence Number=SeqID_93455
  Gene Ontology: Mol. function=protein serine/threonine kinase activity; Cellular component=membrane; Biological process=protein amino acid phosphorylation
  Homolog annotation: Hit_ID=Q8LI83; Match level="QueryCoverage=91%, HitCoverage=69%, E-value=1e-132, Identity=55%"; Hit description =Receptor protein kinase PERK1-like protein
  Pfam annotation: Domain name=Pkinase; Domain location=126-400; Score =144.2; E_value=3.6e-40; Accession=PF00069.15; Description=Protein kinase domain
  Pfam annotation: Domain name=Pkinase_Tyr; Domain location=126-400; Score=106.9; E_value=5.8e-29; Accession=PF07714.7; Description =Protein tyrosine kinase
  Pfam module annotation: Pfam domain module=Pkinase::Pkinase_Tyr; Domain location=126-400::126-400
MLSYLTGTTVGNVTDCRAYTQIYAASLSDQYGASDPGTAKCLFGLDFSSSGSGGKRRKILIAVVSVFCVLALAVFAGLWAYLRFKKRKEVAGTTELGLGSGLDSMNQSTTLIRFTFDDIKKATRNFSRDNIIGSGGYGNVYKGMLLDGSQVAFKRFKNCSVAGDASFTHEVEVIASVRHVNLVTLRGYCTATTNLEGHQRIIVTDLMENGSLYDHLFGSAKKNLSWPIRQKIALGTARGLAYLHYGAQPSIIHRDIKASNILLDHHFEAKVADFGLAKFNPEGMTHMSTRVAGTMGYVAPEYALYGQLTDRSDVFSFGVVLLELLSGRKALQTDNDGQPAALTDFAWSLVRNGSALDVVEDGVPEPGPPEVLEKYVLVAVLCSHPQLYARPTMDQVVKMLETDESVPSLMERPIPFIAGRLDIEKSALSNSGHLCSPTGYQAYTLQARRKSNSKEEEEEEEGSSVAETVTTD

SEQ ID NO: 210234 - protein, 576 aa, Glycine max
  Coding DNA Sequence Number=SeqID_93456
  Gene Ontology: Mol. function=protein serine/threonine kinase activity; Cellular component=membrane; Biological process=protein amino acid phosphorylation
  Homolog annotation: Hit_ID=Q8LI83; Match level="QueryCoverage=81%, HitCoverage=76%, E-value=1e-116, Identity=48%"; Hit description =Receptor protein kinase PERK1-like protein
  Pfam annotation: Domain name=Pkinase; Domain location=276-550; Score =140.7; E_value=3.9e-39; Accession=PF00069.15; Description=Protein kinase domain
  Pfam annotation: Domain name=Pkinase_Tyr; Domain location=276-550; Score=110.2; E_value=6.2e-30; Accession=PF07714.7; Description =Protein tyrosine kinase
  Pfam module annotation: Pfam domain module=Pkinase::Pkinase_Tyr; Domain location=276-550::276-550
  Subcellular localization annotation: CTP_CleavageSite=36; ConfidenceScore=5.56e-01
MPLFVFLATIFLTLPTLSLSVTSCLLNTTLLRSRPSSSVDSATRCRYILQTIRVLQSDYLHRTGFFFPPSSSSFSCWNTLQSSINQYDIRSSCNLPSSSISLSCNNITTKSQFENSLPNSALKPVWSTCNQSLKSSLACSQCNKTLSKLDSFLTEPSTGELVDCKAIASIYAASFSDPQDSGTANCLFNFGFSSSVSSGKRRNIPVVVFSVLAFFLLVFGALWAYFRFKQKQKKKDIGKIEMGLGSGLDSGFDSLNQSTTLIRFTFDEIKKASRNFAGDNIIGKGGYGNVYKGVLFDGTRVALKRFKNCSVAGDASFTHEVEVIASVRHVNLVALRGYCTATTNLEGHQRIIVTDLMENGSLCDHLFGSAKKKLSWSIRQKIAFGTARGLAYLHYGAQPSIIHRDIKSSNILLDHNFEAKVADFGLAKFNPEGMTHMSTRVAGTKGYVAPEYALYGQLTERSDVFSFGVVLLELLSGKKALHVDNDGQPSALTDFAWSLVRNGKALDVIEDGMPELGPIEVLEKYVLVAVLCCHPQLYARPTMDQVVKMLETEELEQPISSIAGRIDVDEKSVSSN

SEQ ID NO: 210235 - protein, 71 aa, Glycine max
  Coding DNA Sequence Number=SeqID_93457
  Gene Ontology: Cellular component=protein complex
  Homolog annotation: Hit_ID=O65048; Match level="QueryCoverage=97%, HitCoverage=49%, E-value=2e-23, Identity=74%"; Hit description =Hypothetical protein Sb08
  Pfam annotation: Domain name=UMP1; Domain location=1-62; Score=4.2; E_ value=0.00013; Accession=PF05348.2; Description=Proteasome maturation factor UMP1
MEIADMFQRPPGPIPSSMLGLETVTGSVDHFGFEDCLNDPRESETFRPLDMHHGMEVRLGLSKGPVYPSII

SEQ ID NO: 210236 - protein, 92 aa, Glycine max
  Coding DNA Sequence Number=SeqID_93458
MTKTIMKINRKPEKMFNIVHIKDQPYDEVNRSFVVRLKDQLKHTWYLLNSNDHMHLVTYNQDLVNPTILVGWTKLKDFYGLTGNHQVIMTYF

SEQ ID NO: 210237 - protein, 329 aa, Glycine max
  Coding DNA Sequence Number=SeqID_93459
  Gene Ontology: Mol. function=phosphoglycerate kinase activity; Biological process=glycolysis
  Homolog annotation: Hit_ID=Q9C735; Match level="QueryCoverage=56%, HitCoverage=36%, E-value=6e-13, Identity=29%"; Hit description=Nt -gh3 deduced protein, putative
  Pfam annotation: Domain name=GH3; Domain location=1-316; Score= -212.7; E_value=1.9e-07; Accession=PF03321.4; Description=GH3 auxin -responsive promoter
  Subcellular localization annotation: CTP_CleavageSite=47; ConfidenceScore=5.13e-01
MKPKLIPYFDSSLSKAASFIGHRGSVAVRQRLFPPRPEVSKILWFLYAENITTTKCGLKVMTASTYPLQSVILGTHVEHQMYCHLLYGLRNLDLIDGITTPYAIGLIKAFGFLESKHNATLRDNTVCDASNFCLLEFLPFNMKEDKDVSKGTMDYSSVEVGKMYEVVVTTYRGYYRYRMGDIVRVVGFYNSPPLVEYVMRAPKNPAEIVTEKDLISAESMPKQLKVFVEVQEESNFLDDKLEESVKVLRSCISSLSSGLGAIYKVQRDKGQLRNLLIFIIRPGAFDQLSELAIKNGTSASQYKPPKIIRNHEVVKLLEKLAFVTVLFDG

SEQ ID NO: 210238 - protein, 205 aa, Glycine max
  Coding DNA Sequence Number=SeqID_93460
  Pfam annotation: Domain name=DUF1218; Domain location=9-156; Score =32.2; E_value=1.8e-06; Accession=PF06749.3; Description=Protein of unknown function (DUF1218)
MERKVLILCSVVAFLGLLSAATSFGAEATRIKVSQVHFVTPNQCTKNLQIPDSNWKVALACFVLSCQLDGCPNTVKPKNWYHLGFTQSRPELWSICHWFTFVIGFLLLLTGAALNDQRGEESVYFGYYYCYVVKPGVFAGGAILSVASAAFGILYYISLTEKNNGIQYPYPNQGVIAMAQPQIPSQTSQEPVFVHEDTYIRRQFT

SEQ ID NO: 210239 - protein, 528 aa, Glycine max
  Coding DNA Sequence Number=SeqID_93461
  Gene Ontology: Mol. function=oxidoreductase activity; Cellular component=integral to membrane; Biological process=electron transport
  Homolog annotation: Hit_ID=Q7FPQ4; Match level="QueryCoverage=89%, HitCoverage=90%, E-value=1e-125, Identity=46%"; Hit description =Cytochrome P450
  Pfam annotation: Domain name=p450; Domain location=51-514; Score =305.3; E_value=1.1e-88; Accession=PF00067.12; Description=Cytochrome P450
MHRYTDLNQKNIRMEEEADYRLIVITASVGFLLLFLYVLKSILLKSKNLPPSPPYALPLIGHLHLIKEPLHLSLHKLTDKYGPIIFLCLGTRKVLVVSSPSAVEECFTKNDITFANRPQTLAAKHLNYNKTTIGVASYGHYWRNLRRLTTVELFSTTRLAMLTSVRVEEVQLMVKQLFEECKGRQQIMIDLRARLLEVSFNIMLRMISGKRYYGKHAIAQEGKEFQILMKEFVELLGSGNLNDFFPLLQWVDFGGVEKKMVKLMKKMDSFLQKLLDEHCTRRNVMSEEEKERRKSMTLIDVMLDLQQTEPEFYTHETVKGVILAMLVAGSETSATTMEWAFSLLLNHPKKMNKVKEEIDTYVGQDQMLNGLDTTKLKYLQNVITETLRLYPVAPLLLPHESSNDCKVCGFDIPRGTMLLVNLWTLHRDANLWVDPAMFVPERFEGEEADEVYNMIPFGIGRRACPGAVLAKRVMGHALGTLIQCFEWERIGHQEIDMTEGIGLTMPKLEPLVALCRPRQSMIKVLSNI

SEQ ID NO: 210240 - protein, 45 aa, Glycine max
  Coding DNA Sequence Number=SeqID_93462
MDPTTAIKSMETESTLRMASGTTLAVDNQITLSVKSNLLFGDKEG

SEQ ID NO: 210241 - protein, 129 aa, Glycine max
  Coding DNA Sequence Number=SeqID_93463
  Gene Ontology: Mol. function=endonuclease activity
  Homolog annotation: Hit_ID=Q9ZU86; Match level="QueryCoverage=59%, HitCoverage=17%, E-value=2e-30, Identity=80%"; Hit description =Expressed protein
MGKPTPKVEVMKHLKSRHYTDAKDFSGECEPVVMIAKGQSVQGTCKYGTRVDYILSSSDSPYKFVTGSYLVLSSKGTSDHHIVKVDVVKVNSNPQENLTKKQGQPRQKVARIKPSPSKCIWKTHTGDID

SEQ ID NO: 210242 - protein, 107 aa, Glycine max
  Coding DNA Sequence Number=SeqID_93464
  Homolog annotation: Hit_ID=Q9SI32; Match level="QueryCoverage=86%, HitCoverage=27%, E-value=5e-37, Identity=73%"; Hit description =Expressed protein
  Pfam annotation: Domain name=Scramblase; Domain location=1-107; Score= -58.8; E_value=2.4e-06; Accession=PF03803.6; Description=Scramblase
MTRVELNHDDDFSHAKVAPLLARSNLLITRDIEWANLVLGFEQPVGFIREQSNIITRQLLRLRRPFVAYITDALGNKLFRVCRPFWWITSSIYAEIDGKEVGVVHRR

SEQ ID NO: 210243 - protein, 716 aa, Glycine max
  Coding DNA Sequence Number=SeqID_93465
MDFHTLSRKQLQALCKKNKIPANITNVAMADALAALNQVEGLDDFFNPSEGDVGTPSVNHRTVVRTSTQRKAAIEEAEGLKVKTSTRRVRVAEEVVEQENKDANAPPITPAASRRRATAVSTRRKKEVEMVEEDAGVQGNPKTPAAVAPVSRRRATSRSVCTTKIETPGAHGTSVYNTRRSVRLLEKDLSKMSLLDTEDTTGLVKIDGDVSQDSSNVSHQLEEDSSGNEKGDSLQMESTVVSGDTRELEVCSLEKNTEYECQSRDLDSDVKLVSVTEIDMLVEPHGPNEAGSEKVNCLELEAEPNASDEAGSESLPVLEESYDSSELETQNNFPLEASEDAFPEVTIGQDIAAVTVVVPDDVSEDVTHQKVAASLPMQSECIVDDKVSYEGDVKEDKNNEPREEDEPYDSNLKLEGSIDTCDKSDDADAPMEVAHQDTVVVADDVFDQDVAGTLPMSPVNDALKEFVECNTDDDQGINKGDDNQDMNSETENLNLADGNMAHEDYQHPFNDDEKSADERDSMTGSEGGFVELESISHSAAIEVCTESSLPDVEAEENTSENLEAEESEEPVAGEDVMLEAGDAFSSPRIPLVHQQVSVESIGNYIVSCPLDVELSCKSNTMVDGDVVSEDNAITNKEEPRLSMDSITENSIQEQLKVDVHNTKMMKENVTSDDLNNKSLGELKRMLRQLTLNEKPKSKTNDVKVRPIPLPNYHCIF

SEQ ID NO: 210244 - protein, 757 aa, Glycine max
  Coding DNA Sequence Number=SeqID_93466
  Gene Ontology: Mol. function=ATP binding; Cellular component=nucleus; Biological process=regulation of transcription, DNA-dependent
  Homolog annotation: Hit_ID=P59278; Match level="QueryCoverage=31%, HitCoverage=41%, E-value=3e-30, Identity=36%"; Hit description =Uncharacterized protein At1g51745
MDCGVGSIVWVRRRNGSWWPGQILGHDDLSAAHLTSPRSGTPVKLLGREDASVDWYNLEKSKRVKAFRCGEFDDCIEKAEAAQGGPLKKREKYARREDAILHALELEKQILKKPGKSGARSLNAVNKGAVASPQETLGNDYENHANLNVYCENETGGGTFASEVAKDGNQLRVEVDYSETTTPRMRDLQDFGLRIAPVKKKLSSSVDPYISQKRIVDNGARVLASGGGIRTGSALLMNGAGQIGASRAKRSRYGHFPAEFSDSLEYRETLPRVEMSPSQHRREFPYHGSLVQDAEYTFMDDVESDSSETASTDSDSDSSETEADMDEEMTIFSAFFHIILHGFTQDVPITAETGHDAEEHESTSSEELDELPISSDMPHLYPRDLITCSDAVSKWQLKGKRNNRNLVKRSVGASDGKCIMYGAGADVEGRNGHLRHNRKGPSLHCYKFDFGDTLDDDDQIFGLEDEYSLITYRSISKSQNKIHHGVAWNDLAWDDHLASKGHWDVKAYSPVYGDRCDFGGRVRPMLVDVDLKVQASYRKEHVPFISLMSKLDGRAIVGHPIQVEALKDGSSDILFPATDDFGNDGIAIEGSSVLPPAWRTARRTANFRVPRPHVPSSNGAEVAAELPSSDQEQNFEYRSLNAGSSSHQVSLQKKSGLKSHRSSADKESSKKVPKKSGLSSSQKTRTLSSLSTEHNLNRKPLHDSSSYQTDRLTKPEISGPTTVACIPVQLVFSRLLEKINRPPLKTASNAALLNTGV

SEQ ID NO: 210245 - protein, 543 aa, Glycine max
  Coding DNA Sequence Number=SeqID_93467
  Gene Ontology: Mol. function=binding; Cellular component =intracellular; Biological process=RNA processing
  Homolog annotation: Hit_ID=Q9FND1; Match level="QueryCoverage=99%, HitCoverage=96%, E-value=0.0, Identity=58%"; Hit description =Arabidopsis thaliana genomic DNA, chromosome 5, P1 clone:MRH10
  Pfam annotation: Domain name=DUF946; Domain location=3-541; Score =1142.0; E_value=0; Accession=PF06101.2; Description=Plant protein of unknown function (DUF946)
  Subcellular localization annotation: CTP_CleavageSite=47; ConfidenceScore=5.33e-01
MVQTFSLPAPISQWPQGQGFASGLVNLGEIQVSKVTRFEFISSSSVMLDTKKAVTFFRPVGVPESFHILGHYCQPSGKPLHGFVLVAKICSPQNADTIPPLKNPLDFKLVWSHNAASMEIPGVYFWLPEPPEGYKALGYLVTNKHDKPLLDEMCCVRADLTDKCEPYRQILAAGSRIPEFSFQVWSLRPCDRGMLGKGVSVGTFFCSNGWTMGEELLPVACLKNLNPVLPAMPDLQQIHALIKHYGPTVFFHPQEKYLPSSVDWFFNNGAMLHKKGVSKGEGIDASGSNLPSGGTNDGQFWIDLPSDHDRKNFVKRGDLKSSRLYVHVKPALGGTFTDIAMWVFCPFNGPATLKIGIKSIPLSKVGEHVGDWEHFTLRICNFSGELYSIYFSQHSGGEWVDAYDLDYIKGYNKATVYSSKCGHASYPHPGTYMQGSSKLGIGIRNDAARSNLYVDSSVHYELVAAEYLENDVTEPQWLQFMREWGPKIVYDTKTELDKVINALPRMLRYSVRNLFNKFPVELYGEEGPTGPKEKNNWIQDERW

SEQ ID NO: 210246 - protein, 315 aa, Glycine max
  Coding DNA Sequence Number=SeqID_93468
  Homolog annotation: Hit_ID=Q9W2U4; Match level="QueryCoverage=33%, HitCoverage=17%, E-value=8e-07, Identity=35%"; Hit description =CG2890-PA, isoform A
  Pfam annotation: Domain name=PPP4R2; Domain location=118-309; Score= -47.3; E_value=0.0012; Accession=PF09184.1; Description=PPP4R2
METQSHEDLQQPPPVTSNEAHSDDASDHRDAEQKQDILSTEEVVQILQVVASTGRFCPRQGCAHLMGFLTLSTLRPKHYSVVTGLLGLYRVLRLQLSQQQITTGIAAILAAPVNSTTAATSLYPLHPAVLLGVGCAAWHDWDKLKSMLSFQLKQVLSEYPEAKMTSEQQYASLGESYIELVNKLDEALTCFIEGPPFTLQRLCEILLDAKGIYPNLSKLALALEKNLLVTSTLTICTDPYPQATEKEPDDQEKASEKQQQQQQSDSAQNGIEPLVSDNDEVMPEADVGDDMTIDMEAFEGVKSSEINSEPNANNA

SEQ ID NO: 210247 - protein, 185 aa, Glycine max
  Coding DNA Sequence Number=SeqID_93469
VVPGDMSRGSGDLGDVRRAPGSQPIKEQRPQSKEACVVAGQLWILSDIWNMASGYRLPRIAMAAQLIHDHVEMECLEGVWETLEGNARCRFRGTIRLTATSLVHPEEPARTLQRTVEWILPTPTPYQLVEPVQVIEELPPEPAVDALDFPEGDEDPLPDVDSPEDVMPASEADSTKKSGPGGTTT

SEQ ID NO: 210248 - protein, 73 aa, Glycine max
  Coding DNA Sequence Number=SeqID_93470
MGLPEGSKRRRCLLVEVTLLASASWVTTTSLFSPINRGKREEQKCSALLVLRNLSKLMRKIVSVKKIQAEVLP

SEQ ID NO: 210249 - protein, 254 aa, Glycine max
  Coding DNA Sequence Number=SeqID_93471
  Gene Ontology: Mol. function=transcription factor activity; Cellular component=nucleus; Biological process=regulation of transcription
  Homolog annotation: Hit_ID=Q9FL03; Match level="QueryCoverage=89%, HitCoverage=39%, E-value=9e-72, Identity=63%"; Hit description =SCARECROW gene regulator
MNNPFWKLMEEIIYNTYPIQRLYLSRERNTLHQNPPLLFVLHTLPPHRPGPPNDRRDSPPEKKTLHLKPLRRVRGQIRLQRLKHSREVLKRSLEAVDKAETCDACFVLAKGDNFGVQRLGQPERSVNSGGRLVEEVIQLEHEVNSQGFVSVVNAEAVAVELVNGSENRSEVEVQVEKLGEVGEAVGGGGERGAGRGTKGEGGDAGDSDLIGLSRRTSGESLQECGPLNPLDDTEVDDVDVGGGLGGFKDGLVGG

SEQ ID NO: 210250 - protein, 567 aa, Glycine max
  Coding DNA Sequence Number=SeqID_93472
  Gene Ontology: Mol. function=protein transporter activity; Cellular component=nuclear pore; Biological process=protein import into nucleus, docking
  Homolog annotation: Hit_ID=Q1SB44; Match level="QueryCoverage=99%, HitCoverage=51%, E-value=0.0, Identity=88%"; Hit description =Importin-beta, N-terminal
  Pfam annotation: Domain name=CRM1_C; Domain location=191-526; Score =714.6; E_value=7e-212; Accession=PF08767.1; Description=CRM1 C terminal
MVIRDLLNLCEITKGKDNKAVIASNIMYVVGQYPRFLRAHWKFLKTVVNKLFEFMHETHPGVQDMACDTFLKIVQKCKRKFVITQVGENEPFVSELLTGLPITIADLEPHQIHSFYESVGHMIQAESDAQKRDEYLQRLMELPNQKWMEIIGQAHQNVDFLKDQDVIRTVLNILQTNTSVATSLGTYFLPQISLIFLDMLNVYRMYSELISKSITEGGPFASRTSYVKLLRSVKRETLKLIETFLDKAEDQPQIGKQFVPPMMDPVLGDYARNVPDARESEVLSLFATIVNKYKAAMIEDVPRIFEAVFQCTLEMITRNFEDYPEHRLKFFSLLRAIATHCFPALICLSSQQLKLVMDSIIWAFRHTERNIAETGLNLLLEMLKKFQGSEFCNQFYRTYFLTIEQEIFAVLTDTFHKPGFKLHVLVLQHLFCLVRNKNNNEFHLFQLETGALTEPLWDVATSQYSYSSNAVFVREFTIKLLSTSFPNMTSAEVTQFVNGLFESTNDLSTFKNHIRDFLIQSKEFSAQDNKDLYAEEAAAQRERERQRMLSIPGLIAPSELQDEMVDS

SEQ ID NO: 210251 - protein, 337 aa, Glycine max
  Coding DNA Sequence Number=SeqID_93473
  Gene Ontology: Mol. function=transcription factor activity; Cellular component=nucleus; Biological process=regulation of transcription
  Homolog annotation: Hit_ID=Q9FL03; Match level="QueryCoverage=80%, HitCoverage=50%, E-value=5e-89, Identity=66%"; Hit description =SCARECROW gene regulator
  Pfam annotation: Domain name=GRAS; Domain location=1-200; Score =144.7; E_value=2.5e-40; Accession=PF03514.5; Description=GRAS family transcription factor
LNDACPYSKFAHLTANQAILEATQTASNIHIVDFGIVQGIQWAALLQAFATRPSGKPNKIRISGIPALSLGSSPGPSLSATAHRLSDFAKLLDLNFHFTPILTPIHQLDRNSFCIDDTNEALAVNFMLQLYNLLDEPPTAVDTALRLAKSLNPKIVTLGEYEASVTRFGFVNRFKTAFKYFSAVFESLEPNLAADSPERFQVESLLLGRRIAAVIGGPGSVRRESMEDKEQWRVLMERAGFESFSVFAGGIYTTGVFVSGLEGCSSLDRLLLALVNGFDLVDCYWKGFPPGPFFPAPSLSSWHSTAETGKMSPERDKGDCHCCFWTCVIATSQGRDL

SEQ ID NO: 210252 - protein, 523 aa, Glycine max
  Coding DNA Sequence Number=SeqID_93474
  Gene Ontology: Mol. function=protein transporter activity; Cellular component=nuclear pore; Biological process=protein import into nucleus, docking
  Homolog annotation: Hit_ID=Q1SB44; Match level="QueryCoverage=95%, HitCoverage=48%, E-value=0.0, Identity=89%"; Hit description =Importin-beta, N-terminal
  Pfam annotation: Domain name=IBN_N; Domain location=37-103; Score =70.9; E_value=4e-18; Accession=PF03810.9; Description=Importin-beta N-terminal domain
  Pfam annotation: Domain name=Xpo1; Domain location=114-258; Score =209.7; E_value=6.8e-60; Accession=PF08389.2; Description=Exportin 1 -like protein
  Pfam module annotation: Pfam domain module=IBN_N::Xpo1; Domain location=37-103::114-258
MAAEKLRDLSQPIDVPLLDATVAAFYGTGSKEERNAADQILRELQNNPDMWLQVMHILQKTQNLNTKFFALQVLEGVIKYRWNALPVEQRDGMKNFISDVIVQLSSNDASFRAERLYVNKLNIILVQILKHEWPARWRSFIPDLVSAAKTSETICENCMAILKLLSEEVFDFSRGEMTQQKIKELKQSLNSEFQLIHELCLYVLSASQRTELIRATLSTLHAFLSWIPLGYIFESPLLETLLKFFPVPAYRNLTLQCLTEVAALQFGNYYDVQYVKMYNIFMVQLQGMLPPTTNIPEAYAQGSGDEQVHIRILESTQENIAALLLGLEYLTNISYVDDTEVFKVCLDYWNSLVSELFEPHRSLDNPAASATMMGLQVPAMLPGMVDGHGSQLLQRRQLYAGPMSKLRMLMICRMAKPEEVLIVEDENGNIVRETLKDNDVLVQYKIMRETLIYLSHLDHDDTEKQMLRKLSKQLSGEDWTWNNLNTLCWAIGSISGSMMEEQGLRSSLNDIKYPIVNLTFNSG

SEQ ID NO: 210253 - protein, 205 aa, Glycine max
  Coding DNA Sequence Number=SeqID_93475
  Gene Ontology: Mol. function=GTP binding; Cellular component =intracellular; Biological process=small GTPase mediated signal transduction
  Homolog annotation: Hit_ID=Q1SE73; Match level="QueryCoverage=99%, HitCoverage=100%, E-value=1e-101, Identity=87%"; Hit description=Ras GTPase
  Pfam annotation: Domain name=Arf; Domain location=4-187; Score=331.2; E_value=1.8e-96; Accession=PF00025.11; Description=ADP-ribosylation factor family
  Pfam annotation: Domain name=MMR_HSR1; Domain location=18-139; Score=- 3.1; E_value=0.0019; Accession=PF01926.13; Description=GTPase of unknown function
  Pfam annotation: Domain name=Miro; Domain location=19-139; Score=3.4; E_value=0.0026; Accession=PF08477.3; Description=Miro-like protein
  Pfam annotation: Domain name=Ras; Domain location=19-189; Score= -66.0; E_value=0.00025; Accession=PF00071.12; Description=Ras family
  Pfam module annotation: Pfam domain module=Arf::MMR_HSR1::Miro::Ras; Domain location=4-187::18-139::19-139::19-189
MGQAFRKLFDTFFGNTEMRVVMLGLDAAGKTTILYKLHIGEVLSTVPTIGFNVEKVQYKNVVFTVWDVGGQEKLRALWRHYFNNTDGLIYVVDSLDRERIGKAKQEFQILNRSMDYLQTIINDPFMLHSIILVFANKQDLKGAMSPREICEGLGLFDLKNRKWHIQGTCALRGDGLYEGLDWLSTTLKERRAAGYSSIGLGTSSF

SEQ ID NO: 210254 - protein, 169 aa, Glycine max
  Coding DNA Sequence Number=SeqID_93476
  Homolog annotation: Hit_ID=Q1SE68; Match level="QueryCoverage=30%, HitCoverage=6%, E-value=7e-13, Identity=84%"; Hit description =Aminoacyl-tRNA synthetase, class Ia; Nucleic acid-binding, OB-fold, subgroup
MECVDSICRSGNAINVKLVALSPIGNWHSWILSQKEKSRSLKKKGLDTYRWLDEMSKIREKQVDSHGTYFRGQFTISLIHYHLQIAHTGEHTYYLGLMIWYRMDGGNHATSSSFVCKSTRNVSQTFFFELKSSSGLATFIPWECNSFSWLSRTGRLNQLKLEGAQQSDI

SEQ ID NO: 210255 - protein, 98 aa, Glycine max
  Coding DNA Sequence Number=SeqID_93477
  Subcellular localization annotation: CTP_CleavageSite=68; ConfidenceScore=5.76e-01
MGNSHAKKRDTQFSRNVVKGRVPSPKDKTLSSLQSPSSPSQSPSPSLEPPREPPPPVMFFNTGSGKLSAKEKYALIPDNFTTLEQTLKRELGSNCGVD

SEQ ID NO: 210256 - protein, 104 aa, Glycine max
  Coding DNA Sequence Number=SeqID_93478
MDFFSRVKKVLRRGTSSERERFPTKNRGGSMVRCLPFQELNYFVAKTRCGEEMLKVQQVVGKESLAEGWQGKSIKDVGSCKNSVVGWSNMFVVFVKNLILKSKD

SEQ ID NO: 210257 - protein, 81 aa, Glycine max
  Coding DNA Sequence Number=SeqID_93479
MYLYLKILGSTKGLGDGVECVEEPPPEIFLIEEHDDHQKFQPRYPSNQQPHRQVDAGFSGWHIVDIHYINFSCALSTPVWN

SEQ ID NO: 210258 - protein, 106 aa, Glycine max
  Coding DNA Sequence Number=SeqID_93480
MKKTQKLRQQDLSGIFGGHPGKGSGDLFGALGGPQQRPTSGGCRSTVAWRYPTVAKDERSKLKWESLVSLSFPEKLGAWNPWKKYQSHMQMAGPKLRQRQPIVRPA

SEQ ID NO: 210259 - protein, 103 aa, Glycine max
  Coding DNA Sequence Number=SeqID_93481
  Gene Ontology: Mol. function=metal ion binding
  Homolog annotation: Hit_ID=Q6YYC5; Match level="QueryCoverage=82%, HitCoverage=21%, E-value=8e-37, Identity=81%"; Hit description =Copine I-like protein
  Pfam annotation: Domain name=Copine; Domain location=20-102; Score =48.8; E_value=1.8e-11; Accession=PF07002.6; Description=Copine
MDCQCIHVVIEGSVSFNNKSLHAIGSTANPYEKAISIIGKTLAPFDDDNLIPCFGFGDATTHDQEVFSFHSDHSPCHGFEEVLACYQKVVPNLRLSGNFHLSL

SEQ ID NO: 210260 - protein, 162 aa, Glycine max
  Coding DNA Sequence Number=SeqID_93482
MSDDNTKAWNQILLLTIVLAIWWLLCHLAEDRETNPIDNEVDDELGEILEHPNGELDHYFDEDGHHRAAEPGGDANGRHGGCSICGNFSTTRCASCKAARYCRGLLLKTIYGRGSLLKQIGVPLFVAASEGISPLVLAGRANVNSPAIGTCGTLISLKACRQ

SEQ ID NO: 210261 - protein, 117 aa, Glycine max
  Coding DNA Sequence Number=SeqID_93483
SAKCQIIHWRSGHKYECSESEITADEARPTHDHGTSKLVEKSEMAILLPKTNPNLTNVTYSGDEVVVDDSAFVSHPSLGDRSILGERCRNFKKRVMGTIWNRDATSKTGVSNLRRRR

SEQ ID NO: 210262 - protein, 200 aa, Glycine max
  Coding DNA Sequence Number=SeqID_93484
  Gene Ontology: Mol. function=RNA-directed DNA polymerase activity; Biological process=RNA-dependent DNA replication
  Subcellular localization annotation: CTP_CleavageSite=19; ConfidenceScore=5.74e-01
MKNSATGSPTFSTQRSCPSLSMVLSRGISKLVTLNKLSLNNGPSNSIHPSNALFVNDVLVFCKGTSGNLNNLVNLLNHYGSNLGQILNLHKCKFYSSPLSSARLCAIKSILRFQQGNFPFDCLGIPFLQVKSVISGMLAYNFNVYRWPKCGSKASKFILMMPKTQDKNQDSSKFQESKSHSIKIQVKIQEKTQDMQELQE

SEQ ID NO: 210263 - protein, 204 aa, Glycine max
  Coding DNA Sequence Number=SeqID_93485
MGVKYLEAVKQRLQAIKEWSPNEIRVAPKKLAMRAKKTAAGEGSSTTPPGKYTKFTIEITRRNWRQLAEPMPKYDPEVVLEFYANAWLNEEGQQCEYTSWRGKTISFDEEAIEPPRHPVDPSKSNKALGFPALIIGLCQFYGMSATPAKHIRSPINRSFIDKYCMPRKEEACPVVSQEVSQGDGGRAEEDKDMVDLVDYCIGGN

SEQ ID NO: 210264 - protein, 99 aa, Glycine max
  Coding DNA Sequence Number=SeqID_93486
MVQIVYTSGKERSTGSVGCQRWSSGFYYCMDAKEKGKRENHGEDRLDYKVGTAKNEVDQNQVEDFEVTRLEIGCKIKTIEASRTGNLSANLEIVELVTS

SEQ ID NO: 210265 - protein, 401 aa, Glycine max
  Coding DNA Sequence Number=SeqID_93487
  Gene Ontology: Mol. function=nucleoside-triphosphatase activity; Cellular component=cellulose and pectin-containing cell wall
  Homolog annotation: Hit_ID=Q9M9M5; Match level="QueryCoverage=87%, HitCoverage=56%, E-value=1e-146, Identity=74%"; Hit description =Putative 26S proteosome regulatory subunit
  Pfam annotation: Domain name=TolA; Domain location=22-371; Score= -144.7; E_value=0.032; Accession=PF06519.2; Description=TolA protein
MAKTYAAGLLSAIAAATAAASLNQNNAYADGILPPNPSEIEPSPAPPPPKVRNDHPRTTSAGFDPEALERGVKALREISKSPHGKKVFEVIKKQEETKQTELSAKVAEFRQMKAQHETERQRIIYDEQKKLAQHQAQTKSQMAKYEDELARKRMQAENEYHRARNQELVKLQEESSIRQEQARRATEEQIQAQRRQTEREKAEIERETIRVRAMAEAEGRAHEAKLAEDVNRRMLVDRANAEREKWVAAINTTFEHIGGGLRAILTDQNKLVVAVGGVTALAAGVYTTREGARVIWGYIDRILGQPSLIRESSRGKYPWSGMFSRTMSSLSRHTNPGSALKNGNGFGDVILHPSLQKRIQQLSSATANTKAHQAPFRNMLFYGPPGTGKTMAARELARKSV

SEQ ID NO: 210266 - protein, 101 aa, Glycine max
  Coding DNA Sequence Number=SeqID_93488
MPASDGASPSSIEVQADLEQLSVIPMMAKQCSPRPKATPIPELGSVSLGGPYQEYNLVKDRDRCTIKHIVRYGFEELTKLIAFALLTSVGDPSSFQETMNS

SEQ ID NO: 210267 - protein, 112 aa, Glycine max
  Coding DNA Sequence Number=SeqID_93489
MHHSSCYHQEASIKHKDKLPPGPYPLRSHHWKSPSTHSSAKLAMIRKYATISYSPTKPLMQAKIIFDVKSATSPANIVFSKDLVQSSGKVLEQFKELVANIVKEGGKPNLAD

SEQ ID NO: 210268 - protein, 328 aa, Glycine max
  Coding DNA Sequence Number=SeqID_93490
  Gene Ontology: Mol. function=4-coumarate-CoA ligase activity; Cellular component=peroxisome; Biological process=phenylpropanoid metabolic process
  Homolog annotation: Hit_ID=P31687; Match level="QueryCoverage=99%, HitCoverage=58%, E-value=1e-136, Identity=74%"; Hit description=4 -coumarate--CoA ligase 2
  Pfam annotation: Domain name=AMP-binding; Domain location=2-254; Score=106.8; E_value=6.3e-29; Accession=PF00501.18; Description=AMP -binding enzyme
MEGENPNVYLKEEDVVLCVLPLFHIFSMHSVMMCALRAGSAILLIEKFEIRALLEEIERHRVTVAMVVPPLVVALAKNPAVEEYDLSSIRLVMSGAAPLGHQLEEVLRNRLPNAILGQGYGMTEAGPVLAMCLGFAKYPFPTKTGSCGTVVRNAELKVIHPLTALSLPPNHPGEICIRGQQIMKGYLNDEKATAATIDVDGWLHTGDIGYVDDDDEIFLIDRAKELIKFKGFQVPPAELEDLLMSHPSIADAAVVPQNDDAAGEVPVAFVVGFDLTEEAVKDFIAKQVVFYKRLHKVYFVPAIPKSPTGKILRKELRAKLASIIIQRT

SEQ ID NO: 210269 - protein, 306 aa, Glycine max
  Coding DNA Sequence Number=SeqID_93491
  Homolog annotation: Hit_ID=Q6YYC5; Match level="QueryCoverage=15%, HitCoverage=11%, E-value=2e-12, Identity=60%"; Hit description =Copine I-like protein
  Pfam annotation: Domain name=DUF593; Domain location=172-261; Score= -29.3; E_value=0.048; Accession=PF04576.6; Description=Protein of unknown function, DUF593
  Pfam annotation: Domain name=zf-C3HC4; Domain location=261-293; Score= 17.8; E_value=0.0023; Accession=PF00097.15; Description=Zinc finger, C3HC4 type (RING finger)
  Pfam module annotation: Pfam domain module=DUF593::zf-C3HC4; Domain location=172-261::261-293
MDWKWHKDHCIARVVDSTPIERPCRDVGLLKNSYEEEENIPSSGPLSLVFHPEGTTSFNSLVPVSHSKGSTNNVLYLEDEVAKSSQNLTSGRIERILLEKNSKVMCPIRIEGCPIACVEEYEKESIAEAETRACNVIHSLHERLTHLQNVVQENIAEKRKLEEDLQNLESECSDLKKQLQEEHKCAQRLTIEFDKRREAAQIAMREVEAVRQVLQEEREHTQRVKENFRRDVIFVEARATFAEEKLSDLYRKIRMSYYKVCSICLSNEKDLVFGCGHMTCRDCGSKLSKCPICREQITNHIKLFPG

SEQ ID NO: 210270 - protein, 367 aa, Glycine max
  Coding DNA Sequence Number=SeqID_93492
  Gene Ontology: Mol. function=binding; Biological process=metabolic process
  Homolog annotation: Hit_ID=Q10HJ4; Match level="QueryCoverage=44%, HitCoverage=24%, E-value=2e-50, Identity=55%"; Hit description =Expressed protein
MLKELPEEEFGSGVDIREYSILDNPSLPSEVKMSWLDVQLCKDGTQDCFASNNTTVGGVLKFPRHSNEETYMKVFLSFKDIKVIQFSSMQDAFSGFSDKARTTTLISFEEREDRFRKRVKRYTGIWCCVLDHTPGHIYYDMYWDEKPEWKPIPPQTSADDHPPWIGALAPLPTSTSLLTDYSKGLFDEIYNRDVLDWNAIVSVSLENNCYKTAIDLKKMIKAQTGFDSTTLLLMVSASFHVKNFDQGQEIHCMSIKSGMLVDISLGNALIDIGSLYNSVPKKALYYFKRKTSSEETADHVSLSCAISASTSLGELAFGQSIHGLGIKLGYKSHISVANSLISLYSQCEYLKAAETVFREIALKDIVS

SEQ ID NO: 210271 - protein, 260 aa, Glycine max
  Coding DNA Sequence Number=SeqID_93493
  Gene Ontology: Mol. function=phosphotransferase activity, for other substituted phosphate groups; Cellular component=integral to membrane; Biological process=phospholipid biosynthetic process
  Homolog annotation: Hit_ID=Q8GUK6; Match level="QueryCoverage=88%, HitCoverage=99%, E-value=4e-77, Identity=60%"; Hit description =Probable CDP-diacylglycerol--inositol 3-phosphatidyltransferase 2
  Pfam annotation: Domain name=CDP-OH_P_transf; Domain location=49-225; Score=15.1; E_value=0.0013; Accession=PF01066.11; Description=CDP -alcohol phosphatidyltransferase
MAWDGSICEYLIGNPVLISQVLEYKEASMAKKPGPRSSKLSVYLYIPNIIGGFVCDAVDGWCARKFNQASFCFVRTAANLDENIKHPPNVDSSCADCQVSTFGAVLDMVTDRISTACLLVVLSQLYKPGLSFLSLLALDIASHWLQMYSTFLTGKTSHKDVKDSSSWLFRAYYGNRMFMAYCCVSCEASVLYLILFYLAENQTEKLVDVISSNLQKISFLSLLMGTSLFGWAVKQIINVIQMKTAADACVLYDIEKEHKN

SEQ ID NO: 210272 - protein, 455 aa, Glycine max
  Coding DNA Sequence Number=SeqID_93494
  Gene Ontology: Mol. function=aminoacyl-tRNA ligase activity; Cellular component=endoplasmic reticulum; Biological process=translation
  Homolog annotation: Hit_ID=Q10HJ4; Match level="QueryCoverage=94%, HitCoverage=67%, E-value=1e-151, Identity=62%"; Hit description =Expressed protein
MACEEVAHSRPLFLTIYTIVIVGIVFSSLYVFSAIRHPSAIPSTWSLSNEDVRLTEQTLNGSQSETVHIVPSVPQEARKMRTRPILSVPPRNKKMPSLNAFRLTKELVQQRVKDNIIILTFGNYAFMDFILTWVEQLNDLGVSNYLVGAMDIKLLEALYWKGIPVFDMGSHMSTDDVGWGSPTFHKMGREKVLLINLILPFGYELLMCDTDMVWLKNPLPYLARYPEADVLTSSDQVVPTVVDDSLEIWQEVGAAYNIGIFHWRPTESAKKLAKEWKELLLADDKIWDQNGFNDIVHRQLGPSVDEDSGLVYAYDGNLKLGILPSSIFCSGHTYFVQAMYQQLRLEPYAVHTTFQYAGTEGKRHRLREAMVFRDPPEYYNPPGGFLSFKPSIPKSLLLSGNHTIESHFRLVNYQIKQIRTALAIASLLNRTLVRTIFWDHNVELQISHISNLKHC

SEQ ID NO: 210273 - protein, 97 aa, Glycine max
  Coding DNA Sequence Number=SeqID_93495
MSKREASSLFPWDTFVMKSKKIYSNEHSTKGKSIKKNKPLVESSLVLRFFVGWKGDITVSLQQIWASSKSALQEFHHHPIILDLSFLDDNVIGNERE

SEQ ID NO: 210274 - protein, 287 aa, Glycine max
  Coding DNA Sequence Number=SeqID_93496
  Gene Ontology: Mol. function=metal ion binding
  Homolog annotation: Hit_ID=Q9LDD1; Match level="QueryCoverage=90%, HitCoverage=77%, E-value=5e-19, Identity=24%"; Hit description =Arabidopsis thaliana genomic DNA, chromosome 3, P1 clone: MGH6
MSIQAQWYPNNNSASPFCNNGYCAGGLIDSHINFQAKNHFQQQQQLSEQHLRELYNGSQGIVDPNLHVYNSEAVNSPVFAVQLEKQWEEIDQYMKSEDEKLRYMIGEHGKQQVIALLKKLESRSLNVLREKDEEIAQAIKKRVELEDYLRKLEAENMKWQKVAQEKEIMALSLYKTLEEMTESGNFLNNGVVPNDAVSFCGETGGKEEEMGEEATSEKEKKRIECCGEFEQNTRGRGVMVCKSCHSRSSSFLFLPCRHLSCCKVCNAFLEACPVCRTPKKATIELRL

SEQ ID NO: 210275 - protein, 190 aa, Glycine max
  Coding DNA Sequence Number=SeqID_93497
  Pfam annotation: Domain name=XYPPX; Domain location=29-33; Score=0.9; E_value=1.7e+02; Accession=PF02162.7; Description=XYPPX repeat
  Pfam annotation: Domain name=XYPPX; Domain location=34-38; Score=1.2; E_value=1.4e+02; Accession=PF02162.7; Description=XYPPX repeat
  Pfam annotation: Domain name=XYPPX; Domain location=41-45; Score=0.3; E_value=2.6e+02; Accession=PF02162.7; Description=XYPPX repeat
  Pfam annotation: Domain name=XYPPX; Domain location=47-51; Score=2.2; E_value=72; Accession=PF02162.7; Description=XYPPX repeat
  Pfam annotation: Domain name=XYPPX; Domain location=53-57; Score=4.0; E_value=22; Accession=PF02162.7; Description=XYPPX repeat
  Pfam annotation: Domain name=XYPPX; Domain location=59-63; Score=2.2; E_value=72; Accession=PF02162.7; Description=XYPPX repeat
  Pfam annotation: Domain name=XYPPX; Domain location=64-68; Score=2.2; E_value=72; Accession=PF02162.7; Description=XYPPX repeat
  Pfam annotation: Domain name=XYPPX; Domain location=69-73; Score=2.2; E_value=72; Accession=PF02162.7; Description=XYPPX repeat
  Pfam annotation: Domain name=XYPPX; Domain location=76-80; Score=2.2; E_value=72; Accession=PF02162.7; Description=XYPPX repeat
  Pfam annotation: Domain name=XYPPX; Domain location=81-85; Score=2.1; E_value=78; Accession=PF02162.7; Description=XYPPX repeat
  Pfam module annotation: Pfam domain module=XYPPX::XYPPX::XYPPX::XYPPX: :XYPPX::XYPPX::XYPPX::XYPPX::XYPPX::XYPPX; Domain location=29-33::34 -38::41-45::47-51::53-57::59-63::64-68::69-73::76-80::81-85
MGGGKDKHNEEEKGVFSHLAHGVAQAAHGYPPGAYPPPPGAYPPYQGYPPAHGYPPQGGYPPAGYPPAGYPPAAGGYPPAGYPPHGYPGSSAPHVTWLKGSNLSDLSLGSHAPGHGGMGALLAGGAAAAAAAYGAHHVSHGHHGYGAYGGYGHMPHGKFKHHGKFKHGKFGKHGKFKHGKFGKGMFKKWK

SEQ ID NO: 210276 - protein, 128 aa, Glycine max
  Coding DNA Sequence Number=SeqID_93498
  Homolog annotation: Hit_ID=Q9FHK0; Match level="QueryCoverage=99%, HitCoverage=36%, E-value=5e-23, Identity=49%"; Hit description =Arabidopsis thaliana genomic DNA, chromosome 5, P1 clone:MFC19
  Pfam annotation: Domain name=F-box; Domain location=83-128; Score =26.1; E_value=0.00013; Accession=PF00646.23; Description=F-box domain
MTLSDDEDENLAQFLESEVLSEVSDKIRVLKEKEEENVEEPKAKRKRVEEDEITKQKQSSDSSSAPKNIVVSNGVVLRRIETGYFSQIPPELFNHILKFLSSEDLVSCSLVCRFLNYAASDEALWRRL

SEQ ID NO: 210277 - protein, 162 aa, Glycine max
  Coding DNA Sequence Number=SeqID_93499
  Gene Ontology: Mol. function=RNA-directed DNA polymerase activity; Biological process=RNA-dependent DNA replication
MVWNGSRIDNFSPTRGLRKGDPRSHLFVMCMEKISFYIQKLVDDGIWNPINVSRGGPCISHLFVDGIRLFCKSNDSHIRLIRDTLERPRSQLSEGELLRKPSVISLIKSITICHLGTLPFVISEGSSLASIDVYPMQSFLLPKGLFEEIDKFSRNSLWSSSE

SEQ ID NO: 210278 - protein, 116 aa, Glycine max
  Coding DNA Sequence Number=SeqID_93500
  Gene Ontology: Mol. function=nucleic acid binding
  Homolog annotation: Hit_ID=Q5Z9H4; Match level="QueryCoverage=58%, HitCoverage=14%, E-value=1e-29, Identity=86%"; Hit description =Putative CBF1 interacting corepressor CIR
  Pfam annotation: Domain name=zf-CCHC; Domain location=23-42; Score =13.2; E_value=0.0064; Accession=PF00098.13; Description=Zinc knuckle
MVFRLETGAPARVKPFGIEVRNVKCLRCGNYGHQSGDRECPLKDAIMPNEESRLKRDDPLNAILAHTEPTENALTMWDRHRLIGALKSSVFTLKAYTPKSPSELLPPDSGPIQKTF

SEQ ID NO: 210279 - protein, 362 aa, Glycine max
  Coding DNA Sequence Number=SeqID_93501
  Homolog annotation: Hit_ID=Q5Z9H4; Match level="QueryCoverage=15%, HitCoverage=11%, E-value=4e-18, Identity=78%"; Hit description =Putative CBF1 interacting corepressor CIR
MMQPLKWELKQRPGISPPRGGFKPDDPNQQIVAEEDIFDEYGGFLGMDNIPELLTNFSKKPKKSKRSKHKKQQQINSDGEASLDDGERRSKKKKVKVNKKKRDRARSSSSETSVSEEGHGKSRQKSSHSSEDSDSYRNDRSRTKREHSFSSRVSDRSRHGLSKHSRRKHAYSSEDSDSQRDDQSRKNIQKHKSKDSKKRHSYSYEDSGPACDHADNRSRDALSYSSDDSNHQRQPKVKRSNHKHSSTAHCDSQKYDRIYGFDRYQGNQSRAVHSCSSEDSDIHKDDQNRRIKQKYCDTPKGSEYPESDMNKQNRKRQWYSSKDSSADGYHRSEKSRYEHSYSSDYSDHREKHHKSRRSSYKH

SEQ ID NO: 210280 - protein, 660 aa, Glycine max
  Coding DNA Sequence Number=SeqID_93502
  Gene Ontology: Mol. function=nucleoside-triphosphatase activity; Cellular component=integral to membrane; Biological process=transport
  Homolog annotation: Hit_ID=Q9C6W5; Match level="QueryCoverage=99%, HitCoverage=99%, E-value=0.0, Identity=71%"; Hit description=White -brown complex homolog protein 14
  Pfam annotation: Domain name=ABC2_membrane; Domain location=398-604; Score=180.2; E_value=5.2e-51; Accession=PF01061.14; Description=ABC -2 type transporter
  Pfam annotation: Domain name=ABC_tran; Domain location=99-287; Score =159.7; E_value=7.8e-45; Accession=PF00005.17; Description=ABC transporter
  Pfam module annotation: Pfam domain module=ABC2_membrane::ABC_tran; Domain location=398-604::99-287
MPQNCIAPKPEYCNSTHHSVEEPPEMTEPHDSTVISYPMQTNEQQQQPFPKLIMYPITLKFEELVYKVKLEQKGGCWGSTWTCKEKTILNGITGVVCPGEILAMLGPSGSGKTTLLTALGGRLSGKLSGKITYNGQPFSGAMKRRTGFVAQDDVLYPHLTVTETLVFTALLRLPNSLCRDEKVQHVERVITELGLTRCRSSMIGGPLFRGISGGEKKRVSIGQEMLINPSLLLLDEPTSGLDSTTAQRILNTIKHLASGGRTVVTTIHQPSSRLYYMFDKVVLLSEGCPIYYGPASTALDYFSSVGFSTCVTVNPADLLLDLANGIAPDSKHATEQSEGLEQERKQVRESLISAYEKNIATRLKSEVCSLEANNYNITKDACARNSIKPEQWCTSWWHQFKVLLQRGVRERRYEAFNRLRIFQVVSVAFLGGLLWWHTPESHIEDRVALLFFFSVFWGFYPLYNAVFTFPQERRMLIKERSSGMYRLSSYFLARTIGDLPLELALPTAFVFIIYWMGGLKPDPVTFILSLLVVLYSVVVSQSLGLAFGAILMEVKQATTLASVTTLVFLIAGGYYIQQIPPFIVWLKYLSYSYYCYKLLLGVQYNENDYYQCSTGELCKVADFPPIKSMGLNHLWVDVCIMAMMLVGYRLVAYLALHRVR

SEQ ID NO: 210281 - protein, 41 aa, Glycine max
  Coding DNA Sequence Number=SeqID_93503
MAQQIGATQGRCFKGLKFLLLGHDGVKASDRKIESERVEGE

SEQ ID NO: 210282 - protein, 159 aa, Glycine max
  Coding DNA Sequence Number=SeqID_93504
  Gene Ontology: Mol. function=nucleoside-triphosphatase activity; Cellular component=integral to membrane; Biological process=transport
  Homolog annotation: Hit_ID=Q6K4D2; Match level="QueryCoverage=98%, HitCoverage=21%, E-value=4e-39, Identity=51%"; Hit description =Putative ABC transporter
GLMMIVASIVPNFLTGIITGAGIQGIMILGAGFFRLPNDLPKPFWKYPMFYIAFHRYVYQGMFKNEFEGLRFATNNVGGGYISGEEILRDVWQVNTSYSKWVDLGIVLGMIIVYRVLFLINIKTTEKLKPIIVSFMSSWSSPKRTILIMQNPNATPLQE

SEQ ID NO: 210283 - protein, 121 aa, Glycine max
  Coding DNA Sequence Number=SeqID_93505
  Gene Ontology: Mol. function=nucleoside-triphosphatase activity; Cellular component=integral to membrane; Biological process=transport
  Homolog annotation: Hit_ID=Q6K376; Match level="QueryCoverage=50%, HitCoverage=11%, E-value=7e-14, Identity=61%"; Hit description=ABC transporter-like protein
MASLLSSNSPALSHYEINPSSRFEATTLEIEETCSAPKPKGTKGGETSGSWNNNEREEMGMCLTWKDVWVTASVGKNEMSKSILEGLTGYAKPGQLLAIMGPSGCGKSALLDTLAGMHISK

SEQ ID NO: 210284 - protein, 165 aa, Glycine max
  Coding DNA Sequence Number=SeqID_93506
MDEFLSSIWNSDDNNQVNPPLPTLDEAAKGKSIHKSQPHYNEANNSLAMNEPLLKRQQTHGEMTFEDFLVKAVVVQPFKHVIGTGSSVSCNGLETQTCWHIITNGKGNRKRIIDGPREVGFQQVRAVKFQSFAMTRTSSPTWKHGHTTAMTRITTMRVAHHPNQT

SEQ ID NO: 210285 - protein, 382 aa, Glycine max
  Coding DNA Sequence Number=SeqID_93507
  Gene Ontology: Mol. function=nucleoside-triphosphatase activity; Cellular component=membrane; Biological process=transport
  Homolog annotation: Hit_ID=Q6K4D1; Match level="QueryCoverage=98%, HitCoverage=51%, E-value=1e-103, Identity=54%"; Hit description =Putative ABC transporter
  Pfam annotation: Domain name=ABC_tran; Domain location=36-203; Score =51.6; E_value=2.7e-12; Accession=PF00005.17; Description=ABC transporter
MTDAFCYKFPFTVFSYKFPFSAKQIHYYKGIIWRLGSNTRQTGEILINGRKQALAYGTSAYVTQDDTLLTTLTVGEAVHYSAQLQLPDTMSKEEKKERADFTIREMGLQDAINTRIGGWGVKGISGGQKRRVSICIEILTRPGLLFLDEPTSGLDSAASYYVMKRIATLDKKDDVHRTVIASIHQPSSEVFQLFDNLCLLSSGRTVYFGPASAAKEFFASNDFPCPPLMNPSDHLLKTINKDFDQDTELNLQGTETIPTEEAIRILVNSYKSSEMNQEVQKQVAILTEKSTSSTNKRRHAGFLNQCFALTKRSCVNMYRDLGYYWFRLAIYIALAISLATIFCDLGSSYRSIQERGSFLMFVSSFMTFMTIGGFPSFVEDMK

SEQ ID NO: 210286 - protein, 155 aa, Glycine max
  Coding DNA Sequence Number=SeqID_93508
  Gene Ontology: Mol. function=hydrolase activity; Cellular component =membrane; Biological process=auxin mediated signaling pathway
  Homolog annotation: Hit_ID=Q9FHJ9; Match level="QueryCoverage=95%, HitCoverage=41%, E-value=2e-46, Identity=58%"; Hit description =Nodulin-like protein
MGIEKVNLLRYEGVAKVGGTLICVSGAILMVFYRGPALIGDTEMDQVAQIKISARGQPEASRWLINGLLDLGFDNFQLGVIFLIGNCICMAAFLAIQAPLLKEYPANLSVTAYSFFFGVALMVVASLFMVNEPTDWILTQSEILAVVYALTISQT

SEQ ID NO: 210287 - protein, 196 aa, Glycine max
  Coding DNA Sequence Number=SeqID_93509
  Gene Ontology: Mol. function=hydrolase activity; Cellular component =membrane
  Homolog annotation: Hit_ID=Q8GW30; Match level="QueryCoverage=68%, HitCoverage=36%, E-value=3e-39, Identity=70%"; Hit description =Putative nodulin
MLPCRRTRPPITKKLLMSFFFLGLTGIFGNQLLFLIGLSYTNPTYAAAAQPAIPVFTFLLTVMMGIERVNLLRYEGLAKVGGTLICVSGAMLMVLYRGPALIGDKEMDHVLQIKRGARAWGYVLDSKLLLHDCFSSYSEQKHLEHTLHKLSHLCSHSTGAGAGAGISVIVSTNVGRDAGAHSSANGSTGAVDNAHT

SEQ ID NO: 210288 - protein, 219 aa, Glycine max
  Coding DNA Sequence Number=SeqID_93510
  Homolog annotation: Hit_ID=Q1SI74; Match level="QueryCoverage=64%, HitCoverage=66%, E-value=3e-65, Identity=79%"; Hit description =Ribulose bisphosphate carboxylase, large chain
  Pfam annotation: Domain name=DUF640; Domain location=10-142; Score =301.8; E_value=1.2e-87; Accession=PF04852.3; Description=Protein of unknown function (DUF640)
IIMDAASGAAPAALAAPQSEGSPAAPSRYESQKRRDWNTFLQYLRNHKPPLTLARCSGAHVIEFLKYLDQFGKTKVHILGCPYFGHPNPPAPCACPLKQAWGSLDALIGRLRAAFEENGGRPESNPFATRAVRIYLREIREGQAKARGIPYEKKKRKRTIVTTTVTAAATVMSTITGSSPNNTITNGAGSSTGNTTNGAGVSEPSAAATATPNVTTAAA

SEQ ID NO: 210289 - protein, 266 aa, Glycine max
  Coding DNA Sequence Number=SeqID_93511
  Gene Ontology: Mol. function=hydrolase activity; Cellular component =membrane; Biological process=auxin mediated signaling pathway
  Homolog annotation: Hit_ID=Q9FHJ9; Match level="QueryCoverage=98%, HitCoverage=74%, E-value=1e-95, Identity=65%"; Hit description =Nodulin-like protein
  Pfam annotation: Domain name=DUF6; Domain location=24-136; Score=4.2; E_value=0.038; Accession=PF00892.11; Description=Integral membrane protein DUF6
MAAVTVAVGGDIWKAHVAMAFVQLFNGGYHVITKVALNVGINQLVFCVFRDLLALSILAPLAYVREKIFGNQLLFLIGLSYTNPTYAAAIQPSIPVFTFLLAVMMGTERVNLLRYDGLAKVGGTIICVSGAIFMVLYRGPALIGYAELGHVTQNEISARGQPEPSGWLIGGLQNLGFDNFHLGVLCLIGNCICMAAFLAIQASVLKKYPANLSVTACSYFFGALLMVTVSLFMTTESTDWSLTSSEILAVIYAESILTLLKWESMS

SEQ ID NO: 210290 - protein, 695 aa, Glycine max
  Coding DNA Sequence Number=SeqID_93512
  Gene Ontology: Mol. function=hydrolase activity; Cellular component =membrane; Biological process=response to chemical stimulus
  Homolog annotation: Hit_ID=Q1SEI2; Match level="QueryCoverage=99%, HitCoverage=99%, E-value=0.0, Identity=65%"; Hit description =Nucleoside phosphatase GDA1/CD39
  Pfam annotation: Domain name=GDA1_CD39; Domain location=74-522; Score= 98.8; E_value=1.6e-26; Accession=PF01150.8; Description=GDA1CD39 (nucleoside phosphatase) family
MVFAKIASLVAPNSHSLPHPLSLQDLSSYCHLEPPLHGGATTITSSSRHKCLRLSLYLATFLFLTYLLFLLLYSYWNHGSAKYYVVLDCGSTGTRVYVYRASVRFNRHTTLPIAVTSLRNASPKNNKKKPPTGRAYDRIETEPGIDKLVNNVSGLNNALKPLLRWAKKQIPVRAHRSTFLFLYATAGVRRLPVSDSRWLLDNAWSVLKDSPFVCQRDWVKIISGPEEAYFGWIALNYDGGILGVRPRKATYGALDLGGSSLQVTFESDQQLNSETSLYVRIGSVSHHLTAYSLPGYGLNEAFGKSVVYLFRKEFGSGNVDVGSGGNVELKHPCLQDGYREEYSCSRCSSSKKGGNGGLGGTQLVLVGAPNWGECSALAKVAVNLSEWTDLGAGLDCGAQPCALGDNLPHPYGHFYVISGFYVVYRFFNLTSEATLDDVLAKGKGFCEKRWDVAKRSVAPQPFIEQYCFRAPYIASLLREGLHINDNQITVGSGNITWTLGVALLEAGKAFSTRFGLRDLEFFQMKINPLVLVPILLLSFILLLCALSCVGNWMPRFFRRQYLPISRHNSVTGASVLNIPSPFRFQRWSPMYSGDGRLKMPLSPKIASSQQSQFGLGHSLDDNSGGIELMESSLYPSANNVSHSYSSNSLGQMQYDSGNMGAFWSPHRSQMCLQSRRSQSREDLNSSLAEVHLMKP

SEQ ID NO: 210291 - protein, 188 aa, Glycine max
  Coding DNA Sequence Number=SeqID_93513
  Homolog annotation: Hit_ID=Q6CQE5; Match level="QueryCoverage=16%, HitCoverage=29%, E-value=8e-08, Identity=84%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGAT

SEQ ID NO: 210292 - protein, 121 aa, Glycine max
  Coding DNA Sequence Number=SeqID_93514
  Gene Ontology: Mol. function=nucleic acid binding; Cellular component= mitochondrion; Biological process=DNA integration
  Homolog annotation: Hit_ID=Q1S3Z1; Match level="QueryCoverage=93%, HitCoverage=8%, E-value=5e-28, Identity=50%"; Hit description =Integrase, catalytic region; Zinc finger, CCHC-type
MDDDQKNEGNEPRSYEEVDNNKQSKNWIAGMNEELSSFHKNVAWILVDKAKGTKLVRCKWIFNPKEEILGVEKARFKVPLVAKGFTQREGIDYNEVFSPTVKHSSIKMVLALAVQEDIELE

SEQ ID NO: 210293 - protein, 637 aa, Glycine max
  Coding DNA Sequence Number=SeqID_93515
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=89%, HitCoverage=41%, E-value=1e-92, Identity=33%"; Hit description=Chromo
MPDSSNVPTSLEDAVLKLAAQHLSMGETLQTVTFQLNEILLRLPPTLPTPVPPASTPTSSSSPAQQHRIKIDVPRFDGSDPSGWIFKITQYFEYHATPEAERLTIAAFYMDGRALAWFQWMNDNGQFTSWPAFLQAIQTRFAPSQYEDPTGVLFKLTQKGTVTQYLAEFEELANRIIGLPPPFLLSCFVSGLASDIRREVQAHQPLTLVQVAGLARLQEEKIFDGRPTSRNRPHQPTQMYPPPPSTTFVPVSPTQNPNSTIPLRPIPTPPLLLPPTSPNPSQVKRLSLEEIASRRERRLCFTCDEKYHRGHRCTSRAFLLVAEEDETLPGLINPPYPQPDPVPPDPTDPYPAQISFNSLAGQVALETLRFMGFIGDRQVILLVDGGSTHNFIQLQLVSELGLTTRDTTPLRIMVGNGQQLECTRVCEDVTVVIQNTSLYFHVTILPEPPSIQDDPTLSPHIQTILDRYHPLFQSPNTLPPQRETDHRIHLLPQATPVNVCPYRYPHFQKQEIEQQVEIMLQTGLIQPSNSPFSSPILLVKKHDGTWRFCVDYRALNALTIKDRFPIPTVDELLDELGGAHYFSKLDLLQGYHQIHMSPEDISKTSFRTHHGHYEFRVMPFGSCNAPSSFQATMNAIF

SEQ ID NO: 210294 - protein, 285 aa, Glycine max
  Coding DNA Sequence Number=SeqID_93516
  Homolog annotation: Hit_ID=Q91W34; Match level="QueryCoverage=45%, HitCoverage=29%, E-value=1e-18, Identity=41%"; Hit description=CDNA sequence BC017158
  Pfam annotation: Domain name=DUF647; Domain location=164-285; Score= -169.8; E_value=0.00065; Accession=PF04884.5; Description=Protein of unknown function, DUF647
  Subcellular localization annotation: CTP_CleavageSite=54; ConfidenceScore=5.56e-01
MGCTCKPFSASLFTSLPLRLRLPPPPPLHFAAAVPFRSKQQTPSHTFRLSALPLLSHGSGNNNNNNGGSWGNNPFDSFDSNSNSHHTLFLSMLCSSALCFFGHLLLAKLAKAKTLSSSSSSDTSLFSEPVYEVKGGKWTKLVPDPTDDVFVSAQQGFLSELSSLKPSQLATFVWLKCSDIFTRLMLPEGFPESVTSDYLEYSLWRAVQGVACQVSGVLATQSLLYAVGLGKGAIPTAAAINWVLKDGIGYLSKIMLSNFGRHFDVNPKGWRLFADLLENAAFGLE

SEQ ID NO: 210295 - protein, 152 aa, Glycine max
  Coding DNA Sequence Number=SeqID_93517
  Pfam annotation: Domain name=bZIP_1; Domain location=96-151; Score =27.7; E_value=4.2e-05; Accession=PF00170.11; Description=bZIP transcription factor
  Pfam annotation: Domain name=bZIP_2; Domain location=96-147; Score =10.0; E_value=0.066; Accession=PF07716.5; Description=Basic region leucine zipper
  Pfam module annotation: Pfam domain module=bZIP_1::bZIP_2; Domain location=96-151::96-147
MGDLKIRGDIVEEQLWPQKPTLIKPIPQRAQANVPIGVGPSFQQRQKPSKPLPKLATIPENDNLSTEENTTNEGGAAFVDANNQNISNEAQANTEQEMERKFRRTISNRFSARRSRLKKLAYMAELESKAKSFEVVKGFNNSQRKKISLMKT

SEQ ID NO: 210296 - protein, 521 aa, Glycine max
  Coding DNA Sequence Number=SeqID_93518
  Gene Ontology: Mol. function=RNA-directed DNA polymerase activity; Cellular component=chromatin; Biological process=chromatin assembly or disassembly
  Pfam annotation: Domain name=rve; Domain location=326-478; Score =44.7; E_value=3.2e-10; Accession=PF00665.16; Description=Integrase core domain
  Pfam annotation: Domain name=zf-H2C2; Domain location=267-308; Score =9.9; E_value=0.018; Accession=PF09337.1; Description=His(2)-Cys(2) zinc finger
  Pfam module annotation: Pfam domain module=rve::zf-H2C2; Domain location=326-478::267-308
MAEHLNHLEITFQGVKPVASKVEAILQWPIPHSIKAVRSFLGLADFYRRFIRGYATIAAPLVHITTKAHFMCTDLAQDAFEKLKQAVSTAPVLSLPDFEQPFTAEADASGLGMGAVLSQQGHPLAFFSEPFPPKLLSASTYVRELFAVTATVIQTPEQHTYLARLTGYDYQIIHRSGALNQAADALSRIPKHNSSLMTLSVPCLTFMEELRRQLEASSEYVSQRNAIGQSPATFPGYSIVNNLILHQKRIWLPQGLPLIPTLLTEFHLTPTGGHMRVAKTLARVSENFSWPGLRRDVTKFVTQCVDCQLTKYETKKSAGLLCPLPVPQRPWEDLSLDFIMGLPPFQGHSVILVVVDRFSKGIHLGTLPASHTAHMVAVLFMEIVRKIHGIPRSLVSDRDPLFLSNFWRELFQLSGTQLRMSFAYHPQTDGQTEWSHNTSWNIATGTTPYEITFGRKPFNFPDYITGTSKLDAVEEMLKDRDETFQCIRKKLIKAQIKMKKFAYMKRREMSYQPGDWVLLKL

SEQ ID NO: 210297 - protein, 138 aa, Glycine max
  Coding DNA Sequence Number=SeqID_93519
  Homolog annotation: Hit_ID=P0ACX5; Match level="QueryCoverage=48%, HitCoverage=97%, E-value=1e-24, Identity=83%"; Hit description =Hypothetical protein ydhZ
MGNVTKDEELYQEMCRVVGKVVLEMRDLGQEPKHIVIAGVLRTALANQRVKRSELTTQAMETVVKALAGRVLLKSGKARGVKTMKKWISTLRRFFATRPANAENSAQRVLESILPVASLYGVDVANIDPEWFHDKTPR

SEQ ID NO: 210298 - protein, 423 aa, Glycine max
  Coding DNA Sequence Number=SeqID_93520
  Homolog annotation: Hit_ID=Q5PJ30; Match level="QueryCoverage=92%, HitCoverage=83%, E-value=1e-168, Identity=70%"; Hit description =Putative exported protein
MEIMMKRTTLTTALSAPALLLAMHAAHAAPQAHVVCGYSHTLGDDAIMMFGRPNEAMLHDFFGNTHTDASSTRETLRTLEETTCDNKADSSAYWAPSLRLPDGTIVKPAYQKTYYQASNVETWPLQPFPAGLSLLAGDHHGSAPNPHITFLCANGKGYTTKTGEVCGLRKAGDAVQFNIGIQFPNCWDGVNLKPSHGHSNAAYDVNGACPADYPVKIPTVNMNIAYVLPQIKSLDTAKIELSMDPVMKGDKREEKWGSIYTAHADFMNGWTVEGAHFMTEHCMNEGMDCGTNVPYSFSLAEENAVVESAQPNVNFGAPGALQISDNWKNGGRTSNPETLTLVKFKIPVLPKDQDASLFKYRLRLYGGKVETNGADQIFFYPASNDWSAASVTWKHRPTCSYNSDGQLYLNSSREYRMVDIDEA

SEQ ID NO: 210299 - protein, 635 aa, Glycine max
  Coding DNA Sequence Number=SeqID_93521
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=51%, HitCoverage=100%, E-value=1e-126, Identity=65%"; Hit description=Ser- thr protein kinase
  Pfam annotation: Domain name=LRR_1; Domain location=43-65; Score =11.1; E_value=2.3; Accession=PF00560.23; Description=Leucine Rich Repeat
  Pfam annotation: Domain name=LRR_1; Domain location=67-86; Score =11.7; E_value=1.8; Accession=PF00560.23; Description=Leucine Rich Repeat
  Pfam annotation: Domain name=LRR_1; Domain location=91-113; Score =5.5; E_value=27; Accession=PF00560.23; Description=Leucine Rich Repeat
  Pfam annotation: Domain name=Pkinase; Domain location=343-604; Score =5.9; E_value=6.5e-09; Accession=PF00069.15; Description=Protein kinase domain
  Pfam annotation: Domain name=Pkinase_Tyr; Domain location=355-604; Score=-4.5; E_value=3.4e-12; Accession=PF07714.7; Description =Protein tyrosine kinase
  Pfam module annotation: Pfam domain module=LRR_1::LRR_1::LRR _1::Pkinase::Pkinase_Tyr; Domain location=43-65::67-86::91-113::343 -604::355-604
MFYYLAFLPNSSIRMHPQWGVVLNLKDLCLEGTLAPEIGKLAHIRSIILRNNSFFGEIPKEILHLEELEVLDLGYNNFSGSIPFDHGNISSLTTLLLDNNYYLANLTTELYKLKMNSEFHANEEQLTGATSRELFVGRCNLRRISQHGDRSYRRQLLKVANAANTPKIQGDVNQGTLKQSASHFRFSLPPDFEPFSSSPSESPLYSPGSAPLSYSPSPSPSPSSIFFAPSPVVLPTPDIPPPVNTPVTVSTPPEFNWAPSPSSFSNQGNTNSSNQIHHSVIIWSAVGGFSLLILLSAIIFACFQSRKVVAVKPWSTGLSGQLQKAFIKGVPSLKRGEIEAASEYFSNIIGSLPDGIVYKGTLSSGVEIAVASSAVTTAQNWSKSMEAQFRKKIASLSRVNHKNFVNLIGYCEENKPFSRMMVFEYAPNGTLFEHLHIREGEELNWTMRMRIAMGIAYCLEYMHELKPPIAHRNLQSSFIYLTEDYAAKVSDLSLWNDMCATKNGSATTQLLETSSADTKDNVYSFGIILFELITGRIPLAGNSELLADWAAEYVRWGKSLRDVVDLRLKSLQEEEIEEWSEVIRNCVQPDPEKRPTMKEITSRLKELTAMGPDGANPKASPLWWAEMAITSTDSS

SEQ ID NO: 210300 - protein, 932 aa, Glycine max
  Coding DNA Sequence Number=SeqID_93522
  Gene Ontology: Mol. function=protein binding; Cellular component =thylakoid; Biological process=ethylene mediated signaling pathway
  Homolog annotation: Hit_ID=Q1SC84; Match level="QueryCoverage=99%, HitCoverage=98%, E-value=0.0, Identity=58%"; Hit description=TPR Domain, putative
  Pfam annotation: Domain name=TPR_1; Domain location=426-459; Score =4.9; E_value=1.4; Accession=PF00515.18; Description=Tetratricopeptide repeat
  Pfam annotation: Domain name=TPR_1; Domain location=555-588; Score =13.0; E_value=0.15; Accession=PF00515.18; Description=Tetratricopepti de repeat
  Pfam annotation: Domain name=TPR_1; Domain location=755-788; Score =30.3; E_value=6.6e-06; Accession=PF00515.18; Description =Tetratricopeptide repeat
  Pfam annotation: Domain name=TPR_1; Domain location=884-917; Score =20.7; E_value=0.0053; Accession=PF00515.18; Description =Tetratricopeptide repeat
  Pfam annotation: Domain name=TPR_2; Domain location=426-459; Score =11.8; E_value=1.4; Accession=PF07719.7; Description=Tetratricopeptide repeat
  Pfam annotation: Domain name=TPR_2; Domain location=555-588; Score =20.2; E_value=0.0072; Accession=PF07719.7; Description =Tetratricopeptide repeat
  Pfam annotation: Domain name=TPR_2; Domain location=681-714; Score =10.3; E_value=2.1; Accession=PF07719.7; Description=Tetratricopeptide repeat
  Pfam annotation: Domain name=TPR_2; Domain location=755-786; Score =14.1; E_value=0.5; Accession=PF07719.7; Description=Tetratricopeptide repeat
  Pfam annotation: Domain name=TPR_2; Domain location=787-820; Score =15.0; E_value=0.28; Accession=PF07719.7; Description=Tetratricopeptid e repeat
  Pfam annotation: Domain name=TPR_2; Domain location=851-884; Score =11.3; E_value=1.6; Accession=PF07719.7; Description=Tetratricopeptide repeat
  Pfam annotation: Domain name=TPR_2; Domain location=885-917; Score =5.0; E_value=8.5; Accession=PF07719.7; Description=Tetratricopeptide repeat
  Pfam annotation: Domain name=TPR_4; Domain location=681-706; Score =11.4; E_value=1.7; Accession=PF07721.5; Description=Tetratricopeptide repeat
  Pfam annotation: Domain name=TPR_4; Domain location=755-780; Score =7.1; E_value=5.4; Accession=PF07721.5; Description=Tetratricopeptide repeat
  Pfam annotation: Domain name=TPR_4; Domain location=787-812; Score =1.3; E_value=27; Accession=PF07721.5; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_2::TPR_2::TPR_4::TPR _4::TPR_4; Domain location=426-459::555-588::755-788::884-917::426 -459::555-588::681-714::...
  Pfam module annotation: Domain location=755-786::787-820::851 -884::885-917::681-706::755-780::787-812
  Subcellular localization annotation: CTP_CleavageSite=75; ConfidenceScore=5.30e-01
MRGLKLVERFKSIQVHALNSEATSRRNKATGEARAITIRSLVSKSKSNTTTTTTTTTTTTNSAIANLVVPLQLPSADTLEPSIEPYLKPTNLVEALAELYHRLECCCLQSEKKTSLCVEQFTLLRSLGDQKLLRRCLRTARQNAEDVLSKVVLSAWLRFERREDELEGVSSMDCGGCVLECPKVNLVKGFSPCSINDRCQCPQGTKEETSNEESVFLCLPDEEKKDVSFCIGSEEIDCVKWRIAALSDPFKAMLYGGFAESKMRKIDFSKNGISSKGMRAVELYSRAKRLDFFCAMTVLELLSFANSFCCEEMKAACDAHLASFVGSVDDALILIDYGLEERAPLLVASCLQVLLRELPNSLHNSKVMNVFCSSEGMKRLAMVGYDSFLLYYFLSQVAMEEIMVSETTLMLLERLGECATERWQKALAFHQLGCVLLERKQYKEAQHSFEVAAEAGHVYSVAGVARTKYKQGQPYSAYKLISSLIFEHKPAGWMYQERALYNMGREKSFDLDVATELDPSLSFPYKYRALAKVEEKHIKAGILELDKIIGFKLSPDCLEVRARMFIALKDYGSAIKDIRALLTLEPNYITSNEKISGKYLVHLLSHVVQQKSQAECWMQLYEQWSSVDDVGSLAIIHQMLENEPGKSLLEFRQSLLLLRLNCQKAAMRSLRMARNHSSSLQERLIYEGWILYDTGYRDEALARVDRSITIQRSFEAYFLKAYVLADTSMDPESASYVIELLEEALKCPSDGLRKGQALNNLGSIYVDCGNLDLAEACYENALAIRHTRAHQGLARVYHQKNQRKAAYDEMTKLIEKAESNASAYEKRSEYCDREMAKVDLDVATQLDPLKTYPYRYRAAVMMDEQKESEAVDELTKAINFKPDLQMLHLRAAFYEAIGELSSALQDCQAALCLDPNHTDTLDLYQRARKLSF

SEQ ID NO: 210301 - protein, 80 aa, Glycine max
  Coding DNA Sequence Number=SeqID_93523
  Pfam annotation: Domain name=LRRNT_2; Domain location=30-73; Score =53.1; E_value=9e-13; Accession=PF08263.3; Description=Leucine rich repeat N-terminal domain
MAPFTPLKLPLLLTLFFALSQKQSLCSTLKSEEGLALLALRERVVSDPQGTLSSWSGADGDVDPCSWFGVECFHGYVVTL

SEQ ID NO: 210302 - protein, 59 aa, Glycine max
  Coding DNA Sequence Number=SeqID_93524
MQKVMKGKDREPQKPKCFNIKLDKMGKSQKLEHFQRETEIWGEVNESGFLVVNERKECF

SEQ ID NO: 210303 - protein, 302 aa, Glycine max
  Coding DNA Sequence Number=SeqID_93525
  Gene Ontology: Mol. function=protein disulfide oxidoreductase activity; Biological process=cell redox homeostasis
  Homolog annotation: Hit_ID=Q941V7; Match level="QueryCoverage=48%, HitCoverage=56%, E-value=4e-34, Identity=49%"; Hit description =Glutaredoxin-like
  Pfam annotation: Domain name=Glutaredoxin; Domain location=134-204; Score=49.5; E_value=1.2e-11; Accession=PF00462.14; Description =Glutaredoxin
  Subcellular localization annotation: CTP_CleavageSite=24; ConfidenceScore=5.12e-01
MWRPWGKSTVRIHSASSSPSSTFSCSSFKDIQTLCLDEPPQHHHHQLPSPSPTRKPSVFHRVRLANSLLRTWSTHLHPQPPKLPRTLSHPDPPESEPDVVVSKPEPDVVVSKPEQQQQQQPAIYYFPGAEQRVVVYYTSLRVVRPTFEACKSVLSILRGFRVQIDERDVSMDSGFTAELNRIMGRPELGPGPSLPRVFIAGRYVGGAEELRQLNEVGELKKILLDLPAVDPTAECHVCAGHRFVLCDECNGSRKVYTEKTGFKTCNACNENGLVKCPSCLPSTSPPPILSSTTSKFNNEIQN

SEQ ID NO: 210304 - protein, 773 aa, Glycine max
  Coding DNA Sequence Number=SeqID_93526
  Gene Ontology: Mol. function=microtubule motor activity; Cellular component=microtubule associated complex; Biological process =microtubule-based movement
  Homolog annotation: Hit_ID=Q1SEG1; Match level="QueryCoverage=100%, HitCoverage=69%, E-value=0.0, Identity=65%"; Hit description=Band 4.1; Unconventional myosin/plant kinesin-like protein/non-motor protein conserved ...
  Homolog annotation: Hit description=region MyTH4; Kinesin, motor region
  Pfam annotation: Domain name=Band_41; Domain location=243-399; Score=- 66.3; E_value=0.0033; Accession=PF00373.8; Description=FERM domain (Band 4.1 family)
  Pfam annotation: Domain name=MyTH4; Domain location=120-234; Score =145.7; E_value=1.2e-40; Accession=PF00784.8; Description=MyTH4 domain
  Pfam module annotation: Pfam domain module=Band_41::MyTH4; Domain location=243-399::120-234
  Subcellular localization annotation: CTP_CleavageSite=36; ConfidenceScore=5.37e-01
MTIDVPPSSGQSVRTNRSSFSSSNGNEATPVHNYASVSNGDGYDSEGSNFAPPTPTTLSMAIPSELAGAVPLIDRFQDPIPTSLLKLNGDLASRATKLFQIILKYIGVDSSDHVTPISLEERVELVGKLYKQSLKRSELRDELFLQLSKQTRNSPEREYLIKAWELMYLCASSMPPSKDIGAYLSEYVHNMAYGVTADPEIRALALNTLNALKHSVKAGPRHIIPGPVEIETLLTGKKLTTIVFFLDETFEEITYDMSTTVADAVEEYVGLDDNKYIGDLLAEFKAVKDRSKGEILHCKLIFKKKLFRESDEAVTDPMFLQLSYVQLQHDYILGNYPIGRNDAAQLSALQILAEIGFVRRPESCALVIFDVHLAHVTKDDARQQFLHILRTLPYGFSVFFNVRKIDDPIGLLPGRIILGINKRGVHFFRPVPKEYMHSAELRDIMQFGSSNTAVFFKMRVAGVLHIFQFETKQGEEICVALQTHINDVMLRRYSKARSAVGESLNEDTSNDFKPSNLELSEKRLQELSKLVEESQTNADQLLDKLREKQKQEEDMLQELEGLQRSLRADKQSLAEVTNDRDKLRSLCEEKDKALQAEILEKRNMEAKMAELSNLVTENTTKKDHTQTNNQVSQKLEDDLKLCKGELRVAEETIKNLRSNKLILEQKLSELEKKSAEEASSLQWKLEQEGKTLNSKVYDLERKLDAFRQELSVAESTVSVKDSELAALKNNLDELEELREMKEDIDRKNEQTAAILKMQAVQLAEMELLYKEEQ

SEQ ID NO: 210305 - protein, 78 aa, Glycine max
  Coding DNA Sequence Number=SeqID_93527
  Gene Ontology: Mol. function=histone-lysine N-methyltransferase activity; Cellular component=nucleus; Biological process=chromatin modification
  Homolog annotation: Hit_ID=Q1SHZ6; Match level="QueryCoverage=91%, HitCoverage=37%, E-value=7e-15, Identity=51%"; Hit description =Nuclear protein SET
METIEHCIAISKRGYTVEADDLIKDMAITAEYIGDVDYLDNQERDDSDSIMSLLRAESSQSVVSCADKRGNIAHPLPL

SEQ ID NO: 210306 - protein, 57 aa, Glycine max
  Coding DNA Sequence Number=SeqID_93528
MGEEGLVKLIESLSEEVVEAIDRRLWSQPMQKYLLRRYGTDMCSCCTTMLPQHHCEL

SEQ ID NO: 210307 - protein, 82 aa, Glycine max
  Coding DNA Sequence Number=SeqID_93529
MKKLKTLKVEAHVEVLLGCDVVLSFPTQEVGVQLVFERQPPPILRIRTTMTTNTNNHHRLCVILFWMTTISNTDNHHATSKW

SEQ ID NO: 210308 - protein, 704 aa, Glycine max
  Coding DNA Sequence Number=SeqID_93530
  Gene Ontology: Mol. function=phospholipase D activity; Cellular component=membrane; Biological process=phosphatidylcholine metabolic process
  Homolog annotation: Hit_ID=Q1RUP7; Match level="QueryCoverage=85%, HitCoverage=79%, E-value=0.0, Identity=71%"; Hit description=C2
  Pfam annotation: Domain name=C2; Domain location=29-140; Score=73.8; E_value=5.5e-19; Accession=PF00168.20; Description=C2 domain
  Pfam annotation: Domain name=PLDc; Domain location=322-357; Score =32.1; E_value=2e-06; Accession=PF00614.12; Description=Phospholipase D. Active site motif
  Pfam module annotation: Pfam domain module=C2::PLDc; Domain location =29-140::322-357
MDCHGGISQSSPNREYEGLNGPVFLHGDLDLLIIEAKSLPNLDLSSETIRKCITMGNMCHPPFIKGLKTHSGKDKMITSDPYVSVCIAGATIAQTRVIANCENPLWDEQFIVPVAHPAQKLEFLVKDNDILGAELIGVVEIPVQKIIAGNTVNDWFPIIGQYGNCLKPYPELHISVQYRQIGVNRSESISSGDGKALGVPKTYFPLRKGGSVTLYQDAHLPDGMLPEITLEGGKVFQHNKCWEDICHAILEAHHLIYIIGWSVYHPVRLVREATKPLPSGGELSLGELLKYKSQEGLRVDGVMQTHDEETKKFFKHSTVVGTLFTHHQKCVLVDSLGSGNNRKITAFIGGLDLCDGRYDTPEHRLFRDLDTVFHNDFHNPTFQLHSNSCAPRQPWHDLHCKIEGPAAYDILTNFEQRWRKAKKWRDFRLKKVTNWHDDALLRLDRISWIVKPSPSSNGDKSVHVTDENDPESWNVQIFRSIDSGSVKGFPKDVDKAKAQVRTRLYVMPLYTTSSCANHLVPMELALKIAGKIGANERFCVYIVIPMWPEGVPTSAAVQEILFWQGQTMSMMYKIVADALEKAGLSYQYHPQDYLNFYCLGKREPQSTNISPTPNPSENRALLFTVALVVGDEQAAENGSNDGTIVVGDGAVGVCRRLDDGGGDAGSDWRMIWMAKSTASHPAWGFWSATRERLLSPAPEEGGDV

SEQ ID NO: 210309 - protein, 584 aa, Glycine max
  Coding DNA Sequence Number=SeqID_93531
  Gene Ontology: Mol. function=binding; Cellular component=integral to membrane; Biological process=phagocytosis
  Homolog annotation: Hit_ID=Q1RUQ0; Match level="QueryCoverage=95%, HitCoverage=95%, E-value=0.0, Identity=79%"; Hit description =Nonaspanin
  Pfam annotation: Domain name=EMP70; Domain location=51-542; Score =932.7; E_value=1.6e-277; Accession=PF02990.7; Description =Endomembrane protein 70
  Pfam annotation: Domain name=MFS_1; Domain location=220-567; Score= -52.1; E_value=0.076; Accession=PF07690.6; Description=Major Facilitator Superfamily
  Pfam module annotation: Pfam domain module=EMP70::MFS_1; Domain location=51-542::220-567
MFFESRSLLFPLLFSLFLASAFASESDHKYQHDEQVNLWVNKVGPYNNPQETYNYYSLPFCHPSSSASAAHKWGGLGEVLGGNELIDSQLEIKFQRNVDKTVFCQIDLDEAKVKQFKDAIENNYWFEFFMGYVGELHPDKNSDNGKHVIYTHKNIIVKYNNDQIIHVNLTQDIPKPLEVGKHLDMTYSVKWDSTNVTFGRRFDVYLDHPFFEHQIHWFSIFNSFMMVIFLTGLVSMILMRTLRNDYAKYAREDDDLESLERDVSEESGWKLVHGDVFRPPRNLVILSAVVGTGAQLALLVLLVVLLAIVGMLYVGRGAIVTTFIVCYALTSFISGYVSGGMYSRNGGKHWIKSMILTASLFPFMCFGIGFILNTIAIFYGSLAAIPFGTMVVVFVIWAFISFPLALLGTVVGRNWSGALNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYFYVKTKMSGFFQTSFYFGYTLMFSLGLGILCGAVGFLGSNLFVRRIYRNIKCD

SEQ ID NO: 210310 - protein, 66 aa, Glycine max
  Coding DNA Sequence Number=SeqID_93532
MTLEFWIMVPDKLGLLERKAGTKLSRMLLREEIDENSTVYREENNGGIVHARGSKEDDDRDGEMEG

SEQ ID NO: 210311 - protein, 98 aa, Glycine max
  Coding DNA Sequence Number=SeqID_93533
  Gene Ontology: Mol. function=acetolactate synthase activity; Cellular component=chloroplast; Biological process=branched chain family amino acid biosynthetic process
  Homolog annotation: Hit_ID=Q9SMC2; Match level="QueryCoverage=78%, HitCoverage=69%, E-value=2e-31, Identity=70%"; Hit description =Acetolactate synthase small subunit
VRDITHLPFAERELMLIKIAVNAAARRDVLDIASIFRAKAVDVSDHTITLELTGDLDKMVALQRLLEPYGICENIHTGGKNSVLLVLAKMYLFSFEAL

SEQ ID NO: 210312 - protein, 183 aa, Glycine max
  Coding DNA Sequence Number=SeqID_93534
  Homolog annotation: Hit_ID=Q2Z1Y9; Match level="QueryCoverage=43%, HitCoverage=35%, E-value=1e-09, Identity=50%"; Hit description=2 -oxoacid-dependent dioxygenase
MEDTFPVIDAEKINCEEGECKKLREACERWGCFMADMKKVVEALVVTWDKMHSALYMRPWVSMTCVPHKLCRFSVLNLMTRSTRVNIGQKMAESLGLVVADFEDCDERFWLISANPSFPRDLQCKEGSKRLSIATFMLRQQANWWTMITHVCIKLLIMKIIRKLRVSNKGMPTNEALELFRLA

SEQ ID NO: 210313 - protein, 315 aa, Glycine max
  Coding DNA Sequence Number=SeqID_93535
  Gene Ontology: Mol. function=microtubule motor activity; Cellular component=microtubule associated complex; Biological process =microtubule-based movement
  Homolog annotation: Hit_ID=Q1SEG1; Match level="QueryCoverage=99%, HitCoverage=24%, E-value=1e-159, Identity=90%"; Hit description=Band 4.1; Unconventional myosin/plant kinesin-like protein/non-motor protein conserved ...
  Homolog annotation: Hit description=region MyTH4; Kinesin, motor region
  Pfam annotation: Domain name=Kinesin; Domain location=2-261; Score =360.7; E_value=2.4e-105; Accession=PF00225.13; Description=Kinesin motor domain
MQYLVQSAVDGYNVCIFAYGQTGSGKTFTIYGAENNLGLTPRGTAELFRILRRDSNKYSFSLKAYMLELYQDTLVDLLLPKNAKRLKLDIKKDSKGMVAVENVTIVPISTVEELNSMIQRGSEQRHTSGTQMNDESSRSHLILSIVIESTNLQSQSTARGKLSFVDLAGSERVKKSGSSGSQLKEAQSINKSLSALGDVISALSSGGQHIPYRNHKLTMLMSDSLGGNAKTLMFVNVSPVESSLDETHNSLMYASRVRSIVNDPSKNVSSKEIARLKKMIAYWKEQAGRRGDDEDLEEIQEERQTKERTDGRHSM

SEQ ID NO: 210314 - protein, 673 aa, Glycine max
  Coding DNA Sequence Number=SeqID_93536
  Gene Ontology: Mol. function=protein serine/threonine kinase activity; Cellular component=cell surface; Biological process =protein amino acid phosphorylation
  Homolog annotation: Hit_ID=Q9XIS3; Match level="QueryCoverage=92%, HitCoverage=94%, E-value=0.0, Identity=61%"; Hit description=Lectin -like protein kinase
  Pfam annotation: Domain name=Lectin_legB; Domain location=33-275; Score=206.5; E_value=6.1e-59; Accession=PF00139.10; Description =Legume lectin domain
  Pfam annotation: Domain name=Pkinase; Domain location=351-592; Score =135.5; E_value=1.4e-37; Accession=PF00069.15; Description=Protein kinase domain
  Pfam annotation: Domain name=Pkinase_Tyr; Domain location=351-613; Score=102.6; E_value=1.2e-27; Accession=PF07714.7; Description =Protein tyrosine kinase
  Pfam module annotation: Pfam domain module=Lectin_legB::Pkinase::Pkina se_Tyr; Domain location=33-275::351-592::351-613
  Subcellular localization annotation: CTP_CleavageSite=69; ConfidenceScore=5.02e-01
NHPMCAFSAVTAILLLFPAATSQAQILKKETYFFGPFNQSDFTTLTVLPSAAINLGALQVTPDSTGNVSLANHSGRIFFNNPFTLWDNDDNLNGKLVSFNTSFLINVFRPQNNPPGEGITFLITASTTVPNNSHGQFLGLTNAATDGNATNKFVAVELDTVKQDFDPDDNHIGLDINSVRSNVSVSLTPLGFEIAPNVTRFHVLWVDYDGDRKEIDVYIAEQPDKDAPIVAKPAKPVLSSPLDLKQVVNKVSYFGFSASTGDNVELNCVLRWNITIEVFPKKNGIGKALKIGLSVGLTMVVLIVAGVVGWVCWLKKKKRGNESQILGTLKSLPGTPREFRYQELKKATNKFDEKHKLGQGGYGVVYRGTLPKENLEVAVKMFSRDKMKSTDDFLAELTIINRLRHKNLVRLLVYDYMPNGSLDNHIFCEEGSSTTPLSWPLRYKIITGVASALNYLHNEYDQKVVHRDLKASNIMLDSDFNARLGDFGLARALENDKTSYAEMEGVHGTMGYIAPECFHTGRATRESDVYGFGAVLLEVVCGQRPWTKNEGYECLVDWVWHLHREQRILDAVDPRLGNGCVVEEAERVLKLGLACSHPIASERPKMQTIVQIISGSVNVPHVPPFKPAFVWPAMDLSSPASDLTTPTTTTEYTPMSSDTHSMHVQFSDSNSLI

SEQ ID NO: 210315 - protein, 143 aa, Glycine max
  Coding DNA Sequence Number=SeqID_93537
  Gene Ontology: Mol. function=oxidoreductase activity; Cellular component=chloroplast; Biological process=amino acid metabolic process
  Homolog annotation: Hit_ID=Q9C8I0; Match level="QueryCoverage=99%, HitCoverage=26%, E-value=2e-35, Identity=50%"; Hit description=NADP -specific glutatamate dehydrogenase, putative
  Pfam annotation: Domain name=ELFV_dehydrog; Domain location=1-143; Score=-123.8; E_value=0.04; Accession=PF00208.11; Description =GlutamateLeucinePhenylalanineValin
MHVLQKLIAYVALPILVSETIQRPVLVRSRYYDEAKPWNERCDVAFAYASQNEIDQSDAINLVNSGCRILVEGSNMPFTPEAVQILRKASVLIASAMAAGVEWMRFLLYFSYVVAGELELNHECSLMHWSPEDFESKLQEAME

SEQ ID NO: 210316 - protein, 98 aa, Glycine max
  Coding DNA Sequence Number=SeqID_93538
MRLRRELVISSSSCWGGSDKREELVEIRGVEVAIHGRVSFPSKRKRLLLWGRRGSQRRGDTAIRRGTTATSAAVDLFFLYSVHVHHAISNKSREMRVI

SEQ ID NO: 210317 - protein, 173 aa, Glycine max
  Coding DNA Sequence Number=SeqID_93539
KLHNPLTYDETLGKVIQIEAIIDQFASAVQKKRENGTRLDAQKQAHTLLLEKARAAQHEVERLTKEAKEGSSEIKDCDDNISSWEATITDLLFHVDDLRQKIVTEQAKRKELQEKAANSIQKLVDEKGREGLKAFSASQAVADEAKVLENADQVLTKEMTSLKKLYGDLVKNL

SEQ ID NO: 210318 - protein, 681 aa, Glycine max
  Coding DNA Sequence Number=SeqID_93540
  Gene Ontology: Mol. function=identical protein binding; Cellular component=cellulose and pectin-containing cell wall; Biological process=negative regulation of enzyme activity
  Homolog annotation: Hit_ID=Q1RYB7; Match level="QueryCoverage=96%, HitCoverage=86%, E-value=0.0, Identity=76%"; Hit description =Protease-associated PA; Proteinase inhibitor I9, subtilisin propeptide
  Pfam annotation: Domain name=PA; Domain location=272-375; Score=68.6; E_value=2e-17; Accession=PF02225.12; Description=PA domain
  Pfam annotation: Domain name=Peptidase_S8; Domain location=34-505; Score=45.7; E_value=1.6e-10; Accession=PF00082.12; Description =Subtilase family
  Pfam module annotation: Pfam domain module=PA::Peptidase_S8; Domain location=272-375::34-505
MPGVVSVFPNAKRKLHTTHSWDFIGLLGNESMEIHGHSTKNQENIIIGFIDTGIWPESSSFSDTDMPPVPRGWKGHCQLGEAFNASSCNRKVIGARYYISGHEAEEESDREVSFISARDSSGHGSHTASTAAGRYVANMNYKGLAAGGARGGAPKARIAVYKVCWDSGCYDVDLLAAFDDAIRDGVHIISLSLGPESPQGDYFSDAVSVASFHAAKHRVLVVASVGNQGNPGSATNVAPWIITVAASSIDRNFTSDITLGNGVNITGESLSLLGMDASRRLIDASEAFSGYFTPYQSSYCVDSSLNKTKAKGKVLVCRHAEYSGESKLEKSKIVKKAGGVGMILIDEANQGVSTPFVIPSAVVGTKTGERILSYINSTRMPMSRISKAKTVLGVQPAPRVAAFSSKGPNALTPEILKPDVTAPGLNILAAWSPASAGMKFNIISGTSMSCPHITGIATLVKAVHPSWSPSAIKSAIMTTATILDKHHQPIRADPDRRRANAFDYGSGFVNPSRVLDPGLVYDSHPEDFVAFLCSLGYDERSLHLVTGDNSTCDRAFKTPSDLNYPSIAVPNLEDNFSVTRVVTNVGKARSIYKAVVVSPAGVNVTVVPNRLVFTRIGEKIKFTVNFKVVAPSKDYAFGFLSWKNGRTQVTSPLVIKVAPASHGLLRRCEIPVVTKTRTTLS

SEQ ID NO: 210319 - protein, 395 aa, Glycine max
  Coding DNA Sequence Number=SeqID_93541
  Gene Ontology: Mol. function=oxidoreductase activity; Cellular component=nucleus; Biological process=snoRNA metabolic process
  Homolog annotation: Hit_ID=UPI000069DAA3; Match level="QueryCoverage =57%, HitCoverage=99%, E-value=9e-23, Identity=28%"; Hit description =UPI000069DAA3 related cluster
  Pfam annotation: Domain name=zf-HIT; Domain location=17-47; Score =28.1; E_value=3.1e-05; Accession=PF04438.6; Description=HIT zinc finger
MSVSASQTEEQVSTRKPTTLCEECKSNPSKYTCPGCSLHSCSLPCVKSHKDRTGCSGKRNQTQFLPLSKFDDNVLLSDYKLLEEVKRVAESAQRMRNKLGIYAYFRLPRYLRSLKNAAGSRRTKLLFLPNGMSRREKNRSQYDQRVDENTSFYSILEKHLKPGPWKNQLRQFCEVQLDCLKLFIRKYPKGPKSSFKELDIKAPIRQQLANIVILEFPVVFVFLPSHRINFEVIKDVNTSKHKSLQKDCEDNQFPQGLSFREEVIEDDNNSADPQVFDLMKQVESSLSHEVMTQNMSSEKAPNDSPEKSLFEGASGGNLSHSLTETNELKFSEDMTFDFDQDLMDFYTDILDQTNPGDLFDFDGEFSKKTENEIDLIGTSDLFPMPEELEEGEILE

SEQ ID NO: 210320 - protein, 284 aa, Glycine max
  Coding DNA Sequence Number=SeqID_93542
MEEEFEVIEVEYAPLCEGHEIDVDYEFDAPQFFNFKRQLETFWDATEVEQWFEFAPSYPPSPFLLKTKWGNCGPSIETEQVSNIEENNSTGLEYCNETIQDTLNGNTKPLSKSSSSKAKEFSFMKPTTSHLAKQKNPSEVQNPQHLRFQRQNSSPIDGQLTKRQKLGSGYLRKVARLKHHIIFTHKKTKEVDHNDANLASKSNVTIAKEPNLMTALRAHRHKPTQSSSQVLKAKSLNKKILEGPTKIFSEMKTPQPTQFQVFHLRTSQRAMQNTYNSVSHLNLL

SEQ ID NO: 210321 - protein, 95 aa, Glycine max
  Coding DNA Sequence Number=SeqID_93543
MKRGSKCERGVVVDTKVNSSGQRLRLEMMTDREKRDSCFCSMTKQPQNLSYFCEAVKSNVLYITHSINLSGWRFRCCTCEEQINKLFKESSQKKR

SEQ ID NO: 210322 - protein, 63 aa, Glycine max
  Coding DNA Sequence Number=SeqID_93544
MVQVEGVGGHCHEIGGVAYGIWIKLKKSETLIWVVFVECPKPMVQVEKVGTLIWIWWSSQRFV

SEQ ID NO: 210323 - protein, 135 aa, Glycine max
  Coding DNA Sequence Number=SeqID_93545
  Pfam annotation: Domain name=zf-CCHC; Domain location=80-97; Score =15.7; E_value=0.0025; Accession=PF00098.13; Description=Zinc knuckle
MELMRLNQHEENNKKRKGIALKASSSIQEGSDKEDLNDIEEDDDFSFFVKRFNKFLRNKGNQRRSNFKPKKRGKDSSSLLKCYEYNQPGHLRVDCLNFKKRIERSKNKTFNDKKAKKAYITWEDSDMDSFEDSKK

SEQ ID NO: 210324 - protein, 75 aa, Glycine max
  Coding DNA Sequence Number=SeqID_93546
MECWCCDHSGSKQNVMASSLNSDDCDGEERVKSGVVCGWLCYASVDSGNEAQGAKEKEAYKHFENSPCILNDCLH

SEQ ID NO: 210325 - protein, 311 aa, Glycine max
  Coding DNA Sequence Number=SeqID_93547
  Homolog annotation: Hit_ID=Q9LTJ3; Match level="QueryCoverage=99%, HitCoverage=99%, E-value=9e-35, Identity=38%"; Hit description =Arabidopsis thaliana genomic DNA, chromosome 5, BAC clone:F2O15
MSFGGLSIALSLVFGCLLLALCAQLYYFLWWKKRRTQMDIEMDAKGVFYWGCWKATPCAMMHGGNNTGRGGVNSRDIESTTRSHHEPDMELDLLHKSFGEESTVESELMRLHNLAGPPRFLFPIKEETKEDLESEDRSRKGSRTRSLSDLMLTIDTPFLTPVASSPLKCCSLPVDPLHSYKHQGFNPLFESSTELDYNRFRSSPPPKFKFMRDAEEKLHRKLMEEAARRKAVDNVQECCGLIKDSCSNETLATDFSDGSFLKFIQNNKDTTTERKQLQQYLPQFPSGSSQILPLASSPTTFRPLEKASVVH

SEQ ID NO: 210326 - protein, 197 aa, Glycine max
  Coding DNA Sequence Number=SeqID_93548
MEEEVDILRDKVSQQLTPVKEDIIIYGARVSTKGSSAETIVNLSRKEPYSDIIPTMGLYVDDDYSTCLVALGKVYEEVSTIHHVYLTNDVVKVVVEEVRDADAQVPFPALEDSQRCPKKQVGYVHRSNPISDPLADLIKNLFDLYTKPLQVSWDTTTFGVHNEDFPLFVMLTDVNEIILATMFDHLYVIVVDNVYHE

SEQ ID NO: 210327 - protein, 343 aa, Glycine max
  Coding DNA Sequence Number=SeqID_93549
  Gene Ontology: Mol. function=hydrolase activity, acting on ester bonds; Cellular component=nucleus; Biological process=regulation of transcription, DNA-dependent
  Homolog annotation: Hit_ID=Q9ZPV5; Match level="QueryCoverage=99%, HitCoverage=43%, E-value=1e-142, Identity=73%"; Hit description =Nucleolar complex protein 2 homolog
  Pfam annotation: Domain name=Noc2; Domain location=62-342; Score =472.6; E_value=4.7e-139; Accession=PF03715.4; Description=Noc2p family
MTDTEMISFTLRRLKYSLLFLAAFPSLLRKYIKVVLHFWGTGGGALPVVSFLFMRDLCIRIGSGCIDECFKGIYKAYVLNCHFVNAVKLKHIRFLGNCVIELLGVDLPTAYQHAFTYIRQLATILREALNTKTKESFRKVYEWKFINCLELWTGAICAYSSESDFKQLAYPLTQIISGVARLVPTARYFPLRLRCVRMLNQIAASTHSFIPVSMLLLDMLEMKELNRPPTGGVGKAVDLHSILKVSKLTLKTRAFQEACVISVVEELAEHLAQWSYSVAFLELSFIPLVRLRSFCKSTKVERFRKEMRQLIRQIEASSDYVNGKRLSISFFPNDPAAASFLEV

SEQ ID NO: 210328 - protein, 51 aa, Glycine max
  Coding DNA Sequence Number=SeqID_93550
MVLSRSKYMMPCTLHSALLDDLGNVGQRRAIAPLEGKGEIEDQLAKLCFGN

SEQ ID NO: 210329 - protein, 199 aa, Glycine max
  Coding DNA Sequence Number=SeqID_93551
  Gene Ontology: Mol. function=small conjugating protein ligase activity; Cellular component=endoplasmic reticulum; Biological process=ubiquitin-dependent protein catabolic process
  Homolog annotation: Hit_ID=Q42541; Match level="QueryCoverage=64%, HitCoverage=77%, E-value=7e-53, Identity=76%"; Hit description =Ubiquitin-conjugating enzyme E2 13
  Pfam annotation: Domain name=UQ_con; Domain location=8-155; Score =262.9; E_value=6.4e-76; Accession=PF00179.16; Description=Ubiquitin -conjugating enzyme
MASQASLLLQKQLKDLCKNPVDGFSAGLVDETNIFEWSVTIIGPPDTLYEGGFFNAIMSFPPNYPNSPPSVKFTSELWHPNVYPDGRVCISILHPPGDDPNGYELASERWTPVHTVESIVLSIISMLSSPNDESPANVEAAQPFPQSYLMATICILEKKRYLICGEILTSPRFVKHRNKEKHGNASFSTISAGLAMEWG

SEQ ID NO: 210330 - protein, 126 aa, Glycine max
  Coding DNA Sequence Number=SeqID_93552
MAAEWRRKRERRRHFKEKMSLEEAHHHRRPWIRAWRKKEMNEGRGREEHEILCSKRALKSEIIGPNLGPWAQKSTLRFMRTLGPSSTALAQSSWSLLLMVLVIGPFLGRIASVVLTLLLYTVVCLV

SEQ ID NO: 210331 - protein, 434 aa, Glycine max
  Coding DNA Sequence Number=SeqID_93553
  Gene Ontology: Mol. function=ATP-dependent peptidase activity; Cellular component=integral to membrane; Biological process=ATP -dependent proteolysis
  Homolog annotation: Hit_ID=Q00M73; Match level="QueryCoverage=85%, HitCoverage=71%, E-value=2e-64, Identity=39%"; Hit description =Membrane protein-like protein
  Pfam annotation: Domain name=DUF81; Domain location=8-398; Score= -26.2; E_value=0.00031; Accession=PF01925.9; Description=Domain of unknown function DUF81
  Pfam annotation: Domain name=MFS_1; Domain location=15-371; Score= -42.7; E_value=0.029; Accession=PF07690.6; Description=Major Facilitator Superfamily
  Pfam module annotation: Pfam domain module=DUF81::MFS_1; Domain location=8-398::15-371
MEFSWRIVVGTLIGILGAAFGSVGGVGGGGIFVPMLILIIGFDPKSAVAISKCKHFSISVSIFCPEMMLTLLIIGFPGKKLLVDKLVRACFGMVTGAAISAVFFCMKQRHPTLDEPVIDYDLMLLIQPTLMLGISIGVILSVIFADWMVTILLIILCIVTSIRAFFMGADTWKKETKMKEESQETIKLSESTATCSEEEGYKYLPGCSDEGYEKDTRKPELLYAIKECNYPCRDSLLTELYSFLFSHILDTYFVTGFYLYQARALYQGRAAGSQHTHWPLHHLFLASICSLLAGIVGGLLGTGSGFVMGPLFLEVGIAPQVASATATFGMMYSSSLSVIQYYLLNRFPVPYALFLTLVAAIAAFLGQYLIDKLSEGYVLLDFSFLFRSLSEQSSCSASFALPCENLQHSNIAFTSMPVYRWSRHIKHDLEDSKE

SEQ ID NO: 210332 - protein, 204 aa, Glycine max
  Coding DNA Sequence Number=SeqID_93554
MADISLCCQVLSRPLLALSIATLFPDLSKCSDGKSDCSTDSQDAVAYSELSPLQVDLNTSQCLTDPKILESEKWLTQLYQELENQGLSLPESLYDGHMYIHICLYEKLFGTLSNTSDFILCILSQVLKSGPGIVFSVSNSMFTAYFLVSPVATDHDLVGFYAESMMMSFGDFMQLLIMIFHASLPQSRRPYDGERLTEFFQKKN

SEQ ID NO: 210333 - protein, 80 aa, Glycine max
  Coding DNA Sequence Number=SeqID_93555
MNSRRRLADVCGSHKKCCDLQLGFSSSFCEQKDIQLNVWIGSPVTVEPSIVPFVLEKPTALLYLYMAVFPSASVLCLLGW

SEQ ID NO: 210334 - protein, 428 aa, Glycine max
  Coding DNA Sequence Number=SeqID_93556
  Homolog annotation: Hit_ID=Q2HT93; Match level="QueryCoverage=98%, HitCoverage=51%, E-value=3e-58, Identity=34%"; Hit description=P -type trefoil
MRLMNMPPLWRECLSSAFRTALACTIVGCVTLYGPSSICTLVAFPAFSYVTAILIIINDAALGDALRGCWLALYATFQSMGPAMLSLWAVGPGRFSKATSAAAVALAAFVVVLPWPQSTHLIAKRVSLGQIVLVYVVAYANGVHTDPIMHPISLAASTALGVLACVVALLLPYPRLASSQMNQSYKRLTKNILKRLKLLVKVICEEDKITAVGLMSHAKSLVTKRTKLLSIIIRYNEGMQWERLPIKIFRSHCLSLIERLQEVDTNLRGMELALACTNSFPINILDQDFKHGLNSLEEHVTLTIKQAKQSLRDGSLTVPESNAKTTTHFLQSLHTIPTTYQELSICFFLFCAKLLHKKSLTEPPTCTQDLLVKKNGNSPKEKLANLIATLRNTNLMPAIKFSLSLGLSVFMGLIYSKENGFWAGLPVA

SEQ ID NO: 210335 - protein, 199 aa, Glycine max
  Coding DNA Sequence Number=SeqID_93557
  Gene Ontology: Mol. function=protein serine/threonine kinase activity; Cellular component=mitochondrion; Biological process=RNA -dependent DNA replication
MAQRELIELNHQDWAKLMQQDKFSMTTIYRLLLKEEIYVPWRFLMHNNHARPLAKLTLWMVCHGRLPTMDRLHRFGMIQETICKLCKEKNESLTHLFFECGMTKTVWDQVLHWLNLNHRIKGWNEELDWIISQTGKKGWRASILKLAFTEAVYGIWHHRNGTVFGHTVSNNLVNDIIDNIVYRGWYTNKLRKHIANLLL

SEQ ID NO: 210336 - protein, 196 aa, Glycine max
  Coding DNA Sequence Number=SeqID_93558
  Gene Ontology: Mol. function=nucleic acid binding; Cellular component= mitochondrion; Biological process=DNA integration
MSEQHWVAVKRILRHLNGTLHFGLELEPIFSTKHYSVHAFCDADWASDPDDRRSTSGAAAFLGPNLVSWWSKNQSIVARSSTEAEYRSLALATAEVTWIQSLLTELKVPHAPPVIFCDNMSTVSLVHNPVLHSCTKHIELDLFFVREKVLGKQLQVVHVPAADQRADILTRAVSPSNFLINRSKLRVVEKHSANHC

SEQ ID NO: 210337 - protein, 336 aa, Glycine max
  Coding DNA Sequence Number=SeqID_93559
  Gene Ontology: Mol. function=translation initiation factor activity; Cellular component=cytosol; Biological process=regulation of translational initiation
  Homolog annotation: Hit_ID=O64760; Match level="QueryCoverage=95%, HitCoverage=45%, E-value=1e-130, Identity=70%"; Hit description =Putative translation initiation factor eIF-2B epsilon subunit
  Pfam annotation: Domain name=NTP_transferase; Domain location=21-248; Score=-85.5; E_value=0.0023; Accession=PF00483.13; Description =Nucleotidyl transferase
MGAQKKRVSEDPDELVRVPLQAILLADSFTTKFRPITLERPKVLLPLVNVPMINYTLTWLESAGVEDVFVFCCSHSKQVISYLEKSEWLSQPNFTVTTVESQNSVSAGDALRVIYERNVIHGDFVLISGDTVSNMSLTQALLEHKERKKKDSNAVMTMVIKRSKPNPAIHQSRLGTDELFMAIDPNTKQLLYYEDKADQSKGKLHLDKSLLFDNPSLSLHHDKQDCYIDICSPEVLSLFTDNFDYQHLRRHFVKGLLVDDIMGYKIFVHEIHSDYAARIDNFRGYDTVSKDIIHRWTYPLVPDVMNFGNTATKLERQGMYRASGMDEIFSFYWACW

SEQ ID NO: 210338 - protein, 568 aa, Glycine max
  Coding DNA Sequence Number=SeqID_93560
  Gene Ontology: Mol. function=hydrolase activity, acting on glycosyl bonds; Cellular component=membrane; Biological process=metabolic process
  Homolog annotation: Hit_ID=Q9FXA8; Match level="QueryCoverage=67%, HitCoverage=57%, E-value=1e-172, Identity=75%"; Hit description =Putative invertase
  Pfam annotation: Domain name=Invertase_neut; Domain location=168-568; Score=762.5; E_value=2.6e-226; Accession=PF04853.3; Description=Plant neutral invertase
MKPSPKILIGYKNSTLLARCHHSLAMSMSNYSNPCSINLDHNTMQCPFHTREFGRIMHGNQQVFGLPSSSFGQSRSLSLSATRTAKRGASAIARVDFNFKARDFSGSVGTRASGNNGEMAYVKGGMNVKPIVVESVDNVEEESRLEVGEEDENTENLGGVKNADDEAENVEEETEVEKEAWRLLQEALVTYFDSPVGTVAANDSDSEQSLNYDQVFIRDFIPSALAFLLKGEKEIVKNFLLHTLQLQGLVCCLGMHFMKMKLLVLVIGHGFISQSWEKTVDCYSPGQGLMPASFKVKTVELDQGKTEEVLDPDFGESAIGRVAPVDSGLWWITLLRAYGKITGDYSLQERLDVQTGLRMIINLCLTDGFDMFPSLLVTDGSCMIDRRMGIHGHPLEIQALFYSALRSAREMVTEDEKSNNLVGEINNRLSALLFHIREYYWLDMRKLNEIYRYKTEEYSLDATNKFNIYPDQIPKWLMDWIPEEGGYLLGNLQPAHMDFRFFMLGNLWSVVSSLGTPRQNNAILNLIETKWGDLVGEMPLKICYPALEHHEWRIITGSDPKNTYKLFP

SEQ ID NO: 210339 - protein, 95 aa, Glycine max
  Coding DNA Sequence Number=SeqID_93561
  Gene Ontology: Mol. function=calcium ion binding; Cellular component =oxygen evolving complex; Biological process=photosynthesis
  Homolog annotation: Hit_ID=O23403; Match level="QueryCoverage=94%, HitCoverage=33%, E-value=8e-21, Identity=61%"; Hit description =Thylakoid lumenal 21.5 kDa protein, chloroplast precursor
MEAAESNLAVDKENHAKAFAVPRRKAMSLILSSYVLSEVGLALAQQSPVFREYIDAFDGCSFQYPGSWIQVRGAGADIFFRDPFVLDENLSVEIS

SEQ ID NO: 210340 - protein, 105 aa, Glycine max
  Coding DNA Sequence Number=SeqID_93562
MLTPLLMPIAIPCPAPRQQSPTPISTPLPMAGKGDGPAIGIDSSTTYFPVRVWQHHRVDINLHLLLHLHFCFDCPTLRTRLAFPAEGNNSNTDGNNNTKSLIPLP

SEQ ID NO: 210341 - protein, 328 aa, Glycine max
  Coding DNA Sequence Number=SeqID_93563
  Gene Ontology: Mol. function=molecular_function; Cellular component =membrane; Biological process=auxin mediated signaling pathway
  Homolog annotation: Hit_ID=Q84TV1; Match level="QueryCoverage=56%, HitCoverage=52%, E-value=4e-56, Identity=58%"; Hit description =Nodulin-like protein
  Pfam annotation: Domain name=Arm; Domain location=189-230; Score =28.7; E_value=2e-05; Accession=PF00514.13; Description=Armadillobeta- catenin-like repeat
  Pfam annotation: Domain name=Arm; Domain location=233-274; Score =26.6; E_value=9e-05; Accession=PF00514.13; Description=Armadillobeta- catenin-like repeat
  Pfam annotation: Domain name=DUF6; Domain location=24-153; Score =76.0; E_value=1.2e-19; Accession=PF00892.11; Description=Integral membrane protein DUF6
  Pfam annotation: Domain name=HEAT; Domain location=196-232; Score =10.5; E_value=2.2; Accession=PF02985.12; Description=HEAT repeat
  Pfam annotation: Domain name=HEAT; Domain location=240-276; Score =7.0; E_value=6; Accession=PF02985.12; Description=HEAT repeat
  Pfam annotation: Domain name=TPT; Domain location=15-153; Score= -23.0; E_value=0.012; Accession=PF03151.7; Description=Triose -phosphate Transporter family
  Pfam module annotation: Pfam domain module=Arm::Arm::DUF6::HEAT::HEAT: :TPT; Domain location=189-230::233-274::24-153::196-232::240-276::15 -153
MEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGNNGRVVFDANFIPPLVQILQHSEFDVKKAAARAIFYVTSEGSQDHIRYLAYEEGCIKGLCDLLSCPDPMVVSTCLEGLENILRVGDADKEMGVNVFVQRVHKYEGWDKIEIFMNHWNNEISLRAVRIVEEMKNDASP

SEQ ID NO: 210342 - protein, 523 aa, Glycine max
  Coding DNA Sequence Number=SeqID_93564
  Gene Ontology: Mol. function=protein transporter activity; Cellular component=nuclear pore; Biological process=intracellular protein transport
  Homolog annotation: Hit_ID=Q94KB0; Match level="QueryCoverage=96%, HitCoverage=95%, E-value=1e-152, Identity=56%"; Hit description =Importin alpha 1
  Pfam annotation: Domain name=Arm; Domain location=102-143; Score =37.7; E_value=4.1e-08; Accession=PF00514.13; Description =Armadillobeta-catenin-like repeat
  Pfam annotation: Domain name=Arm; Domain location=145-187; Score =46.4; E_value=9.5e-11; Accession=PF00514.13; Description =Armadillobeta-catenin-like repeat
  Pfam annotation: Domain name=Arm; Domain location=189-230; Score =10.6; E_value=0.59; Accession=PF00514.13; Description=Armadillobeta -catenin-like repeat
  Pfam annotation: Domain name=Arm; Domain location=240-274; Score =22.6; E_value=0.0014; Accession=PF00514.13; Description =Armadillobeta-catenin-like repeat
  Pfam annotation: Domain name=Arm; Domain location=276-316; Score =37.6; E_value=4.2e-08; Accession=PF00514.13; Description =Armadillobeta-catenin-like repeat
  Pfam annotation: Domain name=Arm; Domain location=318-359; Score =42.1; E_value=1.9e-09; Accession=PF00514.13; Description =Armadillobeta-catenin-like repeat
  Pfam annotation: Domain name=Arm; Domain location=361-401; Score =43.4; E_value=8e-10; Accession=PF00514.13; Description=Armadillobeta- catenin-like repeat
  Pfam annotation: Domain name=Arm; Domain location=404-444; Score =26.1; E_value=0.00012; Accession=PF00514.13; Description =Armadillobeta-catenin-like repeat
  Pfam annotation: Domain name=HEAT; Domain location=108-145; Score =10.1; E_value=2.5; Accession=PF02985.12; Description=HEAT repeat
  Pfam annotation: Domain name=HEAT; Domain location=150-189; Score =7.1; E_value=5.7; Accession=PF02985.12; Description=HEAT repeat
  Pfam annotation: Domain name=HEAT; Domain location=241-276; Score =13.7; E_value=0.67; Accession=PF02985.12; Description=HEAT repeat
  Pfam annotation: Domain name=HEAT; Domain location=282-318; Score =2.8; E_value=20; Accession=PF02985.12; Description=HEAT repeat
  Pfam annotation: Domain name=HEAT; Domain location=324-361; Score =0.1; E_value=42; Accession=PF02985.12; Description=HEAT repeat
  Pfam annotation: Domain name=HEAT; Domain location=410-446; Score =3.3; E_value=17; Accession=PF02985.12; Description=HEAT repeat
  Pfam annotation: Domain name=HEAT; Domain location=63-100; Score=0.1; E_value=41; Accession=PF02985.12; Description=HEAT repeat
  Pfam annotation: Domain name=IBB; Domain location=8-92; Score=46.7; E_ value=8e-11; Accession=PF01749.10; Description=Importin beta binding domain
  Pfam module annotation: Pfam domain module=Arm::Arm::Arm::Arm::Arm::Ar m::Arm::Arm::HEAT::HEAT::HEAT::HEAT::HEAT::HEAT::HEAT::IBB; Domain location=102-143::145-187::189-230::240-274::276-316::318-359::361 -401::404-444::...
  Pfam module annotation: Domain location=108-145::150-189::241 -276::282-318::324-361::410-446::63-100::8-92
MSLGPGSGSGSGSETRKKGYKTAIVAEEGRRRREEDLIGIRKNKRRDALLNKRRVTHAVPSYDTLLELEAIPVMLQRLCSQYPDSQLEITSHLNTLLALVDQRPPIDKILTEGILPLFVELLSRHDAPQLQFEALSVLTNLASGTSEYKRVIVELGVVPTLVNLLSSSSSNNDIREETICALGNIAGDSPSYRDFVLSHGALSPLLSQLEPESLLQLEPHSAWAMLRLATWCLSILVCGYPPVKSALPVLRRLIHSTDEEVVADACWALSYLSDVPINNIQDIIEAGVCPKLVELLLYPSDAVIEPALRTLRNIVYGDDAQTQHVIDSQLLPCLHQLLTQEHKKNIIKEACWTISNIAAGNRAQIQAVIDANIIPPLVGFLLRAEFDIKEDVAWAIFNVTSRGSHDNIRYLAAQGCIKALCDLLSYPDPMINSICLEGLENILSVGKADKEMGLHGKGNIFALRVDECEGWDKIENLLTHQNNQISERAAMIVDKFWRENDLEDMNVDKNDGDGSDQDLSFDF

SEQ ID NO: 210343 - protein, 548 aa, Glycine max
  Coding DNA Sequence Number=SeqID_93565
  Gene Ontology: Mol. function=protein transporter activity; Cellular component=nuclear pore; Biological process=intracellular protein transport
  Homolog annotation: Hit_ID=Q94KB0; Match level="QueryCoverage=77%, HitCoverage=87%, E-value=1e-115, Identity=50%"; Hit description =Importin alpha 1
  Pfam annotation: Domain name=Arm; Domain location=128-169; Score =29.9; E_value=8.9e-06; Accession=PF00514.13; Description =Armadillobeta-catenin-like repeat
  Pfam annotation: Domain name=Arm; Domain location=208-246; Score =19.8; E_value=0.0099; Accession=PF00514.13; Description =Armadillobeta-catenin-like repeat
  Pfam annotation: Domain name=Arm; Domain location=248-288; Score =46.2; E_value=1.1e-10; Accession=PF00514.13; Description =Armadillobeta-catenin-like repeat
  Pfam annotation: Domain name=Arm; Domain location=290-331; Score =35.1; E_value=2.4e-07; Accession=PF00514.13; Description =Armadillobeta-catenin-like repeat
  Pfam annotation: Domain name=Arm; Domain location=333-373; Score =44.0; E_value=5.2e-10; Accession=PF00514.13; Description =Armadillobeta-catenin-like repeat
  Pfam annotation: Domain name=Arm; Domain location=376-416; Score =28.2; E_value=2.8e-05; Accession=PF00514.13; Description =Armadillobeta-catenin-like repeat
  Pfam annotation: Domain name=Arm; Domain location=85-126; Score=18.6; E_value=0.022; Accession=PF00514.13; Description=Armadillobeta -catenin-like repeat
  Pfam annotation: Domain name=DUF634; Domain location=161-396; Score= -148.0; E_value=0.014; Accession=PF04826.4; Description=Protein of unknown function (DUF634)
  Pfam annotation: Domain name=HEAT; Domain location=133-171; Score =3.7; E_value=15; Accession=PF02985.12; Description=HEAT repeat
  Pfam annotation: Domain name=HEAT; Domain location=212-248; Score =6.8; E_value=6.3; Accession=PF02985.12; Description=HEAT repeat
  Pfam annotation: Domain name=HEAT; Domain location=254-290; Score =8.9; E_value=3.5; Accession=PF02985.12; Description=HEAT repeat
  Pfam annotation: Domain name=HEAT; Domain location=296-333; Score =1.4; E_value=29; Accession=PF02985.12; Description=HEAT repeat
  Pfam annotation: Domain name=HEAT; Domain location=338-375; Score =6.1; E_value=7.7; Accession=PF02985.12; Description=HEAT repeat
  Pfam annotation: Domain name=HEAT; Domain location=91-128; Score =13.3; E_value=0.88; Accession=PF02985.12; Description=HEAT repeat
  Pfam module annotation: Pfam domain module=Arm::Arm::Arm::Arm::Arm::Ar m::Arm::DUF634::HEAT::HEAT::HEAT::HEAT::HEAT::HEAT; Domain location =128-169::208-246::248-288::290-331::333-373::376-416::85-126::161 -396::133-171::...
  Pfam module annotation: Domain location=212-248::254-290::296 -333::338-375::91-128
MSERTGSGSGSDRTKRSNTSGVEPHESRRRKEENLIGVRRQKRARLRYPTLTAIPKLLQSLCSEYPALESQITSHLNTLLALDDQIPLIDDVLKDVVLPRFVKFLDDEKEPQFQLEALWVLTNFAEASSKHTKVVLEVGVIPRIVSILKYNSEVEILEQAIYALGLIADYSPSYRDRALSNGSLRPLLSLVESLPGSSMLIARTLCSLVQGKPPVKNALPVLQKLIHTANEEVVSDACWALYHLSEGPEDQIQAIIEAGVCPKLVELLQHSSVAVISPALQTLGNIVTGDNAQKQIVVDNQVLPGLYQLLMRGNRKSIRIEACLAISNITSGNEAQIEAVLKANIIPQLVQILQQDELDIKSEAAWAIYNATAGGSHDNIRLLADQGCIKALCDILTCPDLTVVSVSLEGLENILKVVGEAAKEMVCGCEGLDKIQNLLTLTMECDENEDDENEDENEHEEKLEVFEIAHRILKTFWPELGLEENELENPLDGSLPFEPCMAQDYFFVLKMWDTCLAYYQKLLTGYMIIQSVLLVKCLAFNGHSSMKC

SEQ ID NO: 210344 - protein, 66 aa, Glycine max
  Coding DNA Sequence Number=SeqID_93566
MDELKDLIKQVAPRGIPPYGVDETQMDVMKVLIESNYWKKIGPIEILAVFSKLVSQMEDELPLSQN

SEQ ID NO: 210345 - protein, 139 aa, Glycine max
  Coding DNA Sequence Number=SeqID_93567
MGSVRIPKTGPTASDPRHSASYCEMKAAKPLGGGDGWIIIPQYMTRMFVIIIHYYDLLLPLGVYRKPRPEASPPVSEFESPNTNTTGALSHPVPANAIAVKQDTNTGSHTENAPPQPIISFLLCRLPLPTYLSLSYPSI

SEQ ID NO: 210346 - protein, 269 aa, Glycine max
  Coding DNA Sequence Number=SeqID_93568
  Gene Ontology: Mol. function=hydrolase activity, acting on ester bonds; Cellular component=cellular_component; Biological process =lipid metabolic process
  Homolog annotation: Hit_ID=Q5ZDS5; Match level="QueryCoverage=97%, HitCoverage=58%, E-value=2e-63, Identity=48%"; Hit description =Putative early nodule-specific protein ENOD8
  Pfam annotation: Domain name=Lipase_GDSL; Domain location=21-251; Score=148.4; E_value=1.8e-41; Accession=PF00657.12; Description=GDSL- like LipaseAcylhydrolase
MEQTLQWWGPLLSQNMFLSPSIYRSCSSGVSKLVPLNLLPQELIALQTYKGTRNLINDEGFHGALYLIDIGQNDLADSFAKNLSYVQVIKKIPVVITEIENAVKSLYNEGARKFWVHNTGPLGCLPKVLALAQKKDLDSLGCLSSYNSAARLFNEALLHSSQKLRSELKDATLVYVDIYAIKYDLITNAAKYGFSNPLMVCCGYGGPPYNFDVRVTCGQPGYQVCDEGARYVSWDGIHQTEAANTLIASKILSMAYSTPRIPFDFFCHH

SEQ ID NO: 210347 - protein, 64 aa, Glycine max
  Coding DNA Sequence Number=SeqID_93569
VDCQGCQGMAEDLGTIAEDLERVINLRMITKGTDLYDIMTRCLRRARGDAADGSLRLRQRCRID

SEQ ID NO: 210348 - protein, 124 aa, Glycine max
  Coding DNA Sequence Number=SeqID_93570
  Gene Ontology: Mol. function=glucose-6-phosphate 1-dehydrogenase activity; Cellular component=chloroplast; Biological process =carbohydrate metabolic process
  Homolog annotation: Hit_ID=Q93ZW0; Match level="QueryCoverage=72%, HitCoverage=15%, E-value=4e-27, Identity=67%"; Hit description =Glucose-6-phosphate 1-dehydrogenase 4, chloroplast precursor
  Pfam annotation: Domain name=G6PD_N; Domain location=27-121; Score= -32.3; E_value=1.6e-09; Accession=PF00479.12; Description=Glucose-6 -phosphate dehydrogenase, NAD bin
MESPSLLQTGLSGAPMDVSRKPSLCIAVIGATGELAKRKIFPALFALYYSGFLPENVGIFGYSRKDITDEDLQSIIASTLTCRVDHQYDFLTSSQIVTFYVLLPVHGQIFSTEVYTQNLGNCIA

SEQ ID NO: 210349 - protein, 184 aa, Glycine max
  Coding DNA Sequence Number=SeqID_93571
  Gene Ontology: Mol. function=oxidoreductase activity; Cellular component=membrane; Biological process=electron transport
  Homolog annotation: Hit_ID=Q8LF37; Match level="QueryCoverage=58%, HitCoverage=34%, E-value=4e-28, Identity=41%"; Hit description =Cytochrome P450, putative
MVYIKATDEKSAEMVTDEGIGYDVFEFVSLNFAVVLVSLSTFGYSLVLLDFSFNIGILSVFGHLEDNYRDQLKENYCIVEKGYNSFPNRIPGTAYSKALLRDLLGHFLNYKDEKGQMLSGDQIANNVIGAEQMAVYEANEGGKMPLTWGQTRNMPITHREKKRNMLGKLLCYLLISTAIAIRIY

SEQ ID NO: 210350 - protein, 106 aa, Glycine max
  Coding DNA Sequence Number=SeqID_93572
  Homolog annotation: Hit_ID=Q9ASU7; Match level="QueryCoverage=37%, HitCoverage=11%, E-value=3e-14, Identity=95%"; Hit description=Peter Pan-like protein
MLVLLNYNKDTKLIDFRHYSIRLQPVGVSRRIRKLVQSHQVQILGSPGKQGSCLSGLFLLVLLNIPHARQIQAQIQTSGNGKQALQGPISPKIIISETKGDFVQEM

SEQ ID NO: 210351 - protein, 73 aa, Glycine max
  Coding DNA Sequence Number=SeqID_93573
MVLNGVLLGNNYGVAARVASDMMGSGISHGGGGRSWWWCERSPTTTVVVGEWWRCRERLREGEYKEERRKAKF

SEQ ID NO: 210352 - protein, 78 aa, Glycine max
  Coding DNA Sequence Number=SeqID_93574
ALDSAIGNYENLEGENGIPARTKQGSGAFLGCELGAKARPTGQALGPVREEILKQTRRFRNQAVHLICFFCSLESGSL

SEQ ID NO: 210353 - protein, 80 aa, Glycine max
  Coding DNA Sequence Number=SeqID_93575
MRCLMQTFLRNSSSRFSTNFFLLSDIIVFGMLKRHMILLEFLQPFFNANLRLSEERTSIRQEYLERAILLVSLKQEQVQA

SEQ ID NO: 210354 - protein, 145 aa, Glycine max
  Coding DNA Sequence Number=SeqID_93576
  Subcellular localization annotation: CTP_CleavageSite=50; ConfidenceScore=5.56e-01
MALITSWSILCQAKSKKFCIVILSSTKRNVRKANMTSLQKKPRMFHLFSRTNEKNSIARRYISLGFSGQLIEVGGLFATSSVSLLDLVDVILQILRYDFIEVRVDEDEEGYQLDNYSIQPLLKISPKDVVGPYIVNLSELLNRTV

SEQ ID NO: 210355 - protein, 117 aa, Glycine max
  Coding DNA Sequence Number=SeqID_93577
  Subcellular localization annotation: CTP_CleavageSite=42; ConfidenceScore=5.50e-01
MLDLYILKFQNPSPTLSSRSLFFTLASSSLLVRFFFVTELVCGSHGSSKELVCHHCRGLFGVLTLHSVWGAHSCSQGVLFSECALFLLHFSLLKDLEGFMGLMYGVVGVVCPIEPGA

SEQ ID NO: 210356 - protein, 564 aa, Glycine max
  Coding DNA Sequence Number=SeqID_93578
  Gene Ontology: Mol. function=transferase activity; Biological process= alkaloid metabolic process
  Homolog annotation: Hit_ID=Q9LU88; Match level="QueryCoverage=81%, HitCoverage=95%, E-value=3e-69, Identity=35%"; Hit description =Acetyltranferase-like protein
  Pfam annotation: Domain name=Transferase; Domain location=99-550; Score=256.8; E_value=4.5e-74; Accession=PF02458.6; Description =Transferase family
MEDANGGEAGENESQHGGEEARREETKGAEEEDARRKANLKWKIGNIGTSLNCWVHLATPNKQARLLICPRPHYLTLKSGTIDYATYFLNHTFASTKNMEVEIISTQCIKPSCTTPNHPNTYNLSILDQFMPSIYIPMVLFYSFAQSSQANIDSTITQQRLKQLKESLSQVLTHFYPFAGRVKDKFTIDCNDEGVHYTEAKVSCTLAEFFNQPNFSSLIHKLVPNQPIMELATEGYTAMVQVNCFACGGMVIGTLISHMIADGAGASFFLNSWGSNSNFSHQDAFDQFPNFDTPFPQNNNNYACPHDTNVMNLCGQFLNEGRVAMRRFLFDAEAISRLRAQGSSLTVQNPTRVEVVTSLLCKCTAKVFNANFGLERPTLITHAVNMRRRASPMFPKSCMGNFAWLALALIMSSKDNKVIMELLPDLVVKLREAVSSINSDFVKGFEGDEGYAKYCEVSKELIEKASSFAATTTSGVNYVHFTSWCNFGLYDVDYGWGKPIWVSCVADSVDDSMFFNAVILMDTPSGNGIECWVYLNEDEMAILQQDKELLAFSTLDPNPQQLKD

SEQ ID NO: 210357 - protein, 538 aa, Glycine max
  Coding DNA Sequence Number=SeqID_93579
  Gene Ontology: Mol. function=polygalacturonase activity; Cellular component=amyloplast; Biological process=carbohydrate metabolic process
  Homolog annotation: Hit_ID=Q1RUL3; Match level="QueryCoverage=74%, HitCoverage=83%, E-value=1e-158, Identity=64%"; Hit description =Ribosome-binding factor A; Glycoside hydrolase, family 28
  Pfam annotation: Domain name=Glyco_hydro_28; Domain location=167-505; Score=330.8; E_value=2.4e-96; Accession=PF00295.8; Description =Glycosyl hydrolases family 28
MMHHSTVTSEHNCLPPQNSRHNYLLIFSPQTTTLLVFKLMPMVKEWLKLNNVVKPSLGSYDDAFAIVGAKTVVFSFFNVLNLRRITLFLIFITCLFFPTIRGKLHSHANGKQWLPMSRIWLPPSPSPEVVSPNANGPFVFNVKSFGAVGDGVSDDTEAFKLAWDAACHAEESGTLFVPKGHIFMIQSTTFTGPCNSKLTFKVDGTIWPPDGPDSWPLSSRKRQWLVFYRINGMLMQGSGLIDGRGEKWWNLSYKSHKGANGAKQLGPGDRPVAIRFFESSNLRVEGLKIKNSPKFHFRFDECQNVHVEKLIIKSPALSPNTDGIHIENTTNVNIHNSVISNGDDCVSVGAGCYNVDIRNITCGPSHGISIGSLGNYNSRACVSNITVSDSIIKHSDNGVRIKTWQGGRGAVSKVVFNNIQMDTVRNPIIIDQYYCPSKNCHNQSYAVSVSNVSYSNIKGTYDARSPPMRFACSDSVPCTNLTLSEVELLPAAHSQGKILTNPFCWKVYGTVQTLTTPHVLCLLEGNQLTLKPRDVVWC

SEQ ID NO: 210358 - protein, 245 aa, Glycine max
  Coding DNA Sequence Number=SeqID_93580
  Gene Ontology: Mol. function=protein serine/threonine kinase activity; Cellular component=beta-catenin destruction complex; Biological process=protein amino acid phosphorylation
  Homolog annotation: Hit_ID=P43289; Match level="QueryCoverage=94%, HitCoverage=50%, E-value=1e-107, Identity=81%"; Hit description =Shaggy-related protein kinase gamma
  Pfam annotation: Domain name=Pkinase; Domain location=1-182; Score= -20.7; E_value=2.5e-07; Accession=PF00069.15; Description=Protein kinase domain
MTVRQQLLTESVSMQVNPHTHQVKICDFGSAKVLVKGEPNISYICSRYYRAPELIFGATEYTTAIDVWSVGCVLAELMLGQPLFPGESGVDQLVEIIKGSFERNFMFSHALAQVLGTPTREEIKCMNPNYTEFKFPQIKAHPWHKIFHKRMPPEAVDLVSRLLQYSPNLRCTALDALTHPFFDELRDPNTRLPNGRFLPPLFNFKSHVLADVLAACVPELKGVPVEILLKLIPEHARKQCPFLGL

SEQ ID NO: 210359 - protein, 181 aa, Glycine max
  Coding DNA Sequence Number=SeqID_93581
  Pfam annotation: Domain name=Dirigent; Domain location=15-167; Score=- 0.3; E_value=4.4e-06; Accession=PF03018.5; Description=Dirigent-like protein
MSPRIIFCSAVSLATIAVILLAVLSPVSHNKSHSKPWLDLSLYIQQPQIATSNTHLVPREDAGAFIFRRVLTEGPEKTSRVVGRAQGFVIPTEQFQQSEFNVMYLSFDTPDCSGSLSVQALKDKQEFKVIGGTGSFAFARGVALFTKTHDYSQQSQVAAAATYHVKLQLEFPNHSTKLLKR

SEQ ID NO: 210360 - protein, 65 aa, Glycine max
  Coding DNA Sequence Number=SeqID_93582
MYYFIFPTTDWPRKDMLEFQHWHIHLPKAPNLREEGRKRQRASNMTEAEVWSSSEETLTVFFIAD

SEQ ID NO: 210361 - protein, 313 aa, Glycine max
  Coding DNA Sequence Number=SeqID_93583
  Homolog annotation: Hit_ID=Q8W154; Match level="QueryCoverage=93%, HitCoverage=96%, E-value=5e-81, Identity=52%"; Hit description =Myrosinase
SLVRVLESSSGNTPCYSLVLFQDLLVSTSLSPDDTINLFTYAVLRLTPHALSSGTSSWSYLRKGSSASNVATESNMAHPSSLSESFYGSSDISSGEDNHYHVVRPLQSDKWSKGKDGYLVTDLWGAEVGTWVFASPTVWLQHTGEKMYLCVYQHRSLTLMLLIPVSSIPNGEQGVSAVRQQVVENASLKILKVEEKLSKGWGGDNAYHVSGYRYLLVDGDRNVSRASPATKVTTLTKESLLAMNKLRQEVELEKSRAKLDSRNCEKDLEELYMVLEKANETLLYASDAVEKFSDSLNCYPSCRKNDAENWGGG

SEQ ID NO: 210362 - protein, 760 aa, Glycine max
  Coding DNA Sequence Number=SeqID_93584
  Gene Ontology: Mol. function=zinc ion binding; Cellular component =endoplasmic reticulum; Biological process=ER to Golgi vesicle -mediated transport
  Homolog annotation: Hit_ID=Q9SFU0; Match level="QueryCoverage=79%, HitCoverage=58%, E-value=0.0, Identity=60%"; Hit description=Protein transport protein Sec24-like At3g07100
  Pfam annotation: Domain name=Sec23_BS; Domain location=689-757; Score= 55.8; E_value=1.4e-13; Accession=PF08033.2; Description=Sec23Sec24 beta-sandwich domain
  Pfam annotation: Domain name=Sec23_trunk; Domain location=447-687; Score=410.8; E_value=1.9e-120; Accession=PF04811.5; Description =Sec23Sec24 trunk domain
  Pfam annotation: Domain name=zf-Sec23_Sec24; Domain location=371-410; Score=75.0; E_value=2.4e-19; Accession=PF04810.5; Description =Sec23Sec24 zinc finger
  Pfam module annotation: Pfam domain module=Sec23_BS::Sec23_trunk::zf -Sec23_Sec24; Domain location=689-757::447-687::371-410
  Subcellular localization annotation: CTP_CleavageSite=54; ConfidenceScore=5.75e-01
MGTENPGRPTFPPSRPASSPFAAAQTVSPFSSSGPVAGSEPPSFRPSPPAPPPQAATPFSSAGPAAVRPGAPSFRPAPPGRFNDPSVPLPVRPSNASPAAGPFQQFPPAPSFPPTMQPRGPPLPMGPPSIQSPPSQAQPFPTSLPAQPQMPSVPMGSPPPQSAAPAHLGSNFPPPPTIQPSFPGYPSKQAGPEMQAPPMHSSFPANQGNFGPVPPAAASPFLSHPGGYVPPPPMAPPLGIQPMQQPGSVPPMGAVQGLAEDFNALTLQTRPGTMDPLFDAKELPRPLEGDIEPKNLVDMYPMNCNPRYLRLTTSAVPSSQSLASRWHLPLGAVVCPLAEPPDGVSASLPCLMSRNILGHEEVPIVNFAPASVVRCRRCRTYVNPYMTFTEAGRKFRCNVCTLLNDVPSEYYAQLDATGKRVDINQRPELTKGTVEFVAPAEYMVRPPMPPVYFFLIDVSISAVRSGMIEVVANTIKSCLDELPGFPRTQIGFATFDSTIHFYNMKSSLTQPQMLVVSDLDDIFIPLPDDLLVNLSESRSVVETFLDSLPTMFQDNVNLESAFGPALKAAFMVMSQLGGKLLIFQNTLPSLGVGRLKLRGDDSRVYGTDKEHGLRLPEDPFYKQMAAEFSKYQISTNVYAFSDKYTDIASLGTLAKYTAGQVYYYPAFQSAIHGEKLRHELRRDLTRETAWEAVMRIRCAKGVRFTTYHGNFMLRSTDLLALPAVDCDKAFAMQLSLEETLLTTQTMYLQVALLYPFFDNF

SEQ ID NO: 210363 - protein, 419 aa, Glycine max
  Coding DNA Sequence Number=SeqID_93585
  Gene Ontology: Mol. function=catalytic activity; Cellular component =beta-galactosidase complex; Biological process=carbohydrate metabolic process
  Homolog annotation: Hit_ID=Q0PKY2; Match level="QueryCoverage=99%, HitCoverage=98%, E-value=1e-162, Identity=64%"; Hit description=Endo- 1,4-beta-mannanase
  Pfam annotation: Domain name=Cellulase; Domain location=54-379; Score= -39.7; E_value=7.3e-05; Accession=PF00150.8; Description=Cellulase (glycosyl hydrolase family 5
MGFQNLVLMAFMMTLIVIGQYEHCMATGRLHFHHHSHKNLTTKKLHGGFIERSNTHFYLNGKPHYLNGFNSYWLMNVASDPSTSSKVSITFQEASQHGLNVARTWAFNDGGYNALQISPGSYNENVFKGLDFVISEAGKNGVRLILSLVNNWNDYGGKSQYVQWARERGQYVNNDDDFFSHPIVKEYYKNHVKTMLTRKNTITGLTYQNDPTIFAWELMNEPRSQNDYSGKSIQDWVREMAAYVKSIDNNHLLEVGLEGFYGESMPDKKQFNPGYQVGTDFISNNQVPEIDFTTIHLYPDQWVSNSNESAKDDFVSKWVQAHIQDSNDILGKPILFTEFGKSSKSSGYSVDKRDNYFEKIYNFIFNSASNGGPCAGGLFWQLMTQGMDDLHDGNEIICDENPSTANVITQQSKKMSNLG

SEQ ID NO: 210364 - protein, 201 aa, Glycine max
  Coding DNA Sequence Number=SeqID_93586
  Gene Ontology: Mol. function=RNA-directed DNA polymerase activity; Cellular component=chromatin; Biological process=chromatin assembly or disassembly
MPTIDELLDDLGQTSWFSKLDLCQGFYQIRIVEDDIHKTAFRTHQGHYEFNVMMPFSLCNAPSTFQATMNDALQPFLGKHVAVFFEDILVYSLTLSSHTEHLESIFEGTNWANSISLTVASIFKNSFGIPHLSFEATSGALVGQSRHIFPFCLEPPPSGPTTFYIGLEVGLLVNTANQTRSRSMGGLGPGGHYLGTVGHLV

SEQ ID NO: 210365 - protein, 74 aa, Glycine max
  Coding DNA Sequence Number=SeqID_93587
MARLNLSHREHSGYLFLDFGLLEMGISIGLDVDRGVVWKKKTRVGLGLVSNGRKLKCSVCGQSASIVGLSLVKV

SEQ ID NO: 210366 - protein, 495 aa, Glycine max
  Coding DNA Sequence Number=SeqID_93588
  Gene Ontology: Mol. function=hydrolase activity; Cellular component =intracellular; Biological process=protein amino acid phosphorylation
  Homolog annotation: Hit_ID=Q8LI18; Match level="QueryCoverage=85%, HitCoverage=97%, E-value=1e-129, Identity=41%"; Hit description =Selenium-binding protein-like
  Pfam annotation: Domain name=PPR; Domain location=185-219; Score =38.6; E_value=2.2e-08; Accession=PF01535.11; Description=PPR repeat
  Pfam annotation: Domain name=PPR; Domain location=220-254; Score =15.5; E_value=0.11; Accession=PF01535.11; Description=PPR repeat
  Pfam annotation: Domain name=PPR; Domain location=256-289; Score=2.7; E_value=3.6; Accession=PF01535.11; Description=PPR repeat
  Pfam annotation: Domain name=PPR; Domain location=322-356; Score=2.6; E_value=3.7; Accession=PF01535.11; Description=PPR repeat
  Pfam annotation: Domain name=PPR; Domain location=7-41; Score=44.0; E_ value=5.2e-10; Accession=PF01535.11; Description=PPR repeat
  Pfam annotation: Domain name=PPR; Domain location=82-116; Score=36.5; E_value=9.3e-08; Accession=PF01535.11; Description=PPR repeat
  Pfam module annotation: Pfam domain module=PPR::PPR::PPR::PPR::PPR::PP R; Domain location=185-219::220-254::256-289::322-356::7-41::82-116
MPVRDVVSWNTVIAGNAQNGMYEEALNMVKEMGKENLRPDSFTLSSILPIFTEHANVTKGKEIHGYAIRHGFDKDVFIGNAISWNSIIAGCVQNGRFDQGLGFFRRMLKEKVKPMQVSFSSVIPACAHLTALNLGKQLHAYIIRLGFDDNKFIASSLLDMYAKCGNIKMARYIFNKIEMCDRDMVSWTAIIMGCAMHGHALDAVSLFEEMLVDGVKPCYVAFMAVLTACSHAGLVDEGWKYFNSMQRDFGVAPGLEHYAAVADLLGRAGRLEEAYDFISNMGEEPTGSVWSTLLAACRAHKNIELAEKVVNKILLVDPGNMGAHVIMSNIYSAAQRWRDAAKLRVRMRKTGLKKTPACSWIEMEKEGYVLDTNEVLHDVDEEHKRDLLRTHSERLAIAFGIISTTSGTTIRVIKNIRVMGLVPVEITGEITGKWKPSMKVMQSKLLLEIKPMCSQLGEERAWEIQYPGLGGSAIPHLSGELGGCRFKSQEVNLGV

SEQ ID NO: 210367 - protein, 139 aa, Glycine max
  Coding DNA Sequence Number=SeqID_93589
  Homolog annotation: Hit_ID=Q9LTV8; Match level="QueryCoverage=60%, HitCoverage=12%, E-value=6e-08, Identity=31%"; Hit description =Selenium-binding protein-like
MARLGKFVEWGKMRVEFGVHVHQSVGGVQVEVETEANDGGVEGLSEIEVFEKRGCSEEGREQVAIGGDAERAQEVEGGEGVAEEAVRGVAFDDANPSQGVRCCFGGLHDLGVELFHVARGNHRVGVPEEASHHILAGTH

SEQ ID NO: 210368 - protein, 262 aa, Glycine max
  Coding DNA Sequence Number=SeqID_93590
  Gene Ontology: Mol. function=iron ion transporter activity; Cellular component=vacuolar membrane; Biological process=intracellular sequestering of iron ion
  Homolog annotation: Hit_ID=Q9ZUA5; Match level="QueryCoverage=89%, HitCoverage=88%, E-value=1e-92, Identity=75%"; Hit description =Putative membrane protein
  Pfam annotation: Domain name=DUF125; Domain location=31-259; Score =250.8; E_value=2.9e-72; Accession=PF01988.9; Description=Integral membrane protein DUF125
MAATEHRLSLEPEKKNLLRHHTEKHFTAGEIVRDIIIGVSDGLTVPFALAAGLSGANATSSIVLTAGIAEVAAGAISMGLGGKFNYGAKGANVSLCSYLAAKSETDHYARELKREQEEIIAVPDTEAAEVAETLAQYGIEAHEYAPVVNALRKNPQAWLDFMMKFELGLEKPDPRRALHSAMTIAIAYILGGVVPLVPYMFIQKAAEAVVFSVVVTLVALLIFGYAKGHFTGNKPFRSALETALIGAIASAAAFGLAKAFNP

SEQ ID NO: 210369 - protein, 260 aa, Glycine max
  Coding DNA Sequence Number=SeqID_93591
  Homolog annotation: Hit_ID=Q6EN61; Match level="QueryCoverage=27%, HitCoverage=37%, E-value=1e-09, Identity=45%"; Hit description =Antigen receptor-like protein
  Pfam annotation: Domain name=DUF565; Domain location=173-221; Score= -1.9; E_value=0.0092; Accession=PF04483.3; Description=Protein of unknown function (DUF565)
  Subcellular localization annotation: CTP_CleavageSite=38; ConfidenceScore=5.08e-01
MKELWKGAMASIGHTAPHASGSIHTPFLCVRFLRKMIRASIETTSYPNFTLNSHFALTNTHRVSKVALAAFFYKTTFCQKQCCPSFFSFGQPCLTFSFKRMTWSVRSSLNDSSFSPSTSNSTNGRTRIIRVIQEFQTKLGSKIQEVKKNLPLKLFFFLVGFYCATAFATVIGQTGDWDILSAALAVAVVEGIGALINLSLLHLIYAEAEVTLHCTKVGACSSSKRKLDCFLTGDIKTKFDTNNANWQKGNLSKEIVDHHF

SEQ ID NO: 210370 - protein, 257 aa, Glycine max
  Coding DNA Sequence Number=SeqID_93592
  Homolog annotation: Hit_ID=UPI00003845FE; Match level="QueryCoverage =59%, HitCoverage=32%, E-value=1e-27, Identity=38%"; Hit description =COG0778: Nitroreductase
MKLIILLVPEGTFPVLPSLAPENRGQPNKERIGRKKLGEKPRWDFSSELQRMLLWGIMSDKSGIGHTGYGWCNDVGLGGVQVAAAGINPKGPGGEARGFPRGEGEGVEEELGEGGFGNGGKREERGREIPAEWVGLVGPVEVVGPAGVVGEAVLDDDVEGEGEDDEEKEAMAWDWNEGGVNEGMRGGAGRKWRRSGDGGRVVVVMKIARLFPGLGKDRRGHGFKHLDLQQCEKFKEFGAPEFHHDCAKELEIHSEFK

SEQ ID NO: 210371 - protein, 64 aa, Glycine max
  Coding DNA Sequence Number=SeqID_93593
MPPPPSFSPPVQSPWVSAAKSEADHYARELKREQEEIIAVAETEAAEVAEILAGYGVEAHDLIS

SEQ ID NO: 210372 - protein, 310 aa, Glycine max
  Coding DNA Sequence Number=SeqID_93594
  Homolog annotation: Hit_ID=Q1SF96; Match level="QueryCoverage=99%, HitCoverage=52%, E-value=2e-86, Identity=49%"; Hit description =Membrane attack complex component/perforin/complement C9
  Pfam annotation: Domain name=MACPF; Domain location=117-310; Score =63.1; E_value=9e-16; Accession=PF01823.10; Description=MACPerforin domain
MGEGIVERALNSLGKGFDLASDFRLKFCKGEERLVLLNETEKRELMVPGFRPIRDVSVDIKCDKGDRTRYQSDILTFTQMSELFNQKSSIPGRIPSGYFNTVFGFDEGSWATDAANTKCLGIDGYFIKLFNAHIDRYPLVLSQQVLEAVPSSWDPPALARFIENFGTHILVGLSIGGKDLVLVKQDVSSNLEPSELKKHLDELGNQLFNGTCNFLPKSKEQKYKAPQAFDVFGPQIVAFNSSTSVCAKDGITVICAKRGGDTQVSDHSEWLLTVLKKPDAVDFSFIPITSLLKGAPGKGFLSHAINLYLR

SEQ ID NO: 210373 - protein, 144 aa, Glycine max
  Coding DNA Sequence Number=SeqID_93595
EIEDFARPQLTTTRENFATTQPEVDHNSPEVGHNLVETHWNLAGTFGAHRRIEKKISFDYKMVITRKSDPRLSACSTRAKTSTMQEIKAQMEQLCKKIKADLEASRQKHEANMLQLREENANPRARLAIHHPPPPPTPPHSPSY

SEQ ID NO: 210374 - protein, 70 aa, Glycine max
  Coding DNA Sequence Number=SeqID_93596
MVTTTTYDHDSSDDGGDHRMMVLTKVITLVVSDNNHGSSDDDSNNSGGSNDHLISSVYCNLMGHINSSHF

SEQ ID NO: 210375 - protein, 557 aa, Glycine max
  Coding DNA Sequence Number=SeqID_93597
  Gene Ontology: Mol. function=enzyme inhibitor activity; Cellular component=cell wall; Biological process=cell wall modification
  Homolog annotation: Hit_ID=Q7Y201; Match level="QueryCoverage=90%, HitCoverage=82%, E-value=9e-67, Identity=33%"; Hit description =Putative pectin methylesterase
  Pfam annotation: Domain name=PMEI; Domain location=46-194; Score =38.3; E_value=2.6e-08; Accession=PF04043.6; Description=Plant invertasepectin methylesterase inhibitor
  Pfam annotation: Domain name=Pectinesterase; Domain location=240-539; Score=352.3; E_value=7.9e-103; Accession=PF01095.10; Description =Pectinesterase
  Pfam module annotation: Pfam domain module=PMEI::Pectinesterase; Domain location=46-194::240-539
MDSDNYSKEKEGMVLNIAIMVVSMIAIAMVTVSVVAHIDGSKQDAGKNVKTLLSVCTKTEEPEICFRVLKHVGETATVLNYVKAAINATLTELLFVIRPKPRLERSLTLLQQESYKDCLELLSLGKEELESLYLMANFYVDLSELNLDDLLNSLSAVISYQHACTDELIRINSYGVLGYSLQVPILLTRIALAIVDNFSERPNSREPRRLEEFARWFSERERKMIESNQGDNGGEQWPINVVVAQDGSGHFSTIADSLNACPKNKTIACVIYVKRGKYEERVVIPKGVKVFMYGDGPAHTIVSGTNTRDPRIVTTSFRAATFVVMGKGFICKDMGFTAPADITGAPALLVLSDHAAFFNCKIDGNEGTLYAVAQRQFYRDCEILGSVDIIKGDSATVIQNSQIILKPRNSSDLVLRRNVMSAQSRLDKYQTTGLVIQNCTITAQKESMNTLNATTYLGSPYSEYSRTIIMESFLGDVIHPKGWCKWSDNYGIETATFWEFDNRGPGARTDKRVKWNGYSTIFERNQMVSYTVGRFLQADQWLLNRGIPYESGFVVLK

SEQ ID NO: 210376 - protein, 67 aa, Glycine max
  Coding DNA Sequence Number=SeqID_93598
  Pfam annotation: Domain name=Tbf5; Domain location=1-67; Score=60.1; E_value=7.4e-15; Accession=PF06331.3; Description=Transcription factor TFIIH complex subunit T
MMSYIGLCSDIPMAQYIINMNASLPASDKFIIHILDNTHMFVQPHVEQMIRSQIAKFREDNTYVKPN

SEQ ID NO: 210377 - protein, 499 aa, Glycine max
  Coding DNA Sequence Number=SeqID_93599
  Gene Ontology: Mol. function=carbon-nitrogen ligase activity, with glutamine as amido-N-donor; Cellular component=intracellular; Biological process=translation
  Homolog annotation: Hit_ID=Q9FV81; Match level="QueryCoverage=100%, HitCoverage=95%, E-value=0.0, Identity=68%"; Hit description=Glu -tRNA(Gln) amidotransferase subunit B
  Pfam annotation: Domain name=GatB; Domain location=305-372; Score =102.8; E_value=1e-27; Accession=PF01162.10; Description=PET112 family, C terminal region
  Pfam annotation: Domain name=GatB_N; Domain location=62-282; Score =384.9; E_value=1.2e-112; Accession=PF02934.6; Description=PET112 family, N terminal region
  Pfam annotation: Domain name=GatB_Yqey; Domain location=374-499; Score=139.3; E_value=1.1e-38; Accession=PF02637.8; Description =GatBYqey domain
  Pfam module annotation: Pfam domain module=GatB::GatB_N::GatB_Yqey; Domain location=305-372::62-282::374-499
  Subcellular localization annotation: CTP_CleavageSite=31; ConfidenceScore=5.06e-01
MASTIFRSLQVHPFLLYPTTFLRRRNEVFHLASKATQSQTDTQQTKVTTSSTQSKKLDKIPKDYEAIIGIETHVQLSTLTKAFCGCPYSYGSPPNSSICPICMGLPGALPVLNSKIIDFAVKLGLALNCNLAFNSKFDRKQYFYPDLPKGYQISQFDVPIATAGFLDVDIPVEFGGGHKRFGITRVHMEEDAGKLLHAENGNYSQVDLNRAGVPLLEIVSEPDMRNGIEAAEYAAELQRLVRYLGVSNGNMQEGSLRCDVNVSIRPIGQSKFGTKVQLHSQGREDQIVQETRLWEEGSQASAIVTITMRKKEGLADYRYFPEPDLPAVILSQEYVDGIKNSLPELPEIKRRRYEQMGLSMQDVLFLANDKNIADFFDATLAKGADPKLVANWIMSDIAAFMKNEKLTINEIKLTPEELSELIASIKGGTISSKIGKEILFELLAKGGTVKELIEKKDLVQIADPVEIEKMVDKIIADNPKQVEQYRGGKTKLQGFFAGQ

SEQ ID NO: 210378 - protein, 56 aa, Glycine max
  Coding DNA Sequence Number=SeqID_93600
MKVQGWFCDRHKTGVGSDVGIVEFNFGWDGACTVVLVFVSGSGDIINSLYIFWVVV

SEQ ID NO: 210379 - protein, 237 aa, Glycine max
  Coding DNA Sequence Number=SeqID_93601
  Gene Ontology: Mol. function=two-component response regulator activity; Cellular component=nucleus; Biological process=two -component signal transduction system (phosphorelay)
  Homolog annotation: Hit_ID=Q948L2; Match level="QueryCoverage=94%, HitCoverage=34%, E-value=7e-46, Identity=43%"; Hit description =Response regulator 10
  Pfam annotation: Domain name=Myb_DNA-binding; Domain location=189 -237; Score=26.9; E_value=7.2e-05; Accession=PF00249.21; Description =Myb-like DNA-binding domain
  Pfam annotation: Domain name=Response_reg; Domain location=18-131; Score=65.1; E_value=2.3e-16; Accession=PF00072.14; Description =Response regulator receiver domain
  Pfam module annotation: Pfam domain module=Myb_DNA-binding::Response _reg; Domain location=189-237::18-131
MAKIPTQEKVPNQCPVVLKVLVIDHDSNVLENVKQMCNGCHYEVITYSNALLALNHVRRNKEGIDLILIDVGMPNLDDYELVKEIRKEIDVPFIVMSFDDSRSSRMESIKQGACDYWKKPFHEDQVRNMWVHVARKAWNDNKVDIKCGRLEDNDKRKREENDSKATRGGVKRGREPKRVNAGTSSKRQRIVWTDELHNKFLDAVSQLGDINTAVPKRILELMNVPGLTREQVASHLQ

SEQ ID NO: 210380 - protein, 332 aa, Glycine max
  Coding DNA Sequence Number=SeqID_93602
  Gene Ontology: Mol. function=methionyl aminopeptidase activity; Cellular component=cytoplasm; Biological process=proteolysis
  Homolog annotation: Hit_ID=Q9SLN5; Match level="QueryCoverage=85%, HitCoverage=83%, E-value=1e-139, Identity=73%"; Hit description =Methionine aminopeptidase 1A
  Pfam annotation: Domain name=Peptidase_M24; Domain location=155-331; Score=135.0; E_value=2e-37; Accession=PF00557.14; Description =metallopeptidase family M24
  Subcellular localization annotation: CTP_CleavageSite=42; ConfidenceScore=5.29e-01
MVAIQPAISSSVAATLSRFTEVASIVARGIVNLVKGMALLLRMAAGRRSSQDCFKSSWNSHKSVHLKAKLSSPGTQNSDSLGDGWLYCLKRGQARTPKLPHFDWTGPLQPYPISSKRIVPDQIDKPDWADDGTPKIEPNSSLQHTVEVKTPDQIERMRETCRIAREVLDAAARIIQPGVTTDEIDRVVHEATIAAGGYPSPLNYLFFPKSCCTSVNEVICHGIPDARKLEDGDIVNVDVTVYYKGVHGDLNETYFVGNVDEESRQLVKCTYECLEKAISIGNKAVGVMKAGQTFTIEPMINAGVWRDRMWPDGWTAVTADGKRSAQFEQTLL

SEQ ID NO: 210381 - protein, 229 aa, Glycine max
  Coding DNA Sequence Number=SeqID_93603
  Gene Ontology: Mol. function=pectinesterase activity; Cellular component=cell wall; Biological process=cell wall modification
  Homolog annotation: Hit_ID=O04887; Match level="QueryCoverage=99%, HitCoverage=44%, E-value=2e-85, Identity=63%"; Hit description =Pectinesterase-2 precursor
  Pfam annotation: Domain name=Pectinesterase; Domain location=1-215; Score=404.1; E_value=2e-118; Accession=PF01095.10; Description =Pectinesterase
VSGDGFWARDMTFENSAGPEKHQAVALKVSSDLSVFYRCSFRAYQDTLYVHSNRQFYRDCYVYGTIDFIFGDATVVLQNCDIFVRKPMSHQSNFITAQGRDDPNKNTGISIQSCRVRPDSEFLTLKESFKTFLGRPWRKYSRTVFLKTDLDGLVHPRGWGEWSGEFALSTLYYGEYLNTGYGASTQNRVNWPGFHVLRSASEATPFTVNQFLQGERWIPATGVPFSSGI

SEQ ID NO: 210382 - protein, 167 aa, Glycine max
  Coding DNA Sequence Number=SeqID_93604
MNVDEESGYRVWSPSANTMRQLSIQDNNALTMVDTLHLQHRQQRQEPLIMHPPSVNLHPSCILQVSEDSPIFHGYTTPAPAPAPAPAPPAFHAAANTLVPYVSGSSDSLYQQPPLVNFGYDDKQMYIPGTPRGHQIKESAGDEDHDTLVDIYMSTNTGGDDVDEAAA

SEQ ID NO: 210383 - protein, 91 aa, Glycine max
  Coding DNA Sequence Number=SeqID_93605
MGGKNRQMKSSFLSVFNIFKSNKQQRGGSNYNTYYDEGPKVSGTKTWPSDEDKGRWGVADPVIDMRATAYIAQYKKRVSESEIHCQAQSQH

SEQ ID NO: 210384 - protein, 384 aa, Glycine max
  Coding DNA Sequence Number=SeqID_93606
  Gene Ontology: Cellular component=plastid chromosome
  Homolog annotation: Hit_ID=O80572; Match level="QueryCoverage=99%, HitCoverage=86%, E-value=1e-152, Identity=64%"; Hit description =Expressed protein
  Pfam annotation: Domain name=mTERF; Domain location=41-335; Score =334.3; E_value=2e-97; Accession=PF02536.5; Description=mTERF
MGRNPGSQGELVSRVIIFDYLKCLGIIPDQLHDLELPSTVDVMRERVEFLQKLGLTVDDINNYPLMLGCSVRKNMIPVLGYLEKIGIARPKLGGFVKNYPQVLHASVIVELAPVVKFLRGLDVEKDDIVAYLVSIGVNPRDIGPMVLARMLEKRAYVLGYDLEETMKSNVECLTSFGVKRECLASIIAQYPQILGLPLKAKLSTQQYFFSLKLKVDPEGFARVVENMPQVVSLHQHMVMKPVEFLLGRMIHAQDVASMVIKCPQLVALRVELMKNNYYLFKSEMGRPLQELVEFPEYFTYGLESRIKPRYQRLKSKGIRCSLNWMLNCTDQRFEERLQGHYIETESVGPRFCMGGKLELPGNGIVSDEEEESDDEVLYRRTVSL

SEQ ID NO: 210385 - protein, 162 aa, Glycine max
  Coding DNA Sequence Number=SeqID_93607
  Gene Ontology: Mol. function=pectinesterase activity; Cellular component=cell wall; Biological process=cell wall modification
  Pfam annotation: Domain name=PMEI; Domain location=12-139; Score =23.3; E_value=0.00017; Accession=PF04043.6; Description=Plant invertasepectin methylesterase inhibitor
MVTYVVTTTLFLFLAMAITTLCLQEIEVLQMAQNHVSQAKNLIGNSLRLHGLGSLSLSDQTSATIALSDCAKLYEESESRLSHMMAQESYYAKEDALTWMSAVMTNHRTCLDGLKEKGYIEAQVLDRNLTMLLKQALVVYSKNNKGKGKETTCFELISTYIS

SEQ ID NO: 210386 - protein, 621 aa, Glycine max
  Coding DNA Sequence Number=SeqID_93608
  Gene Ontology: Mol. function=microtubule binding; Cellular component =cortical microtubule, transverse to long axis; Biological process =cytoskeleton organization and biogenesis
  Homolog annotation: Hit_ID=Q1SLE1; Match level="QueryCoverage=98%, HitCoverage=96%, E-value=0.0, Identity=76%"; Hit description=Myosin II heavy chain-like
  Pfam annotation: Domain name=Myosin_HC-like; Domain location=218-574; Score=760.1; E_value=1.4e-225; Accession=PF07058.2; Description =Myosin II heavy chain-like
  Subcellular localization annotation: CTP_CleavageSite=32; ConfidenceScore=5.01e-01
MAEVSGEGVAEATVSTPAPPLAVSGSFKEGKSSSRRRAHSMRPSLDADEFMNLLHGSDPVKVELNRLENEVRDKDRELSEAQAEIKALRLSERLREKAVEELTEELSRVEGKLKLTESLLESKNLEIKKINDEKKASMAAQFAAEATLRRVHAAQKDDDMPPIEAILAPLEAELKLARQEIAKLQDDNKALDRLTKSKEAALIEAEKTVQIALAKASMVDDLQNKNQELIKQIEICQVFAISYGVSLSKYASLNNVAEVEKLTQTVRELEEAVLAGGAAANAVRDYQRKVQEMNEERKTLDRELARAKVTANRVAVVVANEWKDANDKVMPVKQWLEERRFLQGEMQQLRDKLAITERTAKSEAQLKEKYQLRLKVLQDSLRETSNSINRGTSEGRCVSNGPSRRQSLGGSDNISKLASNGFLKRSPSTQIRSSVSSSTVLKHAKGTSKSFDGGTRSLERSKILLNGKPPSYSFNQSSEGTKDGEENDKWKGNSDDKPNDLPTVDTEDSVPGVLYDLLQKEVLALRKAGHEKDQSLKDKDDAIEMLAKKVDTLTKAMEVEAKKMRREVASMEKEVAAMRVEKEQESRAKRFSNVKGTVNSAQHQLVSGRYISLSVSVQGYL

SEQ ID NO: 210387 - protein, 473 aa, Glycine max
  Coding DNA Sequence Number=SeqID_93609
  Gene Ontology: Mol. function=GTPase activity; Cellular component =microtubule; Biological process=cell division
  Homolog annotation: Hit_ID=Q1SLG1; Match level="QueryCoverage=99%, HitCoverage=73%, E-value=0.0, Identity=85%"; Hit description=Dynamin central region; Dynamin; Dynamin GTPase effector
  Pfam annotation: Domain name=Dynamin_M; Domain location=242-472; Score=129.8; E_value=7.3e-36; Accession=PF01031.10; Description =Dynamin central region
  Pfam annotation: Domain name=Dynamin_N; Domain location=38-233; Score= 266.3; E_value=6e-77; Accession=PF00350.13; Description=Dynamin family
  Pfam annotation: Domain name=MMR_HSR1; Domain location=36-204; Score=- 7.0; E_value=0.0043; Accession=PF01926.13; Description=GTPase of unknown function
  Pfam module annotation: Pfam domain module=Dynamin_M::Dynamin_N::MMR _HSR1; Domain location=242-472::38-233::36-204
MATMTSLIGLINKIQRACTVLGDHGGEGLSLWEALPSVAVVGGQSSGKSSVLESVVGRDFLPRGSGIVTRRPLVLQLHKTEDGTQEYAEFLHIPRRRFTDFAAVRKEISDETDRITGKTKQISNIPIHLSIYSPNVVNLTLIDLPGLTKVAVEGQQESIVQDIENMVRSYVEKITFLMFLLNDLTEFSLIVKPNCIILAISPANQDIATSDAIKIAREVDPSGERTFGVVTKLDLMDKGTNAVDVLEGRQYRLQHPWVGIVNRSQADINRNVDMIAARRKEREYFETSPEYGHLAHKMGSEYLAKLLSQHLEQVIRQKIPSIIALINKTIDELNAELDRIGRPIAVDSGAQLYTILEMCRAFDKVFREHLDGGRPGGDRIYGVFDHQLPAALKKLPFDRHLSLKNVQRVVTEADGYQPHLIAPEQGYRRLIEGSIGYFKGPAEASVDAVIFLTLLHFVLIWHPIPRSDEITRY

SEQ ID NO: 210388 - protein, 56 aa, Glycine max
  Coding DNA Sequence Number=SeqID_93610
MEDMSERALKAANPNASAEIAKHILSLLCLWANNTDRNFKKKVALLLQLDSILLGM

SEQ ID NO: 210389 - protein, 326 aa, Glycine max
  Coding DNA Sequence Number=SeqID_93611
  Gene Ontology: Cellular component=phycobilisome; Biological process =photosynthesis
  Homolog annotation: Hit_ID=Q2R3H0; Match level="QueryCoverage=89%, HitCoverage=42%, E-value=2e-66, Identity=44%"; Hit description =Expressed protein
LSLDLGSMKVRENANQQQRPTSHELEDELRLAEEKYEEAESRVRQLEQQAALRNASKNHGGFQAALQADAETAREETESAFEKLRLMTQRMILTPEEMEEVVLKRCWLARYWGLCVRHGIHADIAEAKYKYWSMLAPNPIEVVLAAAEKAKEETDLDVEDTEGQRDLKELSGEGNIENMLFVEQGLRQLASLKVEEALVVALAQHRRPNMLKAGFSDDLKLPIEGQCDAFELSQEEAEDVSFKQAWLAYIWRRAKRHEIEPDIANERLQHWINHNSMTPTSQDAVDVERGLAEIKRLDIEAQLWDESRRELEEEIGNSNIPGRSDF

SEQ ID NO: 210390 - protein, 405 aa, Glycine max
  Coding DNA Sequence Number=SeqID_93612
  Gene Ontology: Mol. function=sodium:hydrogen antiporter activity; Cellular component=integral to membrane; Biological process=sodium ion transport
  Homolog annotation: Hit_ID=Q1SYD9; Match level="QueryCoverage=99%, HitCoverage=75%, E-value=1e-166, Identity=73%"; Hit description =Sodium/hydrogen exchanger
  Pfam annotation: Domain name=FtsX; Domain location=53-220; Score= -30.7; E_value=0.1; Accession=PF02687.11; Description=Predicted permease
  Pfam annotation: Domain name=MFS_1; Domain location=13-339; Score= -42.7; E_value=0.028; Accession=PF07690.6; Description=Major Facilitator Superfamily
  Pfam annotation: Domain name=Na_H_Exchanger; Domain location=1-302; Score=10.0; E_value=0.0003; Accession=PF00999.11; Description =Sodiumhydrogen exchanger family
  Pfam module annotation: Pfam domain module=FtsX::MFS_1::Na_H _Exchanger; Domain location=53-220::13-339::1-302
MGFGKSLDMGDYLAIGAIFAATDSVCTLQVLNQDETPLLYSLVFGEGVVNDATSVVLFNAIKSFDLNKIDPRIGLHFIGNFLYLFTASTLLGVLAGLLSAYIIKTLYIGRHSTDREVALMMLMAYLSYILAELWYLSGILTVFFCGIVMSHYTWHNVTESSRITTKHAFATLSFVLETFIFLYVGMDALDIEKWRPKTSVAVSSVLLGLVLAGRAAFVFPLSFLSNLTKKTQSEKISFREQVIIWWAGLMRGAVSMALAYNQFTLSGHTEQRTNAIMITSTITVVLVSTMVFGLMTKPLIRFLLPVNPLPKRKNSMANIDSSNNSPKSITVPFLGGSQDSENEFDGSEIHRPSSIRALLTTPTHTVHQLWRKFDNSFMRPVFGGRGFVPVAPNSPTARNINQQWH

SEQ ID NO: 210391 - protein, 141 aa, Glycine max
  Coding DNA Sequence Number=SeqID_93613
MGFDFLVVRMEKICWERQNPLHFDDLYAFKKKKWQAVIKFYSSYYVENLWMDAEIVFFFTTVLGIYLDMNHIPSPQLIPSPNFSEGNQFRNASLMADLAGVTVITEDELDSSTLAIAIEKILILEIIPESFVNHAICFDDK

SEQ ID NO: 210392 - protein, 287 aa, Glycine max
  Coding DNA Sequence Number=SeqID_93614
  Gene Ontology: Mol. function=transferase activity, transferring hexosyl groups; Cellular component=1-2nm peptidoglycan-based cell wall; Biological process=carbohydrate metabolic process
  Homolog annotation: Hit_ID=Q9C9T8; Match level="QueryCoverage=60%, HitCoverage=41%, E-value=8e-41, Identity=48%"; Hit description =Putative UDP-N-acetylglucosamine--N-acetylmuramyl-(Pentapeptide)- ...
  Homolog annotation: Hit description=pyrophosphoryl-undecaprenol N -acetylglucosamine transferase; 62395- 63952 (Putative UDP-N -acetylglucosamine--N-acetylmuramyl- (Pentapeptide)-pyrophosphoryl -undecaprenol N-acetylglucosamine transferase)
MSFNKTIHFIKGFNPSLPNNIQATILSQHLIIQIQHRNVNCIGAKRSRKHQQNPAPTIRTGEKMRHGGHLGNEVPNRQPHRVPTHETLVPRETIECGVKSNEDGISEEGKKRVGEAGDRVGFVDDNVGASELGSEAGGERDVAAGADNNVGLEVSEVAEALDQRLEETVREEEKVLGCSSAMATAGYTLLPVPPPAKATRRVSLLELDEWHEIETLLDSGVLWNTGKEKERVVAININACACSSSTLISGSYYELLGKFQPPAKENNLLENKLNEINEINYTSPFEG

SEQ ID NO: 210393 - protein, 49 aa, Glycine max
  Coding DNA Sequence Number=SeqID_93615
MDAYASALRSVTLSGRTLFDPVINMAAQMAVQSLTSHNNTKYYALLIIM

SEQ ID NO: 210394 - protein, 304 aa, Glycine max
  Coding DNA Sequence Number=SeqID_93616
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q6PUG0; Match level="QueryCoverage=92%, HitCoverage=65%, E-value=3e-58, Identity=61%"; Hit description=3 -dehydroquinate dehydratase / shikimate dehydrogenase isoform 2
  Pfam annotation: Domain name=Shikimate_DH; Domain location=149-258; Score=21.5; E_value=4.8e-06; Accession=PF01488.10; Description =Shikimate  quinate 5-dehydrogenase
MQLEALQLAVELGADFIEVQLKVPLIAYSVGERGLISQLLSQKFGGFFVYESLAGNPIPGLPSLDNIQEAYKLEHRTSQFNRLNGKPVTSPETLKNQSIAEPVEIGQTGAVNTIIRRARHGKLVGYNTHCEAAITAIEDALIEHGCNDGGASLGSPLAGRLFVLVGAGGAGIALAFGSKSRGALLVIFDINFDRAKSLACAVFGEAQPFKELVNFQPEKEAILANATPVGMLPNTDRIPVAERLVFDAVYRLRRTRLLKEADAAGAITVGGVEMFLRQAIGQFNLFTSLEAPEEFMREIVLSKF

SEQ ID NO: 210395 - protein, 378 aa, Glycine max
  Coding DNA Sequence Number=SeqID_93617
  Homolog annotation: Hit_ID=Q75J22; Match level="QueryCoverage=76%, HitCoverage=94%, E-value=1e-77, Identity=49%"; Hit description =Expressed protein
MRSGRVLEWCPAIVELEAGRCDVDAALNVCNRLPTSLDKEVRTSGPTRNQGEAPLTCRNQGIRVFPSHLQLQLALWKMVPQSVITQVSDSSGVNAISNVSSSGYGFYDWLFKCHGFWHNATLIIPSFLFVFYLALQARHSLLKVSLARSYIIISYNLCLCLVTLLNLAWCFLQAWECTSGRELTWNLLSLFTTSGMLFLEVSLLAFLLQGNNAGGLEAMKRTFGISTLVVGLDILLKAIYLFVFGIPLFVDSNDHTHHGKWNLWVVHKLLLTAVYGFIMFMYHSGWKETLPAKIAFYKYVAIMFIFNAIATLACGLAGTHAAFAFWLYRVTVVFYHAFYLPFLYTTFLADFFQEENFHLENVYYSEMKDAGFFDTDWE

SEQ ID NO: 210396 - protein, 949 aa, Glycine max
  Coding DNA Sequence Number=SeqID_93618
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=99%, HitCoverage=100%, E-value=0.0, Identity=77%"; Hit description=CHASE; Lantibiotic regulatory protein
  Pfam annotation: Domain name=CHASE; Domain location=110-322; Score =281.7; E_value=1.4e-81; Accession=PF03924.4; Description=CHASE domain
  Pfam annotation: Domain name=HATPase_c; Domain location=433-616; Score=126.4; E_value=8.2e-35; Accession=PF02518.16; Description =Histidine kinase-, DNA gyrase B-, and HSP90-like ATPase
  Pfam annotation: Domain name=HisKA; Domain location=321-386; Score =84.5; E_value=3.2e-22; Accession=PF00512.15; Description=His Kinase A (phosphoacceptor) domain
  Pfam annotation: Domain name=Response_reg; Domain location=799-930; Score=103.7; E_value=5.3e-28; Accession=PF00072.14; Description =Response regulator receiver domain
  Pfam module annotation: Pfam domain module=CHASE::HATPase _c::HisKA::Response_reg; Domain location=110-322::433-616::321 -386::799-930
MGLGLKMKSLRHHPMALKLHEQAGSIRKYTFIQAHRAWLPKFLMLWILLMALIGCFIYSKMDADTKVRRKEVLGSLCDQRARMLQDQFSVSVNHVHALAILVSTFHYYRTPSAIDQETFAEYTARTAFERPLLSGVAYAQRVVNSERGTFEKQHGWVIKTMEREPSLVRDEYAPVIFAQETLSYLESLDMMSGEEDRENILRARATGKAVLTSPFNLLGSHHLGVVLTFPVYKSKLPPKPTMEERIKATAGYVGGSFDVESLVENLLGQLAGHQAILVNVYDITNSTNPLIMYGNQNEEGDMSLVHERSFNFCSEDAYHQVFEQFLATVSHEIRTPMNGILGMLGLLLKTELSSTQRDYAQTAQACGKALIALINEVLDRAKIEAGKLELEAVPFDIRSILDDVLSLFSEKSRNKGLELAVFVSDKVPDIVMGDPGRFRQIVTNLVGNSVKFTERGHIFVKVHLSENSMSTMNGKTEKFINRGSGEPVHMSGAYNSKTLSGYEAADERNSWDNFKHLIADEEFFFDASVKKAASESYEQVTLMVSVEDTGIGIPFSAQDRIFMPFVQADSSTSRHYGGTGIGLSISKCLVELMGGEISFISQLQVGSTFSFTAGFGTIEKNAITDMKKHNLEDLPSNFRGLKAIVVDGKPVRAAVTRYHLKRLGIQAKVANSINKAVSLCGKNGSLTSVLFQPDIIFVEKDSWVCGEDEIFNVWQLDWKQNGHMFKIPQMILLATNIGNAEFDKAKAAGFSDTVIMKPLRASMVAACLQQVLGTGKKRQHGKDMKPNGSTLVRSLLCGKKILVVDDNVVNRRVAAGALKNFGADVTCAESGKTALEMLQLPHNFDACFMDIQMPEMDGFQATQRIRMMETKANEQQMNGEGNGWKDKYHIPILAMTADVIHATYDECVKYGMDGYVSKPFEEENLYQAVAKFFNPKPTTDNSLIENGRT

SEQ ID NO: 210397 - protein, 1058 aa, Glycine max
  Coding DNA Sequence Number=SeqID_93619
  Gene Ontology: Mol. function=heat shock protein binding; Cellular component=integral to membrane; Biological process=protein folding
  Homolog annotation: Hit_ID=Q1EPG9; Match level="QueryCoverage=99%, HitCoverage=98%, E-value=1e-141, Identity=33%"; Hit description=Heat shock protein DnaJ N-terminal domain-containing protein
  Pfam annotation: Domain name=DnaJ; Domain location=67-128; Score =110.8; E_value=4.1e-30; Accession=PF00226.21; Description=DnaJ domain
  Pfam annotation: Domain name=zf-MYM; Domain location=185-222; Score =14.9; E_value=0.017; Accession=PF06467.5; Description=MYM-type Zinc finger
  Pfam module annotation: Pfam domain module=DnaJ::zf-MYM; Domain location=67-128::185-222
MECNKDEALRARQIAENKMQAGDFEGGLKFATKAQRLFPEIQNILQILAVCEVHCAAQKTYSGSDMDWYGILKTEKSADEATIKKQYRKLALLLHPDKNKSAGAEAAFKLIGEANRVLSDQTKRALYDLKFGVPVGNTATKVPPRHPNGNASGMGCDGTARNCQNSYFSQYQAWNAYHRDDNQTFWTCCPHCNTRYQYVKTILNHTIRCQHCSKSFTAHDMGNHNVPPGYWAPFNNQKEPPKHASSKEASKGYGGKSSGREQEGVSMSKCSAGIGAHSKVAKRRDGHVAAGVTKAGVGTSDPTNSKAKELRASTKVGHKRSRQSASDDDKKAANGKAVKDTKVQENRVDPNRRSSRKKQHVSYTENDKDGNFGNSSKKPRHHKSSNNNPASFTDGVGGQNGEIRNKASAPPGETILRNKTKVEQTNVQRKEASNSDLNDRKSKADNCSPLKSNFPPTSEICCPDPDFSDFERDKAEDCFAVNQLWAIFDNTDSMPRFYALVKKVYSPFKLRITWLEPDSDDQGEIDWHEAGLPVACGKFKLGHSQRTSDRFMFSHQMHCIKGIDTGTYLIYPKKGETWAIFRHWDLGWSFDPEKHSEYQFEYVEVLSDFDKNVGVKVAYLSKLKGFVSLFQRTVLNRISFFCILPNELYKFSHHIPSYKMTGAERQDVPRGSFELDPAGLPNSLFEVGDPGVVKMDGVNCSHHEYSKCKVEEAMPNDSIHKATLRESIDSGRVAQILRRSPRSSKKSMDNGQASTSQYIVRKDDINIVHRDDSPPEGNTAASQTIKRKVKTPQKHEKNNYEGEALKARKSPKDLGKKNAQGDAGEYSSNSKNVKVSNIPQSVGASCYGFKKEKSEEMFRCGQIWAIYGDRDHMPDTYAQIRIIECTPNFRLQVYLLEPCSPPNDLKRTTSCGTFAVKEAKLRMLSLSAFSHQLKAELVANNRYEIYPRKGEIWALYKDQNYEQTSSNQGRGECHIVEVLADNNKSFQVVVLVPHGSSQTIFKAPRIQRSKTGVIEILREEVGRFSHQIPAFQHSDNVHLRGCWELDPSSVPGCLIPID

SEQ ID NO: 210398 - protein, 103 aa, Glycine max
  Coding DNA Sequence Number=SeqID_93620
  Gene Ontology: Mol. function=phosphopantetheine binding; Cellular component=chloroplast; Biological process=fatty acid biosynthetic process
  Homolog annotation: Hit_ID=P93092; Match level="QueryCoverage=78%, HitCoverage=60%, E-value=7e-30, Identity=80%"; Hit description=Acyl carrier protein 1, chloroplast precursor
  Pfam annotation: Domain name=PP-binding; Domain location=28-95; Score= 63.4; E_value=7.3e-16; Accession=PF00550.15; Description =Phosphopantetheine attachment site
MATNALAGTSLSMRSLLPQTQAKPETVEKVCKIVKKQLAMPETDVVTGESKFATLGADSLDTVEIVMALEEAFGIAIEEDSAQSIATVQDAADLIEEIVQKSS

SEQ ID NO: 210399 - protein, 329 aa, Glycine max
  Coding DNA Sequence Number=SeqID_93621
  Subcellular localization annotation: CTP_CleavageSite=35; ConfidenceScore=5.42e-01
MDRRRMYDRQNSSPGTPSSPSSPVNVISPLHRHARAGSTGSAMTNVRRAQNNATKAAAQRLAQVMSQTDDDDEDEDDVPLDYSAIAGSGGIGLGGGRPMPTRSPMAVRSVQDAASARSRSPMPVRAVQEQPPSARSRSPASVRSVQEQPPSARSRSPASVRIDQEQPRSVRGMSSVRSYASSNALAEQPPPRTPTLMNNAEQQPPSARSTPANRTLELSPSARTTIITRSPQPSSANNDQPPSARSTSGRPSGLSKVVPMVPPSVPITLRPASSVGVPPSEPLLDIRKDKRYAAACSCSYLLLHFFSKKILDTMDSSYASSSWFFSAFM

SEQ ID NO: 210400 - protein, 266 aa, Glycine max
  Coding DNA Sequence Number=SeqID_93622
  Gene Ontology: Mol. function=nucleic acid binding; Cellular component= mitochondrion; Biological process=ER to Golgi vesicle-mediated transport
  Homolog annotation: Hit_ID=Q1SYD5; Match level="QueryCoverage=58%, HitCoverage=89%, E-value=9e-81, Identity=92%"; Hit description =Transport protein particle (TRAPP) component, Bet3
  Pfam annotation: Domain name=TRAPP_Bet3; Domain location=63-231; Score=208.1; E_value=2e-59; Accession=PF04051.6; Description =Transport protein particle (TRAPP) component, Bet3
MNSRCEEEKGIEYRIPWIIDSRPKVKCSNFYSDASEAREASKTMGIISERERERMVREVSESCVDSLLTEMVACYCNRFYANKPELAARRIEAIGYQVGHQLSERYTMERPRFTDHLEAIKFICKDFWSELFKKQIDNLKTNHRGTFVLQDNKFRWLARMSIDPSTDNVSPLEDITSPTAESKAAQAMSMHLYFPCGIIRGALSNLGIPCAVSADISNLPALMQHCVLASGFYIFQIAVSFPFEEVAYMAYSRVLEILFSPFCCII

SEQ ID NO: 210401 - protein, 249 aa, Glycine max
  Coding DNA Sequence Number=SeqID_93623
  Homolog annotation: Hit_ID=Q1RV13; Match level="QueryCoverage=47%, HitCoverage=38%, E-value=2e-15, Identity=40%"; Hit description=IMP dehydrogenase/GMP reductase
MVIVSILSELKGTRSLGDHNRGNPLGGHNAWKCKGNALFTEGRNSQAPAPCHWWMMQHRANWNKAVNSRWRLAGINEKLKAVKGALKDELRSTDNQLLEGVRQMFELKKEIPKPGIREVTMQAGDYNTRLAGLVHNAVEKGIFKGVNLDSDCNFPIIQYADDSVLMGEASFHNFWAIKTIFRGSITTFQLPWPTGWKKPALILDMGTGPKQISQKISNLDVKVNSNQLGLTKPLSELPINVQGSEEDSQ

SEQ ID NO: 210402 - protein, 233 aa, Glycine max
  Coding DNA Sequence Number=SeqID_93624
  Gene Ontology: Mol. function=zinc ion binding; Cellular component =integral to membrane; Biological process=electron transport
  Homolog annotation: Hit_ID=Q10L01; Match level="QueryCoverage=97%, HitCoverage=62%, E-value=4e-44, Identity=51%"; Hit description=Zinc finger family protein, putative, expressed
MLLTIFLLIPMIILFIQRKNAPLAKFQNLLGQNTAAFVIAVLLDLIITVDGWHFLICLYGTVAIVLVLAGRLRELRVVDILTVYYGIENSFLDLAPNVVQWLLGSYNTQILLMVFLAIVGMLLAGFFGYHAKLCLTNTTTNETFKWQDYMDWQRKLKEANVSAEALKQSIGGMSSEKQPLLSKWRAFFRKSPLEDVVVVKNNVYDKGFFHNIQEVISPFSTRRSFTQNKLKSS

SEQ ID NO: 210403 - protein, 112 aa, Glycine max
  Coding DNA Sequence Number=SeqID_93625
MGTCFSDIKGGKQAVGGKSNEATGTGATTNNNGGQNDAVDFFYKTQGFQQLFTQVELLLCFIRFFLRRTSEVNLLLYIFFQSNQINKSNVVNGGWRFMAESQKSAIKIWRMA

SEQ ID NO: 210404 - protein, 1123 aa, Glycine max
  Coding DNA Sequence Number=SeqID_93626
  Gene Ontology: Mol. function=two-component sensor activity; Cellular component=membrane; Biological process=signal transduction
  Homolog annotation: Hit_ID=Q1SE03; Match level="QueryCoverage=96%, HitCoverage=88%, E-value=0.0, Identity=77%"; Hit description=F5A9.21, related
MELRGLFQYLVNQLKKGQGIELVLLQELIQQMANVQYTENLTEEQLDAMAGSETLRYQATSFGVTRNNKALIKSTSRLRDALLPNDEPKLAIPLLQLIAQHCSLVVINADAPYIKMVSEQFDRCHGTLLQYVEFLCSAVTPASNYAILVPSLNDLVHLYHLDPEVAFLIYRPVMRLFKSPRNPDVCWPLGDKDAASDASTNFESDPLDHSASMVLNLGSDQNPISWSYLLDTVKTMLPSKAWNSLSPDLYATFWGLTLYDLYVPKNRYESEIAKLHANLKSLEELSDNSSSAIAKRKKEKERIQESLDRLISELHKHEENVASVRRRLSHEKDKWLSSCPDTLKINMEFLQRCIFPRCTFSMPDAVYCAMFVHTLHSLGTPFFNTVNHIDVLICKTLQPMICCCTEYEAGRLGRFLYETLKIAYYWKSDESIYERECGNMPGFAVYYRYPNSQRVTYGQFIKVHWKWSQRITRLLIQCLESTEYMEIRNALIMLTKISSVFPVTRKSGINLEKRVAKIKSDEREDLKVLATGVAAALAARKPSWVTDEEFGMGYLELKPSPSMTKSSAGNSATVQSGINLNVSQTESVSGKHVDSGNTVKDQAIRTKTVDGKSERIESITVTKSDAGHIKLKSSSMVNGLDAQSSMAPSSVQSGMPKSMENPKQVEESINRASDEHGTRSTEVAFNISVMLCGTAACTPMQVVLHSARWDTCLTRLRTSAKRSVPASSLAKPSKQDPVKEDGRSGKPVARTSGSLSSDKDLQTHALEGRHTGTTNVPSSNGNTISGSTKGSNPPVKISLDGPGNESKAEVGVAKSSDIRASMVKDDGNDITDNPRGSSSRIVHSPRHENTVVTSKSNDRVQKRASSVEEPDRLGKRRKGDVELRDFETELRFSEREKMMDPRFADDKLGPEEHGLYRASDKPLERTKDKGNERYERDHRERMDRLDKSRGDDFVAEKPRDRSIERYGRERSVERMQERGSDRSFNRLPEKAKDERNKDDRNKLRYNDASAEKSHGDDRFHGQSLPPPPPLPPNVVPQSVGAGRRDEDVDRRYGATRHSQRLSPRHEEKERRWSEETVVSQDDAKRRKEDDFRDRKREEIKVWIIIGYRFFHSATKELRMRALW

SEQ ID NO: 210405 - protein, 510 aa, Glycine max
  Coding DNA Sequence Number=SeqID_93627
  Gene Ontology: Mol. function=two-component sensor activity; Cellular component=membrane; Biological process=signal transduction
  Homolog annotation: Hit_ID=Q1SIR1; Match level="QueryCoverage=99%, HitCoverage=75%, E-value=0.0, Identity=78%"; Hit description =Histidine kinase A, N-terminal
MSGEFRSRLIKLARWLVESEMVPVRLLQERCEEEFLGEVELIKIKAQELKVKEVRVNTRLLYQQTKFNLLREESEGYAKLVLECFELQPDDDVFIELIPIFPKSHASQILGFKFQYYQRMEVNGPVPFGLYRLTALLVKQDFIDLDSMDDEAFEHYNTFSSKRLDEANKIGRINLAAIGKDLMDDEKQGDVTIDLFAAIDMETDAVEERTTELQSSQTLGLLTGFLSVDDWLIKKSISSAYDVIRQTHLQNPGLSTGGSTDVMDVDNSSGFSSFIDLPKELFQMLACTGPYLYRDTVLLQKVCRVLRGYYLSALELVSHGNGVLNPQLQVPGNLHLHLKEARLRVEDALGACLLPSLQLIPANPAVGQEIWELMSLLPYEVRYRLYGEWEKDDERIPMLLAARQTAKLDTRRILKRLAKENLKQLGRMVAKLAHANPMTVLRTIVHQIEAYRDMITPVVDAFKYLTQLEYDILEYVVIERLVLGGRDKLKDDGLNLSDWLQSLASFWGHL

SEQ ID NO: 210406 - protein, 152 aa, Glycine max
  Coding DNA Sequence Number=SeqID_93628
  Gene Ontology: Mol. function=protein binding; Biological process=two -component signal transduction system (phosphorelay)
  Homolog annotation: Hit_ID=Q659H8; Match level="QueryCoverage=90%, HitCoverage=89%, E-value=6e-32, Identity=51%"; Hit description =Putative histidine-containing phosphotransfer protein 2
  Pfam annotation: Domain name=Hpt; Domain location=45-130; Score=54.4; E_value=3.8e-13; Accession=PF01627.13; Description=Hpt domain
MYGVSRLQRQLAEYTSSLFEEGFLDDQFNQLQQLQDESNPEFVVEVVTLFFEDAERLLNELAKALGQESIDFKRVEAHVRQLKGSSSSIGAQRVQKVCIAFRNYCEEKNVEGCLKNLQEIKLECSLVKSKFETLFKMEQQLFAAGGGLLGSE

SEQ ID NO: 210407 - protein, 115 aa, Glycine max
  Coding DNA Sequence Number=SeqID_93629
  Gene Ontology: Mol. function=zinc ion binding
  Homolog annotation: Hit_ID=Q10L00; Match level="QueryCoverage=70%, HitCoverage=29%, E-value=9e-28, Identity=69%"; Hit description=Zinc finger family protein, putative, expressed
MGVEWLLVCHGLVTAVVVVSFLCGRWPIFEGTFIQRIHYFLTFGAYDYFLRFVGAVFGPKCTDAVLSVEYYCCDRPNPLLQVGCECLQLEHLFFLKDNDNNVLKWHYIPLVKLFT

SEQ ID NO: 210408 - protein, 345 aa, Glycine max
  Coding DNA Sequence Number=SeqID_93630
  Gene Ontology: Mol. function=voltage-gated ion-selective channel activity; Cellular component=mitochondrial outer membrane; Biological process=anion transport
  Homolog annotation: Hit_ID=Q1SDZ1; Match level="QueryCoverage=87%, HitCoverage=78%, E-value=1e-107, Identity=67%"; Hit description =Porin, eukaryotic type
  Pfam annotation: Domain name=Porin_3; Domain location=28-336; Score =68.1; E_value=2.9e-17; Accession=PF01459.12; Description=Eukaryotic porin
MATPIPPPPAAAAAAAADTKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSLAAIGAAVVEKLIFADAFAVGIAGIALDSTACMSAAPLPFCYFVATAPSPSASVTQHLSLGGEVFWAGQHRKSGIGYAARYNTDKSSFNLLTYIQVATGQVASTGMVLLSYVQKVSEKVSLASEFMCNYLSRDVTASFGYDYILRQVVFSFFQEFNHALEFGTNTTGMWTS

SEQ ID NO: 210409 - protein, 168 aa, Glycine max
  Coding DNA Sequence Number=SeqID_93631
  Gene Ontology: Mol. function=structural constituent of ribosome; Cellular component=intracellular; Biological process=translation
  Homolog annotation: Hit_ID=Q1STC9; Match level="QueryCoverage=76%, HitCoverage=90%, E-value=3e-66, Identity=96%"; Hit description =Ribosomal protein S9
  Pfam annotation: Domain name=Ribosomal_S9; Domain location=25-150; Score=258.2; E_value=1.7e-74; Accession=PF00380.9; Description =Ribosomal protein S9S16
MAVIFSSAIPGGAAPAAIEQVQCFGRKKTAVAVTYCKRGRGLIKINGCPIELVEPEILRFKAFEPILLLGRHRFAGVDMRIRVKGGGHTSQIYAIRQSIAKALVAYYQKYVDEQSKKEIKDILVRYDRTLLVADPRRCEPKKFGGRGARASVWIAASIAIIALDCAII

SEQ ID NO: 210410 - protein, 526 aa, Glycine max
  Coding DNA Sequence Number=SeqID_93632
  Gene Ontology: Mol. function=sugar porter activity; Cellular component=integral to membrane; Biological process=carbohydrate transport
  Homolog annotation: Hit_ID=Q3ECP7; Match level="QueryCoverage=85%, HitCoverage=91%, E-value=1e-152, Identity=60%"; Hit description =Sugar transporter ERD6-like 5
  Pfam annotation: Domain name=MFS_1; Domain location=70-479; Score =80.3; E_value=6.2e-21; Accession=PF07690.6; Description=Major Facilitator Superfamily
  Pfam annotation: Domain name=Sugar_tr; Domain location=66-519; Score =265.4; E_value=1.2e-76; Accession=PF00083.14; Description=Sugar (and other) transporter
  Pfam annotation: Domain name=Tetraspannin; Domain location=57-228; Score=-58.1; E_value=0.061; Accession=PF00335.10; Description =Tetraspanin family
  Pfam module annotation: Pfam domain module=MFS_1::Sugar _tr::Tetraspannin; Domain location=70-479::66-519::57-228
  Subcellular localization annotation: CTP_CleavageSite=18; ConfidenceScore=5.19e-01
MVNAIDQLSVLKPSFLCFAFHRTQSMDNKTDFSSPLLPTSYGPNDAVDSQGKGPSSSSIPTTLIITTLVAVFGSYVFGSAIGYSSPTQSAIMRDLNLGVAQYSIFGSILTIGAMIGAVVSGRIADYAGRRVAMGFSQVFCILGWLAITFSKVAWWLYVGRLLVGCGIGLLSYVVPVYVAEITPKNLRGAFTAVHQLMICCGMSLTYLIGAYVNWRILATIGIIPCLVQLLSLPFIPDSPRWLAKAGRLKESDSALQRLRGKNADVYQEATEIRDHTEAFQKQTEASIIGLFQMQYLKSLTVSILNHPYSYAPFLCLIHRMASKKMNMIISDFTQKQKLLSMTGFSESIGTIAIVAVKIPMTTIGVLLMDKSGRRPLLLVSAVGTCVGCFLAALSFVLQVLLITESDLDLHKWKGVSPILALVGVLVYVGSYSIGMGAIPWVIMSEIFPINVKGSAGSLVTLVSWLCSWIISYAFNFLMSWSSAGTFFMFSGICGFTVLFVAKLVPETKGRTLEEIQASLNSYSSKR

SEQ ID NO: 210411 - protein, 356 aa, Glycine max
  Coding DNA Sequence Number=SeqID_93633
  Gene Ontology: Mol. function=peptidase activity
  Homolog annotation: Hit_ID=Q2KP21; Match level="QueryCoverage=60%, HitCoverage=68%, E-value=7e-77, Identity=64%"; Hit description =Stress regulated protein
  Pfam annotation: Domain name=CBFD_NFYB_HMF; Domain location=29-93; Score=19.8; E_value=0.0023; Accession=PF00808.13; Description =Histone-like transcription factor (CBFNF-Y) and archaeal histone
  Pfam annotation: Domain name=Histone; Domain location=23-96; Score =108.5; E_value=2e-29; Accession=PF00125.14; Description=Core histone H2AH2BH3H4
  Pfam module annotation: Pfam domain module=CBFD_NFYB_HMF::Histone; Domain location=29-93::23-96
  Subcellular localization annotation: CTP_CleavageSite=41; ConfidenceScore=5.49e-01
MSSTGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKKVDKELAKGDDRAALALVKDLQGLAAWNAFAISPQQIFYISLGLLFLWTLDADALPTDCLQVSFGGGIGSLVVDTIVHSFSQKYHNRVIQHEAGHFLIAYLVGILPRGYTNSSLDALQKEGSLNIQAGTAFADFEFQEETLNKFSCIALAGMSTEYLIYGFSEGGLDDIRKGLGFTQKKSDTQVRWSLLNTVLLLQMHEAARAKVAEALSMGKSVGSCIDIIENSINVSDL

SEQ ID NO: 210412 - protein, 295 aa, Glycine max
  Coding DNA Sequence Number=SeqID_93634
  Gene Ontology: Mol. function=oxidoreductase activity; Cellular component=membrane; Biological process=metabolic process
  Homolog annotation: Hit_ID=Q9LLQ6; Match level="QueryCoverage=99%, HitCoverage=99%, E-value=1e-128, Identity=78%"; Hit description=Seed maturation protein PM34
  Pfam annotation: Domain name=adh_short; Domain location=43-217; Score= 62.3; E_value=1.6e-15; Accession=PF00106.15; Description=short chain dehydrogenase
MASGENQFPRQKQDTQPGKEYLMNPPPQYNSPDYKPSNKLHGKVAVVTGGDSGIGRAVCNLFSLEGATVIFTYVKGQEEIDARDTLEIIRKAKTEDAKDPMAVAVDHLGYEENCKRVVDQVVNAYGSIHILVNNAAVQYESDSLEEIDDKRLEMVFRTNIFSYFFMTKHALKHMKEGSSIINTTSVTAYEGFAKLVDYSSTKGAIVGFTRSLALQLVSKGIRVNGVAPGPIWTPLEVASLTVEEIVRFGSDVTPMKRAGQPIEVAPSYVFLASNICSSYITGQVLHPNGGIIVNT

SEQ ID NO: 210413 - protein, 154 aa, Glycine max
  Coding DNA Sequence Number=SeqID_93635
  Gene Ontology: Mol. function=zinc ion binding; Cellular component =intracellular
  Homolog annotation: Hit_ID=Q1XG53; Match level="QueryCoverage=50%, HitCoverage=32%, E-value=2e-13, Identity=40%"; Hit description =Putative zinc-binding protein
  Pfam annotation: Domain name=PLATZ; Domain location=75-150; Score =17.7; E_value=1.9e-07; Accession=PF04640.4; Description=PLATZ transcription factor
  Pfam annotation: Domain name=zf-B_box; Domain location=70-113; Score =21.0; E_value=0.00077; Accession=PF00643.14; Description=B-box zinc finger
  Pfam module annotation: Pfam domain module=PLATZ::zf-B_box; Domain location=75-150::70-113
  Subcellular localization annotation: CTP_CleavageSite=67; ConfidenceScore=5.56e-01
MGGRQLATLFGVSTLFSFLGPTSHSLSTNLHRPITFQSNGTTALRFPPIGGQNLSPKERSRDWIGVLMNSSFGYCTYHHDLRSNEMNVFCVDCALRMCRHCKEAHSLHRRFQIYKYSYQDVFRHAELQKYFDCSKIQVLISLSQDSNDFIVRVS

SEQ ID NO: 210414 - protein, 243 aa, Glycine max
  Coding DNA Sequence Number=SeqID_93636
MTNPTTIFSLVLPAMIKLFKRNTNTDTCHHHRYRHPVLGLGLATREAHRPPNVLESAMLRPTAPPPSEKRVIIGSVDDVVTGLASCTESLGFESSDEIHNNNDNCCDEKENCDDEIWRRRTMKAEGRGKVRSFPPPLSSLNRNGKPSFYLRPVRKDGRLELTEVRIQRSEILHASRHNGRLTLRLVPDLEEEEEEEEEEERVEEWRLRGVGGSEGLRRCHEMVKQHHHHNVHGNLRMCGISIV

SEQ ID NO: 210415 - protein, 543 aa, Glycine max
  Coding DNA Sequence Number=SeqID_93637
MYNFVLIVMSLAYQSPFVGDFSDIKHGSIESMKELVGFHKYDYGFRITSRSAFVEIIIFVLVALQSYMFSFSEFDYVSKYLEKEQIGAILRQQEKKSAWKIAQLRHIRKAEELKHLRSLQVEKMKSEMLNLQNQLHNMSTEANCSNAHLDLHEENGSRKQDRDITTESIGPFDGNQFLLSEKSKSPLVPQYRKYPKDSLHEIVELKERTKNNDVLDLEIRNRYKLPARKNALVSAIHFIGNGVYQVQSLGNMAVNNLMNYLKIEHGELESTEDSSEDEEYYEIEIENQNMGAEPLEPTISTHSIHEHTVPDTAFLQIGIILRYMWSRMRYWKSLTWEAETPPYFVQLSMEVNSWPKEGIQPKKIESRINKLLKILHKRRCKEENHFKLHSASRVRVQSIEKGEEKENLCLVVFEVLYASPPIEFAAEEWYSSLTPAGDVSNEIQKAQHAGIFKQIGFPYRILSVIGGGKKEIDLYAYIFGADLAVFFLISIFYESVMKANSEFLEVYQLEDQFPEDFVLVLMFPFFEVGTIVPDLKCSASTTV

SEQ ID NO: 210416 - protein, 74 aa, Glycine max
  Coding DNA Sequence Number=SeqID_93638
MDSIGGSGTEGAMSGANGPLPKIHKNDSCGMETPCFSCRQNLAGTTKDVGACGLSLKMFKKKCWILFHLCMKSS

SEQ ID NO: 210417 - protein, 231 aa, Glycine max
  Coding DNA Sequence Number=SeqID_93639
  Gene Ontology: Mol. function=structural constituent of ribosome; Cellular component=ribonucleoprotein complex; Biological process =translation
  Homolog annotation: Hit_ID=O22584; Match level="QueryCoverage=78%, HitCoverage=92%, E-value=8e-53, Identity=66%"; Hit description=40S ribosomal protein S14
  Pfam annotation: Domain name=Ribosomal_S11; Domain location=64-227; Score=175.0; E_value=1.9e-49; Accession=PF00411.9; Description =Ribosomal protein S11
MTSEDDSVGDKSSAPLNAEGSSNLRRPSPDCNHERKRSRRKVREPKEENVTLGPAVRDGEHVFGVARIFASFNDTFIHVTDLSGRETLVRITGGMKVKADRDESSPYAAMLAAQDVAARCKPVSIVLFSFFSDFVLVMLCEITVVWDVIFCEAVKLNALFQIIVEQELGITALHIKLRATGGNKTKTPGPGAQSALRALARSGMKIGRIEDVTPIPSDSTRRKSGRRGRRL

SEQ ID NO: 210418 - protein, 395 aa, Glycine max
  Coding DNA Sequence Number=SeqID_93640
  Gene Ontology: Cellular component=integral to membrane
  Homolog annotation: Hit_ID=UPI0000660475; Match level="QueryCoverage =66%, HitCoverage=12%, E-value=2e-18, Identity=26%"; Hit description =Homolog of Homo sapiens "Protein FAM38A
MYSSGNPTNIANPIKDASARVDIKTSSGRLTLFETTLCEKISWEKLEARKSLDPLGYLRAYNEKDIQLICCQSEASTLWLVPPIVQARFIKSLRWNMDITFSWEFIRDRPKGKEAVKYELTILEQDLPKSSEVTKVFNGSSNSFTVFNIYPRYFRVTGSGDVRSLEQSLDCYIHLLAMAQITKGKRSLQVELVSGDLVLNRGDPEWWSFYDLGILGSHGCGKFPGPMAIIVSEETPLSFTEGIIGDTLSKFSIWGLYITFVLAVGRFIRLQCSDLRMRIPFENLPSCDRLMAICEDIYAARAAGELEVEEVLYWTLSILRLNKYFKGLEDLQSPTACVSHCRQLSMAQFFDGNAKQEEEDQPRVKAAQLYESRVYEATQTIKILLEDSIGVVYWF

SEQ ID NO: 210419 - protein, 122 aa, Glycine max
  Coding DNA Sequence Number=SeqID_93641
  Gene Ontology: Mol. function=sugar porter activity; Cellular component=integral to membrane; Biological process=carbohydrate transport
  Homolog annotation: Hit_ID=Q3ECP7; Match level="QueryCoverage=86%, HitCoverage=29%, E-value=7e-27, Identity=48%"; Hit description=Sugar transporter ERD6-like 5
MIGAIVSGKIADYAGRRVAMGFSEVFCILGSLIIAFSKDARWLCIGRLLIGCGISLISYVVPVYIAEIAPKNLRGAFTEVHQLLTLPFIPDSPRWLTKVGRLKESDVYQEESMLMFIKRKAC

SEQ ID NO: 210420 - protein, 350 aa, Glycine max
  Coding DNA Sequence Number=SeqID_93642
  Gene Ontology: Mol. function=sugar porter activity; Cellular component=integral to membrane; Biological process=carbohydrate transport
  Homolog annotation: Hit_ID=Q2R0I8; Match level="QueryCoverage=93%, HitCoverage=91%, E-value=1e-59, Identity=39%"; Hit description=Sugar transporter family protein, expressed
  Pfam annotation: Domain name=MFS_1; Domain location=22-310; Score =5.4; E_value=0.00018; Accession=PF07690.6; Description=Major Facilitator Superfamily
  Pfam annotation: Domain name=Ribonuclease_BN; Domain location=110 -342; Score=-99.5; E_value=0.094; Accession=PF03631.5; Description =Ribonuclease BN-like family
  Pfam annotation: Domain name=Sugar_tr; Domain location=18-349; Score =92.7; E_value=1.1e-24; Accession=PF00083.14; Description=Sugar (and other) transporter
  Pfam module annotation: Pfam domain module=MFS_1::Ribonuclease _BN::Sugar_tr; Domain location=22-310::110-342::18-349
MVLTVKETWSVPAILILTTLVAVSGSYVFGSAVGYSSPAQTGIMDDLNLGVAKYSLFGSILTIGAMIGAIISGRIADYAGRRTAMGFSEVFCILGWLVIAFSKVGWWLYIGRLLVGYGMGLLSYVVPVYIAEITPKNLRGGFTTVHQDFTEALQKETEASIIGLFQLQYLKSLTVGVGLMILQQFGGVNDIAFCASSIFISAGFSGSIGMIAMVAVQIPMTALGVLLMDKSGRRPLLLDLHKWKEGSSILTLVGVLAYTGSFLLGMGGIPLVIMSEIFPINVKGSAGSLVNLASWLCSWIVSYAFNFLMSWSSAGTFFIFSIICGFTILFVAKLVPETRENSRRSSSIYL

SEQ ID NO: 210421 - protein, 180 aa, Glycine max
  Coding DNA Sequence Number=SeqID_93643
MRKMNLNLYQVITKIQQQLLLLGITETHANKINIKMYPHIYLRHLYLAPPNMNHTLPQKISMVKSILSPNTSSPSSMCHPSTFSYAIQMRHHPWCKYPILVSLSSFTIQYERDVVVVFLAIMLWLLMVVVGLVENKVRRGTIMKEKRGPGNYVTTMIVVAGLGEKVVRKGADMTHIGTTA

SEQ ID NO: 210422 - protein, 815 aa, Glycine max
  Coding DNA Sequence Number=SeqID_93644
MTHELYELINFINWYTLQISLLALSLWSFHFASLCSFGLLAYVGYILYAFPSMLRLQHLNGMLLVFILFWVSSTYIFNVAFAFSNNKSWKDMEIWETIGLWHYPIPGYYLLAQFGLGFLVAMCNLVNSSVLLCITDQEQLTADESVVEEEEETLLVVATIAWGLRKCSHTVVLILIFIIAIRSGIVHAVYSLLNHIHSVDFFQISVLACFCAIHNHGLQTLLSFSAIVRQTSCPPVGFSILRAFLIKPVRLSGYSPRSSESQGTHERKTISYLEVIRQNFLSIYRLCGKYIAFLTILFNVYLCTPNYASFGYLFFLLLWIIGRQLVGKTRKHLWYPMKVYAIVVFVSIYSIGAFSSSEIWFPRIIDLQTALGYNPASSMLQNIWGSLAVLVVMQLYSYERRQSKRSGSSDYDAPEIRPLAFARCLLVRHAEKILYLALFYASLSPISAFGFLYLLGLINCSRLPKLSQILAKVFLVYSGLLIMAEYLFQMWGDQAEMFPGQKHFQLSLFMGLQLYKPGFKGLESGLRGKVVVIVACILQYNVFHWMEKRHVYGNGGKWNEPCPLFNPIEVPNETTACTPQSKQLENATSATFKRGGRNHSMPTVNSALSQGPGSGPERESAKEIRHFHFWESSKDSLKWNRKRILFLRKERMEMQKTVLKVSLKFWMENMFNLFGLEINMLALLLASFAVLNAISLLYIASLAACVLLHRLIIKKLWPIFVMLFASIIVIEYLAIWMRLTFTNQQIEEQVPCHDCWRVSNIYFSDCKKCWLGIIVDDPRMLIWYYGVFMFSCFKFRADQSSCLTGLEDTGHSSTT

SEQ ID NO: 210423 - protein, 61 aa, Glycine max
  Coding DNA Sequence Number=SeqID_93645
  Subcellular localization annotation: CTP_CleavageSite=29; ConfidenceScore=5.37e-01
MSLHLQAPMSSSTSPSTILGTLRSLSVVMADLSGGPITNCSTLAKPIFCCRSQQLDIEQGC

SEQ ID NO: 210424 - protein, 144 aa, Glycine max
  Coding DNA Sequence Number=SeqID_93646
MTETSMRVGNFEVCGFLEPQSIQRSGQSQFESESYMKNWMQNSKRDVYVGAYLNGAHWQMVVILPKENLVVWFCSLHNRLDNYLKGIINNALKGLDDTPQPKSKAGAGWIVVKYFNDARPLEPERLKALRIQWAKYYLKVRNET

SEQ ID NO: 210425 - protein, 120 aa, Glycine max
  Coding DNA Sequence Number=SeqID_93647
MAAEWRRKRERRRHFKEKMSLEEAHHHRRPWIRAWRKKEMNEGRGREEHEILCSKRALKSEDCITMAAKQQNFSKTNLKAMNVALEQTLKEAPKVDVDTINKRKQMRLAKSITEEKTMAE

SEQ ID NO: 210426 - protein, 238 aa, Glycine max
  Coding DNA Sequence Number=SeqID_93648
KLKKMLGKEVVVIISCEANTSIIKVIRPGKLSIHREHWEFKSAASHEIESSNCRDGSESPPSSAVKAYMPCQEGCAGNSFIMGVHRGTTLGALLIFVLLHTPSNLRECHLSGGLNRLLSARLQMECAHSRNMPRLVPQPMCYSSINGSLEASLLNLSRCNGEGGGHGYGVGADLWNGVRGMLLVDSSSDEEEAGSSFFPVKEIAHSLSLIFGLALVAFVLTHRGMDKGRTDARGSIAS

SEQ ID NO: 210427 - protein, 73 aa, Glycine max
  Coding DNA Sequence Number=SeqID_93649
MTNVITHSQCAFVFGLNVILLQVSQHMMHSMLEMKRLSLCYGSALINVALGRCHIFWVRPESGRKDSDELFGV

SEQ ID NO: 210428 - protein, 351 aa, Glycine max
  Coding DNA Sequence Number=SeqID_93650
  Gene Ontology: Mol. function=RNA-directed DNA polymerase activity; Cellular component=chromatin; Biological process=chromatin assembly or disassembly
MDLYVLPISGANVVLGVQWLKILGPEDASYFHIAVLTEDPASAPAPDLPLEIQDLLAKFATLFQNHQGLPPARDIDHHIHLIPHFTLVNDGSWKFCMDFRALNAVIVRDRFLIPTIDELLDKLGGTKYFSKLDLLQGYYQIRMHVADIPKTAFRTHHGHYEFKVEYLGHMVSQKGVEPVASKVEAIHQWPVPQSTRAVQSFLGLVGFYRRFIRGYATIAASLIKITIVKPFKWTSQAQLAFEQLKAALSMTLILALPDLQLPFTIEMDASNMGIGVVLSQKGHLIAFFSKPFSPKFLRASTYVQELFAITKVVKKWHQYLLDHRFTIITDHRSLKELLTQVIQTLEQHMYL

SEQ ID NO: 210429 - protein, 85 aa, Glycine max
  Coding DNA Sequence Number=SeqID_93651
LSHHLSVEVLQFYFAYENPCHIGTEDGSREITTSGLRDGSSDDMHRDGSLVKVNGISDTNGSGHQLDSVEETRDGMNQFLWLPYD

SEQ ID NO: 210430 - protein, 215 aa, Glycine max
  Coding DNA Sequence Number=SeqID_93652
EVGTFDDENDNPSEGDVALSKDGTSKLINFSVKGLQPFVRNSKNKHMIEQLLMKESFSREECDRLIKIIRSRVVDPANDDDGDKRPTDMSNKILGSDTDSPELHDVAIMEAKKWLQEKKSALDTNTDIGYGSLSLNLVALPQDPKDEGSPVDVAKSYMCTRPPWASPSIDHTKPQTPSGIQLFKEETPYLFGNNSMPSSKKIGSYILSRYCWHKA

SEQ ID NO: 210431 - protein, 133 aa, Glycine max
  Coding DNA Sequence Number=SeqID_93653
  Subcellular localization annotation: CTP_CleavageSite=79; ConfidenceScore=5.21e-01
MASVPGSRSGGKIVRTRRSAAARSHTPYDRPAPPPEPPSPNWLSRFVISPSRFIASGAGKIFSSVLDLDNSPSDSSSATCSLSSSANDSDAGILFYVEYVEWSNRACVCCLYFILTLVDLGLVDLVVKVGGAS

SEQ ID NO: 210432 - protein, 391 aa, Glycine max
  Coding DNA Sequence Number=SeqID_93654
  Subcellular localization annotation: CTP_CleavageSite=29; ConfidenceScore=5.66e-01
DTSVVGKEKKAPSSNSPMTTTKKTPTKAPSTTKKATSSPSEKQVPNYLKPTISSGLDSHSSFKLPRNNDGPTKPTLNRRRSLDPSSSSSSRLPKQTHTPSLSRQHKALVSPGPRERTLPLRSSSVPIKTTNNASKPIPERLSRTPKEGRTQPLSAKKSPNKVFASTSKKVMSNDASSNSSNVSKSGGINESEVEEAVNEEQVGEVENVDNHEELPRQVVDSEHEHLDQKLEESDQPHVQDDDEKGIPTVLEEKEDENTNQYECNINESHPKIDHSTTEEVELKQEEQEQEEGGVVHKSETNNEEEVVEEKEGVEKVISEEVKELREGQGEDEQVESEVKEEKVESPKPKQVEEGGWMQEKKEVQSPVSNDVIEENAGKQLEARRNKVRALA

SEQ ID NO: 210433 - protein, 419 aa, Glycine max
  Coding DNA Sequence Number=SeqID_93655
  Gene Ontology: Cellular component=nucleus
  Homolog annotation: Hit_ID=Q2QN39; Match level="QueryCoverage=98%, HitCoverage=98%, E-value=5e-32, Identity=28%"; Hit description =Expressed protein
MQPQQSSRIDLGELRAQIVKKLGADKSKRYFYYLNRFLSQKLSKTEFDKLCFRVLGRENLPLHNHFIKSILKNACQAKTPPPIHPPDPLKSGEHASDMSPGREDGHEHSVASFQNQSQKAPVWSNGFLPASPKVRSGVRERKLRDRPSPLGPNGKVDSVSHQIMGTEDCGSKVDMENGIRSPCDYQRPIQHLQAVAELPENERGDVVQKPAEKPRIHGKGPAEMSIVEDGEEVDQLSRLGFSRSPLIAPLGIPYCSASVGGARKTLPVSSAGDFDSCCDSGRLSDTDTLRRRMEQIAAVQGLGAVSMECANMLNSMLDVYLKRLIRSCVELVGTRSTNELRKPLAPKQQMQGKVINDMWPNNHLHVQCAGGSAEAVPEHRPPCSVSLHDFKVAMELNPRQLGEDCPLLLEKISMQSFEE

SEQ ID NO: 210434 - protein, 48 aa, Glycine max
  Coding DNA Sequence Number=SeqID_93656
MRTKECNSNRGLTEQGTKATEITGWPEKAGNIVGEGWCSAQGSDNCEL

SEQ ID NO: 210435 - protein, 259 aa, Glycine max
  Coding DNA Sequence Number=SeqID_93657
  Homolog annotation: Hit_ID=UPI0000E45E3B; Match level="QueryCoverage =51%, HitCoverage=47%, E-value=2e-08, Identity=31%"; Hit description =PREDICTED: similar to centromere protein, partial
MSGRHFFDYAAGAVQLLLCNARKRSYCLETISSDFCYCVVICCLEGARIGVQYETSFAGEPCEFYHCVLESKSFLEKMTVLEHTVPFFLPIREIENDLLSSNAMKFIDHVGDLLQAFVDRREQVRLIKELYGNQIRELYHSLPYHMIEFVLDDSDCKVTVSLRYADLISVLPTRISVLAWPMFNKNTMATLSRKEDGLSGSHSSPIRLTYAEDALRTMSLPEAVHVLIGCVQLSQLAYAEIVLNLPQALQQTYHQKAPA

SEQ ID NO: 210436 - protein, 35 aa, Glycine max
  Coding DNA Sequence Number=SeqID_93658
MVGVAEILCTCWILILGLKATYIRQMLACPPLVRG

SEQ ID NO: 210437 - protein, 296 aa, Glycine max
  Coding DNA Sequence Number=SeqID_93659
  Gene Ontology: Mol. function=oxidoreductase activity, acting on the CH-OH group of donors, NAD or NADP as acceptor; Cellular component =nucleus
  Homolog annotation: Hit_ID=Q10DL9; Match level="QueryCoverage=77%, HitCoverage=75%, E-value=2e-57, Identity=54%"; Hit description =Dehydrogenase, putative, expressed
DMNMEGSYDSSCNGEAVCGIQVDESTPEFLSLNHIPLSPDTLLEVNGVRSSIYSDGEESSVLRRDRVDKKSEEATFVNTDSIRFTGSMKFEVYDKENCILSGVLETSNSNGFVGESRSGVKRWSMNCQTEMSPGCGFFKGKHVAVPELPCPEIEVYVAGCFSGTPIILTKTLQLNCRKKHNRKFALDSIPEYGTTECQKDVSDHGLDLQVVDYRSFKPEQAEDYNSMYCQRTIYVDEEDGELSWFNAGVRVGVGIGLGLCVGVGIGVSLQQTISGIFFPLHKSLKNVLVSKDGIDA

SEQ ID NO: 210438 - protein, 779 aa, Glycine max
  Coding DNA Sequence Number=SeqID_93660
  Homolog annotation: Hit_ID=Q3TUA5; Match level="QueryCoverage=27%, HitCoverage=29%, E-value=9e-08, Identity=27%"; Hit description=12 days embryo embryonic body below diaphragm region cDNA, RIKEN full- length enriched ...
  Homolog annotation: Hit description=library, clone:3732404K14 product:trinucleotide repeat containing 15, full insert sequence
  Pfam annotation: Domain name=GYF; Domain location=524-579; Score =42.5; E_value=1.4e-09; Accession=PF02213.6; Description=GYF domain
MAEPRAASDTRLNLSVAPPLQISKDVQGSDNPIPLSPQWLLPKPGESKPGSGSVENHVVSNSPFGNRSETVKTSGKGEDVHDAHKKKDVFRPSMFDSESGRRDRWRDEERDTKSSVRKDRWRDGDKDLGDSRRVDRWTDNLSTKNFAEVRRGPSDNHRWNDSGNRETNFDQRRESKWNTRWGPDDKEPEGIREKWSDSGKDGDIHLEKGLPNISNQGKDEKEGDHYRPWRPNYSQSRGRVEPSHTTPNKPASTFSYGRGRGENTSPVSSLGHGRAGSFGSSLSSTYPGTALEKVESGHEENHPFKYNRTKLLDVYRMTGMGTNRKLVDDFVQVPNLTQDEPVEPLALLTPNSEELTVLKGIDKGEIISSSAPQVPKDGRSSTDFTHTRRMKPGSAPFQDRGEDGGSYKVPDEVSSNRDSSFEGNSSVHPGAPRRTMLLGEHATTQFHDSRDVTSDVRLRKGDLNSHQPKDPHNQWENNLGYLSDSKEVGKWQANEDPVIKRQLSGILDSELETRRVPQTAPEELSLLYKDPKGLIQGPFKGIDIIGWFEAGYFGIDLPVRLENSAVDSPWFSLGDVMPHLRAKARPPPGFSAPKLNDFTDAPGRQISNTFGNTLAGLNEVDILRSDSRHRQGSDTEAENRFLESLMSGSKNSPPLDSLTLSEGLQGFVGNNPGNMGPSGVDSGNNLYLLAKRMVLERQRSLPPNPYPYWPGHDAASFAPKSDVVPDASLHSKLLSSVSDNSRQPQSQNSELMSIIQGLSDRASAGLNNGAAGWPNYPLQ

SEQ ID NO: 210439 - protein, 699 aa, Glycine max
  Coding DNA Sequence Number=SeqID_93661
  Gene Ontology: Mol. function=methyltransferase activity; Cellular component=cellulose and pectin-containing cell wall
  Homolog annotation: Hit_ID=Q9FMJ2; Match level="QueryCoverage=75%, HitCoverage=68%, E-value=1e-163, Identity=49%"; Hit description =Ankyrin-like protein
  Pfam annotation: Domain name=DUF248; Domain location=206-694; Score =881.4; E_value=4.3e-262; Accession=PF03141.7; Description=Putative methyltransferase
  Pfam annotation: Domain name=Methyltransf_11; Domain location=323 -418; Score=29.0; E_value=1.7e-05; Accession=PF08241.2; Description =Methyltransferase domain
  Pfam annotation: Domain name=Methyltransf_12; Domain location=323 -416; Score=19.2; E_value=0.0096; Accession=PF08242.2; Description =Methyltransferase domain
  Pfam module annotation: Pfam domain module=DUF248::Methyltransf _11::Methyltransf_12; Domain location=206-694::323-418::323-416
  Subcellular localization annotation: CTP_CleavageSite=61; ConfidenceScore=5.00e-01
MAIARLVRQAKRPHGLWVKMTAVTILGLCFIFVWGVFSSSSTSVTTQRESFEDIAEPASSSSSHKPQKLKKDESKKHPSAATRHHPEQHKGKDNNNDNKEKKHVHKEDNNKEKGNHQGNEDPQPQHDQEEEKEKEKEEVEVEGEADVDAGGGDLAESVDQGDSDEAVEDVEEVRKASKGKGKVKGPLFDPNATYSWKLCSTRSKHNYIPCIDIEVGGGKVPSYRHTERSCPRTPFMCLVPLPHEGYESPLPWPESKLKILYKNVAHPKLAAYVKRHNWLMESGEYLTFPQNQSEFKGGILHYLESIEEMVPDIEWGKNIRVVLDIGCTDSSLAAALFDKEILTLSLGLKNDLVDLAQVALERGFPAVISPLGRRRLPFPSQSFDAIHCGGCSIPWHSNGGKLLLEMNRILRPGGYFIMSTKHDSIEEEEAMTTLTASICWNVLAHKSDDVGEVGVKIYQKPEGNDIYELRRKKVPPICKENENPDAAWYVPIKTCLHTIPIGIELHGAEWPEEWPKRLESYPDWVNDKEKVVADTNHWNAVANKSYLNGLGINWTSIRNVMDMKSVYGGLAVALSQQKVWVMNVVPVHAPDTLPIIFERGLIGIYHDWCESFGTYPRTYDLLHADHLFSRLKNRCKQPVTIVVEMDRILRPGGWIIIRDKVEILNPLEEILKSMQWEIRMTFAQDKEGILCARKTMWRP

SEQ ID NO: 210440 - protein, 126 aa, Glycine max
  Coding DNA Sequence Number=SeqID_93662
  Pfam annotation: Domain name=AT_hook; Domain location=41-53; Score =14.6; E_value=0.07; Accession=PF02178.9; Description=AT hook motif
MGKKKPQKTKELSVAIAEASSAIDEKEQQIQVQVQPQPQAPRKRGRPRKIVLKREESEEEKTQLMIGQRGAQGTESSMEKGTTNEQEGTSSSACMRVTTKQEEMQLPKVEPSRSRARRKSKPRKSS

SEQ ID NO: 210441 - protein, 79 aa, Glycine max
  Coding DNA Sequence Number=SeqID_93663
MNELGLINQQENLKSSLGEDEPADAECNRAGKEKIRVLGRENETKRLRFCIALLLYIRNGIGGKLAMQVQNGNATLGSV

SEQ ID NO: 210442 - protein, 833 aa, Glycine max
  Coding DNA Sequence Number=SeqID_93664
  Gene Ontology: Mol. function=protein-tyrosine kinase activity; Cellular component=cellulose and pectin-containing cell wall; Biological process=protein amino acid phosphorylation
  Homolog annotation: Hit_ID=Q9SIX4; Match level="QueryCoverage=92%, HitCoverage=89%, E-value=0.0, Identity=46%"; Hit description =Putative LRR receptor protein kinase
  Pfam annotation: Domain name=LRR_1; Domain location=101-120; Score =7.1; E_value=14; Accession=PF00560.23; Description=Leucine Rich Repeat
  Pfam annotation: Domain name=LRR_1; Domain location=125-147; Score =16.1; E_value=0.13; Accession=PF00560.23; Description=Leucine Rich Repeat
  Pfam annotation: Domain name=LRR_1; Domain location=149-171; Score =16.9; E_value=0.071; Accession=PF00560.23; Description=Leucine Rich Repeat
  Pfam annotation: Domain name=LRR_1; Domain location=173-195; Score =18.3; E_value=0.027; Accession=PF00560.23; Description=Leucine Rich Repeat
  Pfam annotation: Domain name=LRR_1; Domain location=197-219; Score =16.4; E_value=0.11; Accession=PF00560.23; Description=Leucine Rich Repeat
  Pfam annotation: Domain name=LRR_1; Domain location=221-243; Score =2.8; E_value=86; Accession=PF00560.23; Description=Leucine Rich Repeat
  Pfam annotation: Domain name=LRR_1; Domain location=247-269; Score =6.2; E_value=20; Accession=PF00560.23; Description=Leucine Rich Repeat
  Pfam annotation: Domain name=LRR_1; Domain location=271-292; Score =13.7; E_value=0.66; Accession=PF00560.23; Description=Leucine Rich Repeat
  Pfam annotation: Domain name=LRR_1; Domain location=318-341; Score =9.5; E_value=4.8; Accession=PF00560.23; Description=Leucine Rich Repeat
  Pfam annotation: Domain name=Pkinase; Domain location=461-738; Score=- 16.0; E_value=1.3e-07; Accession=PF00069.15; Description=Protein kinase domain
  Pfam annotation: Domain name=Pkinase_Tyr; Domain location=461-738; Score=-56.1; E_value=5e-09; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::Pkinase::Pkinase_Tyr; Domain location=101-120::125-147::149-171::173-195::197-219::221-243::247 -269::271-292::...
  Pfam module annotation: Domain location=318-341::461-738::461-738
MGMSSRTEWFALRELRQSLEIRAKYWPIKAEPCGNWTGVQCRNGRVVGINVSGLRRTRWGRLNPSFEVGSLVNFTLLETFNASGFKLNGSIPEWLGESLGVLEVLDLSFCSIKGSIPDSIGWLSKLKVLLLSGNFLTGRMPSTFGNLTRLSVLNLSGNSLSGTVPDSVSKLGNLSRLDLSYNFLSGSVPPELGALSSLQFFNLSGNSFTGTFPSQLGNLSKLVDVDLSMNFLSGSLPGGSSSSGLLALKVLILRGNLFDGVLPADLWPMPRLHFLDVSSNNLTGTLPNFTSWNVSSVGFVFNLSNNLFYGLLNTSLDRFEIIDLSSNYLEGEVPGGGVNNVSLDRNCLQRIPNQRDLEDCRVFYDNRSLPFGFLKSGSRSRVIFILVGIFGGLGFIVLLALVLMLVLKQCHNRRSLGVQRGTKDGGPVQEGESPIPPKDTVFVTVGDAFSFEQMLHLTSNFAEANVIKHGHSGDLFLGVLEGGATVVVKKVDLNLFKRESYVVELGLLSKVPHARLVPILGHCLDNENEKFIVYKYMPNRDLATSLHRVTGSDGKLQSLDWITRLKIAIGAAEGIAYLHECSPPLVHRDIQASSILLDDKFEVRLGSLSEVTAQGDLQQGVISRVFSKPPSSNQADSGKSSVTCAYDIYCFGKILLELITGNIEVSKLDDASTKEWLEQTLPYITIYDKERVTKIIDPSLIVDEDLLEEVWAMAIVANACLNPKPSKRPPMRHVLKALENPLKIVREENTSSARLRSNSSRKSWSTAFFGSWRHSSSDSVVATNKEGSSDTKKSGKVGSQSSGNDHSSSNKRSSNEIFPEPLEILDVETGVAR

SEQ ID NO: 210443 - protein, 451 aa, Glycine max
  Coding DNA Sequence Number=SeqID_93665
  Gene Ontology: Mol. function=hydrolase activity; Cellular component =cytosol; Biological process=metabolic process
  Homolog annotation: Hit_ID=Q8RWN4; Match level="QueryCoverage=90%, HitCoverage=66%, E-value=1e-161, Identity=67%"; Hit description =Cytosolic IMP-GMP specific 5-nucleotidase, putative
  Pfam annotation: Domain name=5_nucleotid; Domain location=121-451; Score=348.7; E_value=9.5e-102; Accession=PF05761.4; Description=5' nucleotidase family
MDGIHAIGARHQNSVDFPDSDSAKQLRILSSSPDLGPTTDIGKQIFCNRSLNMKNIVAVGFDMDYTLAQYIPETFESLAYQHTVEKLVYDLDYPRELLSWSFDSNYMVRGLVLDKKRGNILKMDRHKYVKVAYHGFKELSKEDKVGTYENTLVHDSFDGPDYALIDTLFSLAEAYLFAQLVDFKDGNPGKIQEHVDYARLYKDVRNAVDLCHRDGTLKQKVAIDPKRYINEDTSIVPMLKMLRDSGRATFLVTNSLWDYSNVVMNFLCGSSEANESTQFDWLKYFDVVITGSAKPSFFLEGNHANLFEVVPESGMLLNTDNGSPMAQVGNTSARVLKEEKGHARKVFQVLYVGDHIYGDILRSKKVLGWRTMLVIPELEKEVKLLWELRDARKELQHLRSERDRIEDEMHYLNESLRLKNPDEDTKQKFNSKLDKLKVRPFRPILIFLCQA

SEQ ID NO: 210444 - protein, 79 aa, Glycine max
  Coding DNA Sequence Number=SeqID_93666
MLQNFTDCTLTVPFNSRHVAELHGLPNDGRQVPRSGKVRVASQQTDDPRTKLGEGYEYEFIQIVELVSNKINCALLYVT

SEQ ID NO: 210445 - protein, 226 aa, Glycine max
  Coding DNA Sequence Number=SeqID_93667
  Subcellular localization annotation: CTP_CleavageSite=62; ConfidenceScore=5.41e-01
MAPRKLSIKRSRKDARPKGLVPLPSSIAIVSGALSTCSVSKPSRDGPSTERDASSSGTMSTQCEYSQRRNRADGFDEEAIAQLLCIPGQDFARTAAGRRVRIMHTSMTTLTQTWMTLLLSNILPSDHNSDLPLPKSQLVYAILTRMSVHVTQLIADAIYLFVGMPPTRHPLDLDKSNRALGFPELITGLCQSFEVPVTPSKVIRPSITRAFIEKYCTPRQAQSGTP

SEQ ID NO: 210446 - protein, 100 aa, Glycine max
  Coding DNA Sequence Number=SeqID_93668
MDLCDKVDDDKIRRRHEGEALCDEVGAKGSGEELAMTSRMPRLLPPPPWPALRDQREGDGHEGGGSATPRQRLEQRAMAVARLQHDRGGVTELVRRRWGR

SEQ ID NO: 210447 - protein, 49 aa, Glycine max
  Coding DNA Sequence Number=SeqID_93669
MAVSDRASKLWNLYMDLPICGYKSVLWSQFQLVLAVVSDYEACEVEIQR

SEQ ID NO: 210448 - protein, 261 aa, Glycine max
  Coding DNA Sequence Number=SeqID_93670
  Homolog annotation: Hit_ID=Q9FMY8; Match level="QueryCoverage=77%, HitCoverage=91%, E-value=2e-64, Identity=64%"; Hit description =Arabidopsis thaliana genomic DNA, chromosome 5, P1 clone:MJB21
  Pfam annotation: Domain name=Maf; Domain location=28-261; Score=79.8; E_value=8.6e-21; Accession=PF02545.5; Description=Maf-like protein
MDASSFKVLLLLVRVSPHFITHSFSLLTQIILGSSSVARRKILSEMGYLFTIMVAPYPLCFIVPLDIDEKSIRKETPEDLVMALAEAKANAIISKLQTTTNQQRVDEPTILIAADTAEAILQRLPVDDYLKEAEPTLLITSDQVVVYEGVIREKPTSKEEARQFLKDYSGRHAATVGSVLVTNLKTGLRKGDSDRVEIYFNEIPDEIIEKLVDEGITLNVAGGLIIEHPLVLPFVKEVVGTTDSVMGLPKALTEKLLKEAL

SEQ ID NO: 210449 - protein, 513 aa, Glycine max
  Coding DNA Sequence Number=SeqID_93671
  Gene Ontology: Mol. function=acyltransferase activity; Cellular component=integral to membrane; Biological process=biosynthetic process
  Homolog annotation: Hit_ID=Q1SWP9; Match level="QueryCoverage=96%, HitCoverage=98%, E-value=0.0, Identity=78%"; Hit description =Chalcone and stilbene synthases, N-terminal
  Pfam annotation: Domain name=ACP_syn_III; Domain location=238-329; Score=-16.1; E_value=0.032; Accession=PF08545.1; Description=3 -Oxoacyl-[acyl-carrier-protein (ACP)
  Pfam annotation: Domain name=ACP_syn_III_C; Domain location=404-488; Score=20.8; E_value=9.9e-08; Accession=PF08541.1; Description=3 -Oxoacyl-[acyl-carrier-protein (ACP)
  Pfam annotation: Domain name=Chal_sti_synt_C; Domain location=347 -490; Score=24.1; E_value=1.7e-05; Accession=PF02797.6; Description =Chalcone and stilbene synthases, C-te
  Pfam annotation: Domain name=FAE1_CUT1_RppA; Domain location=101-390; Score=762.6; E_value=2.5e-226; Accession=PF08392.2; Description =FAE1Type III polyketide synthase-lik
  Pfam module annotation: Pfam domain module=ACP_syn_III::ACP_syn_III _C::Chal_sti_synt_C::FAE1_CUT1_RppA; Domain location=238-329::404 -488::347-490::101-390
MTVTSGEEEGAVGGVQIQHRSRMVLPDFLQSVNLKYVKLGYHYLISNLVTLFLVPLILVTLIQVFQTTDIDHLRHLWLHLQYNLLTILTCSAVLVFGLTLYAVTRPRAVYLLDSACFRPADHLKAPFRSFMDHSRLTGDFEDSSLEFQRKILERSGLGEETYVPEAMHSIPPQPSMAAARAEAEQVMFGALDKLFQGTNIKPKDIGILIVNCSLFNPTPSLSAMIVNKYKLRGNIRSFNLGGMGCSAGVIAVDLAKDLLQVHRNTYAVVVSTENITQNWYFGNKKSMLIPNCLFRVGCSALLLSNKPADRRRAKYRLVHVVRTHRGADDKAFRCVYQEQDDAGKTGVSLSKDLMAIAGGALKTNITTLGPLVLPISEQLLFFVTLLMNKLFKAGVKPYIPDFKLAFDHFCIHAGGRAVIDELEKNLQLLPEHVEASRMTLHRFGNTSSSSIWYELAYIEAKGRIKKGNRIWQIAFGSGFKCNSAVWQALRNVRPSPNGPWEDCIHKYPVEIVT

SEQ ID NO: 210450 - protein, 253 aa, Glycine max
  Coding DNA Sequence Number=SeqID_93672
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=70%, HitCoverage=23%, E-value=1e-30, Identity=40%"; Hit description=Bg55 protein
MSSNNATALEIPILSYCKVKVRGAVCLELHRLIDRISHVILAIESARPNSTLAVQVLCSLNFTLAKAKSVIRHCSKCSKLYLAITSHKILSRCQKVRNAFEFYLAQIQNAVQTPLADEISAILHDLRDTEFSLEFAEDEARKVLLSLLEKNFPDAASIQKEELEAIQIATSRLEIKSPFSLLVEKATLKKQLEEVSEKNLKEKELLQYLLYLLVKHGKSICQFQNGSHSPKHECHDQSFENELVVDESSQSLS

SEQ ID NO: 210451 - protein, 611 aa, Glycine max
  Coding DNA Sequence Number=SeqID_93673
  Homolog annotation: Hit_ID=Q1SHI0; Match level="QueryCoverage=15%, HitCoverage=31%, E-value=1e-08, Identity=34%"; Hit description =Probable extensin [imported]-Arabidopsis thaliana, putative
  Subcellular localization annotation: CTP_CleavageSite=18; ConfidenceScore=5.30e-01
MAHRSKSFRFRIPWLSVPSESFARRTKERPRSPPHSDTSVPIHRPSKPSLVVPSELSPPSPTKTEEAPRAEPQKESLPHPTQPLTSSFSTESPVKVQPQPKPLSPQPPLQPSSHADSPSQVHIAPSSPKTHLASGSGVMKVPKLVAEETNPLASSSSEQEKEKMVLSEPKQQEAEPKVESPLRTITKSPETSFQPERMSTRPEDTKEQVPSVPSLSSVSKTEPITHPSSPLASKDIKTEETTPEEEKEKMAVLVPQEEKRKMKSPLKTIPKSPEISSQPENLSTQPTTIEQRSTPPKSKSLQPEEKEKVVHETTKARGKGKDTTTTAQSSEQSTMASASGTSSSTTTKAKDSFAKRFHGEKKHHGARETVERKIMFATTNPIGKDTKVVSSTDEGTRNVSSSSISPEKTASSSGEKAPPLQKGIKDDITNFVHKLTASVHPTQHVDEKQFSVITLAGDNRGATMHLGSESAKKEGSIHIHRAYKSDPEDTNEVTTDGEENTNEEVGMAYVNSNIQSINNSLMFHGLITERDPGVQVTLPQKPAEPIKPDDKPSPGLETQRTQFNINRAEKSTYQPTVGRSIRGPFLKPNDKPRRPGCNFSCDKDIEDIEIL

SEQ ID NO: 210452 - protein, 693 aa, Glycine max
  Coding DNA Sequence Number=SeqID_93674
  Gene Ontology: Mol. function=transferase activity, transferring hexosyl groups; Cellular component=intracellular; Biological process= multicellular organismal development
  Homolog annotation: Hit_ID=Q6K643; Match level="QueryCoverage=86%, HitCoverage=85%, E-value=1e-129, Identity=42%"; Hit description =Putative pentatricopeptide (PPR) repeat-containing protein
  Pfam annotation: Domain name=PPR; Domain location=361-395; Score =23.6; E_value=0.00071; Accession=PF01535.11; Description=PPR repeat
  Pfam annotation: Domain name=PPR; Domain location=396-430; Score =12.5; E_value=0.25; Accession=PF01535.11; Description=PPR repeat
  Pfam annotation: Domain name=PPR; Domain location=431-465; Score =17.6; E_value=0.045; Accession=PF01535.11; Description=PPR repeat
  Pfam annotation: Domain name=PPR; Domain location=466-500; Score=9.6; E_value=0.54; Accession=PF01535.11; Description=PPR repeat
  Pfam annotation: Domain name=PPR; Domain location=503-537; Score =26.3; E_value=0.00011; Accession=PF01535.11; Description=PPR repeat
  Pfam annotation: Domain name=PPR; Domain location=538-572; Score =19.7; E_value=0.01; Accession=PF01535.11; Description=PPR repeat
  Pfam annotation: Domain name=PPR; Domain location=573-607; Score =14.5; E_value=0.14; Accession=PF01535.11; Description=PPR repeat
  Pfam module annotation: Pfam domain module=PPR::PPR::PPR::PPR::PPR::PP R::PPR; Domain location=361-395::396-430::431-465::466-500::503 -537::538-572::573-607
  Subcellular localization annotation: CTP_CleavageSite=67; ConfidenceScore=5.73e-01
MSWRTLASTSRHTFKRLNAILRSPSTTIPSSRASSSLFLHVPFSTTTLHSLPQPTNALIDPKLLAPQNDAVNNNDDETTNEFLSRFVWIMRKKVKEAYPDSDKPTVDGMLVAIVEMVVSEMEKGSIGTTSSLFCSADFSEDLWRTVWEVSSLVLEDMNKEIKKEKMKSFLQCEEVKEMCRFAGEVGIRGDLLRELRFKWAREKMEEHEFYEGLERLREEARSEGNGIGVITEKKEKVKEKVVVGLPKRRGNIRYKIYGLDLSDSKWAQVADRIHEAEQVFWPQEPKPITGKAKIVIAKILSSKEEDDDGLQSLLAEWVELVQPSRVEWMDLLDKLKEQNHGLYLKVAEMVLAEDSFQTNVSDYSRLIDIYAKENRFDDVERMLKKLNENGLQVDASIASTLVLMYCKGGNLARATEAFGVLTSLGFQPDAHVYNSMIMTFVNNGQPKLGEKLMRDMDDRLITITKDIYMALLRSYSQLGDVASAERISTTMQFAGIQQSTDKETCTLLVEAYALASNPDQARSHFDCMIKSGHQPDDRCTASMILAYEKKNDLDNALNLLLELEKDGFEPGVATYSVLVDWLGKLQLVDEAEQLLGKIALLGEAPPFKLQVSLCDMYARAGNEKKALQSLGVLEARKDELGQAEFERIISGLIDGGFQKDAQRICQIMEAQGFDASRVKFKLSKPVSRAPSLR

SEQ ID NO: 210453 - protein, 105 aa, Glycine max
  Coding DNA Sequence Number=SeqID_93675
MRKCDGVGRRVGWLNEKFKESEEMMGRGGIGSLRKELEEKVLEKREKVTPIFHSIFTLTSLTLQSRPIRHIEGPVVPSSPSRSPPSPARRRKLSPSLGHRALFPV

SEQ ID NO: 210454 - protein, 258 aa, Glycine max
  Coding DNA Sequence Number=SeqID_93676
  Gene Ontology: Mol. function=protein binding
  Homolog annotation: Hit_ID=Q9ZVQ6; Match level="QueryCoverage=97%, HitCoverage=76%, E-value=2e-24, Identity=32%"; Hit description =Putative phloem-specific lectin
  Pfam annotation: Domain name=F-box; Domain location=1-47; Score=22.3; E_value=0.0018; Accession=PF00646.23; Description=F-box domain
MELQDLPEGCIAKILSYTTPVDACRLSVSIAFRSAAESDTVWDCFLLSDFTSFIPPSSTSKNDLYFTLSDLPTIMDQGRKEKNQEKHYWFRSVQLAKGPGRSVTCFPLEIWPLYGVILFDIGSGQACQSPIVMVDDHHLKPSIELLIFANVFNFVPRAIDSYVARFQEVAMLRAVCWFDISGSINTLTLSSNTHYSASLVFKMINPSGFHYHPTVLSVGIFGGNSNTKYVCLDPNLKDNHRFQELQCPKVRSDGWLEI

SEQ ID NO: 210455 - protein, 324 aa, Glycine max
  Coding DNA Sequence Number=SeqID_93677
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q8H1Y2; Match level="QueryCoverage=85%, HitCoverage=86%, E-value=1e-105, Identity=74%"; Hit description=20S proteasome alpha 6 subunit
  Pfam annotation: Domain name=Proteasome; Domain location=29-254; Score=176.9; E_value=5.2e-50; Accession=PF00227.16; Description =Proteasome A-type and B-type
MFRNQYDTDVTTWSPAGRLFQVEYAMEAVKQGSAAIGLRSKTHVVLACVNKANSELSSHQKKIFKVDNHIGVAIAGLTADGRVLSRYMRSECINYNYTYESPLPVGRLVVQLADKAQVLKDFRHDNVKYCGWEDFKILDEGYNRGCGLILKTFWRATGLHTAVLETSLWVGLLVAGLDESGAHLYYNCPSGNYFEYQAFAIGSRSQAAKTYLERRFENFVGSSREDLIKDALIATRESLQGEKLRSSVCTIAVVGVGEPFHILDPETVQQLIDTFEIVREEEAAPAEEEAQPAAEQDAPTDQGAAAADQGAAAAVDQGGSPMDI

SEQ ID NO: 210456 - protein, 159 aa, Glycine max
  Coding DNA Sequence Number=SeqID_93678
MGVIVQEKEKVENGLVFMVVLLPWAFKGGIGEAATVGEGVATTMVWSWWKSWLGTGGGGLGGFGEAAATTSCFTLKKILCVISVKTKITHDTTHSMPMWPINDHLPPSLMVVVVVATMTTTVMTTMVMKIDDDGDNDENHGDNCNSGNDDDKDRGGDGR

SEQ ID NO: 210457 - protein, 465 aa, Glycine max
  Coding DNA Sequence Number=SeqID_93679
  Gene Ontology: Mol. function=protein binding; Cellular component =plasma membrane; Biological process=regulation of transcription
  Homolog annotation: Hit_ID=Q9M3H9; Match level="QueryCoverage=99%, HitCoverage=100%, E-value=1e-132, Identity=55%"; Hit description =Tubby-like protein
  Pfam annotation: Domain name=F-box; Domain location=62-117; Score =38.5; E_value=2.2e-08; Accession=PF00646.23; Description=F-box domain
  Pfam annotation: Domain name=Tub; Domain location=133-465; Score =462.0; E_value=7.4e-136; Accession=PF01167.8; Description=Tub family
  Pfam module annotation: Pfam domain module=F-box::Tub; Domain location=62-117::133-465
MPFRSIVRELKEIGEGISNMYRRGGEAKHVHRHGKSHIAPECSLPPPPSSSSSSSSSSSWQSRWANLPPELLLDIIQRLEASETSWPARRALVACASVCKLWREITKDVVKTPEQCGFITFPISLKQVWKDMPGPRDSPIQCFIRRERMTSTYCLYLGLSPAIVLANDNSWIFAINVTAATVMKIALSGDMSKLLLAAKKIRRATCTEFIISLVSDDFSWASNTYVGKLRSNFLGTKFTILDGEPAHETSLPLNCKLQQRVHLKQVLPNKVAAAANYKVATVSYELNVLRTRGPRRMRCMMHLIPIFAIQEGGNAPTPLKFTTNYLNDHASTTTEHASTTTPDSKGKKPEVVEFDSTGTANTPESIQRAREPLVLKNKAPRWHEQLQCWCLNFKGRVTVASVKNFQLVAAAEPCQNVSAAEQEKVILQFGKIGKDIFTMDYRYPLSAFQAFAICLSSFDTKPACE

SEQ ID NO: 210458 - protein, 69 aa, Glycine max
  Coding DNA Sequence Number=SeqID_93680
MAQAMAGGSANGRTKEDNNGSKDLRKELVTMKCRRQVPAPLLHSIFRALRNGSSEIAFWDKVLLILFYL

SEQ ID NO: 210459 - protein, 42 aa, Glycine max
  Coding DNA Sequence Number=SeqID_93681
MKRREKGSVGMRYSSNMVRGIKGRDHTLNMPPSHYSTPHQYG

SEQ ID NO: 210460 - protein, 247 aa, Glycine max
  Coding DNA Sequence Number=SeqID_93682
  Homolog annotation: Hit_ID=Q9LW21; Match level="QueryCoverage=47%, HitCoverage=15%, E-value=4e-28, Identity=53%"; Hit description =Arabidopsis thaliana genomic DNA, chromosome 3, P1 clone: MDJ14
MGGSGTMKTQVLVVGRGPILILTFLRQKVTLESTGSTSPQLKQRSTGLNSGDKGIPSMQKNHDISCDGEVMHTDATNVVNKTKSTNQGNGKGSSLLNLINKEDSSKQSLKTKMLGVPSSVKLDYECITEKCERNERKECWDKTCDESGKPLNSCSKVKDNSSSGGPLRYALHLRFICPFPKKTNRSTQKSKNNSLQENSGLDMEGERRFYLCNDLRVVFPQRHSDADEGKLNVEYHFPEDPRYFDIN

SEQ ID NO: 210461 - protein, 102 aa, Glycine max
  Coding DNA Sequence Number=SeqID_93683
  Gene Ontology: Mol. function=jasmonate O-methyltransferase activity; Cellular component=nucleus; Biological process=fatty acid biosynthetic process
  Homolog annotation: Hit_ID=Q9SBK6; Match level="QueryCoverage=98%, HitCoverage=26%, E-value=3e-15, Identity=42%"; Hit description =Jasmonate O-methyltransferase
  Pfam annotation: Domain name=Methyltransf_7; Domain location=2-101; Score=-207.1; E_value=0.014; Accession=PF03492.6; Description=SAM dependent carboxyl methyltransferase
MEMKMEIQKEGSFIVTEHEAYEIDWDAGMELQSDSPTTGTPLTSGERVARSIRAVVESMLESHFGCHIMDELFRRYAQMVEDHLSKTRTKYINLVISLVKQG

SEQ ID NO: 210462 - protein, 524 aa, Glycine max
  Coding DNA Sequence Number=SeqID_93684
  Gene Ontology: Mol. function=glucose-1-phosphate adenylyltransferase activity; Cellular component=chloroplast; Biological process =glycogen biosynthetic process
  Homolog annotation: Hit_ID=Q9AT07; Match level="QueryCoverage=95%, HitCoverage=97%, E-value=0.0, Identity=69%"; Hit description=ADP -glucose pyrophosphorylase large subunit CagpL2
  Pfam annotation: Domain name=Hexapep; Domain location=419-436; Score =0.2; E_value=1.3e+02; Accession=PF00132.14; Description=Bacterial transferase hexapeptide (three rep
  Pfam annotation: Domain name=Hexapep; Domain location=472-489; Score =16.5; E_value=0.095; Accession=PF00132.14; Description=Bacterial transferase hexapeptide (three rep
  Pfam annotation: Domain name=NTP_transferase; Domain location=92-371; Score=380.1; E_value=3.5e-111; Accession=PF00483.13; Description =Nucleotidyl transferase
  Pfam module annotation: Pfam domain module=Hexapep::Hexapep::NTP _transferase; Domain location=419-436::472-489::92-371
  Subcellular localization annotation: CTP_CleavageSite=44; ConfidenceScore=5.74e-01
MDATFATLNASANLVTKGIGSRNRTSSGFWGENTRGSFNMRFCSVQSRKSLKATTFKPGFAQAVYSPDVNKEPLVFHGPIFQNPKANPENVAAIILGGGAGTRLFPLTSTRAKQAVPIAGCYRLIDIPMSNCINSGIRKVYVLTQFNSFSLNGHLSRTYNFGNGVNFGGGFVEVLAATKTPGESGNKWFQGTADAVRRFIWVFEDAKNKDIENILIISGDHLCRMDYMKLLEKHIGTNADITVSCVPMDESRASDYELMKIDRKGQITQFVEKPEGSDLQAMHVDTTLLGLTAEEAQTYPYIAPMGVSVFRTETLLKLLRWSCPSCNDFGSEIIPSALRDHKVQAYMFRDYWKDIGTIKSFFEANLELTKQSPNFEFYDQETPFFTSPRFLPPTKAIKCKIMDAIISHGCFLSESRVQHSIVGVRSRLESGSELQDTMMMGADYYQTDSEIATLLEEGKVPIGVGENTRIRNCIIDKNARIGRNVIIANTDGVQEADRPAEGFYIRSGIVVVVKNATIEDGTVI

SEQ ID NO: 210463 - protein, 299 aa, Glycine max
  Coding DNA Sequence Number=SeqID_93685
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9FJZ3; Match level="QueryCoverage=84%, HitCoverage=59%, E-value=1e-108, Identity=69%"; Hit description =Mannan endo-1,4-beta-mannosidase
MKLGFFVVFLVLYMILERGILLLPQVEADDHDDGFVKVRGVQLMLNGSPYYANGYNAYWLMYMASDPSQRNKVSSVFQKGTNHGLNIARTWAFSDGGYKPLQYSPGFYNEDLFLGLDFVISEARRYGTKLVLSLVNNYDNFGGKKQYVDWARSEGQTIDSEDDFFTNPIVKGYYKNHVKSVLTRRNNFTGIVYKDDPTIMAWELMNEIRCPSDQSGNTVQAWITEMASYLKSIDGNHLLEAGLEGFYGLSKQESNPSFHVGTDFITNNQIPGIDFATVHSYPDQWCGFFLLFFIKTSQG

SEQ ID NO: 210464 - protein, 76 aa, Glycine max
  Coding DNA Sequence Number=SeqID_93686
MTPSQKSIKINKLDEGAGERRQRKPGSWFCEVVSWLCVAMLWLFVAALSHWCRHGGFMICGDFGTSSHHRRLFHSL

SEQ ID NO: 210465 - protein, 142 aa, Glycine max
  Coding DNA Sequence Number=SeqID_93687
MEEKKKKQLEEAAKSESTNTVIDPPSPIRRHVKWKMARTKKIGQMTSEAVKEIADKIDSLEEHTSQGSFVAYGRQDVLTAAIGTKEGFVDPSGNDPDMGDSKKCGLSMAVEWRRRKGDWRRHFMEKMSQEQVHHHRKLWIRA

SEQ ID NO: 210466 - protein, 257 aa, Glycine max
  Coding DNA Sequence Number=SeqID_93688
  Gene Ontology: Mol. function=jasmonate O-methyltransferase activity; Cellular component=nucleus; Biological process=fatty acid biosynthetic process
  Homolog annotation: Hit_ID=Q9AR07; Match level="QueryCoverage=97%, HitCoverage=67%, E-value=9e-61, Identity=50%"; Hit description =Jasmonate O-methyltransferase
  Pfam annotation: Domain name=Methyltransf_7; Domain location=36-257; Score=213.2; E_value=5.8e-61; Accession=PF03492.6; Description=SAM dependent carboxyl methyltransferase
METLEVLHMNKGAGQTSYAMNSSVQNTIISCAEPARKKALVQILCSSNWPEKMGIADLGCSSGPNALRVISEILDGVYATTCLLNRPAPELVVYLNDLFTNDFNNIFGSLPSFYRKQKQEKGSGFGSYFVSAVPGSFYGRLFPSKSLHFAHSSSSLHWLSRVPSGLENGSGRALNKRKIYLSKSSPKCVLDAYSQQFKNDFSVFLASRSQEMVAGGRMVLSLMGRESMDPTTDHSCYQWELLARSLMSMVSEVRTRK

SEQ ID NO: 210467 - protein, 186 aa, Glycine max
  Coding DNA Sequence Number=SeqID_93689
  Gene Ontology: Mol. function=zinc ion binding; Cellular component =proton-transporting two-sector ATPase complex; Biological process =ATP synthesis coupled proton transport
  Homolog annotation: Hit_ID=Q1SLD9; Match level="QueryCoverage=80%, HitCoverage=43%, E-value=1e-27, Identity=48%"; Hit description=Zinc finger, RING-type; RINGv
  Subcellular localization annotation: CTP_CleavageSite=50; ConfidenceScore=5.13e-01
MSSQTAASMEAPESHAPLLRPLTDASRAPVPTLALLLGRAGRRGPSMLVRETAARELEERRADWGYSKPVVALDMSWNMAFVVVTAVMLACTTAERPNTPIRVWIVGYALQCLVHVLLVWLEYRRRSRRDSHHGQRARDVESDAGSGDEDYSDDRDWSSGYSSRSRYEIEMNREYSWSDERLRWSL

SEQ ID NO: 210468 - protein, 109 aa, Glycine max
  Coding DNA Sequence Number=SeqID_93690
  Gene Ontology: Mol. function=DNA binding; Biological process=DNA integration
  Homolog annotation: Hit_ID=Q1S1X7; Match level="QueryCoverage=66%, HitCoverage=5%, E-value=1e-10, Identity=44%"; Hit description =Integrase, catalytic region; Zinc finger, CCHC-type; Peptidase aspartic, catalytic
MGNNSPCKTIGIDSIQIKMHDGIVRTLTNVCQVLKLKKNLVFVDAMDSKGFIYCVEGGVMQIKGKVPSLEGARYFLSVINDYLGMTQVWHRIMDKYTILLQALIFYPPG

SEQ ID NO: 210469 - protein, 116 aa, Glycine max
  Coding DNA Sequence Number=SeqID_93691
  Gene Ontology: Mol. function=metal ion binding; Biological process =metal ion transport
  Pfam annotation: Domain name=HMA; Domain location=3-70; Score=32.4; E_ value=1.5e-06; Accession=PF00403.16; Description=Heavy-metal -associated domain
ITVVSVELGRSRCRQKVMKLIASVEGITSIVLDPDKNTVTVVGEADPLRIVKNVRRFRKSATIVSFGPPKEEKKEEKEKEERKDADTHTPNLSQRCDVWPHWYVTVEDGYSHCSIM

SEQ ID NO: 210470 - protein, 609 aa, Glycine max
  Coding DNA Sequence Number=SeqID_93692
  Homolog annotation: Hit_ID=Q10CY9; Match level="QueryCoverage=20%, HitCoverage=17%, E-value=3e-18, Identity=33%"; Hit description =Expressed protein
MADACAGESNRENARKDSNSIFPLSTERKCEEIDTEHVALLLHAGGCKMRKRKVQVSDNSQPVREMLRWTDEMDNRVLNAMVEEARAGNRIDGSWTPQAYTKIVQTLRDSGLTDVTKNHVKNRQKTMKDRWREIHDLFNGLSGFAWSPVTKRFEAEDEVWDELIKAKPSAAKWRASQVRHYDLLEELYGSNHATEHMGCTPRQTHRTMDKENVTIDSKETLSSSKEKRGRDGKQKKRQKTSQPQSPEPVASEDIAHILDHSRYFSKQKQMTSYADDFLLRDLVHPKIMDFDYFVTSGLQFQELLSVQGLDAFVSLEDTYYPNLIKVFYANLTILDNGDLCSEVCKVKIRVKPRDWLAIANLKYEGQKFQLSKLPDNIGFHRGQALDAMVRPDLQGRNCKNTGSLTIEDRLLHYAFVHILMPRGSNYALVLMEDIFILWAIKQRIQINWPYLICQHMKKCKVNGMPLPYGLLITKIMEFHRIHLGAENESLPGWSNRFNQKSLKKLKVIQVDGVWQHSDQNMSMPMEHGEEDGDSESAEKPQGSQPQAPQVTPDSDMLNQFFSSIQGLQDGLNRLTDIVREEFQRVDKRFDDFDKRFEDLHNLYQQGPSQ

SEQ ID NO: 210471 - protein, 430 aa, Glycine max
  Coding DNA Sequence Number=SeqID_93693
  Pfam annotation: Domain name=RRM_1; Domain location=303-373; Score =23.0; E_value=0.0011; Accession=PF00076.12; Description=RNA recognition motif. (a.k.a. RRM, R
MAGTKKTGQMTSEAAKEIANRIDSLEKQASHKALSPMDHLGRVRAAGTSVMIKHYFGLASRGSHNSCSMAIEDLEQLTQKIKDQLEEPITQKVGPSATHVSTKGSCVDPLGKVPEIGDLDNFGLYVDDNPSRLITLGRVYEGSTTIHNILLGNDQMKVGVQEVRDANAHILVPIQEVAEAPAKLVHMPNLDVDLLYLMTLTIPQLFLKLLQVSWDASVFGMKRKNSVRGAILPPQTLSSKSQRIESVPMRESEWTTVRRGKGRQRERQRDGEDPRLNYASARTRFLHKYHTSSWREKRDITTYYFTRFPDHTTAKDLWTYFKKWGDVREIFIPNHRNQGGRRYGFARFKDVLDEHELARKLDNLIIDGLKLYVNLPKYGRRKMGSEQHVDKLKTKQEGHNTEGRNEHHKPTMFRTEHKTYAEVTANNNPM

SEQ ID NO: 210472 - protein, 435 aa, Glycine max
  Coding DNA Sequence Number=SeqID_93694
  Gene Ontology: Mol. function=transporter activity; Cellular component= intracellular; Biological process=transport
  Homolog annotation: Hit_ID=Q94FN1; Match level="QueryCoverage=95%, HitCoverage=66%, E-value=1e-178, Identity=73%"; Hit description =Phosphatidylinositol transfer-like protein III
  Pfam annotation: Domain name=CRAL_TRIO; Domain location=161-347; Score=127.2; E_value=4.4e-35; Accession=PF00650.10; Description =CRALTRIO domain
  Pfam annotation: Domain name=CRAL_TRIO_N; Domain location=80-144; Score=48.1; E_value=3e-11; Accession=PF03765.5; Description=CRALTRIO, N-terminus
  Pfam module annotation: Pfam domain module=CRAL_TRIO::CRAL_TRIO_N; Domain location=161-347::80-144
MSGPLDRFARPCFEGFSGHDERRERKSDFENSEDDRRTRIGSLKKKAINASSKFRHSLKKKSSRRKSANRSNSVSIEDVRDVKELQAVDAFRQALMLDNLLPPRHDDYHTLLRFLKARKFDIEKAKHMWANMIQWRKEYGTDTIMEDFEFGELNEVLQCYPHGYHGVDKEGRPIYIERLGKVDPNKLMQVTTMERYLRYHVQGFEKTFAVKFPACSIAAKRHIDSSTTILDVHGVGFKNLTKSARELIIRLQKIDGDYYPETLCRMFIINAGPGFKLLWNTVKSFLDPKTTSKINVLGNKFQNRLLEIIDASKLPEFLGGSCTCIDQGGCMRSDKGPWQDPNILKMVLSGEVQCSRQIVTVTNDEGTLIECDKACFPMPIRSSDTSTAESGSEVEDITSPKASGNYTNPRLTPVHEEVSDHDIGILMLQKERKDR

SEQ ID NO: 210473 - protein, 90 aa, Glycine max
  Coding DNA Sequence Number=SeqID_93695
  Subcellular localization annotation: CTP_CleavageSite=38; ConfidenceScore=5.38e-01
MLATGNRLLPSGNRLAESKTLSFLSLHSSSSTFKLLSMASYGVAFPFIFLLLHSTAIKPQEAKESVDEEDPRSTSSNGAQSCSIRASSSR

SEQ ID NO: 210474 - protein, 157 aa, Glycine max
  Coding DNA Sequence Number=SeqID_93696
ATSLQCGGMILCTMFNHCLCDDTSSSQFLHAWAKLIREPNTELTMVHFSHLGYTRTNPAFQDELLLKMMMMMMMQSQSEPLVVTLFTFGASDVVWLKQQCVPEIIVKLPKGYYGNGFVLACAEIIVKDLVAVNLRHGLEVVNEAKASLDDEEYIRSI

SEQ ID NO: 210475 - protein, 137 aa, Glycine max
  Coding DNA Sequence Number=SeqID_93697
MEQCRQGKSAKWIRNLGKRIGSEGWARGVPVPNPSAVGGTARALPRRERGRRVPVGGRIGNGPFGASSPGVEQSTQNWYGQGESDCLIKTKHCDLQITNKPCPPQKTNQSGIPFFFYYVWPKEATVRRLSLVLPAWC

SEQ ID NO: 210476 - protein, 94 aa, Glycine max
  Coding DNA Sequence Number=SeqID_93698
  Homolog annotation: Hit_ID=Q1RTB8; Match level="QueryCoverage=72%, HitCoverage=13%, E-value=9e-07, Identity=54%"; Hit description=Sugar transporter superfamily
  Subcellular localization annotation: CTP_CleavageSite=62; ConfidenceScore=5.20e-01
MVIDYMFKIQIQNLFQQLFFILPFCPTTALATLFRRISTQTRQRTPKSDAICTCIVGGKLINAEMKVEAVAKLITGDKRTKALRESGEAVECKI

SEQ ID NO: 210477 - protein, 86 aa, Glycine max
  Coding DNA Sequence Number=SeqID_93699
VDCEGCQVMAEDLGAIAEDLERVINLRMVTEGTDLYDIMTRCLRRARGDAADGSCRNLPFGGRATRDSLDACSTKGIRAESPPTFI

SEQ ID NO: 210478 - protein, 59 aa, Glycine max
  Coding DNA Sequence Number=SeqID_93700
MVGVWSVSWMIVFRCLVILVLASLVSKSTLVLLSLVGNLPLDKMRVRVASELYGPNFCC

SEQ ID NO: 210479 - protein, 176 aa, Glycine max
  Coding DNA Sequence Number=SeqID_93701
  Homolog annotation: Hit_ID=Q84VH5; Match level="QueryCoverage=84%, HitCoverage=25%, E-value=1e-60, Identity=70%"; Hit description =Envelope-like protein
  Subcellular localization annotation: CTP_CleavageSite=37; ConfidenceScore=5.16e-01
HWPKKGKLSAGKLSVKYAILHRIGTANWVPTNHTSTVATESFAVKLPIAFPTVLCGIMLSQHPNILNTIDSVKKRESPLSLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 210480 - protein, 425 aa, Glycine max
  Coding DNA Sequence Number=SeqID_93702
MASRKRARTDDIPSSSNPAPPTAAMEPDELVHNRPIISMKHFLEKVAWPEAQLPLERSHEVVPPEPAPARIEPIPAEPQPPVVDPPPSPELEILSPPPTPPRIIISEESFDEAAAPLDSPSCNIDDASAKRNTHWLSARKNLEEDELYKFAERTASSYYVHRFSPSAERERHALSRNSLMCAKRPELEEEVVLRALDEFMSGCEILEKAKILCWIFRVGSFNSGNWSDSDDLDRTGLSCCTITRNWGLWEFYGRITGALEAIFQQKEGGACRPAHPVVKLYGLRNDACFSFRNVAKLYGLRNNACFEGPEGNKQGSKVDHKCPWMKLGYDTPNYMPPTMHMPNENANRAVPVIIEGGPPPAVEETEKLDLIEERLRAIKGFIDYPFADMTKFCLAPDVVIPPKFKRRETADAFLPRKLGRGGGHL

SEQ ID NO: 210481 - protein, 216 aa, Glycine max
  Coding DNA Sequence Number=SeqID_93703
  Gene Ontology: Mol. function=metal ion binding
  Homolog annotation: Hit_ID=Q5NAS8; Match level="QueryCoverage=94%, HitCoverage=48%, E-value=3e-43, Identity=53%"; Hit description =C3H2C3 RING-finger protein-like
  Pfam annotation: Domain name=zf-C3HC4; Domain location=87-145; Score =16.0; E_value=0.0035; Accession=PF00097.15; Description=Zinc finger, C3HC4 type (RING finger)
  Subcellular localization annotation: CTP_CleavageSite=47; ConfidenceScore=5.01e-01
MGLKSPDNSISEGRPSFVLSTCSNEMAAGSICGSSDGWSMRTFSELVASSQRERWSFDSECFGSGRHKISGSSSRFSYSPSMELQSCGACSKLLTERSTWSNQKFIANSDLSVVAVLVCGHSYHAECLEAMTSEADRYDPACPICMVGDKNLSKLLSRKGLRAESEMKAKNHKISRNRVVDSYLDGGFDCKELIWKAFLEETLFTWIKVEPIPVRE

SEQ ID NO: 210482 - protein, 181 aa, Glycine max
  Coding DNA Sequence Number=SeqID_93704
MKIMISIPLMNCDLSGGEHHQDSCYFYSINNFDQRKELAMYDYHEKERTPVLESILADFMTYQASSKDYQRESQWQPDHHNEAEGFLNLDDLLMQFRDLVESMQQAFRRTETQISKLVDNMTNVVARKEEERAEIEMHQESILQVTSIHHQLTNEEEKHEFSSTLEYPCLATIGYVGGKDK

SEQ ID NO: 210483 - protein, 440 aa, Glycine max
  Coding DNA Sequence Number=SeqID_93705
  Gene Ontology: Mol. function=nucleoside-triphosphatase activity; Cellular component=protein complex; Biological process=protein catabolic process
  Homolog annotation: Hit_ID=Q9SEI3; Match level="QueryCoverage=99%, HitCoverage=100%, E-value=0.0, Identity=84%"; Hit description=26S proteasome AAA-ATPase subunit RPT4a
  Pfam annotation: Domain name=AAA; Domain location=175-383; Score =294.0; E_value=2.8e-85; Accession=PF00004.19; Description=ATPase family associated with various cellular activities (AAA)
  Pfam annotation: Domain name=AAA_2; Domain location=171-324; Score= -43.5; E_value=0.019; Accession=PF07724.4; Description=ATPase family associated with various
  Pfam annotation: Domain name=AAA_5; Domain location=175-330; Score =4.5; E_value=0.00081; Accession=PF07728.4; Description=ATPase family associated with various
  Pfam annotation: Domain name=Sigma54_activat; Domain location=141 -271; Score=-179.9; E_value=0.015; Accession=PF00158.16; Description =Sigma-54 interaction domain
  Pfam module annotation: Pfam domain module=AAA::AAA_2::AAA_5::Sigma54_ activat; Domain location=175-383::171-324::175-330::141-271
MTDAAEDATRRRNAVAEYRKKLLQHKELESRVRSVRENLRASKKEFNKTEDDLKSLQSVGQIIGEVLRPLDNERLIVKASSGPRYVVGCRSKVDKEKLTAGTRVVLDMTTLTIMRALPREVDPVVYNMLHEDPGNISYSAVGGLSDQIRELRESIELPLMNPELFIRVGIKPPKGVLLYGPPGTGKTLLARAIASNIDANFLKVVSSAIIDKYIGESARLIREMFGYARDHQPCIIFMDEIDAIGGRRFSEGTSADREIQRTLMELLNQLDGFDQLGKKHLLPFLTNLKLVDGGPVCVKVKMIMATNRPDVLDPALLRPGRLDRKIEIPLPNEQSRMEILKIHAAGIAKHGEIDYEAVVKLAEGFNGADLRNVCTEAGMAAIRAERDYVIHEDFMKGLLLLVTHRHNNLTSFFGSQAVRKLNDAKKLESSAHYSADFGKD

SEQ ID NO: 210484 - protein, 397 aa, Glycine max
  Coding DNA Sequence Number=SeqID_93706
  Gene Ontology: Mol. function=transferase activity; Biological process= biosynthetic process
  Homolog annotation: Hit_ID=Q9LSB5; Match level="QueryCoverage=97%, HitCoverage=66%, E-value=4e-34, Identity=28%"; Hit description =Glycosyl transferases-like protein
  Pfam annotation: Domain name=Glycos_transf_1; Domain location=186 -369; Score=64.5; E_value=3.4e-16; Accession=PF00534.10; Description =Glycosyl transferases group 1
MKSKLVLMVSHELSLSGGPLLLMELAFLLRSAGSDVVWITNQKPPKPDDVIYTLENKMLDRGVQVVDARGEKAVDTARNADLVILNTAVAGKWLDAVLKEKVLEVLPKVLWWIHEMRGHYFKVEYVKHLPFVAGAMIDSHTTAEYWKNRTRERLGIKMPETYVVHLGNSKELMEVAEDSVAKRVLREHVRQSLGVRNDDLLFAIINSVSRGKGQDLFLRSFYESLMLIQEKKLQVPSLHAIVVGSDMNAQTKFETELRQFVMEKKIQDRVHFVNKTLAVAPYLASIDVLVQNSQARGECFGRITIEAMAFRLPVLGTAAGGTVEIVVNRTTGLLHPVGKEGVTPLAKNIVNLATHVERRLTMGKKGYERVKERFLEPHMAQRIALVLKEVLRKGSHN

SEQ ID NO: 210485 - protein, 336 aa, Glycine max
  Coding DNA Sequence Number=SeqID_93707
  Gene Ontology: Mol. function=catalytic activity; Biological process =cellular metabolic process
  Homolog annotation: Hit_ID=UPI0000383F0E; Match level="QueryCoverage =86%, HitCoverage=93%, E-value=7e-26, Identity=34%"; Hit description =COG0451: Nucleoside-diphosphate-sugar epimerases
  Pfam annotation: Domain name=Epimerase; Domain location=33-277; Score= -45.4; E_value=0.0034; Accession=PF01370.11; Description=NAD dependent epimerasedehydratase family
MEIALSLPLERCHVHVGTSFGSITPTLSEKRSMFILGMGFFGQSLARKLHNQGWVVSGTCTTHVKKKELQEMGFNVHLFDANHPDVDVLQVMKNYSHILVSVPPLVGIGDPMLRHEELLRSSLTDGDLRLSKTRFAPLQAMSTAALTYFSNAFRFKYDDRDTFCLAGVYGDCDGELVDEDYPTNPESGLAKLRLASEEGWSNLAHNLGISPLLFRLGGIYGPGRSAVDTIIKQKPMSEGQKRRKNRKYTSRIHVDDICQALMATVLAPPPREVYNIVDDDPAPREEVFEYAMKLVEKKWPGLKLQSVEQKQKEWPNAKNPRGEKRVCNARMKRELG

SEQ ID NO: 210486 - protein, 75 aa, Glycine max
  Coding DNA Sequence Number=SeqID_93708
MELCDIDVKMDDKDLALILLASLPPSYENFRASAKRNTHWLSARKKMSCTGSLSAPLHLTKRIASVHPLSEKGTR

SEQ ID NO: 210487 - protein, 309 aa, Glycine max
  Coding DNA Sequence Number=SeqID_93709
  Gene Ontology: Mol. function=nucleotide binding; Cellular component =intracellular; Biological process=small GTPase mediated signal transduction
  Homolog annotation: Hit_ID=Q9FJM0; Match level="QueryCoverage=98%, HitCoverage=53%, E-value=1e-134, Identity=79%"; Hit description=GTP binding protein-like
  Pfam annotation: Domain name=Dynamin_N; Domain location=71-190; Score= -18.4; E_value=0.0005; Accession=PF00350.13; Description=Dynamin family
  Pfam annotation: Domain name=GTP_EFTU; Domain location=66-250; Score=- 71.4; E_value=0.045; Accession=PF00009.17; Description=Elongation factor Tu GTP binding domain
  Pfam annotation: Domain name=MMR_HSR1; Domain location=69-191; Score =139.8; E_value=7.5e-39; Accession=PF01926.13; Description=GTPase of unknown function
  Pfam module annotation: Pfam domain module=Dynamin_N::GTP_EFTU::MMR _HSR1; Domain location=71-190::66-250::69-191
MEYQLPRLTKMWTHLERQAGGKVKGMGEKQIEVDKRILRNQIGILKKELESVRKHRKQYRNRRFSVPVAVVSLVGYTNAGKSTLLNQLTGADVLAEDKLFATLDPTTRRVQMKNGKEFLLTDTVGFIQKLPTTLVAAFRATLEEISESSLLVHVVDISHPLAEQQINAVDKVLSELDVSSIPKLIVWNKDQVDKRAIIATPILKVDKVGDPQKLRLEAEKRDDVVCISALSGNGLQEFCNAVQDKLKDSMVWVEALVPFENGDLLSTIHQVGMVEKTEYTEQGTYIKAHVPLRFARMLTPMRQLCVSQP

SEQ ID NO: 210488 - protein, 611 aa, Glycine max
  Coding DNA Sequence Number=SeqID_93710
  Gene Ontology: Mol. function=sequence-specific DNA binding; Cellular component=nucleus; Biological process=regulation of transcription, DNA-dependent
  Homolog annotation: Hit_ID=Q8LLD8; Match level="QueryCoverage=76%, HitCoverage=68%, E-value=9e-92, Identity=44%"; Hit description=BEL1 -related homeotic protein 30
  Pfam annotation: Domain name=Homeobox; Domain location=382-440; Score= 7.3; E_value=0.00086; Accession=PF00046.19; Description=Homeobox domain
  Pfam annotation: Domain name=POX; Domain location=196-340; Score =223.7; E_value=4e-64; Accession=PF07526.2; Description=Associated with HOX
  Pfam module annotation: Pfam domain module=Homeobox::POX; Domain location=382-440::196-340
MYPNQAFSSGSYADMLSGNPLLPHNYGETVGGQNELKFITSMRDTMIMQPIDGHPNAAATTGNPDSFENAGDSHSHVIPRTTQLGLVDNEQNVQNQGLSLSLGSVMPSIASVPTFPYQYPGTSFSSLMSACVPNLKGTSSLKDDEASLQRELRNAECMASLASSGGFHKRDGLYNPQHPSMCLGEGQSHGSQGFSNNMLNSQYLKAAQELLDEIVNVRKQTSLEKQPSFRDVGLDGSKDSDGKSTTQSVQISSGPNGSSAANSSCELSPTERQNFLDKKTKLLSMLDEVDKRYRQYCHQMQIVVSSFDMVSGCGAAEPYTALALRTISRHFRCLHDAISGQIQVTQRNLGEQEGIPRLRYVDQQLRQQKALQQLGVMRQAWRPQRGLPETSVSILRAWLFEHFLHPYPKDSEKIMLARQTGLTKNQVANWFINARVRLWKPMVEEMYKEEFDVQASDNKREESQDNLITVDDSVQHHGLKLDHADRGIQSSDHGENAMDPRIGKLQGDQRFNMNNNNSPYYGDGCIMASTPATYDLSELGNIAVGGHVSLALELRNCESEGFGVSNDDMHKRRKKTLASSPEADLLDYHFTDTGKQQNKFGNPHLLHEFVV

SEQ ID NO: 210489 - protein, 112 aa, Glycine max
  Coding DNA Sequence Number=SeqID_93711
EVSQPILLRASEARLTVASSKGGKCTESSPTFIYGKRRKNRRKPVMKNIPDSGVVFTFEEDWKTYPLKNEERMKNGEERRRTMKNFHIIAYGGITETLRLDFAAQRLNEEDF

SEQ ID NO: 210490 - protein, 70 aa, Glycine max
  Coding DNA Sequence Number=SeqID_93712
MVQEENKWGGGKREGEWSVWMVHNWKRKRLELPGAFKRVRGIFVRSGLYEVQEARAVELGKSVCIQLDQI

SEQ ID NO: 210491 - protein, 343 aa, Glycine max
  Coding DNA Sequence Number=SeqID_93713
  Gene Ontology: Mol. function=oxidoreductase activity; Cellular component=vacuole; Biological process=hydrogen peroxide catabolic process
  Homolog annotation: Hit_ID=Q96512; Match level="QueryCoverage=97%, HitCoverage=97%, E-value=1e-140, Identity=72%"; Hit description =Peroxidase 9 precursor
  Pfam annotation: Domain name=peroxidase; Domain location=58-307; Score=470.7; E_value=1.8e-138; Accession=PF00141.13; Description =Peroxidase
MHFIKVTLLAMIAFFLSVKLSLAHPGFHFGWGDHHRGISFGLSPQFYQFSCPQANDIVMSVLEKAIAKDMRIAASLLRLHFHDCFVQGCDASILLEDSARIVSEKNSGPNKNSVRGFEVIDKIKSKLEEACPQTVSCADILALAARGSTVLSGGPNWELPLGRRDSKTASLSDSNKNIPPPNATIENLVTFFKRQGLDEVDLVALSGAHTIGVARCVTFKQRLYNQKGNNQPDENLEKSFYFDLKTMCPKSGGDNFISPLDFGSPRMFDNTYFKLILRGKGLLNSDEVLLMGNVKETRELVKKYAQDESLFFEQFAMSMIKMGNLRPLTGFNGEVRKNCRRVN

SEQ ID NO: 210492 - protein, 406 aa, Glycine max
  Coding DNA Sequence Number=SeqID_93714
MAKQKICALSHQTSEKDNTRAKRIWHQGKGRALLLGHRLSMIPGDFNPWKPGTDIHDVPPEGGCFWRKQPISPGRAGKFKLRRFRNVFVGDFAKIFNRSSSFVLRRSSIFNRRTREPRLARPQKELKRFNLHKCLTNLQEGSIDVAVVKELYANLYSSEDQSPKQVRVRGHLIRIDADSLNSFLETPIVLEEGETLPTYSRFSRMRIDPQEFAAHLCIPGRGFVLNAGGHPWKLLRKDLTTLAQTWSVLSYSNPTPTSHTSDLNMDRAINFRRVRKVRARPANAPSFSAPPAPPTSATPTPAAHDSQRFEAMLQRSILSVEQFIEKVSWPGTVPSAMREGAGVEMRLFFLSQLCQIYMRLLKQVADPPTPVHERPDDPSTLILEIPKDLTTPVLTLNTTPPATLEL

SEQ ID NO: 210493 - protein, 152 aa, Glycine max
  Coding DNA Sequence Number=SeqID_93715
MSSLSISLEPQSQLTINLALKRKQKQKKRKRREKEKRRKFPIKRIERKRKEKIPNQKSGRKQKERKFPIKHRKKKKCAEKSLDQTTSEQIQNCHQLSQHALLRACEARVTGALSKGGKMRGVATNVYLWKTSEKPKETGQNENSKFGSCIYI

SEQ ID NO: 210494 - protein, 278 aa, Glycine max
  Coding DNA Sequence Number=SeqID_93716
  Homolog annotation: Hit_ID=Q47522; Match level="QueryCoverage=22%, HitCoverage=83%, E-value=1e-21, Identity=75%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSMVNMIAQTEGLERGSDKGSGGLEEPAIPFGSGKQSWLCVRGGVVCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 210495 - protein, 110 aa, Glycine max
  Coding DNA Sequence Number=SeqID_93717
  Subcellular localization annotation: CTP_CleavageSite=86; ConfidenceScore=5.09e-01
GSHPQDTQWTRKSPTGPWGFQLWLRASINPTGCPYPPGKGSHLQDTQWTRRSPTGSWSCQALITGLCQFYRVPVTSSKGIRPPTDRAFIKKYCVPRQAQGETLQQPGDGR

SEQ ID NO: 210496 - protein, 125 aa, Glycine max
  Coding DNA Sequence Number=SeqID_93718
GREEIEHSAQKEAKLGLLLVLRSSMNPVPALPFRLSHSLVVPIKGLNKKTLVLKAKYHMKEKSQHETRKTLGDKEKKMTLSSVDMAEAHALTLRKATPDVPPQLVGIKGEQISQCFGRLGGKASS

SEQ ID NO: 210497 - protein, 157 aa, Glycine max
  Coding DNA Sequence Number=SeqID_93719
MTKTSSVKLAEAEDDVYQCRSDLKESENCSFLTTTSKAKLETLSTEETQLQYNYDLVQISDNVEFPSSLVIPRFDRYLSFKITERNNVRDSERVKRTLDHNLAAIYGKKLFSKRKRDAVKFQQLSDLMRTLMYSMKITPKYVWDSCVLAYICYEMDQ

SEQ ID NO: 210498 - protein, 169 aa, Glycine max
  Coding DNA Sequence Number=SeqID_93720
  Gene Ontology: Mol. function=metal ion binding; Cellular component =integral to membrane; Biological process=defense response
  Homolog annotation: Hit_ID=Q9XF92; Match level="QueryCoverage=97%, HitCoverage=98%, E-value=1e-44, Identity=52%"; Hit description=BRH1 RING finger protein
  Pfam annotation: Domain name=PHD; Domain location=92-138; Score=4.1; E_value=0.022; Accession=PF00628.19; Description=PHD-finger
  Pfam annotation: Domain name=zf-C3HC4; Domain location=93-135; Score =31.9; E_value=2.2e-06; Accession=PF00097.15; Description=Zinc finger, C3HC4 type (RING finger)
  Pfam module annotation: Pfam domain module=PHD::zf-C3HC4; Domain location=92-138::93-135
MGFPVGYVEVFFPNPFLHTLALLGLLRNLVFFLFHLLGLSDFFETEVAWPDPRPSDTAEARPPSVSALLIRDLLPVAKFGDSDIAARQNGCACAVCLFEFSEEEEIRCMRNCKHIFHRTCVDRWIDHDQKTCPLCRTPFVPDDMLDDYNQRLWAATGVNEFYTDYTSSF

SEQ ID NO: 210499 - protein, 237 aa, Glycine max
  Coding DNA Sequence Number=SeqID_93721
  Gene Ontology: Mol. function=NADPH dehydrogenase activity; Cellular component=peroxisome; Biological process=electron transport
  Homolog annotation: Hit_ID=Q398P6; Match level="QueryCoverage=98%, HitCoverage=66%, E-value=2e-91, Identity=75%"; Hit description=NADH -flavin oxidoreductase/NADH oxidase
  Pfam annotation: Domain name=Oxidored_FMN; Domain location=4-237; Score=76.8; E_value=6.8e-20; Accession=PF00724.10; Description =NADH:flavin oxidoreductase  NADH oxid
  Subcellular localization annotation: CTP_CleavageSite=29; ConfidenceScore=5.20e-01
MSAMLFTSHRLGPLTLPNRIVMPPMTRSRAAAGNVATAEMATYYAQRAGAGLIVSEGTQISPQGQGYAWTPGIHSPEQVKGWRKVTDAVHAAGGRIFAQLWHVGRISDPVFLNGELPVAPSAIAAGGHVSLVRPKRGYVVPRALETDEIPGIVEAYRRGAQLAHEAGFDGVEVHGANGYLLDQFLQDSTNQRTDGYGGSLECPRPPDAGRGGCLRQRLGRRPGRPAPVAAWRCAYDG

SEQ ID NO: 210500 - protein, 266 aa, Glycine max
  Coding DNA Sequence Number=SeqID_93722
  Gene Ontology: Mol. function=peptidase activity
  Homolog annotation: Hit_ID=Q4KE43; Match level="QueryCoverage=90%, HitCoverage=86%, E-value=2e-61, Identity=51%"; Hit description=LasA
MARHEGSSTHGVDLLQAGFDLYRAMRHAVIAGAHHVFPVLQLQPAHDEVTARHVLVVVGEHGIERCTCSGTDNRHRLRGEFLGDHHAETRRHFLHHLRQQLAGLLRCHAQGQVAAGHHAPGQFGRQVAHHVGGEAAGQVVAGLAGVIARRVATQREHLQAGLAGAEFGQVKALAAGHVGHRAHHDGGRHRQLDEQGRKAECPADRAGGGRRQFVPAGGGPLARGVVHAPQRGLRRFGQRRLHRIVDAVGDRTGQRLHRELQRRANQ

SEQ ID NO: 210501 - protein, 127 aa, Glycine max
  Coding DNA Sequence Number=SeqID_93723
MAIYRKSHLVQGKLAQASFLLRAEGISLPRRVAYLGLKLFLGLGELDASLGEFRNVITIQFSNLGVILLQNIQQPQMSMLRVVVALAPIPPQPSIHASLKPPPQTLTLIPPPTPSSPPPSQPLPSQD

SEQ ID NO: 210502 - protein, 258 aa, Glycine max
  Coding DNA Sequence Number=SeqID_93724
  Gene Ontology: Mol. function=nucleic acid binding
GLVPCIQEMVGDSEHRFCVRHLYANLKKKFGGGTQIRDLIMGAAKATYFSAWEDKMNQLKKINEDAYRWLTRDELPKNIWCRHAFKYHSKCNVLINNLTKSLNNTLLPARDKPILILEEWIRIYLLRRYFTLREKVKKQEGSIMPKPMKSLTREVEYSCQRFASWSHAGIFEVIHTLFTEKFIVNLANHSCTCNFWDLLGIVEAMPSKVILMMPKNSRIKRKIQEKFQVSSFQESRIKNNQEQDSRIKRRLNQDKYEK

SEQ ID NO: 210503 - protein, 286 aa, Glycine max
  Coding DNA Sequence Number=SeqID_93725
  Gene Ontology: Mol. function=alkanal monooxygenase (FMN-linked) activity
  Homolog annotation: Hit_ID=Q08VH3; Match level="QueryCoverage=86%, HitCoverage=93%, E-value=7e-84, Identity=66%"; Hit description =Flavin dependant oxidoreductase
IGGEHQFVGLVPFDEGGDALGHLLRITQHGAGQCPLHTQLFMRRRDSASLSLATTFRASIACGCFNVAEGRNSRRYTASASSITSGAKCEANAYGRPIEAAMRAPNRLEPRIQLAHILRELVGAVEVTAQCTRGRLIGARRAAQAQVDPVRIQRGQRAELLGHLQRGMVGQHDAAGTDPDAPGTAGDMADHHGGGRTGDAGHVVVFGQPVTAVAQRIGVLGQFQHVGKGGGGVTALADRGQVKDRQQDHHAFFRHRIPHAWGPPGATAIASGGMLIPAARVHDWLR

SEQ ID NO: 210504 - protein, 423 aa, Glycine max
  Coding DNA Sequence Number=SeqID_93726
  Gene Ontology: Mol. function=glutamate synthase activity; Biological process=glutamate biosynthetic process
  Homolog annotation: Hit_ID=Q36JQ6; Match level="QueryCoverage=62%, HitCoverage=51%, E-value=6e-90, Identity=64%"; Hit description =Putative glutamate synthase
  Pfam annotation: Domain name=Glu_synthase; Domain location=236-422; Score=-160.1; E_value=5.6e-06; Accession=PF01645.7; Description =Conserved region in glutamate synthase
RARRRRQQVEFPAVPTGAGRRSLHRRRSVLPAAQVRERGLPPGPDPHRTAGQQPRRRACGGAGAGDAGRAWPCAGGRTHPGAGRDLQGGLPGPAQQPRAGTGATAARCRRAGRYDAVVLAVAHARFKAMDESAIRGLLAPVNGAVDSGAVATEESHAPVYRLPARHPDVPDMPVAGHDLAGLVLGRRPDCRDGGAGDLGSAAEAQHAAPQLSGDGALPLRAGIDRPGDPPRALIYQRAKNEMDTVPFGTLRSTYAVDYEWINHSLAPTAIAKHDFRVLIGPNCAKPYSASVFNISAMSFGSLSANAIRALNEGARQGGFYHDTGEGSISPYHREMGGDLVWEIGSGYFGCRDEKGGFSEERFVANATHDQVKMIEIKLSQGAKPGHGGVLPAPKVTAEISVTRGVPMGVDCVSPSRHSAFSTP

SEQ ID NO: 210505 - protein, 179 aa, Glycine max
  Coding DNA Sequence Number=SeqID_93727
  Gene Ontology: Mol. function=chitin binding; Cellular component =extracellular region; Biological process=chitin metabolic process
  Homolog annotation: Hit_ID=UPI00006A17C9; Match level="QueryCoverage =47%, HitCoverage=100%, E-value=5e-11, Identity=34%"; Hit description= UPI00006A17C9 related cluster
LVTKAGNPRALLDSSGSTGPTDTLQGEIGVVVAGQNVANGAGEILPQYASWLHNSLPLVVLTQLALLRDQRGDQGTDKGKLLAPHMGAQAQMWSPLKVRTCNPLKARTCSPLKARACSSLKTRTCSPLKARMCSPLKARTCSPQKARTCSPLKRRVCSTLKARTCSPQKARTCSPLKAR

SEQ ID NO: 210506 - protein, 144 aa, Glycine max
  Coding DNA Sequence Number=SeqID_93728
MEKKISHCGKRRDEIFPSEVQKKSLRVCLDRFLNGPAIVAQWSTRRKPAREQWGRRREEQGFARRGRQRRAQHSEWLRVAEGEREQGSRRRRKGLNRRIASAKLRRKTMVSSWNWNRSQREAVTVLVLFEVFLKREVVSKHKIL

SEQ ID NO: 210507 - protein, 83 aa, Glycine max
  Coding DNA Sequence Number=SeqID_93729
MAHHCSNKALGCYLLFSIVVSIFSTFTCAHFDGFFPNEPIIFQDTNAYAPTLEVDVIEPTLKIEDDSQLAPPPVVGAIPPTFE

SEQ ID NO: 210508 - protein, 782 aa, Glycine max
  Coding DNA Sequence Number=SeqID_93730
  Gene Ontology: Mol. function=phosphoinositide binding; Cellular component=intracellular; Biological process=intracellular signaling cascade
  Homolog annotation: Hit_ID=Q2RAA5; Match level="QueryCoverage=96%, HitCoverage=75%, E-value=1e-80, Identity=42%"; Hit description=Phox domain-containing protein, putative, expressed
  Pfam annotation: Domain name=PX; Domain location=491-600; Score=93.6; E_value=5.8e-25; Accession=PF00787.14; Description=PX domain
  Pfam annotation: Domain name=PXA; Domain location=102-285; Score =25.4; E_value=1.7e-06; Accession=PF02194.6; Description=PXA domain
  Pfam module annotation: Pfam domain module=PX::PXA; Domain location =491-600::102-285
MPFFYNQNLDADISLSAFGVVLLSEFEFQLDTSKSMWMNLPMSILFVAALRILLNKVEFHWKVQPPRLQTYLSHLEKNQLPLNDERLSSSPPTPKWKKKIDSPVVEAALNDFIDLILKDFVINMWYADITPDMEFPELVRDLIMDAIAEVSARVKEINLVDLLTRDIVDLIGDHIDLFRRNQDAIGVDVMLTLSSEERDERLKFHLLNSKELHPALISPESEYKVLQRLMSGLLATVIRKREVQCPVIRSIAREIVTCLIVQPVMNLASPAYINELIESLLVFLNDECINWTGGGDHSTNTTIHNHGHSGAAGGGHDNHASSSDWAQMLEAATQRRTEVLMPENLENMWARGRNYRRKQHKKTKVGFQDPSVKNPATDAIPEGKSSLHYVSSDPLLTAGGTNRSESPPDHDKELSSEADPLDEVKDMKDFSCNKYKDPFKRSRSASLVGIQTYKGGSPRSEFHTAESEKHGEGFRGKSSSDMVVRREAHVVPKLRCRVLGAYFEKLGSTSFAVYSIAVTDGQEKTWFVRRRYRNFEQLHRHLKDIPNYVLHLPPKRIFSSSTEDAFVYQRCIQFDKYLQDLLSIANIAEQHEVWDFLSVSSKNYSFGKSSSMMRTLAVNVDDAVDDIVRQFKGVSDGFIQKVVGSSSPSTEGSSTSTSRNMSWNVDEMDKSISRQNTLECVLSSDNEEGDENIDKEVAEDNEWNSDNELSSKDYSQHLINHGSESSNLDLDRKHDATVEAKVGKDVPATNFNLVPDNLEDVPPELLILFGIKLLNVMLLPTW

SEQ ID NO: 210509 - protein, 230 aa, Glycine max
  Coding DNA Sequence Number=SeqID_93731
  Gene Ontology: Mol. function=monooxygenase activity; Cellular component=integral to membrane; Biological process=electron transport
  Homolog annotation: Hit_ID=Q1SKI2; Match level="QueryCoverage=99%, HitCoverage=44%, E-value=6e-63, Identity=56%"; Hit description =Arthropod hemocyanin/insect LSP; E-class P450, group I
MKTHDVVFASRPQSATFDILYYESTGIASAPYGNYWRVIRRMCTIELFTQKRVNYFQPIREEELSYLIIKIIDYSHKGSSSSPINVSQMVLSSIYSITSTVAFGKNYKDQEEFISLVKEEVEIAGRDLYCSARWLQLVTGLRAKLEKLHRQMDRVLENIIIEHKEAKSGAKEGQCEQKKEDLVDILLKFQDGSDKDICLTNGKFKGIIQDIFVGGGDTSAITIDWAMAEM

SEQ ID NO: 210510 - protein, 112 aa, Glycine max
  Coding DNA Sequence Number=SeqID_93732
MWTKLKEKGETIFSNAGWIHREPSQGIQGKEKSSPGLAVVAGQQHVQGELTKLREKVVMARKSLFSKGKEGSEEEQVVKKEAHKVMMAVQRDTHETMSEATVCLLMDRFVPC

SEQ ID NO: 210511 - protein, 438 aa, Glycine max
  Coding DNA Sequence Number=SeqID_93733
  Gene Ontology: Mol. function=DNA binding; Biological process =regulation of transcription, DNA-dependent
  Homolog annotation: Hit_ID=Q1SQW9; Match level="QueryCoverage=97%, HitCoverage=97%, E-value=1e-140, Identity=61%"; Hit description =Transcriptional factor B3; Cupredoxin
  Pfam annotation: Domain name=B3; Domain location=300-398; Score=70.0; E_value=7.7e-18; Accession=PF02362.12; Description=B3 DNA binding domain
  Pfam annotation: Domain name=B3; Domain location=9-99; Score=50.6; E _value=5.4e-12; Accession=PF02362.12; Description=B3 DNA binding domain
  Pfam module annotation: Pfam domain module=B3::B3; Domain location =300-398::9-99
MVPPWRNDVADFLPTTIDNLIPDNFLRKYGTQLSTIATLTVPDGSVWRIGLKKADNRILFVDGWQDFVQHYSIGVGYFLVFMYEGNSSFIVHIFNLSTSEVNYQSAIRNRNEGSCLANYHHIFDEMEDVDSLDLSDLSPQYLTPGSLQNKGCVGSVDQLTPGKSHTPALQNLFNGGSKLNRINWGDGGSAFSSKNANSQGNQSTRDIGVQFNANEFKRSTEELKLLFFVSGNLKDDVFLFITNSMCGTIDGEEPSGENEEEAEMRYRFYESASARKRTVTAEERERAINASKTFEPTNPFCRVVLRPSYLYRGCIMYLPSCFAEKNLNGVSGFIKLQLSNGRQWSVRCLYRGGRAKLSQGWFEFTVENNLGEGDVCVFELLRTKEVVLQVTVFRVTEDAGLLNQPPMMQQQHIPNMSHTKLLNPHLQHRVSTTKLIRN

SEQ ID NO: 210512 - protein, 130 aa, Glycine max
  Coding DNA Sequence Number=SeqID_93734
MDSKVEAAQKGVKKRSLTESGMNEHENCVGLDLELKLSLAGSSSGNLSNALKSTTSRTLLPSSSSSHKVYLPSLLGINGNHEPTPLIATGCPHCLYYVMISEADPKCPNCKSYNLIDMFQENPTKKMRTC

SEQ ID NO: 210513 - protein, 69 aa, Glycine max
  Coding DNA Sequence Number=SeqID_93735
MAEINQGKTMTGHDWSHIIWLLLAGSSGQTLTHKEGGDMVNVPLQKKNGRLVPLGELSSPGGATPAFKI

SEQ ID NO: 210514 - protein, 172 aa, Glycine max
  Coding DNA Sequence Number=SeqID_93736
  Gene Ontology: Mol. function=protein serine/threonine kinase activity; Cellular component=membrane; Biological process=protein amino acid phosphorylation
  Homolog annotation: Hit_ID=Q1STT5; Match level="QueryCoverage=93%, HitCoverage=19%, E-value=2e-28, Identity=37%"; Hit description =Protein kinase; S-locus glycoprotein; Curculin-like (Mannose -binding) lectin; Apple-like
  Pfam annotation: Domain name=PAN_2; Domain location=1-45; Score=39.0; E_value=1.6e-08; Accession=PF08276.2; Description=PAN-like domain
MDQTIGLEECKAKCLDNCSCMAYVNLDISGQGSVCAMWFDDLIDIRLFAAGGQDVYVQIDASELEYANEGHKKGGFLVAVTVSLVMAVVARILIILGSCFRKKSCCSVKERSDFNIKSNQNSGMRVDDMDLPVFDLSTIATTTSNFTVKNKIGEDGFGPAYKAHEFVEDKDG

SEQ ID NO: 210515 - protein, 203 aa, Glycine max
  Coding DNA Sequence Number=SeqID_93737
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=96%, HitCoverage=53%, E-value=2e-34, Identity=50%"; Hit description=E3 ubiquitin ligase PUB14
  Pfam annotation: Domain name=Arm; Domain location=111-151; Score =19.7; E_value=0.01; Accession=PF00514.13; Description=Armadillobeta -catenin-like repeat
TCPKTQQTLVHTALTPNYVLKSLIALWCESNGIELPKRQGNCRTKKCGGSSLSDCDRTAIGALLDKLTSNDIEQQRAAAGKKDAATALIKLLCEGTPTDEALAIMAILASHHEGRVAIGQAKPIHILVEAIRTGSPRNRENAAVVLWSLCIGDPLQLKLAKEHGAEAALQELSENGTDRAKRKAGSILELLQRMEGVDNLQSS

SEQ ID NO: 210516 - protein, 150 aa, Glycine max
  Coding DNA Sequence Number=SeqID_93738
  Homolog annotation: Hit_ID=Q1T493; Match level="QueryCoverage=60%, HitCoverage=17%, E-value=1e-13, Identity=42%"; Hit description =Nucleic acid-binding, OB-fold, subgroup
MKKRDRIHVIVKKEDLKNWEVELKEGKTYYMYNFRVVPNDGQYKVCAHPFKLFFTGGTTLRQVDLAEIPLKSFEFKSFEDIDNGNYDPNMLIENVFLCSSFSIYWTVPNNNNSLKASKLLINQLMLIIEEFKERLTELKIMIRPVLMFRG

SEQ ID NO: 210517 - protein, 169 aa, Glycine max
  Coding DNA Sequence Number=SeqID_93739
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=59%, HitCoverage=15%, E-value=2e-29, Identity=62%"; Hit description=E3 ubiquitin ligase PUB14
  Pfam annotation: Domain name=Arm; Domain location=15-55; Score=17.7; E_value=0.041; Accession=PF00514.13; Description=Armadillobeta -catenin-like repeat
MVDEALAIMAILASHHEGRVAIGQAKPIHILVEVIRTGSPRNRENVVAVLWSLCTGDPLQLKLAKEHGTEAALQELSENGTDRAKRKVGSILELLQRMEGVDNLQTHRWSEKLEDLWKLKIPLKPTTFAWQLIKDTIPTKGNLRKRQLEKGFAQPYNYWSSNLSTTFFD

SEQ ID NO: 210518 - protein, 154 aa, Glycine max
  Coding DNA Sequence Number=SeqID_93740
  Homolog annotation: Hit_ID=Q8M1F6; Match level="QueryCoverage=33%, HitCoverage=12%, E-value=4e-09, Identity=63%"; Hit description=NADH dehydrogenase subunit 7
ALQDPPTLMKTRVGRSSIHLTGGVDNEATFTTFSLLSLCCSKGIASGIGADSASAASCRTGVIQYVVPHVPPLLRSFPILIVKHHEQQDVEIARHNVLCDTGIDFFNFRKVNGKPPFPLLTILPNLLKNEWHFEVPHVGGSAWGTSTGSGLEPA

SEQ ID NO: 210519 - protein, 297 aa, Glycine max
  Coding DNA Sequence Number=SeqID_93741
  Gene Ontology: Mol. function=RNA-directed DNA polymerase activity; Biological process=RNA-dependent DNA replication
MKFPILTGEIVIVKTDQKQARKCYVESLKVTPYTPMKEPCKLYSPTRGSNSQVMSVVEEFPIKTLTIYETNRGSQDNTFDVDPWDDAINKGPKPIKELIKLQLGPKLGQCTQLSRDLTNCNYKNIVEPNQSHRRRETWENNYVGWLGKRSTRCSKPSLSGRLDTQPSWPTLSCIDQLVDGAFGFQLLSFLDAYSGYNQIRMNPLDEGKTIFITEDANFCNRIMPFGLKNHDLTLVELEEVFREIYKYNMWLNPEKCTFGVGGRKFMCFMITHLGLKPTLTTVPPEACRKGEAVLPAT

SEQ ID NO: 210520 - protein, 232 aa, Glycine max
  Coding DNA Sequence Number=SeqID_93742
MEVDLPIGWKPLNLEHYDETTDPQKHLDAFLTQANLYTNDDMILCRVDDESFCRFMDRFSQLIVQIRNVNPNVALHSMLLALQPGKFINSLCKKPPSNIDELRERAKGYIQMEETSMFWNKVQQVGQKREKGESSTRTDSHKSGKQHKKYKHQPLLRGPRLLGPQEQDRGTHTGQIPSPIRNKSPMTTKLEASLGGTMRTIVETEILIEGGDQTEETGRQRCHTQRHEHQPQ

SEQ ID NO: 210521 - protein, 99 aa, Glycine max
  Coding DNA Sequence Number=SeqID_93743
  Gene Ontology: Mol. function=DNA binding; Biological process=DNA integration
MIKKVALALITSARRLRPYFQSHQIIAKTDHPIRQVLRKLELAGRMVVWSVELSKFDLQYEPRSLMKTQFMVNFPTDFANNIQATLDLFNYMAISDERQ

SEQ ID NO: 210522 - protein, 83 aa, Glycine max
  Coding DNA Sequence Number=SeqID_93744
  Gene Ontology: Mol. function=oxidoreductase activity; Cellular component=integral to membrane; Biological process=potassium ion transport
  Homolog annotation: Hit_ID=Q39151; Match level="QueryCoverage=87%, HitCoverage=24%, E-value=2e-20, Identity=72%"; Hit description=K+ channel protein
MHEVYANDRAEEIMGQAIQELDWKHSDIIISTSCNDKGLSCKHIIEGTKASLKRLDMEYNMWMFSTVTGRIPLCRYGIRRIQF

SEQ ID NO: 210523 - protein, 73 aa, Glycine max
  Coding DNA Sequence Number=SeqID_93745
MSASEADSMEESGPEGIATSGGLHHSRQLLRLEFIYFLGEFDDCIHVAEATTVDTFALDVTVYFAKLPYFGQL

SEQ ID NO: 210524 - protein, 508 aa, Glycine max
  Coding DNA Sequence Number=SeqID_93746
  Gene Ontology: Mol. function=signal transducer activity; Biological process=G-protein coupled receptor protein signaling pathway
  Homolog annotation: Hit_ID=O81225; Match level="QueryCoverage=57%, HitCoverage=34%, E-value=2e-82, Identity=54%"; Hit description=Extra- large G-protein
MDSSVPPVALETEDSISSYSIPEIPAFKLDQILVATLAPLSHDEFSDPVIQPLGKSLHKRKQNLCTADSAVLSGLEDSCAVISPPAPDTLEVPDDRDGTVLHTTSETTESGPGSSSTSLFVSSDEICSFREEEETPSPTPKHVKRVSDVIFSDLESNYTDTDEFDDSQIESVPVMERAVSISVMERAVRSGKKGSCYRCLKGNHLTLKEVCIVCSAKYCRSCVVRAMGSMPEGRKCVTCIGYRIDERNRSRLGKCSRMLKGLLSESEAAQAMDDERSCEANQIPPELVCVNLQPLNREQLKLLLNCRNPPKQLKTGSYWYDKCSGLWGKEGQPPSHLQKNASNGNTNVFINVREITKEEKLVLQVAGVPWEGTRNFWVHADGSYTEEGQIYLRGSIWHKRIVRLTCAVLSLPVPSKSVALSCEGEIANTDSLSKKILNKFLLIGSVNSDSKSFSWAVDNAIMSESETASKLGASPVRSFGSVVDNAIRSSSASEADLGTVALSVNMRM

SEQ ID NO: 210525 - protein, 69 aa, Glycine max; identical to SEQ ID NO: 184761
  Coding DNA Sequence Number=SeqID_93747

SEQ ID NO: 210526 - protein, 187 aa, Glycine max
  Coding DNA Sequence Number=SeqID_93748
  Gene Ontology: Mol. function=long-chain-fatty-acid-CoA ligase activity; Cellular component=integral to membrane; Biological process=metabolic process
  Homolog annotation: Hit_ID=Q96537; Match level="QueryCoverage=91%, HitCoverage=26%, E-value=7e-74, Identity=75%"; Hit description=Acyl CoA synthetase
MTGTVGVPMTTIEARLESVPEMGYDALSNVPRGEICLRGNTLFSGYHKREDLTKEVMVDGWFHTGDIGEWQSNGAMKIIDRKKNIFKLSQGEYIAVENIENKYLQCPLIASIWVYGNSFESFLVAVVVPERKAIEDWAKEHNLTDDFKSLCDNLKARKHILDELNSTGQKHQDHIDQLYKEAKGAMV

SEQ ID NO: 210527 - protein, 68 aa, Glycine max
  Coding DNA Sequence Number=SeqID_93749
MTLTDKSYPVSSVIGKAGSHVTASGARAGHESKDDESRIVEGMNNKLPDDAELGRGKRVRRPSWKLTE

SEQ ID NO: 210528 - protein, 1259 aa, Glycine max
  Coding DNA Sequence Number=SeqID_93750
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=81%, E-value=0.0, Identity=59%"; Hit description=Chromo
  Pfam annotation: Domain name=RnaseH; Domain location=895-1014; Score=- 14.6; E_value=0.0013; Accession=PF00075.14; Description=RNase H
  Pfam annotation: Domain name=rve; Domain location=1142-1259; Score =21.9; E_value=8.9e-05; Accession=PF00665.16; Description=Integrase core domain
  Pfam annotation: Domain name=zf-H2C2; Domain location=1083-1124; Score=13.8; E_value=0.0052; Accession=PF09337.1; Description=His(2) -Cys(2) zinc finger
  Pfam module annotation: Pfam domain module=RVT_1::Retrotrans _gag::RnaseH::rve::zf-H2C2; Domain location=635-804::133-223::895 -1014::1142-1259::1083-1124
MADNTRMKEIYAELKKNADAITRVSEDFHRQIERLEGANHAHMERMEAIQIANESQITQLNSAMTQILQRLQSIPVSPHGASNSNKEQTRTPFQVRSVKLDFPRFDGNNVMDWIFKAEQFFDYYATPDADRLLIASVHLDHDVVPWYQMMQKTDPLLSWQALTRALELDFGPSAYDCPRATLFKLAQSASVNEFYIQFTALVNRVDGLSPAAILDCFISGLQDEIRRDVKAMEPRTLSKAVALAKLFEEKYIANKKPNQMTNVARNYSQNTSFNHKNNQNSQKLDHTTKPNLPPLLPTPQIKPFNPRNQNIKKISPAEIQLRREKNLCYFCDEKFSPAHKCPNRQVMLLQLEDDEELQPDRNQATIEEGEEGGNVTETHHLSLNAMKGSNGVGTIRFTGQVGSIRVKILVDGGSSDNFIQPRVAQVLKLPIEPAPNLRVLVGNGQTLQAEGMIQQLPLHIQGQEVKVPVYLLQISGADVILGSTWLATLGPHVADYAALTLKFFQNGHFITLQGEGTMKPSPAQFHHFRRLHNTDAIEECFAIQWLPNEVPGDTLLELPTDMDPEIAILLHTYAQVFKVPSSLPPPREQDHAIPLKQGSEPVKVRPYRYPHTQKEQIEKMVHEMLDQGIIQPSTSPFSSPILLVKKKDGSWRFCTDYRALNAITVKDSFPMPTVDELLDELYGAQYFSKLDLRSGYHQIMVKPEDRAKTAFRTHHGHYEWLVMPFGLTNAPATFQSLMNKVFQSALRKFVLVFFDDILVFSSYWHDHLKHLEAVLQILQQHQLYARLSKCSFGASEVDYLGHRVSGKGVSMESTKVQAVLEWPPLTNSKQLRGFLGLTGYYRRFIKAYAHIAAPLTDLLKKDNFVWNSEAEAAFLKLKNAMTIAPVLALPDFTQPFILETDASGIGVGAVLSQNGHPIAYFSKKLAPRMQKQSAYTRELLAITEALAKFRHYLLGNKFIIRTDQRSLKSLMDQSLQTPEQQAWLHKFLGYDFKIEYKPGRDNQAADALSRMFLLAWSEPHSLFLEELRSKLTANPHLKQLMEDYRSSNEASHYAVRQGLLYWKDRLVIPVEEEMVQRILQEYHSSPIGGHAGITRTLARLKAQFYWPKMQEHVKEYVQNCVICQQAKVSNTLPSGLLQPLPIPQQVWEDVAMDFITGLPSVNGFSVIMVVVDRLTKYAHFLPLKADYSSKSVAETFMNNIVKLHGIPKSIVSDRDRVFTSSFWQNLFKLQGTTLAMSSAYHPQTDGQSEILNKCLEMYL

SEQ ID NO: 210529 - protein, 377 aa, Glycine max
  Coding DNA Sequence Number=SeqID_93751
  Gene Ontology: Mol. function=ribonuclease H activity; Biological process=RNA-dependent DNA replication
  Pfam annotation: Domain name=RnaseH; Domain location=239-364; Score= -27.9; E_value=0.023; Accession=PF00075.14; Description=RNase H
MLDNFKPNRGLHQGNPLSSYMFLLCMEKLALLIQAKVSEGTWQPMKTSVRGPKVSHLFFANDCLLFVKATNAQVRLVKEVFWIFLQGLRFKDIVNSKLARWKTKLPNKAGMLTLAKSVLSAIPTYTMQNLWILKGICNRIDVAVRNFIWDKPSTHWHSLMKAYDRLEDGFKFRLGQGEVSLFYEKWYGYTEEDFIHLIRDFPQALIQVHKEIISAATTSTTPAPPREVVWKPPTNATLNLNMDGSAIGNPGPSGFRGLIRNNIGDWIIGFVGHYGYATNLFAELTTIHQGLQLIWRFGHHDVVCESDCKTTLHLICDANTGYHPYTTIINKIKDYRSKPRRLHFCHILREGNKCVGALAMIELSHEDNFVQWDTPPH

SEQ ID NO: 210530 - protein, 105 aa, Glycine max
  Coding DNA Sequence Number=SeqID_93752
  Gene Ontology: Mol. function=RNA-directed DNA polymerase activity; Biological process=RNA-dependent DNA replication
  Homolog annotation: Hit_ID=Q1S4N5; Match level="QueryCoverage=51%, HitCoverage=10%, E-value=1e-09, Identity=43%"; Hit description =Peptidase M, neutral zinc metallopeptidases, zinc-binding site
MFWDSLGYKPWHVVETQGHSGGLWILSIRDDIAYTIVDSMTHAVTFSLPKHQAVWFYTAGWWLRRGDFKEILLSPKVSGGNFHPARAIDLATSLLGGRISTIGGM

SEQ ID NO: 210531 - protein, 94 aa, Glycine max
  Coding DNA Sequence Number=SeqID_93753
MLAALKQREQQFGGLRASMMKEKEEELTLFLEMKKSEEESNNLLLNNSKDFYASLGSNGGVNHIFNILSSTPTPMWKTGVDDFLNLENDKNDYD

SEQ ID NO: 210532 - protein, 118 aa, Glycine max
  Coding DNA Sequence Number=SeqID_93754
MVGDTRSNFVDLVFTGERIEVGLKRGKFDHLALMNEKIGTNGGDEEEEGNHVVAVIPRWPCFPPAQQCHYPPPNHPQGGGDDAILPRKGPVTRAISKRLQEDRARAAEEGLRVLMNLK

SEQ ID NO: 210533 - protein, 176 aa, Glycine max
  Coding DNA Sequence Number=SeqID_93755
  Subcellular localization annotation: CTP_CleavageSite=31; ConfidenceScore=5.52e-01
MATPPNSLPPIGAASSSPSTLKRTRNVTRLRALATRPVGAERSLVHVDPMTEKADCPHSKKLRTYLGIVARDKVDVTYENWKQVSAAQKDLIWEDIQAEFDIPEVYDQRTKRKILQIVGERWRQFKSDLTSKWALADDKESVDDTVCQKYDINKEKWAQFCQSRRDPSWEDVQKKA

SEQ ID NO: 210534 - protein, 70 aa, Glycine max
  Coding DNA Sequence Number=SeqID_93756
MERDEKRHNSNSLKCIHHHTYSQQKLDLIEIGKHDQRNKTLGAKPRKISVISLFVRNARVVEMNMGKANA

SEQ ID NO: 210535 - protein, 75 aa, Glycine max
  Coding DNA Sequence Number=SeqID_93757
MTVMMMSVTVDITMTVDGSDGNWSRRIVATMRVLGGSIKRLPSKSPTAAYLLPQMKVRDHHRHQSHGTKIANVSL

SEQ ID NO: 210536 - protein, 152 aa, Glycine max
  Coding DNA Sequence Number=SeqID_93758
MHARARVMGEIDEVQEQMKVDMEALKEKMATMMEAMMSMKKILEANAAVAAATSTVAEVYPTPPSSPKQINHPTSDMIGQGGKELGSTGGPHFVQVQNKHAFPPYGLPPNYTPPNVAHTSDENVDNSTPILIESQQTQFDHAHGLSTHGGYT

SEQ ID NO: 210537 - protein, 464 aa, Glycine max
  Coding DNA Sequence Number=SeqID_93759
  Gene Ontology: Mol. function=transferase activity, transferring phosphorus-containing groups; Cellular component=integral to membrane; Biological process=two-component signal transduction system (phosphorelay)
  Homolog annotation: Hit_ID=UPI00005FA7BC; Match level="QueryCoverage =96%, HitCoverage=51%, E-value=1e-158, Identity=63%"; Hit description= COG0642: Signal transduction histidine kinase
  Subcellular localization annotation: CTP_CleavageSite=34; ConfidenceScore=5.26e-01
PKPTPPSAGPAAPAAVPHPAGRADDRPDRASGVPADSAQCPGCAASACAPERFCRIRAVPAAAACSPSPLYPDRASGTDADFIHLVVDRRLDHPVMLFGHMGDLLQTEVRQQVLGDFIAGDHRIVGEAVDQQAGRQAGDDFLIQRALGLQFHRHVFARANVLAADKVDAQHRQRQQQQVDRDQPDVVAQQVDGQIDGRNAIHHLQRRIGQGGAELHPAAAHRRMGAEDGFRRDGAVVEIDIVRLQQEIGAGQIGRNDVVDRQVEGDHRRQMPWLIESGANRERIGVLEALLAQIGKALALVEHIGLLQHLGAAFVRRGGQVAFPKARSQLFERLSGDQAEAVVLTIEVIHGVVFGLGAPAGVQVIRDVGDHRQRALVMAAEDHRVGFLVRFLDIIDVGPQAGFLQTGIDILRRRIAKFVIDLIGHIAVGIDALLQRTGNAVQRVLFFRQPGIGVVVAIQADADR

SEQ ID NO: 210538 - protein, 292 aa, Glycine max
  Coding DNA Sequence Number=SeqID_93760
  Gene Ontology: Mol. function=RNA-directed DNA polymerase activity; Biological process=RNA-dependent DNA replication
MPRIISPFQTRFIPIRSPFFAPERGLRQGDPLSPYLLVLALDKLSRIISKRVDDGSKMRAGREGPLVSHLMSADDLLIFGEASISQMQTVTGVLEEFCSMSGQQATSLVNTKLAGWKASPLSLVGRITLAKTAIQPIPAYPMLIMIIPQNIIAEIQKVQKAFIWGTMLSTRGLHHEVGLGNGENNLWTNVLKGKYSRRFNVAQAMDYKGTDSPLWIDIVKHSAPLVKEEWWVIGNGEKVNALNDKWLDENTKVADFITDIPDQFQNLTRIRAIMPQSQIAGEDIRMWTIDIG

SEQ ID NO: 210539 - protein, 93 aa, Glycine max
  Coding DNA Sequence Number=SeqID_93761
MELDLFFVREKVPSKQLQIHHVPASARLIEDKVSFPRGSDGTTLPLQTYFRKKKREKKAELEGFDQVNSNLPTIVVQAETVFLNSVHGTAMVE

SEQ ID NO: 210540 - protein, 303 aa, Glycine max
  Coding DNA Sequence Number=SeqID_93762
  Homolog annotation: Hit_ID=Q7EY72; Match level="QueryCoverage=67%, HitCoverage=36%, E-value=8e-60, Identity=57%"; Hit description =Putative myrosinase
MVCMSCESLSFLAVPFQWVVLSFSVSGDLPDKVFARVCDEGVAAVVDGDVIGSIDLFGGEGGKEETVVGAEVVGDEGVERRDPRRKRYGDDGVGDVMESMELCIFDLRRGQHEGQELDKILFFFPAGLPFSKQLSVIGLSEGLITFTRIFSPEAACDVIEAERHSHVFYEAEPDIWIVMVPSPVADKSNDSEPIWRVDALRKVLKEIHSLFVMFHGSIRAMLEKEPGGGLTRRHLYTFIMDYLRACKKRSPWDTCCCGNGEVAVSNDFLAGKKLLLPSFRDCLKERGTVQMLTIGREAAIEVQ

SEQ ID NO: 210541 - protein, 291 aa, Glycine max
  Coding DNA Sequence Number=SeqID_93763
  Gene Ontology: Mol. function=catalytic activity; Biological process =metabolic process
  Homolog annotation: Hit_ID=Q01CB8; Match level="QueryCoverage=69%, HitCoverage=66%, E-value=8e-46, Identity=44%"; Hit description =Homology to unknown gene
  Pfam annotation: Domain name=PGAM; Domain location=12-186; Score =102.0; E_value=1.8e-27; Accession=PF00300.12; Description =Phosphoglycerate mutase family
MCSHSQRVLPKRIILVRHGESQGNLQPTAYDTIPDPKIQLTPEGIAQARHAGHRIRHVIAGEGSTNWRVYFYVSPYARTRSTLREIGRSFSRKRVIGVREECRIREQDFGNFQVQERMNVIKETRQRFGRFFYRFPEGESAADVFDRVSSFLESLWRDVDMNRLNHDPSDDLNLIIVSHGLASRVFLMKWFKWTVEQFELLNNFENGEFRVIQLGSGGEYSLAVHHTDEELLEWGLSPDMVADQKRRASASKGDWNDPCSWYLDAFFDHLPDSDDDNVDKHDETDSLSECS

SEQ ID NO: 210542 - protein, 135 aa, Glycine max
  Coding DNA Sequence Number=SeqID_93764
MVGEKRRKMSEMASLVKNLRLKHAHPFLPHTHTSKRTKFFFPVIRSHKFWNPNLLHFVLDLHLNRKNQSCCATRILASSLWNQVIYDELEPIAETLASSMEDFPSIVVRVDDFSSVNCNNDIKIHSNGDGAMQLW

SEQ ID NO: 210543 - protein, 53 aa, Glycine max
  Coding DNA Sequence Number=SeqID_93765
MSTLSWGKIKGDPDPDTFHMAKGARADAAKSSRCYDKDKGKWNVIHNTMSSEL

SEQ ID NO: 210544 - protein, 100 aa, Glycine max
  Coding DNA Sequence Number=SeqID_93766
  Homolog annotation: Hit_ID=Q9FMI8; Match level="QueryCoverage=58%, HitCoverage=13%, E-value=9e-12, Identity=59%"; Hit description =Arabidopsis thaliana genomic DNA, chromosome 5, P1 clone:MHJ24
MTPATRLNVLGIQTNGLTSIRSPFSVLMYTDRNLLALFSGLWGLQREAVCHCGIWSWRRRRGGGWLRTPQGMVALRSGCERGRGRQGRGGRRGLPGGGGG

SEQ ID NO: 210545 - protein, 183 aa, Glycine max
  Coding DNA Sequence Number=SeqID_93767
  Homolog annotation: Hit_ID=Q2HV28; Match level="QueryCoverage=76%, HitCoverage=98%, E-value=1e-40, Identity=58%"; Hit description=C2
MGKQLGLLKIIVMQGKRLVIQDFKTSDPYVVLKLGNQREREIEREREEVFDKDLLKVDDKMGNTFLNLQPIVSVARLRDILRVSSIETTLRKVIPDGENYLVRERNTNCVNGEVVQNVWLRLRGVKYGELELTIKLVTHVAPAIQCNNCMCHKCRSLINILCLVNRGFWQICTISSTASDQVS

SEQ ID NO: 210546 - protein, 74 aa, Glycine max
  Coding DNA Sequence Number=SeqID_93768
  Subcellular localization annotation: CTP_CleavageSite=28; ConfidenceScore=5.20e-01
MARSSGQFSLSAIPSRVGIALNEPFALRETSKVVTFKIPTVTLCINVFGSFKQNLKMIQRLTNPRLRFYWNRFR

SEQ ID NO: 210547 - protein, 36 aa, Glycine max
  Coding DNA Sequence Number=SeqID_93769
MSAWKISCSVPLWGFVVAFILFRVKGNEDSHTVEVP

SEQ ID NO: 210548 - protein, 429 aa, Glycine max
  Coding DNA Sequence Number=SeqID_93770
  Subcellular localization annotation: CTP_CleavageSite=55; ConfidenceScore=5.67e-01
MDVKALAKSKRNHTQHHSKKSPHSHKPKAPTSSSSSSVGPNDAAKNNPLGKQQVSQKKKSHRSALPSNWDRYEDEEEELDSGSGIASKTVDVVLPKTKGADFRHLVAEAQSQAETSLEGFPAFDDLLPGEFGVGLSSMLVVRGEGIVSWVGDDNFVVDDKTTGNPEASFLSLNLHALAESFAKVDLSKRLFIESDLLPTELCVEELAVSSNEEHKELKTKEDSELANRMSKELDLDDLAADQFTSSSSSSSSHAVSTFPLSNNVFHIPVNYVNAEAQQTSCSSKNKAFVPCSDASLHSTEDARGKQYSAFGAADVEKELDMLLDSLSETKILDSSGFKSYTSIPVSLGVSSVYPQVSKKDPVPSKTASITASLDDALDELLEETSTLMNPNVLLRPQEEKPFHHSMQSSSHSGNKSKVADDFDSWFDTL

SEQ ID NO: 210549 - protein, 328 aa, Glycine max
  Coding DNA Sequence Number=SeqID_93771
  Homolog annotation: Hit_ID=Q9LK54; Match level="QueryCoverage=12%, HitCoverage=7%, E-value=4e-11, Identity=83%"; Hit description =Similarity to SUN and FMU proteins
MEFICFGVVRPTAIGAIVDLLALPLIENLGLLALPQIFEDTESLSYFTSVFKLRNIKTPKWPNPQHKCNDYRFDTEQGTTCKEVYIRSNQMEEKQENIPSSNTHKRKSLSALGMTLSVLFGLLETFSVTLNRENGGEGAQGGFERRERDKGGFFDSQSCADEFDSWVLNKSFVSLEGWRFSSNDGGERRVVGFGSSGDTDSDNWNNKKKSKSNIGSSESVGVGGRLKLVLQPRTLSGLIRSERRGRGMLNFRRVPYAEFCFLPHHPLKEVSAVRLMWIELGGAFADLLNEKGKGSGENEMGYVQRTLGFPTFSYLTRLCKVQSIITPN

SEQ ID NO: 210550 - protein, 243 aa, Glycine max
  Coding DNA Sequence Number=SeqID_93772
  Gene Ontology: Mol. function=glutathione synthase activity; Cellular component=chloroplast; Biological process=glutathione biosynthetic process
  Homolog annotation: Hit_ID=Q94GA0; Match level="QueryCoverage=85%, HitCoverage=31%, E-value=5e-79, Identity=73%"; Hit description =Glutathione synthetase GSHS1
  Pfam annotation: Domain name=GSH_synth_ATP; Domain location=1-209; Score=63.0; E_value=9.5e-16; Accession=PF03917.8; Description =Eukaryotic glutathione synthase, ATP binding domain
MEQSSAVKCPSISYHLVGTKKIQQELAKPGVLERFLDNKDDIAKLRKCFAGLWSLDDSNIVRKAIERPELFVMKPQREGGGLVHPNFDLPTALLLFKNKERGEETYLTNPPNYFSGNNIYGDDVRETLLKLQKADSQEDAAYILMQRIFPSISATVLLRNGCWHKDHAISELGIFGTYLRNKNKVIMNEQSGYLMRTKVSSSDEGGVAAARKWFEYGIFHDRRSIFNPVELILLGKRQQGTLA

SEQ ID NO: 210551 - protein, 105 aa, Glycine max
  Coding DNA Sequence Number=SeqID_93773
QREAAVVAEDALNVDDATKEVFQHPEEVGVDAQGFPGRSRDTSVLTVYVDHVAIIVWNEEERPELKLSSHGRKVQKFRRSVAKIEGLVAATGLSPLIACSLDTGD

SEQ ID NO: 210552 - protein, 121 aa, Glycine max
  Coding DNA Sequence Number=SeqID_93774
  Subcellular localization annotation: CTP_CleavageSite=51; ConfidenceScore=5.52e-01
MVSHTPSVLGKKGMNSVADLQRAPRRGGGGGTRRCRSVNGVAASPVSQPCRCAEQQRARVFDFQLWSPEQRRENPVQISRRSATIAVTPTVMLNRAATSIPVADGGRAAPLRRDSGRDSRD

SEQ ID NO: 210553 - protein, 145 aa, Glycine max
  Coding DNA Sequence Number=SeqID_93775
  Gene Ontology: Mol. function=glutathione synthase activity; Cellular component=chloroplast; Biological process=glutathione biosynthetic process
  Homolog annotation: Hit_ID=Q9M426; Match level="QueryCoverage=77%, HitCoverage=18%, E-value=3e-30, Identity=71%"; Hit description =Homoglutathione synthetase
SRSPCTNIYKKETAVQKLQVGGNLERESWRNVASKLTRSTSSLNIGANSQASLQWFSGNGVGNKATGACTNPTPGTLPDLCMHAITNTLNGNKKGGRVRDLNGFVTNKEAVERGPNESIVGDSVKELLMKTMVVEDAINMLRHRE

SEQ ID NO: 210554 - protein, 118 aa, Glycine max
  Coding DNA Sequence Number=SeqID_93776
  Gene Ontology: Mol. function=glutathione synthase activity; Cellular component=chloroplast; Biological process=glutathione biosynthetic process
  Homolog annotation: Hit_ID=Q94GA0; Match level="QueryCoverage=66%, HitCoverage=21%, E-value=3e-27, Identity=56%"; Hit description =Glutathione synthetase GSHS1
  Pfam annotation: Domain name=GSH_synthase; Domain location=64-111; Score=-14.4; E_value=0.00022; Accession=PF03199.6; Description =Eukaryotic glutathione synthase
MVEIYFRFKDFFKKYLYISWSFSRYILSRHGKLLGLDSKRIPANNAVNQYAEALAKAWSEYNNPRAVIMIVVQAEERNMDGQAISVIYFRAGYTPIDYPSESVSDISLFAAHKHVFPL

SEQ ID NO: 210555 - protein, 736 aa, Glycine max
  Coding DNA Sequence Number=SeqID_93777
  Gene Ontology: Mol. function=protein serine/threonine kinase activity; Cellular component=nucleus; Biological process=protein amino acid phosphorylation
  Homolog annotation: Hit_ID=Q9LER4; Match level="QueryCoverage=76%, HitCoverage=99%, E-value=0.0, Identity=64%"; Hit description=Protein kinase-like protein
  Pfam annotation: Domain name=Pkinase; Domain location=16-297; Score =223.6; E_value=4.5e-64; Accession=PF00069.15; Description=Protein kinase domain
  Pfam annotation: Domain name=Pkinase_Tyr; Domain location=16-297; Score=59.3; E_value=4.1e-16; Accession=PF07714.7; Description =Protein tyrosine kinase
  Pfam module annotation: Pfam domain module=Pkinase::Pkinase_Tyr; Domain location=16-297::16-297
MEHVLEKRFPLNAEDYTLYEEVGEGVSASVYRALCVPLNEIVAIKVLDLEKCNNDLLYSVAVVLDKFLLIALQIMQDGIRREVQTMNLIDYPNVLRAHCSFTAGHNLWVVMPYMAGGSCLHIMKSNYPEGFEEPVIATLLHEVLKALVYLHAHGHIHRDVKAGNILLDSNGAVKLADFGVSACMFDTGDRQRSRNTFVGTPCWMAPEVMQQLHGYDFKADIWSFGITALELAHGHAPFSKYPPMKVLLMTLQNAPPGLDYERDKKFSKAFKELVATCLVKDPKKRPSSEKLLKHHFFKQARASKYLARTILEGLAPLGDRFRMLKAKEADLLVQNKALYEDKDQLSQKEYIRGISAWNFNLEDLKSQAALIQDDDIPNAEEPQRDKKQKDRLDNFKVSAERLSAGAANHSDDAPTQDKEDGFNNLQDLEGSLVSFPTKPLQALKGCFDMCEDDINNSSPRDLDHDGRIDNESSRPSTSLQQNTTSQQKKFPSGSLLPDNFLFPKMVVTDGDRDYLQTKYSSERNHSGPLQYRQKRDTNNLPLVDDTSDGAFFRRRGRFTLTDLSPMGPSNSTSGPVVSPTSPPNQNFMSTAILPSLQCILQHNGLQREEIIKLIKYAEQSSGKNTESVEAGTGDMLQAPPATTRERELHFQVIQLQQSIGSLVEELQRQKMKNVQIEYCFLGIVLLFQSQEMLNIPLTRKIGWMYKESPKTYVEWEGMLKHVACSGILSQDLAVHG

SEQ ID NO: 210556 - protein, 226 aa, Glycine max
  Coding DNA Sequence Number=SeqID_93778
  Gene Ontology: Mol. function=glutathione synthase activity; Cellular component=chloroplast; Biological process=glutathione biosynthetic process
  Homolog annotation: Hit_ID=Q93XE5; Match level="QueryCoverage=98%, HitCoverage=32%, E-value=2e-75, Identity=65%"; Hit description =Glutathione synthetase
  Pfam annotation: Domain name=GSH_synth_ATP; Domain location=1-226; Score=86.6; E_value=7.7e-23; Accession=PF03917.8; Description =Eukaryotic glutathione synthase, ATP binding domain
MQEWSARILMEQSSAVKCPSISYHLVGTKKIQQELAKPGVLESGVVQNVAAAIVGQWWQECMVNNWDLWILASKTSSSKFKLNPCVKTVSRFIENKEEIAKLRKCFTGLWSLDDSNIVRKAIERPELFVMKPQREGGGNNIYGDDVRKALLKLQKEGSLEDAAYILMQRIFPSNSAAILMRNGCWHKDRAISELGVFSTYLRNKDKVIMNKQSGYLMRTKISSSDE

SEQ ID NO: 210557 - protein, 55 aa, Glycine max
  Coding DNA Sequence Number=SeqID_93779
MASCVVTFFEIIVHSSILSWFLGIGGIAGLIEYLAHWLDVLRGISYIRVCLDREF

SEQ ID NO: 210558 - protein, 72 aa, Glycine max
  Coding DNA Sequence Number=SeqID_93780
MKGFKSFKAHPIPLKIIEATRSNTRSMCSTDVCDIVIVGSGPVGIIITHARGVIPYRRGLDSWPGNLLEKGL

SEQ ID NO: 210559 - protein, 167 aa, Glycine max
  Coding DNA Sequence Number=SeqID_93781
  Gene Ontology: Mol. function=nucleotidyltransferase activity
  Homolog annotation: Hit_ID=Q1SQ35; Match level="QueryCoverage=36%, HitCoverage=70%, E-value=3e-18, Identity=64%"; Hit description=Pol -related
MRLNAYESSKLYKQKMKPSQQVLLFNSRLRLFPGKLKSKWSGPFIIKEVRPYGALELVDPTLSDLERSQIVKDGLKRLTRLAEKQIDVALVKEFYSNVYDSEDSSPKQCMERGRTIRFDAQVLNEFLGTLLIIVEGEQLTAYSSTSILTQTMRPLRPSCAPQEGDSC

SEQ ID NO: 210560 - protein, 184 aa, Glycine max
  Coding DNA Sequence Number=SeqID_93782
  Gene Ontology: Mol. function=glutathione synthase activity; Cellular component=chloroplast; Biological process=glutathione biosynthetic process
  Homolog annotation: Hit_ID=Q9M426; Match level="QueryCoverage=99%, HitCoverage=38%, E-value=4e-94, Identity=91%"; Hit description =Homoglutathione synthetase
  Pfam annotation: Domain name=GSH_synth_ATP; Domain location=1-184; Score=90.6; E_value=4.7e-24; Accession=PF03917.8; Description =Eukaryotic glutathione synthase, ATP binding domain
EWRARLLMEQSSAIKCPTISYHLVGTKKIQQELAKPGVLERVLSTVHALGLWSLEDSDIVKKAIENPELFVMKPQREGGGNNIYGDELRETLLKLQEAGSQEDAAYILMQRIFPATSPAILVRDGNWDTGHVISEAGIFGTYLRNKDKIIINNESGYMVRTKISSSYEGGVLPGFGVVDTVYLT

SEQ ID NO: 210561 - protein, 190 aa, Glycine max
  Coding DNA Sequence Number=SeqID_93783
  Gene Ontology: Mol. function=glutathione synthase activity; Cellular component=chloroplast; Biological process=glutathione biosynthetic process
  Homolog annotation: Hit_ID=Q93XE5; Match level="QueryCoverage=67%, HitCoverage=23%, E-value=4e-56, Identity=86%"; Hit description =Glutathione synthetase
  Pfam annotation: Domain name=GSH_synth_ATP; Domain location=7-190; Score=18.3; E_value=4.4e-12; Accession=PF03917.8; Description =Eukaryotic glutathione synthase, ATP binding domain
MANVVPIVVGRTVKKNLDIAARITVAWTRSGSVPGVGLVHAPLALLPTPFPEKQWREANELAPIFNELVDRVSLDATFLQESLSRTKKADEFTSRLLDIHSKMLQINKKEEIRLGLHRSDYMLDEKTKSLLQIELNTISSSFAGLSNLVTELHRIVNLEQLDSKAIAPYSAMASWQVAATGVQSCHVFGS

SEQ ID NO: 210562 - protein, 298 aa, Glycine max
  Coding DNA Sequence Number=SeqID_93784
  Gene Ontology: Mol. function=nucleic acid binding; Cellular component= intracellular; Biological process=regulation of transcription
  Homolog annotation: Hit_ID=Q9FFH3; Match level="QueryCoverage=64%, HitCoverage=46%, E-value=3e-11, Identity=33%"; Hit description =Similarity to zinc finger protein ID1
  Subcellular localization annotation: CTP_CleavageSite=59; ConfidenceScore=5.32e-01
MATHFPSIFKPISSTDETSNQTSRGLPLWMGQTSSQAQETMVNTNFREIHQLGSATSSSGTMYGGNSILQYSNLPPSNNYQLSWVFGTKISNSSNNQELTTNTTTTTSLPIGNSSVPSLYCSQHQPQQTCSSANMSATALLQKAAQIGATSSDPSWLGSLGLKCGNSQGQDGNNNKYSDMYGSSLVLTTLGSEADNSACELSQMHPHKRRHVLNEESGGGQTRDFLGVVSFFMCNGKITIKANGGGVEVGLGGEELSIWKLLREEKVGIECLMRGKKFAVRKTIEGLKGEIHAYSFEC

SEQ ID NO: 210563 - protein, 187 aa, Glycine max
  Coding DNA Sequence Number=SeqID_93785
MMFIVPFELIFLLYAVLLPRKCKKKKASKRPNNVRLSLTLRLIEDCLMLMLNHDYSTSEQLLWARSRLLNSKEKQNGHDSFCIRCIDTETFFFKDEKDEEFVFSFDIVFYEQSEQADVYQFLALPVIRDVVDAINGTIITYGQFQIMHARTYVVFLLIQGSYVCVGSCEKLQEILHRRSFAEYDPWH

SEQ ID NO: 210564 - protein, 320 aa, Glycine max
  Coding DNA Sequence Number=SeqID_93786
  Gene Ontology: Mol. function=glutathione synthase activity; Cellular component=chloroplast; Biological process=glutathione biosynthetic process
  Homolog annotation: Hit_ID=Q9M426; Match level="QueryCoverage=80%, HitCoverage=51%, E-value=1e-136, Identity=95%"; Hit description =Homoglutathione synthetase
  Pfam annotation: Domain name=GSH_synth_ATP; Domain location=77-316; Score=226.9; E_value=4.5e-65; Accession=PF03917.8; Description =Eukaryotic glutathione synthase, ATP binding domain
  Subcellular localization annotation: CTP_CleavageSite=59; ConfidenceScore=5.65e-01
MGGRSGGLVCSTSSYTGIRTRRLCTSNNTTFPFPQQPQSLSFAKPLKLMSQPLTTNSVLVEEAAADGDSSAAAPPLFDYHRIDQKLLQNIVYDALVWSTLNCLLVGDKSVQRSGRVPGVGLVHLPLSLLPGPFPESHWKQGCELAPIFNELVDRVSLDGKFLQESLSRTKNADEFTSRLLDIHSKMLQINKKEDIRMGIVRSDYMIDEKTKSLLQIEMNTISTSFALIGCLMTGLHKSLLSQYGKFLGLNSNRVPANNAVDQSAEALAKAWSEYNNPRAAILVVVQVEERNMYEQHYISALLREKYPFLISYNYDTEGTI

SEQ ID NO: 210565 - protein, 112 aa, Glycine max
  Coding DNA Sequence Number=SeqID_93787
MDQRELNLGICYRLYHFIMETLASQAMKTVTLGRSSHYDSSSTKVKITTRGFGANADKVVQPEIPCVEKNIPCRNSIDEKVVVVGDLPHAPKKMKPLRSILKVGANLNDKSN

SEQ ID NO: 210566 - protein, 477 aa, Glycine max
  Coding DNA Sequence Number=SeqID_93788
  Gene Ontology: Mol. function=nucleic acid binding; Cellular component= nuclear pore; Biological process=DNA integration
  Homolog annotation: Hit_ID=Q1SNY3; Match level="QueryCoverage=65%, HitCoverage=46%, E-value=2e-58, Identity=50%"; Hit description =Integrase, catalytic region; Zinc finger, CCHC-type; Peptidase aspartic, catalytic
  Pfam annotation: Domain name=zf-CCHC; Domain location=105-122; Score =7.4; E_value=0.06; Accession=PF00098.13; Description=Zinc knuckle
  Pfam module annotation: Pfam domain module=RVT_2::zf-CCHC; Domain location=235-377::105-122
  Subcellular localization annotation: CTP_CleavageSite=37; ConfidenceScore=5.34e-01
VHEKELQQDEGVNKGKSLAPNTQKARKTPSSKKSLSRSSSKSVSMALSVDNSSNDESKQESEKDNELTFVSRKIRKMWKNNSGSRWKNSSMKVFKEKKDKEKSSIIGYECKKPRHFKLECPKLEKSKDKYKHYKSKEKKNLMSIGEDLDDTTSNEDKEEEANLWLKHNLLSISQLCDIGYDVSFNKDECIIQNNDGLLLFYAKRKVEEFIHVRFDDTKLDKESLELGESFVDLRLDNGIKNFVSPIHNTDKKAIGAKWVFRNKLEEDTKVARNKARLVAKGYSQQEGIDYTETYALIACLEAICILLSFVAYNNIKIYQMDTKVEMSMMGEMKIFLGLQIKQTDKEIYINQTKYVKELLKKFNMDDGKEMKTPMHLTTYLGLGKEYKKVDGIQYRGMIGSLLYLTVSKPDIMFNLCLCARFQKEPREVHLTAVKRIFRYLIGTPNLGLCFKKGKDFRLSSYCDADYAREKLERKSTG

SEQ ID NO: 210567 - protein, 281 aa, Glycine max
  Coding DNA Sequence Number=SeqID_93789
MTSGSEASMYGEPIPKIDTTLVLTKNEATIHIEHFFDVPALEGIGLSLNETMLYCGIRGFYNDYQTIHPKLIRMFLCKAYFKTAYAKVSTILSKTMTLSMESITQVIGCMREGNIYNNNWEKNYEEHQTPKDYSHKEKSIEASYGEELSCQLEGNTLAHNPYPLQRQSTWGRSNKGRNLVEGAFCASSSSTTTTLTQTQNLSDPQIIVPGKKRRVKASDTQFKENWLASLSNPFPEKTHLLNGEHEPTHQNDGSKWVLGIDPDVSGAVALLKTHGSVCSAQ

SEQ ID NO: 210568 - protein, 46 aa, Glycine max
  Coding DNA Sequence Number=SeqID_93790
  Gene Ontology: Mol. function=ATP-dependent helicase activity; Cellular component=chromosome, telomeric region; Biological process =mRNA processing
  Homolog annotation: Hit_ID=Q1RYY7; Match level="QueryCoverage=100%, HitCoverage=9%, E-value=3e-16, Identity=89%"; Hit description =Helicase, C-terminal
MDVVCQAKSGMGNTAVFVLSTLQQADPVPDQVAALVLCHTRELAYQ

SEQ ID NO: 210569 - protein, 72 aa, Glycine max
  Coding DNA Sequence Number=SeqID_93791
  Gene Ontology: Mol. function=ATP-dependent helicase activity; Cellular component=chromosome, telomeric region; Biological process =mRNA processing
  Homolog annotation: Hit_ID=Q56XG6; Match level="QueryCoverage=65%, HitCoverage=11%, E-value=9e-12, Identity=73%"; Hit description=DEAD -box ATP-dependent RNA helicase 15
MGELKYIEAYEEELINYQEEEKAPDSAKPVAESGKKGYVGIHSSRFQDLLLKPKLLQAIVDSGFEHPSEGKI

SEQ ID NO: 210570 - protein, 90 aa, Glycine max
  Coding DNA Sequence Number=SeqID_93792
MANMEVYGACGIPNVGIRFLVYSYGGEAWSGRVMVVMGHFNAILYDNERQVGVARPNTTGIRAFKEAMKWCKSLDVGYKGQKFKWKRRDL

SEQ ID NO: 210571 - protein, 290 aa, Glycine max
  Coding DNA Sequence Number=SeqID_93793
MDHEQFFLKGKFPSLDPLELEMMGKEMDEKIKQAIFIVGSFKVPSEDKFQALFYQSQWDVMIWRVALDALSPTGGIKQGDLLSPYMFVSCMKRLSQLISVAVDNELWKPIQVGRKPPKLSHLAFVDDLIIFVEASMEQVEVTSTCLDFFCNNSSEKKLSLGGYIFNKKAEGSRESRGKAIKNLQRLPEISVVALEQAPLSDGQVRQCATSSAPLPPRTSPASPHKFAAAPVPWRHGRAIVLRGLASTSLRFHSTLGMKPHMGTTHFVGTTASTTERKSLRPLGFFTNSKL

SEQ ID NO: 210572 - protein, 353 aa, Glycine max
  Coding DNA Sequence Number=SeqID_93794
  Gene Ontology: Mol. function=RNA-directed DNA polymerase activity; Cellular component=chromatin; Biological process=RNA-dependent DNA replication
MGEERRKAVREEVEKLPNVNFIREVRYSTWLANIVMHQLTSRQSVRVPGAKLPGYLLQIQLDHDRVMSFGLKNTGATYQRLMDRVFKQQIKLNVEVYVDDMVVRSQSIVQHVVDLEEVFEKLCKYGMCLNPKKCTFGVSRGKFLGFMITHRGIEANPNKCTVILEASIPVQVPPEARQKGPNNVTLEQALKLNFRAPNNQAEYEVLIAGLKLAREYYHIAKTLIDNFKCFKIYYIPRENNARADLLSKPASTKKVGHLKTIIQEMFQTPTIHIEEVMAREEEEPDWMTPYKNFLIWGELPPNKDEDAPLPLKWCEPATTGQCLGQVPSTLPGGADDVKSLQTCHTLLLAIFIV

SEQ ID NO: 210573 - protein, 108 aa, Glycine max
  Coding DNA Sequence Number=SeqID_93795
MSRSRASSSRWTSVNEELGQLLANVPELTIEEHEEWRELANMMQNVAAPPEAFFQTFHATDQIFDEVGKDVPSSMYYFFKDKGWTHLHLENVAECWLVFNHWRKTLKI

SEQ ID NO: 210574 - protein, 174 aa, Glycine max
  Coding DNA Sequence Number=SeqID_93796
MKVSFKHFLRECNASADALVKHGSPDIWARGEDGHGCGKHHFTVDYTDRPIHLMINLAYIKKNCRNPTDSSITFPWPRRVCARATQDAPPPRLIIENLHQLSIHLAMDHPLMMPEDFIQRVAWPGVQPSTNEGMIPLALEMLQMLKQTLIMLRISWPHREIGTHGPYRTEAILS

SEQ ID NO: 210575 - protein, 173 aa, Glycine max
  Coding DNA Sequence Number=SeqID_93797
  Homolog annotation: Hit_ID=Q9SRX3; Match level="QueryCoverage=33%, HitCoverage=11%, E-value=3e-09, Identity=50%"; Hit description =Endoglucanase 1 precursor
MACLHDQSLSFAPRCAYETKPSSKSVLQQSVIDIEATILEMEAFRGPRKINREEEIEPNSKIINSQTKRNICNKNIYGKFLLWTCFYYKDLLSTKCIDHNFWERPEDMDTPRKTFVVSRDFPCSEVSAKIVEALATFSIVYRKYHIGYFTRLLERDCYEWEAKHKTLCSNRTI

SEQ ID NO: 210576 - protein, 178 aa, Glycine max
  Coding DNA Sequence Number=SeqID_93798
MLKLKGWGPKDADARGTTRLTSNLVDIPNKGRRLSMDARIDNFHAGSSTDATDKIRMRERQALGKNREEIEEIWLEILERIQVTSLKEFLFKEDKMISVSFGEDLELGDKFVLYLIALDVVSCKGPENSDMAKKVMKDLMQSYPARALDRRLQEDWARDAREGPRVLMSLRVDFGPMG

SEQ ID NO: 210577 - protein, 265 aa, Glycine max
  Coding DNA Sequence Number=SeqID_93799
  Gene Ontology: Mol. function=DNA binding
  Homolog annotation: Hit_ID=Q1SDS1; Match level="QueryCoverage=81%, HitCoverage=40%, E-value=6e-27, Identity=36%"; Hit description=IMP dehydrogenase/GMP reductase
MDILALLIFGVVLFPNVDGLVDWAAIDAFLAFYDRKESPVVAILADLYDTFDRRCEKNNARIICCTPVLYIWLVSHFFCQEMRHVCPLEGHRSCTEKKEANWDRLLASKEGAPVNWFPRWKEGRTEILISCGKFPNVPLIGTRGCINYNLVLAIRQLGYPRRGVPLEEGLIPFITRGFDSTNAGVLQKVHKAWEMSQRKDKELKWSSNGPIGDYHRWLKAYAQDLDWLLSLRTTKGMEVETLEEDEEVQALKTELEKAQIVKEKF

SEQ ID NO: 210578 - protein, 60 aa, Glycine max
  Coding DNA Sequence Number=SeqID_93800
MEARCAKKEEGEVCMQSGDRNPSKPKPLVIHFIRDITTQRPRGFQPFTTKTPAPFPYVIP

SEQ ID NO: 210579 - protein, 75 aa, Glycine max
  Coding DNA Sequence Number=SeqID_93801
MWGCEKAKIDGPKRLSPREKMSGVTTNVYSRENARKPKKGSTGFENEASGVFYAWGRVLPLLLRILRCDEEFRPT

SEQ ID NO: 210580 - protein, 100 aa, Glycine max
  Coding DNA Sequence Number=SeqID_93802
MGLNQEHAFKERIIKSRGGARADEGRHGGHERANGHNDRSHDEYEKMMEVNVATVVAARKELGSAGGPHFVQVQNKHSFPPYGLPPNYTPPNVAPAPDEN

SEQ ID NO: 210581 - protein, 67 aa, Glycine max
  Coding DNA Sequence Number=SeqID_93803
MGSDQASSFKKRLYHVKVKNLELVSMRKLGQRMDQVRRQAFSKVYGKIWDLEMIEVFVEAITSLTQY

SEQ ID NO: 210582 - protein, 88 aa, Glycine max
  Coding DNA Sequence Number=SeqID_93804
MSKVVGGDTLWSSAPFIDRGERIRKYQDDVGHSAIGCNGKGSAGTICLVGCDLRMTASRNLTPIVRQSVKFRDMSGVERKHYCAIHKV

SEQ ID NO: 210583 - protein, 152 aa, Glycine max
  Coding DNA Sequence Number=SeqID_93805
MEQELDPSVPCCQHLLSAILAMEPSECLISHARACGGGSITDQVQQFISDHCLSTPGDFHAPYLKTFLKKLITQVEFDRGCVLDHLYELYAHYISSFKDDSLGKRDGRICKRISFLFPDGCSELLSFPHSRVLVFSLQCSLNMLEGDTGYAH

SEQ ID NO: 210584 - protein, 267 aa, Glycine max
  Coding DNA Sequence Number=SeqID_93806
  Gene Ontology: Mol. function=microtubule motor activity; Cellular component=microtubule associated complex; Biological process =microtubule-based movement
  Homolog annotation: Hit_ID=Q9LY67; Match level="QueryCoverage=80%, HitCoverage=46%, E-value=9e-30, Identity=42%"; Hit description =Kinesin heavy chain-like protein
  Pfam annotation: Domain name=Kinesin; Domain location=1-90; Score= -185.4; E_value=0.01; Accession=PF00225.13; Description=Kinesin motor domain
MRSGKLILVDLAGSEKVEETGAEGRVLEEAKTINKSLSALGNVINSITCGLQGKASHIPYRDSKLTRILQDELVSPPSPFYSLSNNTHCSPNLYPKRGTISYSQEEMLELHYSVVAHPALLMHPRVCPLFVSVSPSMKAFDYLRAKHTKALPRLREKLNVEDVMLQEELLIQEGILFDPSSVEEESDIEDLTLQAISSLQAAMEKLTATVDELKGENSILKAKVDASMESLFYKGAENRSIFQNMVSDVCLLKRLQWIQPDHDLIPP

SEQ ID NO: 210585 - protein, 120 aa, Glycine max
  Coding DNA Sequence Number=SeqID_93807
  Gene Ontology: Cellular component=chloroplast thylakoid membrane
  Homolog annotation: Hit_ID=Q00XT9; Match level="QueryCoverage=76%, HitCoverage=36%, E-value=2e-14, Identity=50%"; Hit description =Homology to unknown gene
MALLAPFLHLLPSILHFGATHGIVLATDEKYNEAIFSTANRLVAAIDGLPDPGWPKFKDNKRESNFKSREETDEKCGQFTLVVGGLLVIAFVVPMAQYYAYVSKNYNQCHVTLGLEKVVE

SEQ ID NO: 210586 - protein, 37 aa, Glycine max
  Coding DNA Sequence Number=SeqID_93808
MWAVTKRGYGDLLLRKSMMRRPSEYLPDGFWKWKVKI

SEQ ID NO: 210587 - protein, 169 aa, Glycine max
  Coding DNA Sequence Number=SeqID_93809
LGADVIYDPVCLPHLVRVLAMLLNQTNLGSCRQHASCKGHSPNIEHENGEHNHEYAIDKSDGGCKAIYNDGSSSLSKEAPVAYIAYVIRNIETFNYFLSLGKQANLDIVDLTDSLKPARNLAPSFCQSLVREIKVFLKKNDGMIYVHHAPADFMAKLDLQGGASDFSTS

SEQ ID NO: 210588 - protein, 85 aa, Glycine max
  Coding DNA Sequence Number=SeqID_93810
  Homolog annotation: Hit_ID=Q9C9D1; Match level="QueryCoverage=40%, HitCoverage=6%, E-value=2e-07, Identity=80%"; Hit description =Putative cytochrome P-450; 4810-6511
MNYVIPVEEKLISRFLHRPVGEIGAVENLLRGFLFARDNELGPSKPTESEEHREQEGKEKDAEGDLESDDSGLHEFREEQKCEIL

SEQ ID NO: 210589 - protein, 490 aa, Glycine max
  Coding DNA Sequence Number=SeqID_93811
  Gene Ontology: Mol. function=oxidoreductase activity; Cellular component=membrane; Biological process=electron transport
  Homolog annotation: Hit_ID=Q43071; Match level="QueryCoverage=81%, HitCoverage=99%, E-value=1e-145, Identity=62%"; Hit description =Cytochrome P-450
  Pfam annotation: Domain name=p450; Domain location=50-484; Score =234.7; E_value=2e-67; Accession=PF00067.12; Description=Cytochrome P450
  Subcellular localization annotation: CTP_CleavageSite=70; ConfidenceScore=5.25e-01
MSPDFTLLFSPELMQSPIITFQATFCVLLFTLMFTPFFTPGGLPWAWARPRTIIPGPVTALLGVFTGSTPHSALSKLARTYHAEKLMAFSIGLTRFVISSEPETAKEILGSPGFADRPVKESAYELLFHRAMGFAPYGEYWRNLRRISALHLFSPKRITSSESFRSKVGLKMVEQVKKTMSENQHVEVKKILHFSSLNNVMMTVFGKCYEFYEGEGLELEGLGVRKRCRCLVEKVNVFVGGVIKEHRVKRERGDCVKDEGAEDFVDVLLDLEKENRLSEADMIAVLWEMIFRGTDTVAILLEWILARMVLHPEIQAKAQREIDFVCGSSRLVSEADIPNLRYLQCIVKETLRVHPPGPLLSWARLAVHDVTVGGKHVIPKGTTAMVNMWAITHDERVWAEPEKFRPERFVEEDVSIMGSDLRLAPFGSGRRVCPGKALGLASVHLWLAQLLQNFHWVSSDGVSVELDEFLKLSMEMKKPLSCKAVPRVSV

SEQ ID NO: 210590 - protein, 158 aa, Glycine max
  Coding DNA Sequence Number=SeqID_93812
  Gene Ontology: Mol. function=RNA-directed DNA polymerase activity; Biological process=DNA integration
  Homolog annotation: Hit_ID=Q1S3I6; Match level="QueryCoverage=55%, HitCoverage=6%, E-value=4e-21, Identity=47%"; Hit description =Integrase, catalytic region
MMTTIIIHIYNTNGGGDDGMPMLTMVMNGGCGGEDDNGEMVACDNNNGVQHLSQFVAALTSAHQQDVVRILRVDFHKPVTLYCDDKYDLHITSNPVFHERIKHIKIDCHIVREKVLRGLVKLLSIPSTNQLADVYTKAPMSGAFKFMHSKLGMSDIHS

SEQ ID NO: 210591 - protein, 186 aa, Glycine max
  Coding DNA Sequence Number=SeqID_93813
  Gene Ontology: Mol. function=transaminase activity; Biological process=metabolic process
  Homolog annotation: Hit_ID=Q1STG7; Match level="QueryCoverage=93%, HitCoverage=27%, E-value=7e-60, Identity=66%"; Hit description =Aminotransferase, class IV
ATLRGLCNDLEIPFQPGMLKWEAGPKSIDGLWAPWWYKSVHKSTGFEKPRKYPQPFPFSLYDLLEQSLPLYNMLRRHVKKKSSLLSPPLPNPDLPVPANGKLLAWVGDEILPRDSAKVINCMTLKSLLYAVDRAKLQSYTDSHVVQGGDSVWEGLRVYNGKIFKLEEHLDRIYFSFPIEHPYLLKS

SEQ ID NO: 210592 - protein, 115 aa, Glycine max
  Coding DNA Sequence Number=SeqID_93814
MKSSQRGSAYSWTVPVEDVLDCCKGFTSNNLCSICGSHAETTEVHLLRDCSFATKLWNYLTKGRLPRDFFSEIGWATPEEGWVKGMGQLEWVVTKSHVGKFSEMRMIYELGRVPN

SEQ ID NO: 210593 - protein, 313 aa, Glycine max
  Coding DNA Sequence Number=SeqID_93815
  Gene Ontology: Mol. function=transcription regulator activity; Cellular component=nucleus; Biological process=regulation of transcription
  Homolog annotation: Hit_ID=Q1RUX8; Match level="QueryCoverage=99%, HitCoverage=96%, E-value=1e-103, Identity=65%"; Hit description =Helix-loop-helix DNA-binding domain, putative
  Pfam annotation: Domain name=HLH; Domain location=119-170; Score =60.0; E_value=7.6e-15; Accession=PF00010.16; Description=Helix-loop -helix DNA-binding domain
MALEAVVYPQPQDPFGYGIKDPSYNYNNLLEGGGGNWGFEKEEQGFVTFLENQTENYPYGEWNCSPSPPSMLPHLNASNPQSSETSNIHNNLDSSISTPARPKRRRTKSRKNKEEIENQRMTHIAVERNRRKQMNEYLSVLRSLMPESYVQRGDQASIIGGAINFVKELEQRLQFLGGQKEKEEKSDVPFSEFFSFPQYSTSAGGGCDNSTAMSEQKCEAQSGIADIEVTMVESHANLKIRSKKRPKQLLKIVSSLHGMRLTILHLNVTTTGEIVLYSLSVKVEEDCKLGSVDEIAAAVYQMLDRIQQESILN

SEQ ID NO: 210594 - protein, 940 aa, Glycine max
  Coding DNA Sequence Number=SeqID_93816
MSSFLFDTAIGMSGIDSGALVELPMMDWEVISIGSSLSQDTHRGASDSESSSPERVRVLCRIGGGTSRPRGIVRPSTTSREPILVIVILPPSTFGGVKRGCGNGDVRDDVLKYKSSLTSTTSFAALQRQVKLEIPEDSCKLAVQAYESDDFPFLRATSGLILSLTAFQCALLEHLNVAPSQLQPNNWAMVRAFEILYHFFNIWPSVPVFLFFFQMKLTGKINWVSLINVSNKLFEFDSNVFCRFKDRFFKVLATGVVADGLPLMINKDGEPYFLFYQKYEPTRFKSFDEDLLTFAVRVDKAILEPKLTLACAVVAYFAGIMGDFTWRSLMKQVRPAGETVPPSTTALVVGEGVTPGASSFVLPKRKWDDGSGSFGCKKSKSPMSLRALRQVAGLTPDVGRPSVVQDVSLAPATVEAPTAIVSTHVTHAPSPPADVPIQEVIPVVAVNVPATLAAEVAKWKVTACTVWIVKRPKVANATIAFAEVVRSNRQLSSKVFSVLAKLLCLRLDGDQLFARCKSLQEEKKDLAKKVEGIAAERNELAKVVANLEAWLKESESKLEDSELWAAREREANKEVEEELLVYKKKAMKQHERGFKKTVRQAGLFAKDLALGLFDPFKDMKDGVFLDKEEIATKEEAALKQDLVDVEEELWWCCKRWMTRNNLRFEFNLVKGLVTHLLRLASALWSFSPNAYKESKYELHLIEGLVTQFGDRSMYQGRTMGFGGVRTKVPVEMELSNRKLTKGEPWRMFCAFANMSLAMGAMTRQGRTMGFMSLFGGSTKKLFVLGFVRRALAYMSLVMGGTHSSVFVPTCHSLWVACTGDLMLEGGLTKGSPSVLRVVELQLWMFLLDKRNVKRKRLVVTLNGPSQLGSSFPARGSFLASPQTHHSSLAASSLILTVSRTSSVVSSSTLILSSCCGWNNNLLVDDSLTSMGIMVSVSYVI

SEQ ID NO: 210595 - protein, 119 aa, Glycine max
  Coding DNA Sequence Number=SeqID_93817
MWEESICGNDKKAVYQHIVKSDFDINAIGWQASSGMSSYSRSLNSSKNFGVGKPVGHHYIHYCITKGKTAAAKVLIMRMPNIYRGDNTYVTDKEGKIPVKLASESGCVDNEIIALLTSR

SEQ ID NO: 210596 - protein, 93 aa, Glycine max
  Coding DNA Sequence Number=SeqID_93818
MAIFSQHNTSVDHTTSANIERSTPLPTPIVLTTTSNKGIELILIEGHEEEYKKDEYPIIHKETIRSDFLKERSGIFRASPPKDRKVLLVGLLV

SEQ ID NO: 210597 - protein, 85 aa, Glycine max
  Coding DNA Sequence Number=SeqID_93819
MSEIQLRRTGEPRIEKSGPLRHRDLDITSKTSSSKSWSLSKSNMLQSWPYWMPNFQLPIKVNTIEKQIEGAQFFSPFSSVVEKAS

SEQ ID NO: 210598 - protein, 175 aa, Glycine max
  Coding DNA Sequence Number=SeqID_93820
MVLSVNSRGVRAFTAEAHKVVVWFGKSGCSYETYATSTKVADEGSVSKARENLNKHVQVANKHSYGQIHRDRYHQSSNSIMRSYKDKTGEDGSNQHRRSFSVSIKLLSANKSSSSTSSVSGSTLFSFSNKSYGCQARQLFEKVQQCKFRDRKFNPGSNCTLQEVSGNVFFKEDCK

SEQ ID NO: 210599 - protein, 91 aa, Glycine max
  Coding DNA Sequence Number=SeqID_93821
MTTISYLCSSPGLHFYIVILVEEHTKAVIFISKLCECREEKVEEDTKAMIFIYKKLRFLSQTVVVMAGILDRKSADSSDRVADNQEAAKLE

SEQ ID NO: 210600 - protein, 411 aa, Glycine max
  Coding DNA Sequence Number=SeqID_93822
  Gene Ontology: Mol. function=signal recognition particle binding; Cellular component=signal recognition particle, endoplasmic reticulum targeting; Biological process=electron transport
  Homolog annotation: Hit_ID=Q9FH46; Match level="QueryCoverage=91%, HitCoverage=57%, E-value=1e-127, Identity=62%"; Hit description =Signal recognition particle 68kD protein-like
MEKRQLPNGPNARQRIYLIGRLRKAVKWATLFSLLCAVKADSRTSLEAEVVNLEKKAYESYMKGSLLFEQDQNWDVALKNFKSASIPAFGMFMFFLLTLLEFLTMSLFNRAVYEELGKYGDLDNQVLCRERVEELEPSIRYCLHKIGQSNLQASELLQIGDVEGPALDLFKAKLEAAMAEARSQQAASMTEFIWLGHRFPISNAKTRVSILKSQELEKDVHGPLADSIPADKRLVIFDKIFSAYHEARGYIRADLATTGSTESVKDDLNGLDKAVSAVLGERTIERNLLLVKVAKSKLANRHDDKNEKLTKPEELVRLYDLLLQNTADLSDLVNSGRDKKPEEVSFAEVCSYKSLAFRAQSLCGISTQHTHLMSRIEHFECGDCRPHFFMYIYYTGKLSGDPWSKVHFSTT

SEQ ID NO: 210601 - protein, 76 aa, Glycine max
  Coding DNA Sequence Number=SeqID_93823
MGASGLMGWVVPDDTSWEDWDQLRSDYHLEDKVFLQVTGNDSNLGVQSEVNQQEVHIVRSKLKRNNNTPAYLKDFI

SEQ ID NO: 210602 - protein, 150 aa, Glycine max
  Coding DNA Sequence Number=SeqID_93824
MEVHEEGNVLDGDGNSLTKEVALKVLAIFEHDAQRESEVLVTIDKGRGGRGAWARLPEQASTSFSSCSFAKPAACTNIRGWWAWTSLRISGVHPKIKQLKRNDGEGTGGILVLRQGEPSQQRLKEDWPGDELTITGHPLEPSQGVPLHVK

SEQ ID NO: 210603 - protein, 356 aa, Glycine max
  Coding DNA Sequence Number=SeqID_93825
  Gene Ontology: Mol. function=RNA-directed DNA polymerase activity; Cellular component=integral to membrane; Biological process=RNA -dependent DNA replication
  Homolog annotation: Hit_ID=Q8H7X6; Match level="QueryCoverage=37%, HitCoverage=12%, E-value=1e-35, Identity=58%"; Hit description =Putative retroelement
  Pfam annotation: Domain name=LRR_1; Domain location=260-282; Score =3.9; E_value=52; Accession=PF00560.23; Description=Leucine Rich Repeat
  Pfam annotation: Domain name=LRR_1; Domain location=284-306; Score =18.2; E_value=0.03; Accession=PF00560.23; Description=Leucine Rich Repeat
  Pfam annotation: Domain name=LRR_1; Domain location=308-330; Score =16.8; E_value=0.078; Accession=PF00560.23; Description=Leucine Rich Repeat
  Pfam module annotation: Pfam domain module=LRR_1::LRR_1::LRR_1; Domain location=260-282::284-306::308-330
MTFFHIGHLVEFQGTTDPASVILTLPQGASACFHIAITPSELPSNDYEEPSFPPQVQHLLTQFTTLFEEPHSLPPSRLTDHHIHLHPNSGPVNVQPYRYPHYQKLEIESQVASMLQNKIIQPSTSPFSSPVLLVRKHDGSWHFYVDYRALNSIMIKDFFPIPTIDELLDELGGANHDLGDEGDAFEINPEVLWSISNCGKDWAAPTGGVAASARDRRRQSTLGDTTDHIGFTTCDGLPSIQMGGSGPMGLETEMVKILTIFTSIDFSSNHFEGPIPEDLMDFKTLHVLNLSNNALSGEIPSSIGNLNQLESLDLSQNSLSGEIPMSLASNDKLYDLPLIEKIDGKESGVLPQQECE

SEQ ID NO: 210604 - protein, 121 aa, Glycine max
  Coding DNA Sequence Number=SeqID_93826
  Homolog annotation: Hit_ID=Q1SAV4; Match level="QueryCoverage=46%, HitCoverage=14%, E-value=2e-07, Identity=47%"; Hit description =Integrase, catalytic region
MEGSPSHVVNPIWSVASPGVDCLWRSRAEAVVPHWSELREMVSVKNSERWDEFLPLQGLSWGGDEYGDKLVKRGAGSVVPRRGWRIGSGGVELGAGRKVPHNHLKGLQPLHTQDNVDTVQR

SEQ ID NO: 210605 - protein, 102 aa, Glycine max
  Coding DNA Sequence Number=SeqID_93827
MGYTLNPTFFKHTQIGIQREPIFQEGMGYKRKRLSSDISEDSTDFNNITKLLRRNSDILKAHIGTQNINYQLARDQQKQQTDIIVAALGKLTDALTKIADKL

SEQ ID NO: 210606 - protein, 120 aa, Glycine max
  Coding DNA Sequence Number=SeqID_93828
MVVDQQYDSQDLRTRKEGTGGILVLRRGKPSMQCLKADCPGGEMTITGHPLEPGQGVPIHVKRGDRQAVLPGCGIVIKELVDLEDSTSGFNSIKPRNIEFQAVQVGGRDRRKGVGIGWKW

SEQ ID NO: 210607 - protein, 117 aa, Glycine max
  Coding DNA Sequence Number=SeqID_93829
MVPYQIPSTYHSQPHQKHLVLKVLGFNAWLQKVIPGSQGHEGAVGMGSGGSMDGGGGMGDGVGMGDGVGMGDGGSMGGGVDMSGKVSMNHRVDMSEVDMMAAGAYTGTEDENCGVGL

SEQ ID NO: 210608 - protein, 68 aa, Glycine max
  Coding DNA Sequence Number=SeqID_93830
MLSGLKSRNAVIDEWTKLRWKTIQDGLGMFDEWMMTYIGPGKCGIVEYAPIKRDDETKKDMVEDYLEG

SEQ ID NO: 210609 - protein, 284 aa, Glycine max
  Coding DNA Sequence Number=SeqID_93831
  Gene Ontology: Mol. function=DNA binding; Cellular component=nucleus; Biological process=regulation of transcription
  Homolog annotation: Hit_ID=Q5QMP4; Match level="QueryCoverage=70%, HitCoverage=62%, E-value=2e-96, Identity=80%"; Hit description=No apical meristem (NAM) protein-like
  Pfam annotation: Domain name=NAM; Domain location=49-190; Score =205.2; E_value=1.5e-58; Accession=PF02365.6; Description=No apical meristem (NAM) protein
MTQCSDSENNHHNIIVEGRKDSLIRTCPTCGHHIKCQDQGGGIHDLPGLPAGVKFDPTDQEILEHLEAKVRSDIHKLHPLIDEFIPTLEGENGICYTHPEKLPGVSKDGLIRHFFHRPSKAYTTGTRKRRKVHSDEDGSETRWHKTGKTRPVYNNAKLKGYKKILVLYTNYGKQRKPEKTNWVMHQYHLGSDEEEKEGELVVSKVFYQTQPRQCGSLMKDSSVPGKHMKGQSVHEVMNNKNNNNGYVGYYHSNFISFEQGGQHRPSNAQVISHIPFHEGAPFIP

SEQ ID NO: 210610 - protein, 180 aa, Glycine max
  Coding DNA Sequence Number=SeqID_93832
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=75%, HitCoverage=15%, E-value=8e-36, Identity=37%"; Hit description =Prefoldin
MLSLAQLDAKEFDEKASEAEIEAKILRQELGQLEAQKDVGFLIYKQCVENISVLEAKITLVEENSRMLIKALRKNLAELNGEKESLAVLYHQCLENEILLAQQNSEKLNREIEKGAEKLKTAEEHCHTLEKSNQSLRLEAENLLQRIAMKDQALLEKTTDLPHNIKMIARILISIKAKRK

SEQ ID NO: 210611 - protein, 43 aa, Glycine max
  Coding DNA Sequence Number=SeqID_93833
MVVGVHYLLPYSKSKRDFVSRVVEFRSNYAQFGDPRKVCFPWN

SEQ ID NO: 210612 - protein, 74 aa, Glycine max
  Coding DNA Sequence Number=SeqID_93834
  Gene Ontology: Mol. function=hydrolase activity, acting on ester bonds; Biological process=lipid metabolic process
  Homolog annotation: Hit_ID=Q1SQA1; Match level="QueryCoverage=93%, HitCoverage=19%, E-value=3e-17, Identity=54%"; Hit description =Lipolytic enzyme, G-D-S-L
MTCFTVANASCCPSSRTNGLCIPNQTPCENRTTYVFWDQFHPTEAANRIIAINSYNGSDPALTYPMDIKHLVQT

SEQ ID NO: 210613 - protein, 292 aa, Glycine max
  Coding DNA Sequence Number=SeqID_93835
  Gene Ontology: Mol. function=transferase activity, transferring groups other than amino-acyl groups; Cellular component =mitochondrial inner membrane; Biological process=protocatechuate catabolic process
  Homolog annotation: Hit_ID=Q1R0U4; Match level="QueryCoverage=97%, HitCoverage=71%, E-value=5e-82, Identity=56%"; Hit description=Beta -ketoadipyl CoA thiolase
  Pfam annotation: Domain name=Thiolase_N; Domain location=6-272; Score= 350.3; E_value=3.2e-102; Accession=PF00108.13; Description=Thiolase, N-terminal domain
MMSINDDGVYLIDGTRTAIGAYGGSLAHTRPDDMAATIIRSLLQRNPAAEAKLDEVVLGCANQAGEDNRNVARMAALLSGLDPSVPAITLNRLCASGLDAVIYAAAKIRSGLSELILAGGVESMSRAPYVLSKGDTPFDKGVKLYDTTLGWRFVNPRLAERYGSDPLGITAENVAQRQHISREEQDLFALASQQKARRAIDSGRLAREITPVDVPADRKTTRTFAQDEFPRLSTLQQLQALKPAFSAGGSVTAGNASGINDGAAALLLASGRYVKRQGWQPLAEIGDSAAAG

SEQ ID NO: 210614 - protein, 215 aa, Glycine max
  Coding DNA Sequence Number=SeqID_93836
  Gene Ontology: Mol. function=transferase activity, transferring nitrogenous groups; Cellular component=mitochondrion; Biological process=tetrapyrrole biosynthetic process
  Homolog annotation: Hit_ID=Q0APF5; Match level="QueryCoverage=95%, HitCoverage=50%, E-value=9e-39, Identity=42%"; Hit description=5 -aminolevulinic acid synthase
  Pfam annotation: Domain name=Aminotran_1_2; Domain location=1-202; Score=-22.0; E_value=2.9e-06; Accession=PF00155.11; Description =Aminotransferase class I and II
MDGDFAPLAQIVALAEQYQALTYLDEIHSAGVYGERGLGYAEQLGLLDKITIIQGGFGKSYGAAGGYIAAPRSVVEAVRSWAPAFVFSTSSPAPVVAAALASFKYNLEHDTQRKHLLAIVDHLKTGLRSAGIPLVSADSHILPLRVGDPHRNKHISKVLLDEHDIYVQPVNAPTVPAGSERLRVTPTSAHSHADVETFLAALGRVWAANDLRRAG

SEQ ID NO: 210615 - protein, 84 aa, Glycine max
  Coding DNA Sequence Number=SeqID_93837
MAFLGETSSQTVVNSTLGNEFWFQCMQLKDDVDVNTMLMCNHEFSFIGPIELLCSIARTSDGILNLLQATMTPTHDALLYYKGR

SEQ ID NO: 210616 - protein, 128 aa, Glycine max
  Coding DNA Sequence Number=SeqID_93838
  Gene Ontology: Mol. function=DNA binding; Cellular component =mitochondrion; Biological process=DNA integration
  Homolog annotation: Hit_ID=Q1SKN1; Match level="QueryCoverage=96%, HitCoverage=9%, E-value=3e-32, Identity=55%"; Hit description =Integrase, catalytic region
NSLISWKAKKQKTVSKSSSEAEYRALSSVSSELTWLRNDLNIKTSFAVVYCDNKAVIHIATNPTYHERTKHLEIDLYYVREQVGKGALKLIHVRKHHQLANVFTKSLPRSTFLSIISKLGIENIFLPS

SEQ ID NO: 210617 - protein, 185 aa, Glycine max
  Coding DNA Sequence Number=SeqID_93839
  Homolog annotation: Hit_ID=Q1SKD7; Match level="QueryCoverage=96%, HitCoverage=50%, E-value=1e-07, Identity=25%"; Hit description =Ankyrin
MASKKRKAPSTPTQARYDRSRKLLPEKNVVVYYTEFDEFKEELKRRHWDEKLIDFANSSINITIVKEFYANLYDPEDKSPKQVRVRGHLVKFDEDTLNTFLKTPTILEEGENLSTYSRFALLRPDPQELAAKLCIPGRGFKINVDGQPLKILRKNMTTLAQTWSVLSFSNLIPTSHTSNVTLDRA

SEQ ID NO: 210618 - protein, 43 aa, Glycine max
  Coding DNA Sequence Number=SeqID_93840
MRKLIKERIENKVVNFVGLNKVKWWLDRNIEMAITEATGLQMR

SEQ ID NO: 210619 - protein, 388 aa, Glycine max
  Coding DNA Sequence Number=SeqID_93841
  Gene Ontology: Mol. function=carbohydrate binding; Cellular component= membrane; Biological process=transport
  Homolog annotation: Hit_ID=Q1XS93; Match level="QueryCoverage=94%, HitCoverage=40%, E-value=6e-19, Identity=22%"; Hit description=OmpA -related protein precursor
  Subcellular localization annotation: CTP_CleavageSite=80; ConfidenceScore=5.05e-01
MTAKNPTSAGSTTSRSGAPYSISIEAVREFKITTNQYDVTLGRSGGGTVSAVTKSGTNTFTGSAWEYLRTGWLSSKYDIRGNERVNDFSTSQFGVLNIGRAKYGVGNTPQFGSFDKVRNSDAGFLRLDWQINPKNLLTLRNNFTYDFNKNGLADNTAINFFESYGNDKNLDNSLLLTLRSNLKSNLTNELKAQYLYTYQNSYQNNQLGHAVPRAIVERVPSTIDGKDLTTNIQIGGHRFGQESFRNNVFQIVDNLYYNTDKIKYTAGIDLMYTKSKSIYGSEVNGRFQFLGIDNFNNLTPYRFYREVPLMDDPSVKSNIWNVGVYGQIQTKIAKGLDLMAGLRLDYGGYPKAELNQKLYDQMGIRTDNRIKSFVIQPRFHFDWNINEE

SEQ ID NO: 210620 - protein, 70 aa, Glycine max
  Coding DNA Sequence Number=SeqID_93842
  Subcellular localization annotation: CTP_CleavageSite=30; ConfidenceScore=5.28e-01
QAYPATTVGGILSPKPIPQPLLAGSSLPCPATTVGGTALSYPAISKGGTLLSPVLPHPAIAAGGTPPPLS

SEQ ID NO: 210621 - protein, 306 aa, Glycine max
  Coding DNA Sequence Number=SeqID_93843
  Subcellular localization annotation: CTP_CleavageSite=40; ConfidenceScore=5.43e-01
MTTPPPSPTQAEIPSDGTSRKTRQATRLRRLTTRTLEQARATVNVNPATGTGSGPHKDQFHSYLGVVARDKIPIVHASWNDVPETLKNMIWDNILAKFDIPEGDNAKKKVMSTVATRWRQFKLALTTKYVYGNTDGQAKDEPLVKYGINEKDWAEFAKMRQTPTWQDSLEEQSRQGSIVPSGRDDILNMAIGRPEHPGRVRGAGIGVTIMQYFGPASRRSTTSSNITVEQLADIIGNLKEEWQRQVEQENIKREEVWMRRVEEEKQRTMDTFKGQIQEAIKLELSQIASQHSAPLQPNDIQVLAAR

SEQ ID NO: 210622 - protein, 204 aa, Glycine max
  Coding DNA Sequence Number=SeqID_93844
  Gene Ontology: Mol. function=protein serine/threonine kinase activity; Cellular component=integral to membrane; Biological process=protein amino acid phosphorylation
  Homolog annotation: Hit_ID=Q9FUU9; Match level="QueryCoverage=97%, HitCoverage=22%, E-value=5e-36, Identity=42%"; Hit description=Leaf senescence-associated receptor-like protein kinase
  Pfam annotation: Domain name=Pkinase_Tyr; Domain location=103-199; Score=-147.2; E_value=0.0019; Accession=PF07714.7; Description =Protein tyrosine kinase
MNDASLDQNPNLCESDPCIQQTNNKQPDGDQQKNKNNIVIPVVSSVAGVLVLLIIVAAAIICGLKRKKPQASDVNIYVETNTPNGSQFASKQRQYTFNELVKITNDFTRILGRGGFGKVYHGFIDDTQVAVKMLSPSAVKLLMRVHHRNLTSLVGYCNEENNIGLIYEYMANGNLDEIVSGKSSRAKFLTWEDRLQIALDAAQG

SEQ ID NO: 210623 - protein, 263 aa, Glycine max
  Coding DNA Sequence Number=SeqID_93845
  Gene Ontology: Mol. function=DNA binding; Cellular component=nucleus; Biological process=regulation of transcription
  Homolog annotation: Hit_ID=Q67UM4; Match level="QueryCoverage=48%, HitCoverage=40%, E-value=3e-28, Identity=45%"; Hit description=Gt-2 -related-like
MAQDSEKICEGASESAITPVIGTQAPESEPKSTPTTQRIKATRHPRWTRQETLVLIESKKMVESGEQVCRFRSASGYVQTDPKWDMVSSLCQQRGVKRGAVQCRKRWGNLLTDFRKIKKWESSVREESESFWIMRNDVRKEKKLPGFFDSVVYNVLDGGVCTTVAFPLTLVKMAPNKVEILDGEKMGWSTEEENMETNITGNMINGFPKTPKKGSLKRTPILTLPTPEKVQQQPSYQGNYDPGKSNQLTFAVHILCVGYYPVH

SEQ ID NO: 210624 - protein, 456 aa, Glycine max
  Coding DNA Sequence Number=SeqID_93846
  Gene Ontology: Mol. function=metal ion binding; Biological process =metal ion transport
  Homolog annotation: Hit_ID=Q1ST83; Match level="QueryCoverage=54%, HitCoverage=48%, E-value=3e-55, Identity=48%"; Hit description=Heavy metal transport/detoxification protein
  Pfam annotation: Domain name=HMA; Domain location=13-73; Score=52.7; E_value=1.3e-12; Accession=PF00403.16; Description=Heavy-metal -associated domain
MSKQDFLKVQSCVLKVNIHCDGCEQKVKKLLQKIDGVYSVRIDADEGKVVVAGDVDPAKLVKKLKRGGKHAEIWQNQKGEMMYNHKYPINQNMMQLGGKDNNKSQNQKGQKEKGAGGVGQLAHFPNIKGIQDLKVPAKEQKSVKFNLPEDEFDASDDGFDEYDDNFDEYDEEGLSHGHPLNQKKMMPMMGDGRGPHGPPAMMNGPAINHNHKGNSGGSSVKKADVIDQAMMFKGKGGNFNEAYGGKKGSSNQKVEKKKGDDHKKKNGLLGRFLGFGKKKSKKGELEEATNTNNSKNGGENKKGKEGKKGEGKLEDHANNDFDFHDYGHTLTHPKNNVKEGQMGPGPIMGHQMKNIPSVQGLPAMNDDGGYYQGVQMQHAPYNNLQQQHYMGMMMNQQQHQHQQANLNNNMYPTSMMYGRSHPSMNYMPPPPMPSHPMADPITHTFSDENVESCSIM

SEQ ID NO: 210625 - protein, 122 aa, Glycine max
  Coding DNA Sequence Number=SeqID_93847
  Gene Ontology: Mol. function=signal peptidase activity; Cellular component=signal peptidase complex; Biological process=signal peptide processing
  Homolog annotation: Hit_ID=Q2HTM7; Match level="QueryCoverage=99%, HitCoverage=85%, E-value=4e-56, Identity=74%"; Hit description =Signal peptidase 22 kDa subunit
  Pfam annotation: Domain name=SPC22; Domain location=1-122; Score =148.6; E_value=1.6e-41; Accession=PF04573.3; Description=Signal peptidase subunit
MASVSDNFNTPTPSAQVQVLNINWFQKQPNGNDEVFVFLAAEYETPKNSLNQISLWDGIIPSKEHAKFWIHTSNKYRFIDQGSNLRGKEYNLTMHWHVMPKTGKMFADKIVMPGYRLPQEYR

SEQ ID NO: 210626 - protein, 92 aa, Glycine max
  Coding DNA Sequence Number=SeqID_93848
PLLFLILSLSLTLKTYTSTKLSDSTTEPNRPHGLKGLEAEDLPVRPGPCLKKIRLFVAQLSRSAYQIGVLANLFGVWSKRFTTHWLAILMSI

SEQ ID NO: 210627 - protein, 80 aa, Glycine max
  Coding DNA Sequence Number=SeqID_93849
  Gene Ontology: Cellular component=integral to membrane
  Homolog annotation: Hit_ID=Q2HTM6; Match level="QueryCoverage=67%, HitCoverage=13%, E-value=9e-22, Identity=85%"; Hit description =Sodium/calcium exchanger membrane region
MLVNVESSLAEISKTWELPVKTLMRLTIPQPAPSQWSRFYAWANIALCPLALLYACNSFMPFNHPIGSHGAGMGKFSGRS

SEQ ID NO: 210628 - protein, 48 aa, Glycine max
  Coding DNA Sequence Number=SeqID_93850
MGSALDAVIECFLIWGLLELRRGLEETFQNAWDSLCARFSIDSVLHLY

SEQ ID NO: 210629 - protein, 66 aa, Glycine max
  Coding DNA Sequence Number=SeqID_93851
MEKVVVAGSVSSSQKRKDPNQKKLCHRVCLPFMTILYQCQNHQKIDGVPTEKAAERIWRNAPVDKA

SEQ ID NO: 210630 - protein, 43 aa, Glycine max
  Coding DNA Sequence Number=SeqID_93852
MILVQQILQQREREKNNQAPESVVNVKLNGWEDPYYIASRSCS

SEQ ID NO: 210631 - protein, 376 aa, Glycine max
  Coding DNA Sequence Number=SeqID_93853
  Gene Ontology: Mol. function=phosphotransferase activity, alcohol group as acceptor; Cellular component=cytoplasm; Biological process =isoprenoid biosynthetic process
  Homolog annotation: Hit_ID=Q2HTL9; Match level="QueryCoverage=92%, HitCoverage=90%, E-value=1e-144, Identity=75%"; Hit description =Mevalonate kinase/phosphomevalonate kinase
  Pfam annotation: Domain name=GHMP_kinases_N; Domain location=127-209; Score=54.5; E_value=3.6e-13; Accession=PF00288.16; Description=GHMP kinases N terminal domain
MEVKSRAPGKIILSGEHAVVHGSTAVASSIDLYTYVSLRFSTPSDDQDSLKLQLKETALEFSWPITRIRASFPQLSSTPTSCSVENAKAIAALVQDLNIPEANFGLASGVSAFLWLYSSIQGFKPATVLVTSELPLGSGLGSSASFCVALAAALLAYTDSVSFHVNHQGWLSFGEKDLELVNQWAFEGEKIIHGKPSGIDNTLPPLSGNIISFKLGSLTHMKSSVPLKMLITNTKVGRNTKALVAGVGERMLRHPDIMAFVFSAVDSLSNELTSILKSPTPDELSVTEKEQKIEELMEMNEGLLQSMGVSHATIQTVLQTTLKYKLASKLTGAGGGGCVLTLLPTCILFTYCSLPCASNVPLHLWFSSFLFGLHGR

SEQ ID NO: 210632 - protein, 418 aa, Glycine max
  Coding DNA Sequence Number=SeqID_93854
  Gene Ontology: Mol. function=nucleic acid binding; Cellular component= spliceosome; Biological process=mRNA processing
  Homolog annotation: Hit_ID=Q6ZK57; Match level="QueryCoverage=99%, HitCoverage=75%, E-value=2e-78, Identity=42%"; Hit description =Putative RNA recognition motif (RRM)-containing protein
  Pfam annotation: Domain name=RRM_1; Domain location=338-406; Score =23.1; E_value=0.001; Accession=PF00076.12; Description=RNA recognition motif. (a.k.a. RRM, R
  Pfam annotation: Domain name=zf-CCCH; Domain location=184-209; Score =22.0; E_value=0.0016; Accession=PF00642.15; Description=Zinc finger C-x8-C-x5-C-x3-H type (and similar)
  Pfam module annotation: Pfam domain module=RRM_1::zf-CCCH; Domain location=338-406::184-209
MDISEYTRIVFDKLHRFEPENATKIIGYLLLQDHGEQDMVKLASLPDHLIRDVAYKARTELQRLASRSAIQPISLPTNSQQCLSHLSVISPTSVITPGTLTSPASFQVQSPYWDPQSASNTNAEFMALGYVDSISELQKQTPLFSLENHMDTMNSGTAGIANDYYGLDASSASNLGGKNGRFEFPVKTCHYFNKGFCKHGNSCRYYHEQGAPDMFSHMYGNDIFNDDQVISPGSLAQLESEIVELLKLKKGGSISIASLPMAYYDRYKKVLQADGYLTESQRHGKSGYSLTKLLARLKNSIRLIDRPHGQHSVVLAEDAPKFNGKVDYAKYISASRQIYLTFPADSTFSEGDVSNYFSTFGKVEDVRIPSQERRMFGFVTFDDPETVKVILDKGNPHYVCESRVLVKPYKEKPKLMLR

SEQ ID NO: 210633 - protein, 103 aa, Glycine max
  Coding DNA Sequence Number=SeqID_93855
MKTLMKHILDFKETRRGLVIIIDNCSEVMSISRSQVGCLLLILLSISVLNHQVLGARYVKEEVEHLLNKSAVWRKSFTNETKGDFYGTVNRVVPSSPDPLHNR

SEQ ID NO: 210634 - protein, 168 aa, Glycine max
  Coding DNA Sequence Number=SeqID_93856
  Gene Ontology: Mol. function=binding
MNPVDWEQELKKYEDVIASGTNCMKIKAMVMLTRLSKHAPEDVLARTIPILTEILGHNVSNDSAPTLQEAAAYCLKCIACRGDGELAVEIGGHGATRSLMRLLPHSEGRMQKVLTKCMLVIVSFCNASRTVVATNGGVELIIGLLSSCTEDTRRYLLEILRALALRRD

SEQ ID NO: 210635 - protein, 248 aa, Glycine max
  Coding DNA Sequence Number=SeqID_93857
  Gene Ontology: Cellular component=integral to membrane
  Homolog annotation: Hit_ID=Q9AX74; Match level="QueryCoverage=85%, HitCoverage=72%, E-value=1e-98, Identity=78%"; Hit description =Putative integral membrane Yip1 family protein
  Pfam annotation: Domain name=Yip1; Domain location=59-224; Score =209.6; E_value=7.1e-60; Accession=PF04893.7; Description=Yip1 domain
MARVIMFNYFSWISVLHVCVELSRSFYADSFSKPVSGSDEPQQGGWFQTFTIAAYKPYFDVDTSDVLERIIDSLFPFRGSFNEKTATNPDLYGPFWICTTLIFVAASIGTFVTYVAHKLKSKEWDYDINLVTWSAGLFYGYVTIVPLCLYVILKYFSAPAGLVQLFCLYGYSLFVFIPALCMSVVPLDIFRWVVAGVAGFMSATFVALNLRAHIKSAGERWFLIVAGIFLLQLALAVVLKIYLFTVSV

SEQ ID NO: 210636 - protein, 1453 aa, Glycine max
  Coding DNA Sequence Number=SeqID_93858
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=98%, E-value=0.0, Identity=58%"; Hit description =Multidrug resistance-associated protein 3
  Pfam annotation: Domain name=ABC_membrane; Domain location=269-542; Score=51.5; E_value=2.8e-12; Accession=PF00664.13; Description=ABC transporter transmembrane region
  Pfam annotation: Domain name=ABC_membrane; Domain location=888-1162; Score=70.3; E_value=6.2e-18; Accession=PF00664.13; Description=ABC transporter transmembrane region
  Pfam annotation: Domain name=ABC_tran; Domain location=1234-1417; Score=163.4; E_value=5.9e-46; Accession=PF00005.17; Description=ABC transporter
  Pfam annotation: Domain name=ABC_tran; Domain location=616-787; Score= 152.6; E_value=1e-42; Accession=PF00005.17; Description=ABC transporter
  Pfam annotation: Domain name=Dynamin_N; Domain location=619-771; Score=-44.3; E_value=0.067; Accession=PF00350.13; Description =Dynamin family
  Pfam annotation: Domain name=MMR_HSR1; Domain location=1235-1321; Score=-16.0; E_value=0.029; Accession=PF01926.13; Description=GTPase of unknown function
  Pfam annotation: Domain name=SMC_N; Domain location=602-790; Score= -127.7; E_value=0.029; Accession=PF02463.9; Description=RecFRecNSMC N terminal domain
  Pfam module annotation: Pfam domain module=ABC_membrane::ABC _membrane::ABC_tran::ABC_tran::Dynamin_N::MMR_HSR1::SMC_N; Domain location=269-542::888-1162::1234-1417::616-787::619-771::1235 -1321::602-790
MFFLFSHYYSSMMHHGTDFLLQPIFTRGVSASLNLVLLLVLVVYWVWKKVQVDHREKSERKGFRNAGFLYYKHSLVCSLVICVFNLVLCLLSYFYLYNNYGSEELVTLTDLALKTIVWGAVCAYLHSRNSEAQDPSLPRSSITSLFLCYVGSLGCSVNSMAKLAPLEEPLLNGDSNVSNNSVPIKARGNENLTWYSNAGFFSILTFSWISPLITLGNEKTLEHEDLPHLATDDSVAGIFPTLRNKLESECGSVRNVTTLKLVKVLFLSTWQGILLSGLLEFLYSCASYVGPFLIDILVQYLNGEHKFKNEGYVLAMAFVAAKLLECVSQRHCMFRFQQVGVSVQSKLVAMIYAKGLTLSCQSKEVRSTGEIINLMTVDAERIGEFCWYMHDPWMCVLQVALALLILYRSVGVASIAALAATVTVMLLNLPLSSLQEKFQGKVMEFKDKRMKATSEILKNMRILKLQAWEMKFLSKVIQLRKTEEIWLHKFLAGTAIIRFLFTNAPTFIAVVTFGACVLMGIPLESGKVLSALATFRILQMPIYNLPDTISMITQTKVSLDRIASFLRLDELQTDVIEKIPWGSSDKAIELVDGNFSWDLSSPITTLKNINLKVFHGMRVAVCGTVGSGKSSLLSCIIGEVPKISGTLKICGTKAYVSQSPWIQGGKIEDNILFGKEMDREKYEKILEACSLTKDLEVLPFGDQTIIGEKGINLSGGQKQRVQIARALYQDADIYLFDDPFSAVDAHTGSHLFKECLLGILKSKTVIYITHQVEFLPDADLILVMRDGRITQSGNYNDILKTGTDFMALVGAHRAALSSIKSLERRPTFKTSSTTKEDTKSLSKIYDQKSDDTIEAKRQLVQEEKREKGRVGFNIYWKYITTAYGGALVPFILLSQTLTVGFQIASNCWMTVATPVSATAEPDIGSFTLMVVYVALAIGSSIFTFARAFLAVIAGYKTATVLFNKMHLCIFQAPISFFDATPSGRILNRASTDQSALDMKIANILWAITLNLVQLLGNVVVMSQAAWQVFIVLIPVTAACIWYQRYYSASARELARLVGTCQAPVIQHFSETISGSTTIRSFEQESRFNDINMKLIDRYSQPKLYSATAMAWLIFRLDILSTLTFAFCLVFLITFPNSMTAPGIAGLAVTYGLNLNAVQTKAILFLCNLENKIISVERMLQYTTLPSEAPFVIKDNQPDYSWPLFGEVHIRDLQVRYAPHLPIVLRGLTCTFTAGAKTGIVGRTGSGKSTLVQTLFRLIEPVAGEILIDNINISLIGIHDLRSRLSIIPQEPTMFEGTVRTNLDPLEEYTDEQIWEALDMCQLGDEVRRKEEKLDSIVMQNGENWSMGQRQLVCLGRVLLKKSKILVLDEATASVDTATDNIIQQTVTQHFSECTVITIAHRITSILESDMVLFLNQGLIEEYDSPKKLLKNKSSSLAQLVAEYTRRSNSGFGN

SEQ ID NO: 210637 - protein, 51 aa, Glycine max
  Coding DNA Sequence Number=SeqID_93859
MAVAWRKEQRRLSVCIRVQNRERTGAGVCQKYHWTEGGRVLVAQKREAWSK

SEQ ID NO: 210638 - protein, 124 aa, Glycine max
  Coding DNA Sequence Number=SeqID_93860
  Gene Ontology: Mol. function=ATPase activity, coupled to transmembrane movement of substances; Cellular component=integral to membrane; Biological process=transport
  Homolog annotation: Hit_ID=Q71CZ3; Match level="QueryCoverage=85%, HitCoverage=7%, E-value=3e-34, Identity=67%"; Hit description =Multidrug resistance associated protein MRP2
MLLNLPVASLQEKFQGKVMEFKDKRMKTTSEILMNMRILKLQAWEMKFLSKIIQLRKTEEIWLKKFLVGTAIVRFLFYNAPTFIAVVTFATCVLIGIPLESGKITEAKTDKRTKSKNSQLSRTK

SEQ ID NO: 210639 - protein, 271 aa, Glycine max
  Coding DNA Sequence Number=SeqID_93861
  Gene Ontology: Mol. function=binding; Cellular component=ubiquitin ligase complex; Biological process=protein ubiquitination
  Homolog annotation: Hit_ID=Q6ZC56; Match level="QueryCoverage=62%, HitCoverage=20%, E-value=6e-11, Identity=29%"; Hit description =Putative arm repeat-containing protein
  Pfam annotation: Domain name=Arm; Domain location=135-175; Score =26.7; E_value=8.2e-05; Accession=PF00514.13; Description =Armadillobeta-catenin-like repeat
  Pfam annotation: Domain name=Arm; Domain location=17-57; Score=20.7; E_value=0.0053; Accession=PF00514.13; Description=Armadillobeta -catenin-like repeat
  Pfam annotation: Domain name=Arm; Domain location=176-218; Score =17.9; E_value=0.037; Accession=PF00514.13; Description=Armadillobeta- catenin-like repeat
  Pfam annotation: Domain name=Arm; Domain location=58-98; Score=16.7; E_value=0.085; Accession=PF00514.13; Description=Armadillobeta -catenin-like repeat
  Pfam annotation: Domain name=HEAT; Domain location=140-177; Score =10.4; E_value=2.3; Accession=PF02985.12; Description=HEAT repeat
  Pfam annotation: Domain name=HEAT; Domain location=182-220; Score =6.8; E_value=6.4; Accession=PF02985.12; Description=HEAT repeat
  Pfam annotation: Domain name=HEAT; Domain location=22-59; Score=7.0; E_value=6; Accession=PF02985.12; Description=HEAT repeat
  Pfam module annotation: Pfam domain module=Arm::Arm::Arm::Arm::HEAT::H EAT::HEAT; Domain location=135-175::17-57::176-218::58-98::140 -177::182-220::22-59
MVSRERACQAIGLLGVTRQARRMLVELGAIPVLVAMFRDGDHATKLVAGNSLGVISAHVDYIRPVAQAGAIPLYAELLEGPDPSGKEIAEDVFCILAVAEANAVEIAGHLVRILREGDDEAKASAADVMWDLSGYKHTTSVVRDSGAIPILVELLGSGSEDVKVNVSGAFAQLSYDGTDRMALAEAGAVPILIDLMNDVDEVEELRDNAAEALVNYYVDPLYHDSVSDAINVPSFRNMQNRLTHIRASNEHMARSLRRMSVEQLTWNPDLA

SEQ ID NO: 210640 - protein, 165 aa, Glycine max
  Coding DNA Sequence Number=SeqID_93862
  Homolog annotation: Hit_ID=Q9AX74; Match level="QueryCoverage=36%, HitCoverage=20%, E-value=4e-10, Identity=53%"; Hit description =Putative integral membrane Yip1 family protein
  Subcellular localization annotation: CTP_CleavageSite=49; ConfidenceScore=5.15e-01
MMSGKYTSIDAQQLQGSVPAVPDSRPATVNFADSNLQTFPPSGPLGKITAASGPPRDADDCEIAQSHMLSSLLRAESLPGLFQSVIVIFHLKSWEHRSPMSQAGFVKTLNSSCVSHPFPFTICSSCSQASSPSFATAGPLSYTTTAAQGCHRLRLCLQTLFCELK

SEQ ID NO: 210641 - protein, 106 aa, Glycine max
  Coding DNA Sequence Number=SeqID_93863
MGYAHRPEIYPKAHENPRAFSCIFVPNLLGVFCPMPLGGRIASASLQAKKVFQIQFAKEEKVQVVDDSLSEADPLSEWHPLSEAYSSLSRFGTLNEKELEMCLPSA

SEQ ID NO: 210642 - protein, 103 aa, Glycine max
  Coding DNA Sequence Number=SeqID_93864
  Pfam annotation: Domain name=G-patch; Domain location=35-79; Score =19.8; E_value=0.00074; Accession=PF01585.13; Description=G-patch domain
MEAKEESLATAFQAFKVVSNAYVESPPVQPRSSGAMFMVARVMLGHGYEPDIGLGRNGDGVASLKEFTGNRGRLGLGYEPTHTNVRRISLERRGKSMGQSQGP

SEQ ID NO: 210643 - protein, 215 aa, Glycine max
  Coding DNA Sequence Number=SeqID_93865
MVLLRCVDAWEAEQMLVKVHEGSFGTHANGHAMARRILRAGYYWLTMENDWITPPRHPVDLEKSNRALGFPTLITGLFQFYGVSVTPAKLIRPSINRAFIEKYCVPRQAPQSGQAQQQQDEGQQQPTVDVPPSPLQETPFLESISTQVHRCMQHVTGQQADNHRGQPTPKQFGATVAWPGDEPNFKIGARPTGAPRDDEGAQEDDDMADVMDFFI

SEQ ID NO: 210644 - protein, 159 aa, Glycine max
  Coding DNA Sequence Number=SeqID_93866
MTEGCGEGFCLANLPGDAFSLWGNFFEAKKQMMADAKVGGAGLWPRAKFRIGWPPPPPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 210645 - protein, 130 aa, Glycine max
  Coding DNA Sequence Number=SeqID_93867
MLRNFTDCAIMFPFDSRHVAELNGLPNDGCQVPRSGQVKVASQQTDGSGLDGGGCMNSARQSIHGAPDLMVEDARTAQGNQFMGIRTQWWRMHEQRLAINSWGSRLDGGGCMNSARQSIHGAPDLMVENA

SEQ ID NO: 210646 - protein, 95 aa, Glycine max
  Coding DNA Sequence Number=SeqID_93868
MEVSVGLCRPDIGIAPIRHPVDPEEPNRALGFPTLVTGLCLSYRVPVPPSKGSRPQDTSGPKEVQQGLGVVSSDYGPLSVLRSASRPQQGHQEPY

SEQ ID NO: 210647 - protein, 111 aa, Glycine max
  Coding DNA Sequence Number=SeqID_93869
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-12, Identity=32%"; Hit description= UPI00006A17C9 related cluster
MSSPSEDYTSSKGLHTLAFGGLHVLAFRGLHVLAFQGLHVIAFGGLHVLAFRGLHVLTFRGLHALAFIGLRVLTFRALHVLAFRGLHVLAFRGLHAQTFRGLHALAFRGLH

SEQ ID NO: 210648 - protein, 553 aa, Glycine max
  Coding DNA Sequence Number=SeqID_93870
  Gene Ontology: Mol. function=transferase activity, transferring hexosyl groups; Biological process=carbohydrate biosynthetic process
  Homolog annotation: Hit_ID=UPI000034F48F; Match level="QueryCoverage =73%, HitCoverage=98%, E-value=1e-126, Identity=52%"; Hit description= transferase, transferring glycosyl groups
  Pfam annotation: Domain name=Glyco_transf_8; Domain location=267-473; Score=150.1; E_value=5.9e-42; Accession=PF01501.10; Description =Glycosyl transferase family 8
  Subcellular localization annotation: CTP_CleavageSite=33; ConfidenceScore=5.04e-01
MASNKSSPSRSHSRIKRFLICLVLMSLPLLFFVLSEKQKRVTKMLEVDPKPRPRPAWFDVIAKGIINNKKKIKVGLVNIDARVDGSIFEQLDTLDSQVDTISIDFDHVDKNLKWEDIFPEWIDENGKWGQPKCPNLPMPALQNYGDLNVVVAKVPCGIRDVFRLQVNLVVANLAVESGWVTKMESDHRKVHVVFVGSCGPMVEIFRCDDLLMHRPEYWVYRPDLRRLKHQTLMPLGSCQIAPGYAETGKEAWRIDVALTRVPKLAYVTVLHSSEAYVCGAIALAQSILGTQTMFIETDLVLLADNSIGPQSTTGLKAAGWKIKRIQRILSPFAKKGAYNQWNYSKLRMWQLTTYDKIIFIDSDLLVLRSIHHLFVLPQLSAAPNEKTLFNSGLMVIEPSQCMFRKMMNVTSKVRSYNGGDQGFLNEIFTWWHRLPAKVNQLKTFPSSGHGMHELPDDVYAVHYLGLKPWMCYRDYDCNWDMQDRHVFASDSAHRRWWQVYDAMPKELQAYCGLTEKMNERIVKWRRIARNASFSDGHWKIKVQDPRRGNYYSD

SEQ ID NO: 210649 - protein, 389 aa, Glycine max
  Coding DNA Sequence Number=SeqID_93871
  Homolog annotation: Hit_ID=Q6K3K4; Match level="QueryCoverage=99%, HitCoverage=96%, E-value=2e-61, Identity=43%"; Hit description =Putative microtubule-binding protein
MVARSPPKHNKMLAVLNRSLIRETLNKVDQCMVRLQELQYTVAGGNKVVSGVSLSPRSTRGYLRTSLRCKQESVRIKHDAPRRSPPGKFPKPTNSEGKEWRQMSLPSMLVGETVGEILKASQFASEIVSAVSRKTATKEPKTPQSQRSNQKVDTENTQLNARRRKEKQIKPLSDTPPSQWARSRINFKVSPPKRTVEFDKENNNKCLPNRACASSSTNKTVLVPKPLFLSTHSSRQQLFCKTKSHVISRNIGTQQKCLIMSPPSAASKVQVKVKNPSIMFISSSPTRPTNTSLSLSKKSSPTKRWVRTFSPRVATRLLASPIKSKKTVQKSDGVVNLRKCSPKRSVASKLCRSFSPSRLATRFVSPLKSRKRAQQSDGLVSGLKQRPAK

SEQ ID NO: 210650 - protein, 439 aa, Glycine max
  Coding DNA Sequence Number=SeqID_93872
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=69%, HitCoverage=20%, E-value=3e-72, Identity=47%"; Hit description =Multidrug resistance-associated protein 3
VHHGDGGVELDGGVVQEEEIDGDGEGICIRLYSAPVVAAVVEVVSLPEVEWIVVSSYPAWWRPLISEKYLEGYPWWACCVCDKEGRFMVARTSCHPGPNRVSQSLKERQVEFFKLCSLSQEKLVTLLDLVLKVVAWGVGGVCMHDELFISRERRLPFFFRGWCVLYLFVSGYCFIVNIVLYEKHAALPIQCLGSDVSSVCVGLFFCYLGFFVKFEGGVRNSTLQESLLNGDSNDNDVFGTNETKGGDTVTPYSYAGIFSILTFSWVSPLIAGGKKKSLDLEDVPQLDKRDSLIGAFPIFSDKLEAYCGATNTLTTLKLVKSLVFSTWKEIIFTAILALVNTLATFVGPYLIDCFVQYLNGKRQFEKEGLVLVSAFCVAKLVECLTKRHWFFRLQQVGIRMQALLVTIIYNKALNLSCQSKQGQTTGEIINFMSVDAERV

SEQ ID NO: 210651 - protein, 971 aa, Glycine max
  Coding DNA Sequence Number=SeqID_93873
  Gene Ontology: Mol. function=hydrolase activity, hydrolyzing O -glycosyl compounds; Cellular component=lysosome; Biological process =carbohydrate metabolic process
  Homolog annotation: Hit_ID=Q84XI2; Match level="QueryCoverage=99%, HitCoverage=99%, E-value=0.0, Identity=75%"; Hit description =Glycosyl hydrolase
  Pfam annotation: Domain name=Glyco_hydro_2; Domain location=210-329; Score=6.6; E_value=0.00018; Accession=PF00703.11; Description =Glycosyl hydrolases family 2, immunoglobulin-like beta-sandwich domain
  Pfam annotation: Domain name=Glyco_hydro_2_C; Domain location=338 -646; Score=-145.9; E_value=0.082; Accession=PF02836.7; Description =Glycosyl hydrolases family 2, TIM barrel domain
  Pfam annotation: Domain name=Glyco_hydro_2_N; Domain location=4-163; Score=-28.7; E_value=0.00023; Accession=PF02837.8; Description =Glycosyl hydrolases family 2, sugar binding domain
  Pfam module annotation: Pfam domain module=Glyco_hydro_2::Glyco_hydro_ 2_C::Glyco_hydro_2_N; Domain location=210-329::338-646::4-163
MAEQHRKTTLDSGWVAARSTEVQFTGIQLTTTHPPTRPTSPWMQALVPGTVLATLVKNKAVPDPFYGLQNEHIIDIADSGRDYYTFWFFTTFNCKLSSNEHCDLNFRGINYSADVYLNGHEIILPKGMFRRHSLDVTDILHSDGTNLLAVLVHPPDHPGRIPPEGGQGGDHEIGKDVTTQYVEGWDWMAPIRDRNTGIWDEVSISVTGPVKIIDPHLVSTFSDDYKKAYLHTTTELENRSSLTAECSLSVQVTTELEDSICLVEHLQTQDLSIPANSAVQYTFPELFFSKPNLWWPNGMGKQSLYNVVIVIDVKGFGESDSWSHHFGFRKIESHIDDATGGRLFKVNGKPIFIRGGNWILSDGLLRLSKKRYNTDIKFHADMNFNMIRCWGGGLAERPEFYHYCDYYGLLVWQEFWITGDVDGRGDPVSNPNGPLDHDLFLFSARDTVKLLRNHPSLALWVGGNEQVPPDDINAALKNDLRLHPYFESVEENSKPVGDWSPMSTDFSQYLDGTRIYIQGSMWDGFADGKGNFTDGPYEIQNPEDFFKNHFYNYGFNPEVGSVGMPVAATIRATMPSEGWQIPVFKKLPNGYVEEVPNPIWEYHKYIPYSKPTKVHDQIQLYGDAKDLDDFCLKAQLVNYIQYRALLEGWTSRMWSKYTGVLIWKTQNPWTGLRGQFYDHLLDQTAGFYGCRCAAEPVHVQLNLATYLIEVVNTTAEEMSNVAIEASVWDLDGTCPYYRVHENFSLLPKKVAPIFKMKYPESKDPKPVYFLLLKLYNMSDNRVISRNFYWLHLSGGDYKLLEPYREKKIPLKITSKVSIEECTYNIQMLVANTSKRPASTSSTARLSDGFYGTHSLETLACGVGIEQKSSWFKRIHRCFAGKSDGLKVTEISGPDVGVAFFLHFSVHTSKMDHNEGKDTRILPVHYSDNYFSLVPGETMPINISFEVPLGVTPRVILHGWNYDGGEIICEVV

SEQ ID NO: 210652 - protein, 334 aa, Glycine max
  Coding DNA Sequence Number=SeqID_93874
  Homolog annotation: Hit_ID=Q9LUB0; Match level="QueryCoverage=80%, HitCoverage=80%, E-value=7e-55, Identity=45%"; Hit description =Arabidopsis thaliana genomic DNA, chromosome 5, P1 clone:MIF21
  Pfam annotation: Domain name=Rrp15p; Domain location=145-272; Score =115.4; E_value=1.6e-31; Accession=PF07890.2; Description=Rrp15p
MAEEMTMVEPGRGKRKFFKKQGHKKSSNKAKVMPPQHGQKKVKIDKKMKKLFRKRAREYNSDDEDEEATVPATSEPKGLASITNKRNDEDDTESEDGSEDEGAAGPQKTWNKNATDMNNHSSDDEGEDDNEIQPGITKFTEGCRAFKMAFKNIMQKSVPDDMLGPILSGQRKLVVDKLAEEEAESKVKGEAKKEKKMLAEKGHVKPATYLDSHEKFLISVATKGVVKLFNAVNKAQTAQKGLNPSRTKDAKEIRKRTKQAFFSELGKPSLPAIGTTTKAKESTDRVEDEQPAWAPLRDNYMLTSSRLKDWDKMPDKNVSDDMGKTSEDSSSDED

SEQ ID NO: 210653 - protein, 671 aa, Glycine max
  Coding DNA Sequence Number=SeqID_93875
  Gene Ontology: Mol. function=protein serine/threonine kinase activity; Cellular component=plasma membrane; Biological process =protein amino acid phosphorylation
  Homolog annotation: Hit_ID=Q40541; Match level="QueryCoverage=99%, HitCoverage=99%, E-value=1e-178, Identity=53%"; Hit description =Protein kinase
  Pfam annotation: Domain name=Pkinase; Domain location=66-329; Score =309.9; E_value=4.5e-90; Accession=PF00069.15; Description=Protein kinase domain
  Pfam annotation: Domain name=Pkinase_Tyr; Domain location=66-329; Score=105.7; E_value=1.4e-28; Accession=PF07714.7; Description =Protein tyrosine kinase
  Pfam module annotation: Pfam domain module=Pkinase::Pkinase_Tyr; Domain location=66-329::66-329
MQDIFGSVRRSLVFRGSPENEESSLGVGGSLVDRISYCIRSSRVFSKPSTPSPPSFPKDAAPPIRWRKGELIGCGAFGQVYVGMNLDSGELLAVKQVLIAASNATKEKAQAHIKELEEEVKLLKDLSHPNIVRYLGTVREEDTLNILLEFVPGGSISSLLGKFGAFPEAVIRTYTKQLLLGLEYLHKNGIMHRDIKGANILVDNKGCIKLADFGASKQVVELATISGAKSMKGTPYWMAPEVILQTGHCFSADIWSVGCTVIEMATGKPPWSQQYQQEVAALFHIGTTKSHPPIPDHLSAAAKDFLLKCLQKEPILRSSASKLLQHPFVTGEHMNSLPLSSNVMENLEASSPSCAPNAESFLCCSTVNPLDLGIKQSWGMSNDDDMCVIDDKEEFSQSDAKYKSFMSTNIESFNPMSDPSDDWGGCKFDASPELENRGVNFGTDESYVPPDQSGDDDKGQKDFSFPGVPSLSEEDDELTESKIKAFLDEKALELKKLQTPLYEEFYNSLNTSCSPNVIESTSDDTACRKYLKLPPKSRSPSRVPISTPSKAVDNSGSPGSNGRSSSTVGHVNNHSPQDIPASSLNEWKGLIADSQQQPSSPSLSFSERQRKWKEELDQELERKRVNLILDLLLGHKRCRNDAAGWHGRKDIFTEGSSFKSAEGENKICFSQ

SEQ ID NO: 210654 - protein, 764 aa, Glycine max
  Coding DNA Sequence Number=SeqID_93876
  Gene Ontology: Mol. function=microtubule motor activity; Cellular component=microtubule associated complex; Biological process =microtubule-based movement
  Homolog annotation: Hit_ID=Q75HV1; Match level="QueryCoverage=51%, HitCoverage=47%, E-value=1e-149, Identity=67%"; Hit description =Putative kinesin-related protein
  Pfam annotation: Domain name=Kinesin; Domain location=133-452; Score =530.4; E_value=2e-156; Accession=PF00225.13; Description=Kinesin motor domain
  Pfam annotation: Domain name=Pox_A_type_inc; Domain location=463-485; Score=17.8; E_value=0.04; Accession=PF04508.3; Description=Viral A -type inclusion protein repeat
  Pfam module annotation: Pfam domain module=Kinesin::Pox_A_type_inc; Domain location=133-452::463-485
MLPLPSDYLDFGISADNVLAQLNNETSDNMDESSIPNGIHECSPREDHTLPILKKILDLSTKIQNLKKQHVALSNQVKLTTESFPGLDVLKSVQLLGAEYEVLKRKYVEESSERRRLYNEVIELKGNIRVFCRCRPLNESEIANGSAVSVVNFESSSDELQVICSDSSKKHFKFDYVFRPEDNQETVFEQTIPIVTSVLDGYNVCIFAYGQTGTGKTFTMEGTPQHRGVNYRTLEELFRISEERNDVIKYELFVSMLEVYNEKIRDLLVENSVEPTKKLEIKQAVDGTQEVPGLIEARVYGTVDVWEKLKSGNQARSVGSTSANELSSRSHCLLRVTVLGENLINGQKTRSHLWLVDLAGSERVGKTEAEGERLKESQFINKSLSALGDVISALASKSAHIPYRNSKLTHILQSSLGGDCKTLMFVQISPGAADLTETLCSLNFATRVRGIESGPARKQTDLTELNKYKQMVRDLENQVTEERKMRLKQESKSLAAVSAQPSTMSESIAARKIMKKPPLDPRLPLRRITNILPPPPERKPSCSSSMDEQENIARTTSINTQDLVKPRRGVSIAVRPPTTPSTSRTLQPRRRRVSVATLCPVRTPLRSPTQQSPRRPSCSSSMDGQENIARTTSINTQDLMKPRRRVSIAVRPPPPPSASQALQPRRRRVSVATLCPVRTPLGFPTQQSPKRNQRETQYSRLFAPLPEAITSVETASPTLMRSSSKFAGSPRHQRRKPLVWTPLKLKGLKNSSRKSLVIPSRPFY

SEQ ID NO: 210655 - protein, 635 aa, Glycine max
  Coding DNA Sequence Number=SeqID_93877
  Gene Ontology: Mol. function=metalloexopeptidase activity; Cellular component=exocyst; Biological process=creatine metabolic process
  Homolog annotation: Hit_ID=Q1SBD5; Match level="QueryCoverage=91%, HitCoverage=82%, E-value=0.0, Identity=85%"; Hit description =Peptidase M24; Peptidase aspartic, active site
  Pfam annotation: Domain name=Creatinase_N; Domain location=72-215; Score=-10.5; E_value=0.00025; Accession=PF01321.8; Description =Creatinase
  Pfam annotation: Domain name=Peptidase_M24; Domain location=410-620; Score=22.4; E_value=2.4e-09; Accession=PF00557.14; Description =metallopeptidase family M24
  Pfam module annotation: Pfam domain module=Creatinase_N::Peptidase _M24; Domain location=72-215::410-620
  Subcellular localization annotation: CTP_CleavageSite=64; ConfidenceScore=5.65e-01
MQRGLLASSLPLSTRSLFLPLPLCLSSPNPFFYKLNSHSKPFFTIRNCSSSFKVKPSSQIKKIRAEAELDPKLTALRNLFSKPGVNIDAYVIPSQDAHQSEFIAECYSRRAYISGFTGSAGTAVVTKDKAALWTDGRYFLQAEKQLSSNWILMRAGNPGVPTASEWLNDVLAPGGRVGIDPFLFTSDAAEELKGVISKNNHELVYLYNSNLVDEIWKESRPKPPNNPVRVHNLKYAGLDVASKLSSLRSELVNAGSSAIVISMLDEIAWLLNLRGSDIPHSPVVYAYLIVEVSGAKLFIDDSKVTEEVSDHLKKADTEIRPYNSVISEIERLAARGASLWLDTSSVNAAIVNAYRAACDRYYQNCENKHKTRTNGFDGSSDVPFSVHKVSPVSQAKAIKNESELEGMRNCHLRDAAALAQFWDWLETEITKDRILTEVEVSDKLLEFRSKQAGFLDTSFDTISGSGPNGAIIHYKPEPESCSSVDANKLFLLDSGAQYVDGTTDITRTVHFGKPTAREKECFTRVLQGHIALDQSVFPENTPGFVLDAFARSFLWKVGLDYRHGTGHGVGAALNVHEGPQSISHRYGNLTPLVKGMIVSNEPGYYEDHAFGIRIEVIFSSAILCSEMITLAPSVA

SEQ ID NO: 210656 - protein, 215 aa, Glycine max
  Coding DNA Sequence Number=SeqID_93878
  Gene Ontology: Mol. function=hydrolase activity
  Homolog annotation: Hit_ID=Q1SBD1; Match level="QueryCoverage=68%, HitCoverage=30%, E-value=3e-49, Identity=69%"; Hit description =Epoxide hydrolase
  Subcellular localization annotation: CTP_CleavageSite=60; ConfidenceScore=5.23e-01
MAIITEEPEAEADSHSQIPKPRKPKLKTPSSPPPNSNNNPFSFWFYFTLSVSLLTLFFVLTSSLSPQDPKTWFLTLPPPLRHHYSNGRTIKVQTHSNEAPIQVFTLQEGPTSSENIIILHGQGLSSYSYRHLAQSLAANGLHVTSLDLPGHGFSDKSVEASVEGVNGVFGRFWYVYSEIQERGLFWAFDQMVETGQIPVRGNSSSYVEEKNKKAY

SEQ ID NO: 210657 - protein, 274 aa, Glycine max
  Coding DNA Sequence Number=SeqID_93879
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=87%, HitCoverage=15%, E-value=1e-101, Identity=77%"; Hit description =Multidrug resistance-associated protein 3
  Pfam annotation: Domain name=ABC_tran; Domain location=96-258; Score =70.6; E_value=4.9e-18; Accession=PF00005.17; Description=ABC transporter
IPLEAGKILSTLATFQILQEPIYNLPETISMMAQTKVSLDRIASFLRLDEMLSDVVKKLPPGSSDIAIEVVDGNFSWDSFSPNITLQNINLRVFHGMRVAVCGTVGSGKSTLLSCILGEVPKKSGILKVCGTKAYVAQSPWIQSSTIEDNILFGKDMERERYEKVLEACCLKKDLDILSFGDQTIIGERGINLSGGQKQRIQIARALYHDADIYLFDDVFSAVDAHTGSHLFKGDQSGSCCFGRMLQPCGIDTDLKEHSNQVYLPLRPTLQRVC

SEQ ID NO: 210658 - protein, 1137 aa, Glycine max
  Coding DNA Sequence Number=SeqID_93880
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=75%, E-value=0.0, Identity=69%"; Hit description =Multidrug resistance-associated protein 3
  Pfam annotation: Domain name=ABC_membrane; Domain location=560-844; Score=63.1; E_value=9.1e-16; Accession=PF00664.13; Description=ABC transporter transmembrane region
  Pfam annotation: Domain name=ABC_tran; Domain location=294-465; Score= 134.7; E_value=2.5e-37; Accession=PF00005.17; Description=ABC transporter
  Pfam annotation: Domain name=ABC_tran; Domain location=916-1099; Score=167.4; E_value=3.8e-47; Accession=PF00005.17; Description=ABC transporter
  Pfam annotation: Domain name=MMR_HSR1; Domain location=917-1003; Score=-13.6; E_value=0.018; Accession=PF01926.13; Description=GTPase of unknown function
  Pfam module annotation: Pfam domain module=ABC_membrane::ABC _tran::ABC_tran::MMR_HSR1; Domain location=560-844::294-465::916 -1099::917-1003
LVECLTKRHWFFRLQQVGIRMQALLVTIIYNKALNLSCQSKQGQTTGEIINFMSVDAERVGEFSWHLHDLWLVVLQVLVGLLVLYKNLGLASIAGFVAILIVMWANIPLGSTQEKFHNKLMESRDERMKATSEILRNMRILKLQGWEMKFLSKITELRKIEQGCLKKVIYTLVLIISIFWCAPAFVSVVTFGTCMVIGITLESGKILSTLATFQILQEPIYNLPETISMMAQTKVSLDRIASFLRLDEMLSDVVKKLPPGSSDIAIEVVDGNFSWDSFSPNITLQNINLRVFHGMRVAVCGTVGSGKSTLLSCILGEVPKKSGILKVCGTKAYVAQSPWIQSSTIEDNILFGKDMERERYEKVLEACCLKKDLDILSFGDQTIIGERGINLSGGQKQRIQIARALYHDADIYLFDDVFSAVDAHTGSHLFKECSLGFLSSKTVVYVTHQVEFLPAADLILVMKDGNITQCGKYNDLLISGTDFMELVGAHKEALFALDSLDGGTVSAKISVSLSHAVEEKEVKKDVQNGGEDDKSHLKGQLVQEEEREKGKVGFSVYWKYIIAAYGGALVPLILLAEILFQLLQIGSNYWMALVTPISTDVEPSVGGSMLIVVYVALAIGSSVCVLARATLVATAGYKTATLLFNNMHFCIFRAPMSFFDATPSGRILNRASTDQSAVDIDIPFQAGSLASSVVHLLGIIVVMSQVAWQVFIVFVPITAISIWYQQYYLPSARELSRLVGVCKAPVIQHFAETISGASIIRSFDQVPRFQQTIMKLMDGYSRPKFNNAGAMEWLCFRLDMLSSITFSFCLIFLISIPQGFIDSGVAGLAVIYGLNLNIVQSWMIWELCNIETKIISVERILQYTSIPSEPPLVVEENRPHDSWPSCGRIDIHNLQVRYAPHMPFVLHSLACTFHGGLKTGIVGRTGSGKSTLIQTLFRIVEPTVGRIMIDGVNISSIGLRDLRSRLSIIPQDPTMFEGTVRSNLDPLEEYTDEQIWEALDKCQLGDEVRRKEGKLESAVCENGENWSMGQRQLVCLGRVLLKKSKVLVLDEATASVDTATDNLIQQTLRQHFFNCTVITIAHRITSVIDSDMVLLLNQGLIEEYDSPTRLLEDKLSSFAQLVAEYTTRSNSSFDQLK

SEQ ID NO: 210659 - protein, 898 aa, Glycine max
  Coding DNA Sequence Number=SeqID_93881
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=75%, HitCoverage=63%, E-value=0.0, Identity=53%"; Hit description =Multidrug resistance-associated protein 3
  Pfam annotation: Domain name=ABC_membrane; Domain location=162-428; Score=35.0; E_value=2.5e-07; Accession=PF00664.13; Description=ABC transporter transmembrane region
  Pfam annotation: Domain name=ABC_tran; Domain location=500-683; Score= 159.8; E_value=7e-45; Accession=PF00005.17; Description=ABC transporter
  Pfam annotation: Domain name=MMR_HSR1; Domain location=501-587; Score= -15.1; E_value=0.024; Accession=PF01926.13; Description=GTPase of unknown function
  Pfam module annotation: Pfam domain module=ABC_membrane::ABC _tran::MMR_HSR1; Domain location=162-428::500-683::501-587
MKLSLQPGQSGSRSNPNPRFPGPLEDECLLDLLSSKTVVYVTHQVEFLPAADLILVLKDGKITQCGKYNDLLNSGTDFMELVGAHKEALSALDSLDRGKESDKISTSQQDISVSLSHGAEEKEVKKDAQNGVKDDKCGPKGQLVQEEEREKGKVGFSVYWKYITAAYGGALVPLILLAEILFQLLQIGSNYWMAWATPISTNVEPPVGGSKLIVVYVALAIGSSVCVLARATLVATAGYKTATLVFNNMHIRIFRAPMSFFDSTPSGRILNRASTDQSAVDIDIPLQTGALASSVIHLLGIIVVMSQVAWQVFIVFIPITAISIWYQAPVIQHFSETISGASTIRSFDQVPRFQQTNIKMMDGYSRPKFNKAGAMEWLCFRLDILSSMTFAFCLIFLISIPQGFIDSGVAGLAVTYGLNLNIIQSWMIWDLCNLETKIISVERILQYTSIPSEPPLVVEENQPHDSWPSYGRIDIHNLQVRYTPRMPFVLHGLTCTFHGGLKTGIVGRTGSGKSTLIQTLFRIVEPSVGRIMIDGINISSIGLYDLRSRLSIIPQDPTMFEGTVRTNLDPLEEYTDEQIWEALDKCQLGDEVRRKEGKLDSSVCENGENWSMGQRQLVCLGRVLLKKSKVLVLDEATASVDTSTDNLIQQTLRQHFPNSSVITIAHRITSVIDSDMVLLLNQGLIEEYDSPTRLLEDKLSSFARLVAEKKSTISNGGDPNIEERDGELSKGYETKELCIAGSEFDKEDTYKFVRYKKEELNKDFQFKIDQNIIVERFFNNKNVNSKWVSKITAEKLKPNDDVKLTQIMDVVRFKYAYGEELECVCEGNNYKLILERSSWLLLPRQLLIVVGRDPNDQHLPIAFVVVENETKDSWKWFLELLIYDIGDIKANKWLCISD

SEQ ID NO: 210660 - protein, 549 aa, Glycine max
  Coding DNA Sequence Number=SeqID_93882
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=94%, HitCoverage=34%, E-value=0.0, Identity=63%"; Hit description =Multidrug resistance-associated protein 3
  Pfam annotation: Domain name=ABC_membrane; Domain location=139-411; Score=72.2; E_value=1.7e-18; Accession=PF00664.13; Description=ABC transporter transmembrane region
MGNSSFQGKEDCHSSSELGASFTSLFPAGVRNSTLQESLLNGDSNDNDVFGINETKGGDTDTPYSNAGIFGILTFSWVGPLITLGKKKTLDLEDVPQLDKRDSLVGAFPTFRDKLKACCGASNTVTTLELVKSLVFSTWTEIIVTAILALVNTLATFVGPYLIDGFVQYLNGKRQFEKEGLVLVSAFCVAKLVECLTKRHWFFRLQQVGIRMRALLVTIIYNKALNLSCQSKQGQTTGEIINFMSVDAERVGEFSCHLHDLWLVVLQVLVGLLVLYKNLGLATIAGFVAILIVMWANIPLGSTQEKFHNKLMESKDERMKATSEILRNMRILKLQGWEMKFLSKITKLRKIEQGWLKKVIYTLAIIIFLFWCAPAIVSVVTFGTCMLIGIPLEAGKILSTLATFQILQEPIYNLPETISMMAQTKVSLDRIASFLRLDEMLSDVVKKLPPGSSDIAIEVVDGNFSWDSFSPNITLQNINLRVFHGMRVAVCGTVGSGKSTLLSCILGEVPKKSGILKVCGTKAYVAQSPWIQSSTIEDNILFGKDMERE

SEQ ID NO: 210661 - protein, 806 aa, Glycine max
  Coding DNA Sequence Number=SeqID_93883
  Gene Ontology: Mol. function=zinc ion binding; Cellular component =intracellular
  Homolog annotation: Hit_ID=Q1SBC2; Match level="QueryCoverage=93%, HitCoverage=84%, E-value=0.0, Identity=62%"; Hit description=Zinc finger, RanBP2-type
  Pfam annotation: Domain name=zf-RanBP; Domain location=343-372; Score= 47.7; E_value=4e-11; Accession=PF00641.9; Description=Zn-finger in Ran binding protein and others
  Pfam annotation: Domain name=zf-RanBP; Domain location=376-405; Score= 27.0; E_value=6.5e-05; Accession=PF00641.9; Description=Zn-finger in Ran binding protein and others
  Pfam module annotation: Pfam domain module=zf-RanBP::zf-RanBP; Domain location=343-372::376-405
  Subcellular localization annotation: CTP_CleavageSite=55; ConfidenceScore=5.26e-01
MGYGYGPFSLLLTRRLHLYSSLNPKPSFPLFHLLTKPFSTAPPDPNPKPSSLSARLSFVFDQIDAIEKERSQKHETLQRIRAWRESKNAPPSPSQNDAPPEPALSVSADDESPPEPPPNKAVELVHPWPEWIQLMEMLVHQNYFDHKRRDEDKMVHDLGFNSPEVAEGFDFTKDFKSVHMACLYFGRDRFDILRSLSRKDIQVLVGYGCPTVDRKVVFSAKLLRKHVHLDEGDVCSSCSLRNTCERGYLLTNKEDEAQTLDVMRLLLTFGFDPVDGSVINKSLLKQKSVKTVVRKLLHEVVKLSSVPIDPNLPPPVIKKPPPKVKQPPPPPKRRVGRDDVEMKKGDWLCPKCEFMNFAKNTVCLQCDAKRPKRQLLPGEWECPECNFLNYRRNMVCFHCECKRPPDEFLENKMQDRIQSSKPKLDKMGSRQEVSNAWNFDFDDNESDGADVAAFEYADTHAIDENSDNHAQHANHTGWEDDFEKNKVQGSPDGEYANPGLYRPRTGFDDFEDEDDIDSYELETAQNSSRMEESKYNFSEGENFSESEDIEATDDKMHARRKTASGRSAQSRSIRKNTSFSGSDDDELKFGTDEQLSVVSNFKSGHVSAADRKRKGRGPSKKLSFGSESEEEIGAGKIKGTNVIYPDKIRGIDTILEEGTSPKTESQDLLAVAKQICSVMILMDHPSSLIGTVGGLGKMTIIGRVLKILMDRLGNHMVMVEGPEETTVMDHPGSLTGMVGGLEEMTVIVRDLKILMDCLNDHIVMVEGPVETSAKDHPGNLMGMVEDLEEMTEIGRDLKTGKMERDG

SEQ ID NO: 210662 - protein, 152 aa, Glycine max
  Coding DNA Sequence Number=SeqID_93884
  Gene Ontology: Mol. function=DNA-directed DNA polymerase activity; Biological process=nucleobase, nucleoside, nucleotide and nucleic acid metabolic process
  Homolog annotation: Hit_ID=Q1SBC5; Match level="QueryCoverage=94%, HitCoverage=14%, E-value=3e-29, Identity=46%"; Hit description =Probable DNA polymerase zeta catalytic subunit F12B7.5 [imported]- Arabidopsis thaliana-related
MDSIDQSVACRGENLKVRTTFTKPVASDACTQNPFLDPRMRTAPERTPQTDTSASSSVQSSFIDDKVSGKYSFMDQSSHGSRSFVQHDQMTFCENSVEKNAASDVQVLLSEKVDSQKLGETLLHETMKLTEITTSKNPMADKNLEGLIKETK

SEQ ID NO: 210663 - protein, 67 aa, Glycine max
  Coding DNA Sequence Number=SeqID_93885
MGRLPIRHYFLQVLVLACLRTLSITHTPPNTERKDEEGKGKENGAGEKVTDALEKSLGKRKSTLEYS

SEQ ID NO: 210664 - protein, 234 aa, Glycine max
  Coding DNA Sequence Number=SeqID_93886
  Gene Ontology: Mol. function=DNA binding; Cellular component=nucleus; Biological process=regulation of transcription, DNA-dependent
  Homolog annotation: Hit_ID=Q10G93; Match level="QueryCoverage=83%, HitCoverage=55%, E-value=2e-35, Identity=56%"; Hit description=DIRP family protein, expressed
  Pfam annotation: Domain name=DIRP; Domain location=105-193; Score =63.3; E_value=7.8e-16; Accession=PF06584.3; Description=DIRP
  Subcellular localization annotation: CTP_CleavageSite=37; ConfidenceScore=5.18e-01
MAPTKKPRTTTNKRFSSLSEVSPKKDEVGSSKNKQRVAENVSSRSVEMVKALHSISQAYLSMPKESASAVGLIAMMTDYYNMVVCFFHVSPVQHDSHLCWAARKSYIVYLNYWGDAYIPVGQLLIMPIGLSSLGKPRRFSERFLHGERQKLEQYRESVRKYYNELRTGIRDGLPTDLAKQLCVGQRVIALHSKTREIHDGSVLTVDHDNYKVQFDRPELGVEFVMVIRSLISTY

SEQ ID NO: 210665 - protein, 157 aa, Glycine max
  Coding DNA Sequence Number=SeqID_93887
  Homolog annotation: Hit_ID=Q84PE0; Match level="QueryCoverage=43%, HitCoverage=14%, E-value=7e-24, Identity=72%"; Hit description=AKIN betagamma
MFASVVDGACEGSGVSGPILIPRRFVWPYGGTTVFLTGSFTRWSNHIAMSPMEGCPAVFQVVCNLMPGFHQELHDDFQLSLGVGISNLWVKVGMAFMEGMRVGMAPAGVVGKSGQVKLMVGFEVTKHLGNFHHFDYGGSHASLLSQKQDGQLGGRLD

SEQ ID NO: 210666 - protein, 373 aa, Glycine max
  Coding DNA Sequence Number=SeqID_93888
  Gene Ontology: Mol. function=kinase activity; Cellular component =nucleus; Biological process=cholesterol homeostasis
  Homolog annotation: Hit_ID=Q84PE0; Match level="QueryCoverage=98%, HitCoverage=72%, E-value=1e-160, Identity=80%"; Hit description=AKIN betagamma
  Pfam annotation: Domain name=CBS; Domain location=220-372; Score =34.6; E_value=3.3e-07; Accession=PF00571.18; Description=CBS domain
  Pfam annotation: Domain name=CBS; Domain location=38-189; Score=17.3; E_value=0.0018; Accession=PF00571.18; Description=CBS domain
  Pfam module annotation: Pfam domain module=CBS::CBS; Domain location =220-372::38-189
MTWKFYQEANPRMPVSDLEVSRHRISVFLSTHTAYNLLPESGKVIALDINLPVKQAFHVLYEQGVSMAPLWDFFKSQFVGVLSAMDFILILKELGNHGSNLTQEQLETHTIAAWKEGKFQQFRTLDSNGGSYPWRFVHAGPHECLKDVALKVLQNKVSTVPIIHSSSEDGSYPQLLHLASLSGILKGICRHFKHSLSSLPILQLPVASIPLGTWMPRVGEPNGRPLAMLMPSASLGAALSMFVQAKVSSIPIVDANDSLLDIYSRRFPLAYMKRAYYFLFSDITALAKDKAYARISLDEISIHQALLLGQDATSPSGIYNGQRCHMCLRSESLYKVMERLANPGVRRLVVVEAGSKRVEGIISLSDVFRFLLG

SEQ ID NO: 210667 - protein, 96 aa, Glycine max
  Coding DNA Sequence Number=SeqID_93889
  Gene Ontology: Mol. function=DNA binding
  Homolog annotation: Hit_ID=Q1SBB0; Match level="QueryCoverage=86%, HitCoverage=15%, E-value=1e-15, Identity=51%"; Hit description =Homeodomain-like
MTKKAFSMNVEKSESQSSVTFSIPQVPLKSENGEMMATVEEDGQCLKAVVEEPPRTSCDVVSMEHQPNINSRRQSTRNRPLSLRALESLETFIQTN

SEQ ID NO: 210668 - protein, 41 aa, Glycine max
  Coding DNA Sequence Number=SeqID_93890
MQDITAECLEMESFLEHKKQDGLYTERVSCKGFNQPVYFNG

SEQ ID NO: 210669 - protein, 366 aa, Glycine max
  Coding DNA Sequence Number=SeqID_93891
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1SCC5; Match level="QueryCoverage=99%, HitCoverage=100%, E-value=1e-121, Identity=59%"; Hit description=2OG- Fe(II) oxygenase
  Pfam annotation: Domain name=2OG-FeII_Oxy; Domain location=215-314; Score=146.0; E_value=9.9e-41; Accession=PF03171.10; Description=2OG -Fe(II) oxygenase superfamily
MVATSTNQSELETSKKDSTYDRIAEVKAFDETKLGVKGLFDSGITKIPRMFHHAKVEDHTETTPNDSNFSIPIIDLQDIDTNSSLRVKALDKIRSACKEWGFFQVVNHGIAVDLLDEMICGIRRFHEQDAEVRKSFYSRDMNKKVRYFSNGTLYRDPAANWRDSIVFLLLLILRIPKKYQQYAEKVRALGFTIFELFSEALGLHSSYLNELDSVDGQYLLCHYYPPCPEPELTMGTSKHTDISFMTILLQDQMGGLQVLHQNQWVDVPPVHGSLVVNIGDLLQLITNDMFVSVYHRVLSRYTGPRISVASFFANSSPQSSSKVVGPIKELLSEDNPPVYRDTTVKDVAAHYFEKGLDGNYLQPFRL

SEQ ID NO: 210670 - protein, 140 aa, Glycine max
  Coding DNA Sequence Number=SeqID_93892
MCLHLFDGQFDFFDFRAHWQLLVLCPRENIVVWFCSIRRKHDVHIKATVNSAMKKISITFQGKENGPPPQWIEPKSYVQAGAYECGYYVMHRMWCIVTGGLKNEWNKCFSNGTPLDSDTMTTLRKKWAAYFLQVGKMDVN

SEQ ID NO: 210671 - protein, 34 aa, Glycine max
  Coding DNA Sequence Number=SeqID_93893
MGLVYRIFMRDRGTFWSSLVHQEGSEDDAWLGLG

SEQ ID NO: 210672 - protein, 123 aa, Glycine max
  Coding DNA Sequence Number=SeqID_93894
MNCVFVHASSTHEFGAMRSDCLVQFSILYPFSEPMNCVFVHASPTHEIGAMRSDCLVQFSILYPFSEPMNCVFVHASPTHEFGAMGSDCLLQFSILYPFSEPMNCVFAHASPTHEIVAMRRDS

SEQ ID NO: 210673 - protein, 123 aa, Glycine max
  Coding DNA Sequence Number=SeqID_93895
MRERKRNSWAPKKGREWRIAVSNHYPWLQTRGWGMHERKRNSWAPKKGREWRIALSNHYAWLQSRGWGMHERKRNSLAPKKGREWRIALSNHYAWLQTRGWRTHERKRNSWGSEKMVENGELH

SEQ ID NO: 210674 - protein, 65 aa, Glycine max
  Coding DNA Sequence Number=SeqID_93896
EGRSTTGAEGSEVASRDLSGVAAATCLTCVSPASSPKTNGSGMVASDDSSSTCCGTWAVGPLSSL

SEQ ID NO: 210675 - protein, 53 aa, Glycine max
  Coding DNA Sequence Number=SeqID_93897
MAKYIEGVWPNYGLAPLRFKKIGVTLRSQYPNWEIDFDNISYRGALGALCKGI

SEQ ID NO: 210676 - protein, 92 aa, Glycine max
  Coding DNA Sequence Number=SeqID_93898
  Homolog annotation: Hit_ID=Q1RSK1; Match level="QueryCoverage=77%, HitCoverage=13%, E-value=6e-08, Identity=51%"; Hit description=Zinc finger, C2H2-type
MSNSNITSCDSWSFTTENNNNGEDAAATVKQQLEMLGQLYSPNSNTSTTTNNSNGGSNADSQPPAKKKRNLPGNPGIFSFFFSLFLFFFLSP

SEQ ID NO: 210677 - protein, 265 aa, Glycine max
  Coding DNA Sequence Number=SeqID_93899
  Gene Ontology: Mol. function=nucleic acid binding; Cellular component= intracellular; Biological process=regulation of transcription
  Homolog annotation: Hit_ID=Q1RSK1; Match level="QueryCoverage=50%, HitCoverage=25%, E-value=7e-64, Identity=84%"; Hit description=Zinc finger, C2H2-type
  Pfam annotation: Domain name=RS4NT; Domain location=115-152; Score =14.1; E_value=0.042; Accession=PF08071.2; Description=RS4NT (NUC023) domain
  Pfam annotation: Domain name=zf-C2H2; Domain location=130-152; Score =20.1; E_value=0.0079; Accession=PF00096.16; Description=Zinc finger, C2H2 type
  Pfam annotation: Domain name=zf-C2H2; Domain location=54-76; Score =25.6; E_value=0.00018; Accession=PF00096.16; Description=Zinc finger, C2H2 type
  Pfam module annotation: Pfam domain module=RS4NT::zf-C2H2::zf-C2H2; Domain location=115-152::130-152::54-76
MKVYYYIYTITLGQCACIHIHSSINILRDTFTCADPSAEVIALSPNTLVATNRFICEICNKGFQRDQNLQLHRRGHNLPWKLKLRTTTEVRKRVYVCPEPSCVHHNPARALGDLTGIKKHFSRKHGDKKWKCEKCSKKYAVQSDWKAHSKICGTKEYKCDCGTIFSRLFCLLPRPKPGKPMSPSPPHSAEPLGFSLSTSLSCFLMLKPGGVANSDLPPLSSALFTFLLSPIPPRTEAPPFSLCVNLQSSFESKGGGSRGFKFTLE

SEQ ID NO: 210678 - protein, 60 aa, Glycine max
  Coding DNA Sequence Number=SeqID_93900
MEEGNRERREFPKEEFSGFGGLEPSYLRLVRSARSMQMHVFALSVCCALSAGACLCAPLD

SEQ ID NO: 210679 - protein, 444 aa, Glycine max
  Coding DNA Sequence Number=SeqID_93901
  Gene Ontology: Mol. function=acyl-CoA binding; Cellular component =intracellular; Biological process=lipid transport
  Homolog annotation: Hit_ID=Q10B01; Match level="QueryCoverage=99%, HitCoverage=68%, E-value=1e-171, Identity=66%"; Hit description=Acyl- CoA binding family protein, putative, expressed
  Pfam annotation: Domain name=ACBP; Domain location=10-98; Score=34.1; E_value=8e-10; Accession=PF00887.9; Description=Acyl CoA binding protein
  Pfam annotation: Domain name=Kelch_1; Domain location=183-228; Score =39.8; E_value=9.4e-09; Accession=PF01344.15; Description=Kelch motif
  Pfam annotation: Domain name=Kelch_1; Domain location=238-284; Score =4.7; E_value=1.1; Accession=PF01344.15; Description=Kelch motif
  Pfam annotation: Domain name=Kelch_1; Domain location=289-335; Score =21.2; E_value=0.0037; Accession=PF01344.15; Description=Kelch motif
  Pfam annotation: Domain name=Kelch_1; Domain location=341-386; Score =17.9; E_value=0.036; Accession=PF01344.15; Description=Kelch motif
  Pfam annotation: Domain name=Kelch_1; Domain location=391-436; Score =22.3; E_value=0.0018; Accession=PF01344.15; Description=Kelch motif
  Pfam annotation: Domain name=Kelch_2; Domain location=183-228; Score =41.1; E_value=3.9e-09; Accession=PF07646.5; Description=Kelch motif
  Pfam annotation: Domain name=Kelch_2; Domain location=238-284; Score =13.2; E_value=0.69; Accession=PF07646.5; Description=Kelch motif
  Pfam annotation: Domain name=Kelch_2; Domain location=289-335; Score =22.6; E_value=0.0014; Accession=PF07646.5; Description=Kelch motif
  Pfam annotation: Domain name=Kelch_2; Domain location=340-386; Score =15.7; E_value=0.17; Accession=PF07646.5; Description=Kelch motif
  Pfam annotation: Domain name=Kelch_2; Domain location=391-436; Score =14.0; E_value=0.54; Accession=PF07646.5; Description=Kelch motif
  Pfam module annotation: Pfam domain module=ACBP::Kelch_1::Kelch _1::Kelch_1::Kelch_1::Kelch_1::Kelch_2::Kelch_2::Kelch_2::Kelch _2::Kelch_2; Domain location=10-98::183-228::238-284::289-335::341 -386::391-436::183-228::...
  Pfam module annotation: Domain location=238-284::289-335::340 -386::391-436
  Subcellular localization annotation: CTP_CleavageSite=3; ConfidenceScore=5.01e-01
MARASSGLQYPERFYAAASYVGFDGSSPTKSLTSKFPQSTALLLYSLYQQASVGPCNITEPSTWKIVEHGKWASWNQLGNMSSTEAMRLFVKILEEEDPGWYSRLSNSVVEPVVDVQMNHNSKVEPVIENGNSYPETKTISISTQNGSEVGTQDKDTVVEGFGSVEVYDQWIAPPVSGGSPKARYEHGAAVVQDKLYIYGGNHNGRYLNDLHVLDLRSWTWSKIEAKTGVESPTTSIPCAGHSLIPWGNKLLSIAGHTKDPSESIQVKVFDLQMATWSTPKIFGKAPVSRGGQSVNLVGKTLVIFGGQDAKRTLLNDLHILDLETMTWDEIDAVGVPPSPRSDHTAAVHVERYLLIFGGGSHATCYNDLHVLDLQTMEWSRPMQLGEIPTPRAGHAGVTVGENWFIVGGGDNKSGVSETIVLNMSTLAWSVVTSVQGRVPVASE

SEQ ID NO: 210680 - protein, 303 aa, Glycine max
  Coding DNA Sequence Number=SeqID_93902
  Gene Ontology: Mol. function=nucleic acid binding; Cellular component= intracellular
  Homolog annotation: Hit_ID=Q1RSK1; Match level="QueryCoverage=98%, HitCoverage=61%, E-value=9e-48, Identity=41%"; Hit description=Zinc finger, C2H2-type
MICRRDSFVTHRAFCDALSEENNKCNEVPKMHGSNLQPPIIPNIVASLPIINANNHKNPFSLPHDLMTTIPAKPFNNMAAAFTRSLSSTSSPSQLSSNSPNINMLVENGLLSPHMSATALLQKAAQMGATVNSNNNSMMSSDEKSFIVTSMAPPSYGIMNHNMHNGQQDLSQYNFNANGMVDGGSNNGMGMGGLDMFNAILDQSKALSKIIEQNNRNSTYNGVLHAMNNGKSSDPIEGGGTKGSEAVNHVMTLDLLGIGGGGGDGNFYGGDQQSEIAAGDGIWRNWSNKNAGLESFSATNSTM

SEQ ID NO: 210681 - protein, 73 aa, Glycine max
  Coding DNA Sequence Number=SeqID_93903
MVLVSFYSDFVIELRLGCQNRHYGLLSLGSLVFRVVIEVLGDKVGVPIKVLVKRAGDKLVTLTVIPEEANLDV

SEQ ID NO: 210682 - protein, 127 aa, Glycine max
  Coding DNA Sequence Number=SeqID_93904
MSHKSTLQSKIIENSIPDSVSAIPNVTNVESEFEAGHDSNPPKSKGDIVSVLKAEKEELESSLIKEKHHALQLKQDLAEAESCNSDLYKQSWLASSVAAGGVFLRLQKKTADGGAKPYLALIPSKER

SEQ ID NO: 210683 - protein, 1103 aa, Glycine max
  Coding DNA Sequence Number=SeqID_93905
  Gene Ontology: Mol. function=protein binding
  Homolog annotation: Hit_ID=Q1RSL1; Match level="QueryCoverage=60%, HitCoverage=81%, E-value=4e-93, Identity=39%"; Hit description=IMP dehydrogenase/GMP reductase
  Pfam annotation: Domain name=PWWP; Domain location=75-151; Score =64.8; E_value=2.9e-16; Accession=PF00855.8; Description=PWWP domain
MTELHSHDNAAVATDSKPEVSSTEEFRVSVCSDANTSSSTVDTDKFHGFDSKSLLPEFDEYVAAERHVSQDLGFEFEVGDMVWGKVKSHPWWPGHLYNEAFASPSVRRSKHEGHVLVAFFGDSSYGWFEPEELIPFDANFAEKSQQTNSRTFLRAVEEAVDEACRRRWLGLACRCRNPENFSATDVEGYFCVDVEDYEPGGLYSDGQIRKARDSFKPSETLAFVKQLAIAPHDDDQGSIGFSNNKATLSAYRKAVFEQFDETYAQAFGVQPMHATRPQSNPLDQPGIVRHPPRAPLSGPLVIAEALGGGKSTTKSVKVKEALKKDRYLLKRRDDPNNSVQLAYKEDKSDAADRYVFQKRAPAVPVAPHNLEKQADTEFFSHDGAASISDAKEDLIGQVQADDCDLTSHAISSDVKPHLDKGKEPSEEVIHSFEWDNASSKSILSIDDEMSQPSHLENQDSVDVKHDGNAKLSGPCEDFKQIEQGLLTIANGVNDMHQVKSENNVYGSPVEAKHHKISAVKKKKGLKRPADELNSETSAVGEEKKKKKKNLNLQPTLGSQDKHSTFGKMIHLSGKSTENAVSSGLAPREDFPAEQGEVDVNARNLLPMDTTGNANFELVQLLGDLQALALNPFHGIERKIPSAVQKFFLRFRSLVYQKSLFVSPPTENEAPDVRVTKPPSSVGISDSPDEYVKASPVVKKIKDIKALASEKAVTNQKTSEAWQEDGKESMSQAPSKLVKLESNKKVDCPAKAVEPTILMIKFPPETSLPSIAELKARFARFGPMDQSGFRVFWNSSTCRVVFLHKVDAQAAYKYSVGSQSLFGSVGVRFFLREFGDSAPEVSEAAKARADDGANETPRVKDPAGIHRQTLVSSQQPLLQPIQLKSCLKKSTGDDSGQVTGNGSSSKGNSRVKFMLGGEESSRGDQLTSGSRNNFNNASFADAGAPPVATDFNSKNVQKVTLQPPLPPILPLPTQFIKSPQHNLRNSELAMAPRNSPNFINTIASAATATTVDISQPMINLLTRCSDIVTNLTVPDFCVPEALRYHCPDYIHLPPTCGFGRKTSSAPEGEEEQIEIVKERKGGTIRGTAQFVVVVKKIIYKSQKE

SEQ ID NO: 210684 - protein, 281 aa, Glycine max
  Coding DNA Sequence Number=SeqID_93906
  Homolog annotation: Hit_ID=Q1SYE0; Match level="QueryCoverage=58%, HitCoverage=15%, E-value=7e-66, Identity=74%"; Hit description=HASTY
MTRMQDIFCNYNTCSGCNSKLLERHFTAAMNEAGRKQMDIAKQHAATVTATLNAMNAYAEWAPLSDFAKSGIIHGCGVLLSAPDFRLHASEFFKLVSPRKRPIDASASEFDQAMSSIFQILMNVSREFLHRSGSGPGSIDEGEYEFAEFICESMVSLGSYNLQSIAGDSTILPLYLEQVCVIYESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 210685 - protein, 791 aa, Glycine max
  Coding DNA Sequence Number=SeqID_93907
  Gene Ontology: Mol. function=actin binding; Cellular component =phragmoplast; Biological process=actin cytoskeleton organization and biogenesis
  Homolog annotation: Hit_ID=Q1RSM0; Match level="QueryCoverage=95%, HitCoverage=92%, E-value=1e-173, Identity=50%"; Hit description =Actin-binding FH2
  Pfam annotation: Domain name=FH2; Domain location=377-772; Score =483.0; E_value=3.6e-142; Accession=PF02181.13; Description=Formin Homology 2 Domain
MGLDSQAHSMIFIITILIFLTLQNAAGNENQIEKISGMDENDNKQTPIVENFRLLLGLNMFNTRRPCYKVANSDFESLSPSLSPNTEAEAPVPAPELHVQPHSYHPHRNMPLHKILQKDRGRAKRTTLVAVVVPGGVATLICALGCVCVCKKFRNQKRKPNRTMPLFSKNERTGGTSTYQNPSSNVSLNSAPDLIYLTCLKQTCGTQNSSTSSHCSQQRTIYEKKVLHREEYDKVSTSSSSTKEILSVHEDLEYDGGGKASSGEKTVLQGCHSLSSDSESFHSCFDTHSSISETETLSLSPRNSISSTNQFPCSPQNSTTKVKPNQSQSPCIPKQEEQKKLETCQPSIPPPPCPPPFLKGNINSAIKTPPSPLPQGKGGSSPLPKLKPLHWDKVRATPDRTMVWDKLRTSSFELDEVMIESLFGYNLQNSMKNDETKSKTPSPSKHVLEPKRFQNIAILSKALNTTAEQICEALILGKGLSLEQLEALVKMVPTKEEEAKLLSYKADINELGSAEKFVRAMLSVPFAFQRVEAMLYRETFEDEVVHLRNSFSTLEEACKELRSSRFFLKLLEAVLKTGNRMNVGTIRGGARAFKLDALLKLADVKGTDGKTTLLHFFVQEIVRSEGIKASERIMGKTSENRTEEEKEEDYKRIGLELVSGLSAELCNVKKTATIDLDVLASSISNLSSGVANMENLVKGLLCEDEKSESFVISMKWFLNYAERKVRDLQGDEGRVMARVKEITEYFHGDVSKEESNPLRIFVIVRDFLEMVDNVCNELKRSTKSPRTIRIE

SEQ ID NO: 210686 - protein, 74 aa, Glycine max
  Coding DNA Sequence Number=SeqID_93908
MSIFLTIRGMGLDRGRKGKGVESVTLTIGCTPMAMDNDLVLTAACLLPKTLCMSHSQSVLQLHSRGQFNCVRLN

SEQ ID NO: 210687 - protein, 287 aa, Glycine max
  Coding DNA Sequence Number=SeqID_93909
  Gene Ontology: Mol. function=serine-type endopeptidase activity; Cellular component=extracellular region; Biological process =proteolysis
  Homolog annotation: Hit_ID=Q3E6S8; Match level="QueryCoverage=98%, HitCoverage=62%, E-value=1e-105, Identity=66%"; Hit description =Putative protease Do-like 14
  Pfam annotation: Domain name=Trypsin; Domain location=60-240; Score =50.0; E_value=7.9e-12; Accession=PF00089.16; Description=Trypsin
MRLLYSYRVSPVPSSGVSKEASAAAGDESKPHDCFGKDTIANAAAKVGPAVVNIAIPQDFFGITSGKSIGSGTIINKDGTILTAAHVVVDFLGTRGSSKGKIEVTLQDGRTFEGKVINADLHSDVAILKINSETPLPEAKFGSSSRLRPGDWVIAMGCPLSLQNTVTAGIVSCVDRKSSDLGFSGMPREYLQTDCAINMGNSGGPLVNMDGEIIGVNIMKVAAADGLSFSVPIDSVCKILEHFKKSGRVIRPWLGLKMLDLNEMIIAQLKKQDPSFPNVNKGILVPM

SEQ ID NO: 210688 - protein, 414 aa, Glycine max
  Coding DNA Sequence Number=SeqID_93910
  Gene Ontology: Mol. function=methionyl aminopeptidase activity; Cellular component=cytoplasm; Biological process=proteolysis
  Homolog annotation: Hit_ID=Q9SLN5; Match level="QueryCoverage=96%, HitCoverage=88%, E-value=1e-180, Identity=74%"; Hit description =Methionine aminopeptidase 1A
  Pfam annotation: Domain name=Peptidase_M24; Domain location=168-400; Score=290.8; E_value=2.5e-84; Accession=PF00557.14; Description =metallopeptidase family M24
MLEPILISFDSSQDCFKSSWSSHKSVHLKAKLSPPGTQNSDSLDEGWLYCLKRGQARTPKLPHFDWTGPLQPYPISSKRIVPDQIDKPDWAGDGTPKIEPNSSLQHTIEVKTPDQIERMRETCRGRSVSERGKRQHKVKQRREKNETENTEKKKRVHKNKKGNLQEWKTGRIAREVLDAAARIIQPGVTTDEIDRVVHEATIAAGGYPSPLNYHFFPKSCCTSVNEVICHGIPDARKLEDGDIVNVDVTVYYKGVHGDLNETYFVGNVDEESLQLVKCTYECLEKAISIVKPGIRFREIGEVINRHASMSGFSVVKSYCGHGIGELFHCAPNIPHYSRNKAVGVMKAGQTFTIEPMINAGVWRDRMWPDGWTAVTADGKRSAQFEHTLLVTETGVEVLTGRLQTSPNVFPWLGS

SEQ ID NO: 210689 - protein, 67 aa, Glycine max
  Coding DNA Sequence Number=SeqID_93911
NYVGLSSSLRIRRSKSLAFVGRPTISVILTLESRDMRRYPSGYPGGGPDDMREPFGLTLSFAIYKTQ

SEQ ID NO: 210690 - protein, 293 aa, Glycine max
  Coding DNA Sequence Number=SeqID_93912
  Gene Ontology: Biological process=regulation of progression through cell cycle
  Homolog annotation: Hit_ID=Q10LK4; Match level="QueryCoverage=61%, HitCoverage=47%, E-value=6e-46, Identity=56%"; Hit description=Rad9 family protein, expressed
SSLQEITIIATEPSSLPLDASNEIGGKAVELRSYMDPTKDNDTLLHTQLWIDPKEEFLQYVHTGDPIDVTFSVKELKGCEVDLHLHFEKAGEPILMAPKFGLEDGSHSNFDATLVLATMLISQLHEGAASEPLAGATRTHPHTEERNASYMQQENCRANVSSELPSDHTRIWSDLSAFLSRFTVLHDAVAANVIIAFFTSVTWLNSQRAFTKYGMLKPDTRSRISTLTDIPDQLKRIMDKNLKYIYPDAMQDNGQAISQHHRSNWVDAEEDDEDEQDEDDQYIQPTPPYYEEH

SEQ ID NO: 210691 - protein, 163 aa, Glycine max
  Coding DNA Sequence Number=SeqID_93913
  Homolog annotation: Hit_ID=Q945T0; Match level="QueryCoverage=39%, HitCoverage=55%, E-value=1e-27, Identity=89%"; Hit description=RALF
  Pfam annotation: Domain name=RALF; Domain location=99-163; Score =149.3; E_value=9.9e-42; Accession=PF05498.2; Description=Rapid ALkalinization Factor (RALF)
  Subcellular localization annotation: CTP_CleavageSite=32; ConfidenceScore=5.11e-01
MAGMGLLKLVANNAAVTLQNQSKKEHCNRKLRSFMIFQQPSKTEKKEENNLNKQTSMANTYSWLFLAICATLLLLLSSSPTADAGALGMEMTWIPSMPMEEEFQLDSEISRRILATTKYISYGALQRNTVPCSRRGASYYNCQPGAQANPYSRGCSAITRCRS

SEQ ID NO: 210692 - protein, 78 aa, Glycine max
  Coding DNA Sequence Number=SeqID_93914
  Homolog annotation: Hit_ID=Q1SEE1; Match level="QueryCoverage=63%, HitCoverage=3%, E-value=2e-15, Identity=80%"; Hit description =Integrase, catalytic region; Zinc finger, CCHC-type; Peptidase aspartic, catalytic
MDKWIIIAWIYFLLLNKSSDFSCIKYLNFIVGTTTVSWMSQIQKIVVLSTTEIEYVAVTEATEELIWRQGLLTELGFV

SEQ ID NO: 210693 - protein, 105 aa, Glycine max
  Coding DNA Sequence Number=SeqID_93915
  Homolog annotation: Hit_ID=Q1S238; Match level="QueryCoverage=66%, HitCoverage=15%, E-value=3e-07, Identity=54%"; Hit description=IMP dehydrogenase/GMP reductase
  Subcellular localization annotation: CTP_CleavageSite=62; ConfidenceScore=5.50e-01
MAVKCSAVAKVRLLAKNFVPTTAFRRSPVLCWFSFHFSGATIRGHRNTRSPQYISVGYNLSSAAATTVPVHGKTLVPTDVSIWNSPPPLSLTITRASRLDLELAD

SEQ ID NO: 210694 - protein, 146 aa, Glycine max
  Coding DNA Sequence Number=SeqID_93916
MGEIYPGLSRFSKFNQQKGDSKNCETQRNKQKEKKAIEGHSCNKGVCNMSAVQKGQNNKEGATEGISRSQHTDMHASEAKELWENAKSLGAGVKKDEKPVLEVLTDMERRDRGRLQKEDKVNSEGLKKLFYKDPFIQHKGSAGRRS

SEQ ID NO: 210695 - protein, 666 aa, Glycine max
  Coding DNA Sequence Number=SeqID_93917
  Homolog annotation: Hit_ID=Q67XY5; Match level="QueryCoverage=40%, HitCoverage=85%, E-value=1e-113, Identity=75%"; Hit description=ClpP protease complex subunit ClpR3
  Pfam annotation: Domain name=CLP_protease; Domain location=111-304; Score=142.0; E_value=1.7e-39; Accession=PF00574.13; Description=Clp protease
  Subcellular localization annotation: CTP_CleavageSite=64; ConfidenceScore=5.74e-01
MAMVGGTMMAAYLRVSMPTSPQSPTTTRRRCRNLKTSCSVNRPKIPMPPLNPKDPFLSKLASVAASSPETLLNTPKNSDTLPYLDIFDSPKLMATPAQVERSVSYNEHRPRRPPPDLPSLLLHGRIVYIGMPLVPAVTELVVAELMYLQYMDPKEPIYIYINSTGTTRDDGETVGMETEGFAIYDAMMQLKNEQIHTVAVGSAIGQACLLLSAGSPGKRFMMPHAKAMIQQPRIPSSGLMPASDVLIRAKEVIINRDNLVKLLAKHTGNSEETVANVMKRPYYMDATRAKEFGVIDREKVMADVASPDDWDKGAGGGCKGDCCLKFGRKNQVDDCCLKFGRKNQVDDISPLSLPPLPVFSKRYSPSSSSPIPKATPSHLLSLLGSKTQSSAVNPVVARGLKSCFKFLVPFSPVQPRHRKLGLGLPKLTVPSQREENELIWWPPEPVLELARLAVDSGGDPAAIHRLLDPTIIPHRYLIVKDQRKSAVSSPELAMADASFELNLYLQFLFELIVDRGPSVGLDVALNRFDLFHGHLFLALDSGRLECNNFTFGRFHAKEYPAYDKQVFPYNMGFCQRGSNVTYDDSMNLRNILWLAPMLGDSGEFWVAPGVLVVLDACPDGIIYRDLIPDYVNFARTIYEDDLGDVAVDVNYLNVGSETRNYQIFIC

SEQ ID NO: 210696 - protein, 467 aa, Glycine max
  Coding DNA Sequence Number=SeqID_93918
  Gene Ontology: Mol. function=acyltransferase activity; Cellular component=integral to membrane; Biological process=metabolic process
  Homolog annotation: Hit_ID=Q1SFZ6; Match level="QueryCoverage=99%, HitCoverage=99%, E-value=0.0, Identity=77%"; Hit description =Phospholipid/glycerol acyltransferase
  Pfam annotation: Domain name=Acyltransferase; Domain location=116 -263; Score=83.0; E_value=9.1e-22; Accession=PF01553.11; Description =Acyltransferase
MPLLDRGDVWKSKARSLQLQFRDRFRVAVDHHWRRRHHHTFIPSADGYFSSTIQRCLSRFRDFRRDSLPSSTSFYRKRVIKDFSSEEDSALVRTMQAVAVPVLGNVCHVFMNGLNQVQVYGLEKLHSALLHRPKGKPLLTVSNHVASMDDPLVIASLLPPSVLLDARNLRWTLCATDRCFKNPVTSAFFRSVKVLPVSRGDGIYQEGMDLALSKLNHGGWVHIFPEGSRSRDGGKTMGSSKRGVGRLVLDGDSMPLVVPFVHTGMQEIMPVGANFPRIGKMVTVLIGDPINFDDILEFDMEKGSNVPRRRLFDAVASRIGDRLHEMKVQVDTIAIEQEMQLQDNSSHSTDRTSEILQQVDWELFGMDSFMSVEDDSKQRQETVLLRNVSVSQHHQKSHSDQSWRAGFSYRMRDYIDQMELVSFAARGIFMNNETKNSAGRSREMGPLKAWKQFLEANLLRQWNYVHY

SEQ ID NO: 210697 - protein, 67 aa, Glycine max
  Coding DNA Sequence Number=SeqID_93919
MEGERSRRRRVAEKQWHGVAAASCVCEWVAGSRRRVDLCGAVPEWVAASSSRVTQVGSIVVRVDTSV

SEQ ID NO: 210698 - protein, 185 aa, Glycine max
  Coding DNA Sequence Number=SeqID_93920
  Homolog annotation: Hit_ID=Q1SG00; Match level="QueryCoverage=98%, HitCoverage=88%, E-value=2e-63, Identity=72%"; Hit description =Fibronectin, type III-like fold
MLILLCILHIILNGPTLCLGNKVEDKILKVGEELWRETLPLQGGSCFYQLQGLKPHTWYEVKISYPASIPASFSIQLKRNKSDVVLNNNRRLLNTEKLIFKTNSNQDEFLLVLVTVEPEGFPAKLHVAERQFIIFNIGIPHKAWWVVALALLCLGIAFIVPSFLPLHLLPKNQVLRTDDYVSKIS

SEQ ID NO: 210699 - protein, 176 aa, Glycine max
  Coding DNA Sequence Number=SeqID_93921
  Subcellular localization annotation: CTP_CleavageSite=64; ConfidenceScore=5.11e-01
MTTLTQIWMTLLLSNIPSSGHNTDLPCGGISWSVSSRHRNHTHKDTQWTRRSPTGPWGFQLWLRASVSPTGCPFPPARSRHHDIGIAPARHPVDPKKSNRVLELPTLITGLCQFYGVPVASSKVIRPTTNRAFIKKYYAPRQAQGETPQQPGDGRQRATDAPPPPLEFTSAHPQKG

SEQ ID NO: 210700 - protein, 145 aa, Glycine max
  Coding DNA Sequence Number=SeqID_93922
MGTLRFNALVTKWVVVPICWKRRNILVGSGRGCGERFCLLDYGEKFFDAMAHSDDANARRRTFSGNNRETGRRRGTQKYSYPLENLPNRETALYTKTIPPLLMVIGQTSKSDQQRAYNLGMKNRERKEVGKGKLFEIVERNIIQF

SEQ ID NO: 210701 - protein, 384 aa, Glycine max
  Coding DNA Sequence Number=SeqID_93923
  Gene Ontology: Mol. function=zinc ion binding
  Homolog annotation: Hit_ID=Q1STG4; Match level="QueryCoverage=81%, HitCoverage=81%, E-value=1e-128, Identity=73%"; Hit description=Zinc finger, RING-type; Zinc finger, PHD-type
MQCPNCRKVEKGQWLYANGCRSYPEFSMDEWTHDEDLYDLSYSEMSFGVHWCPFGNLTRLPSSFEEGDFSSTAYADHDVLGQHAIFAEHTAVSSASHPCPYIAYFGPIHPSTSNSGGTVSEASNFNHWNGPPVPGDMPTSYTFPAVDLHYHSWEHNSSHFSSANSRLGTAEQASVSPGSQRPARVGSEVPRSGSFMHPFLVGHSSAARAGNSVASSMIPPYPGSNARARDRVQALQAYYQPQQPHNSTTIRTPVASSTRRSSSHSGPVQLAPVASPPDQSAGFVYIPSGSSGRNFQEETHLPSRFHAWEREHLPSLALNNVGRESSWRAYHQTASVSDPTIVENQNLCMIEKRYIMLLAWLACYDRLYTLAGLGIHLSGSRVAV

SEQ ID NO: 210702 - protein, 171 aa, Glycine max
  Coding DNA Sequence Number=SeqID_93924
  Gene Ontology: Mol. function=nucleoside-triphosphatase activity; Cellular component=protein complex; Biological process=protein catabolic process
  Homolog annotation: Hit_ID=O04019; Match level="QueryCoverage=99%, HitCoverage=41%, E-value=2e-78, Identity=85%"; Hit description=26S protease regulatory subunit 6A homolog
  Pfam annotation: Domain name=AAA; Domain location=48-171; Score=88.6; E_value=2e-23; Accession=PF00004.19; Description=ATPase family associated with various cellular activities (AAA)
  Pfam annotation: Domain name=AAA_2; Domain location=45-171; Score= -50.7; E_value=0.066; Accession=PF07724.4; Description=ATPase family associated with various
  Pfam annotation: Domain name=AAA_5; Domain location=48-170; Score= -6.8; E_value=0.0058; Accession=PF07728.4; Description=ATPase family associated with various
  Pfam module annotation: Pfam domain module=AAA::AAA_2::AAA_5; Domain location=48-171::45-171::48-170
MEVDEKPTEDYNDIGGLEKQIQEWVETIVLPITHKERFQKFGVGPPKGVLLYGPPGTGKTLIARACAAQTNATFLKLAGYKYALVLAKLVRDAFQLAKEKSPCIIFMDEIDAIGTKRFDSEVSGDRELQRTMLELLNQLDGFSSDDRVKVIAATNRADILDPALMCSGRLD

SEQ ID NO: 210703 - protein, 318 aa, Glycine max
  Coding DNA Sequence Number=SeqID_93925
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=Q2R301; Match level="QueryCoverage=89%, HitCoverage=60%, E-value=6e-63, Identity=44%"; Hit description =Expressed protein
LMILVDDAGGQWPMIGHAPWNGCNLADFVMPFFLFIVGMAIPLALKTYLWGERQNIMLCFDIMDDLNNEGGFSHAPDNLTYGVDMKHIRWCGILQRIALAYLVVALVEIFSRSAQARDPEPTHLSIFKLYYWHWLVGACILAVYLALLYGIHVPDWQFTVHNPDSIYNGTTLTVTCGVRGKLDPPCNAVGYIDREVIGINHMYKRPAWRRSEACTENSPYEGPFKKNAPSWCYAPFEPEGILRCITCSSVPNSNVMCNCSSISAILSTIIGLHFGHVLIHLQDHPSRLKHWLLLGLALLTSGLILHFTHGVNSKLTVG

SEQ ID NO: 210704 - protein, 569 aa, Glycine max
  Coding DNA Sequence Number=SeqID_93926
  Gene Ontology: Mol. function=protein binding; Cellular component =intracellular; Biological process=cell proliferation
  Homolog annotation: Hit_ID=Q1SU92; Match level="QueryCoverage=99%, HitCoverage=99%, E-value=0.0, Identity=72%"; Hit description=BRCT; Pescadillo, N-terminal
  Pfam annotation: Domain name=BRCT; Domain location=306-383; Score =38.4; E_value=2.5e-08; Accession=PF00533.16; Description=BRCA1 C Terminus (BRCT) domain
  Pfam annotation: Domain name=Pescadillo_N; Domain location=8-259; Score=269.4; E_value=7.4e-78; Accession=PF06732.2; Description =Pescadillo N-terminus
  Pfam module annotation: Pfam domain module=BRCT::Pescadillo_N; Domain location=306-383::8-259
MVKHYRPPGKKKEGNAAKFVIRSQAIKQLQISLPLFREPKKKFKGTHQTYYHVKDVSFLHHEPLVEIHRAIRVHERKIKKAEAKKNHERANRLRQKTPKPKIDRIIRQRYPRFVDALGELDDCLTMVHLFAALPASESKKIDVECVHKCRRLAHEWQAFVSRTHKLRKTFVSVKGIYYQAEVEGQPITWLTPHSLQQVVSDDVDITTMLNFLQLYEYPPILDPSVGSFGSRYASANTRPSVLNSEASQAESEQVETKQKEAETGNETSELRLAQLQHQLPSNEPGALMHLVEEVTGEDEEDQDTKDCKKLFKNMKFFVSREVPRESMLFVIPAFGGIVSWEGEGAPFGESDQSISHQIVDREAQGHRFLSREYVQPQWVYDCVNARIILPTDNYLVGRTPPPHLSPFINYDEEGAYIPDYAKTIKHLQAAARKEILPLPGVGKDALEDPQNLLVEGIIDRAEANDAAQRKQKMMILEQQYRDDLKKELQGITCTSAGSIETSTEVVQTGESTTSVHENVDHDDMGKLMLSRKRRGLVKAIEKSRERNKAQTDLIKQRKKKIDEEQRQRS

SEQ ID NO: 210705 - protein, 445 aa, Glycine max
  Coding DNA Sequence Number=SeqID_93927
  Gene Ontology: Mol. function=protein transporter activity; Cellular component=nuclear pore; Biological process=protein import into nucleus, docking
  Homolog annotation: Hit_ID=Q1SYE0; Match level="QueryCoverage=99%, HitCoverage=47%, E-value=1e-179, Identity=66%"; Hit description=HASTY
DLAVMESMQLALENVVNAAFDGSNDFTKTNAEVQFALCRTFEAAFIAVTLACLSYGLFGLLVALKEGIADTMGCLQREGRLLQGEHNLLGEAFLVMSSSAGIQQQQDVLRWLLEPLSIQWTQLEWQDKYLSGPHGLVQLCSDVPVMWSIFHTVTFFERALKRSGLKKANWNSENSSTPNSIPLNPMASHISWMVTPLLKLLRCIHSLWSPSVSQALPGEVRAAMVMGDVERFSLLGEGNSKLPKGVTDGSKIDMNKEGYAEPNESDIRNWFKGIRDSGYNVLGLSTTVGDSFFKYLDVHSVAVALMENIQSMEFRHIRQLVHSTLIPLVKNCPLDMWEIWLEKLLHPFFVHAQQALSCSWSSLLQDGRAKVPDAHGILSGSDLKVEVMEETILRDLTREMCSLLSAIASPPLNTGIPSLEQSGHVCRLDMSSLKNLDTVASCSMV

SEQ ID NO: 210706 - protein, 130 aa, Glycine max
  Coding DNA Sequence Number=SeqID_93928
MSTSSSTASTRIRYAIVRPPAIKQFRVAFHNDQTFIEIPPFYHEQWAPNYPDKVRFKYNGATYPIRVQQHRGRYFFADGLSDVRADLKIYESIIINFFACNDNTIFDLHFTPPLNQQTCGRPILHSRVHA

SEQ ID NO: 210707 - protein, 220 aa, Glycine max
  Coding DNA Sequence Number=SeqID_93929
  Homolog annotation: Hit_ID=Q8LKG1; Match level="QueryCoverage=61%, HitCoverage=100%, E-value=3e-42, Identity=65%"; Hit description=Drm3
  Pfam annotation: Domain name=Auxin_repressed; Domain location=90-215; Score=183.4; E_value=5.4e-52; Accession=PF05564.3; Description =Dormancyauxin associated protein
  Subcellular localization annotation: CTP_CleavageSite=40; ConfidenceScore=5.46e-01
MWAHTLSNPYLDVNADPCGHVKGSNFDHNRRFRSPLTPTSCSTFNALASLNMTSVGRSCISYSEIWSSLGSPYAGSAKIRLIHMGLLDHLWDDTVAGPRPENGLGKLRKHHTFTFRPSSGKETEGGSVRSYGDESSEEATRVTRSIMIVKPPGYQSGSPPVSPAGSTTPISPFSALQLNPSVHFSQLGGKDSFRFRRRSASDAYEKRGQNRSGPSSPFDV

SEQ ID NO: 210708 - protein, 228 aa, Glycine max
  Coding DNA Sequence Number=SeqID_93930
  Gene Ontology: Cellular component=integral to membrane; Biological process=defense response to bacterium
  Homolog annotation: Hit_ID=Q10LN5; Match level="QueryCoverage=55%, HitCoverage=38%, E-value=2e-29, Identity=49%"; Hit description =MtN3/saliva family protein, expressed
  Pfam annotation: Domain name=MtN3_slv; Domain location=5-72; Score =56.8; E_value=7.1e-14; Accession=PF03083.6; Description=MtN3saliva family
MKSKTFCRVVKKKSTENYKGAPYITTFLCTSLWTSYGVLKPGGFQIAIVNGAGAVFHCTYIILFLVYSPQDQKVKTALWVAILDVGFLGTVISVTLFALHGTIQLSVLGMFCSGLTIIMYASPLLSMLTVYVVYKKKQPEATKGPRVGLSLGKGASNYEEAQLKDETVKVVVVEKALKKVKSLPKPVLNHEHILKKTLSFGVNNLPSTFWSTKPQQEDVAVDAEEAQV

SEQ ID NO: 210709 - protein, 239 aa, Glycine max
  Coding DNA Sequence Number=SeqID_93931
  Gene Ontology: Mol. function=enzyme inhibitor activity; Cellular component=cell wall; Biological process=cell wall modification
  Homolog annotation: Hit_ID=Q1SFY9; Match level="QueryCoverage=97%, HitCoverage=40%, E-value=1e-107, Identity=74%"; Hit description =Pectinesterase; Pectinesterase inhibitor
  Pfam annotation: Domain name=Pectinesterase; Domain location=2-220; Score=266.2; E_value=6.7e-77; Accession=PF01095.10; Description =Pectinesterase
MDYTNIYKLMHAAILGDFFVGIGMGFENSAGAEKHQAVALRVQADRSIFYKCRMDGYQDTLYAHTMRQFYRDCIISVAVLQNCTFVVRKPLENQQCIVTAQGRKERNQPSGLVIHGGSIVSDPTYYPVRFDNKAYLARPWKNFSRTIFMDSYIGDLITPDGYMPWQTLEGFSGMDTCFYAEFNNRGPGSDKTKRVKWEGVKTLDSDGITNFLPSMFFHGDDWIRVTRIPYYSGQVSHTN

SEQ ID NO: 210710 - protein, 251 aa, Glycine max
  Coding DNA Sequence Number=SeqID_93932
  Gene Ontology: Mol. function=structural constituent of ribosome; Cellular component=intracellular; Biological process=translation
  Homolog annotation: Hit_ID=Q1STF7; Match level="QueryCoverage=78%, HitCoverage=93%, E-value=2e-78, Identity=77%"; Hit description =Ribosomal protein L18e
  Pfam annotation: Domain name=Ribosomal_L18e; Domain location=51-250; Score=423.6; E_value=2.7e-124; Accession=PF00828.9; Description =Eukaryotic ribosomal protein L18
MRKARVHNKNPSMHSLNLRYSIDRSVVLEEVPFIALIAAMGIDLKAGGKSKKTKRTAPKSNDIYLKLLVKLYRFLVRRTDSNFNAVILKRLFMSKVNKPPISLSRLIKYTKGKEDKIAVVVGTVTDDIRVYEVPALKITALKFTERARARIEKAGGECLTFDQLALRAPLGQNTVWVDNNFGHCNFWTELLNLVPAVVPVLLRGPKNAREAVKHFGPAPGVPHSHTKPYVRAKGRKFERARGRRNSRGFRV

SEQ ID NO: 210711 - protein, 350 aa, Glycine max
  Coding DNA Sequence Number=SeqID_93933
  Gene Ontology: Mol. function=phosphoprotein phosphatase activity; Cellular component=nucleus; Biological process=protein amino acid dephosphorylation
  Homolog annotation: Hit_ID=P48490; Match level="QueryCoverage=87%, HitCoverage=97%, E-value=1e-172, Identity=95%"; Hit description =Serine/threonine-protein phosphatase PP1
  Pfam annotation: Domain name=Metallophos; Domain location=55-250; Score=159.1; E_value=1.1e-44; Accession=PF00149.18; Description =Calcineurin-like phosphoesterase
MEGMMDKGVLDDVIRRLLEGKGGKQVQLSESEIRQLCVNARQIFLSQPILLDLRAPIRICGDIHGQYQDLLRLFEYGGYPPAANYLFLGDYVDRGKQSLETICLLLAYKIRYPDKIYLLRGNHEEAKINRIYGFYDECKRRFNVRLWKIFTDCFNCLPVAALIDEKILCMHGGLSPELENLDQIREIQRPTEIPDSGLLCDLLWSDPDASIEGWAESDRGVSCTFGADVVAEFLDKNDVDLVCRGHQVVEDGYEFFAKRRLVTIFSAPNYGGEFDNAGALLSVDDSLVCSFEILKPADRASGSGSSKMNFKKESNPANSTCTELKLSSRSLAWESLPSTLRLQIANDTIL

SEQ ID NO: 210712 - protein, 97 aa, Glycine max
  Coding DNA Sequence Number=SeqID_93934
MKHLTVQRGTKRVTGQRRLFINLIQHVNTYYYWKFCCMDSFLNLRCTHFLGRDKDDGVRRSAVSGKKILLKLEKTKEDKVAESKRNELLNFLNASFD

SEQ ID NO: 210713 - protein, 231 aa, Glycine max
  Coding DNA Sequence Number=SeqID_93935
  Gene Ontology: Mol. function=enzyme inhibitor activity; Cellular component=cell wall; Biological process=cell wall modification
  Homolog annotation: Hit_ID=Q1STF1; Match level="QueryCoverage=97%, HitCoverage=43%, E-value=3e-96, Identity=73%"; Hit description =Pectinesterase; Pectinesterase inhibitor
  Pfam annotation: Domain name=Pectinesterase; Domain location=1-215; Score=417.1; E_value=2.4e-122; Accession=PF01095.10; Description =Pectinesterase
VVAQGFVAINITFRNTAGAIKHQAVALRSGADLSAFYNCSFEGYQDTLYTHSLRQFYRNCDIYGTVDFIFGNAAVVLQDCNIYPRLPLQNQFNAITAQGRTDINQNTGTSIHNCSITAASDLATSNGTTKTYLGRPWKQYSRTLYMQSFMDDGLVDPEGWKAWSGDFALDTLYYAEFDNQGPGSNTSNRVTWPGYHVINATDAVNFTVANFIIGDAWLPATGVPYYADLLI

SEQ ID NO: 210714 - protein, 215 aa, Glycine max
  Coding DNA Sequence Number=SeqID_93936
  Gene Ontology: Mol. function=enzyme inhibitor activity; Cellular component=cell wall; Biological process=cell wall modification
  Homolog annotation: Hit_ID=Q1SFY9; Match level="QueryCoverage=99%, HitCoverage=36%, E-value=6e-70, Identity=64%"; Hit description =Pectinesterase; Pectinesterase inhibitor
  Pfam annotation: Domain name=PMEI; Domain location=50-203; Score =117.7; E_value=3.2e-32; Accession=PF04043.6; Description=Plant invertasepectin methylesterase inhibitor
  Subcellular localization annotation: CTP_CleavageSite=50; ConfidenceScore=5.17e-01
MGGDAQKRNVIIGVSTFLLVAMVVAVTVNVNFNNKGSSSDSKEESKSHVASSMKAVKTLCAPTDYKKECEDNLIEHASNITDPRELIKIAFHVTISKIGEGLEKTQLMHEVENDPITKEALDTCKQLMNLSIGEFTRSLDKFAKFDLNNLDNILTSLKVWLSGAITYQETCLDAFENTTTDAGQKMQKLLQTAMHMSSNGLSIINELSKTLSEMH

SEQ ID NO: 210715 - protein, 329 aa, Glycine max
  Coding DNA Sequence Number=SeqID_93937
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=3e-46, Identity=30%"; Hit description= UPI00006A17C9 related cluster
GGPFGTSIPTFRGLHVLAYRELHVLAYRGLHVLAYRGLYVLAFRGLHALVFRGLHVLTFIGLHILTFIGLRVLAFRGLHTLPFRGLHALAFRGLHALTFKGLHALTFRGPHTLTFKGLHALIFRGLHVLTFRGLHVLAFRGLHALVFRGLHTLAFRGLHALAFRVLHVLAFRGLHVHDLALRGMHALTLRGVHTLAFRGPHALAFRGLHVLAFSGLHILAFRGLYALDFRGPHILAFKGLHAFAFRGLHALAFKGLHALTFRGLHVLTFRGLHVLTFKGLHVHTFKGLHAITFRGLHFLTFRGLQVLTFRGLHVLAFRGLHAFAFRGLH

SEQ ID NO: 210716 - protein, 76 aa, Glycine max
  Coding DNA Sequence Number=SeqID_93938
MERAMITMIVHTLLVFYYEKMVGYMPSSFADLVLVGERIGVGLKRGKFDYVASMNSGDRSQYQSFLLPTTLPVEKA

SEQ ID NO: 210717 - protein, 326 aa, Glycine max
  Coding DNA Sequence Number=SeqID_93939
  Gene Ontology: Mol. function=enzyme inhibitor activity; Cellular component=cell wall; Biological process=cell wall modification
  Homolog annotation: Hit_ID=Q7XAF8; Match level="QueryCoverage=86%, HitCoverage=52%, E-value=2e-62, Identity=42%"; Hit description =Papillar cell-specific pectin methylesterase-like protein
  Pfam annotation: Domain name=PMEI; Domain location=36-190; Score =90.9; E_value=4e-24; Accession=PF04043.6; Description=Plant invertasepectin methylesterase inhibitor
  Pfam annotation: Domain name=Pectinesterase; Domain location=242-326; Score=-156.5; E_value=8.6e-10; Accession=PF01095.10; Description =Pectinesterase
  Pfam module annotation: Pfam domain module=PMEI::Pectinesterase; Domain location=36-190::242-326
  Subcellular localization annotation: CTP_CleavageSite=81; ConfidenceScore=5.23e-01
KLHICGLMTFMAISELSLSLFMVYVLSIFSNFASLASSSSSTDTICNLTPYPTFCESNSPSSNSQGDIHEYGRFFAGKSLSSSKKFVALVSKYLYKSPSNFSNSTILALQDCHLLGDLNKDFWHKTQQSINSTNTLSSSEGEKLHNLLSATLTNHDTCLNSLHETTSSPDNDLLTHLSNGTKFYSISLAIFKRGWVNNTANKERKLAERNYHMWEQKLYEIIRIRGRKLFQFAPDNVVVSQRVVVNPDGSGNFTTINDAVVAAPNNTGVGNGFFVIHVVAGVYEEYVSIPKNKQYLMMIGDGINQTIITGNRSVVDGWTTFNSATF

SEQ ID NO: 210718 - protein, 574 aa, Glycine max
  Coding DNA Sequence Number=SeqID_93940
  Gene Ontology: Mol. function=sugar porter activity; Cellular component=intracellular; Biological process=metabolic process
  Homolog annotation: Hit_ID=Q1SZI6; Match level="QueryCoverage=95%, HitCoverage=53%, E-value=4e-82, Identity=32%"; Hit description =Tetratricopeptide-like helical
  Pfam annotation: Domain name=PPR; Domain location=111-145; Score =41.6; E_value=2.8e-09; Accession=PF01535.11; Description=PPR repeat
  Pfam annotation: Domain name=PPR; Domain location=214-248; Score =36.1; E_value=1.2e-07; Accession=PF01535.11; Description=PPR repeat
  Pfam annotation: Domain name=PPR; Domain location=315-349; Score =34.1; E_value=4.7e-07; Accession=PF01535.11; Description=PPR repeat
  Pfam annotation: Domain name=PPR; Domain location=416-450; Score =29.5; E_value=1.2e-05; Accession=PF01535.11; Description=PPR repeat
  Pfam module annotation: Pfam domain module=PPR::PPR::PPR::PPR; Domain location=111-145::214-248::315-349::416-450
  Subcellular localization annotation: CTP_CleavageSite=44; ConfidenceScore=5.40e-01
MSTSIVTPLPLKSISVNTLNKGTLNPAFQSLTLLSTHPLATPSRLEHAHSLLLDLCVAVKALPQGQQLHARLLKSHLSAFLATKLLHMYEKCGSLKDAVKVFDEMTERTIFTWNAMMGAFVSSGKYLEAIELYKEMRVLGVAIDACTFPSVLKACGALGESRLGAEIHGVAVKCGFGEFVFVCNALIAMYGKCGDLGGARVLFDGIMMEKEDTVSWNSIISAHVTEGKCLEALSLFRRMQEVGVASNTYTFVAALQGVEDPSFVKLGMGIHGAALKSNHFADVYVANALIAMYAKCGRMEDAERVFASMLCRDYVSWNTLLSGLVQNELYRDALNYFRDMQNSAQKPDQVSVLNLIAASGRSGNLLNGKEVHAYAIRNGLDSNMQIGNTLIDMYAKCCCVKHMGYAFECMHEKDLISWTTIIAGYAQNECHLEAINLFRKVQVKGMDVDPMMIGSVLRACSGLKSRNFIREIHGYVFKRDLADIMLQNAIVNVYGEVGHRDYARRAFESIRSKDIVSWTTIISALSATANLSSLKKGKEIHGFLIRKGFFLEGPIASSLVDIHSGLMVEGKEVP

SEQ ID NO: 210719 - protein, 133 aa, Glycine max
  Coding DNA Sequence Number=SeqID_93941
  Gene Ontology: Mol. function=protein transporter activity; Cellular component=nuclear pore; Biological process=intracellular protein transport
  Homolog annotation: Hit_ID=Q94KB0; Match level="QueryCoverage=89%, HitCoverage=22%, E-value=1e-20, Identity=46%"; Hit description =Importin alpha 1
  Pfam annotation: Domain name=Arm; Domain location=37-78; Score=32.2; E_value=1.8e-06; Accession=PF00514.13; Description=Armadillobeta -catenin-like repeat
  Pfam annotation: Domain name=Arm; Domain location=80-119; Score=7.1; E_value=1.6; Accession=PF00514.13; Description=Armadillobeta-catenin- like repeat
  Pfam module annotation: Pfam domain module=Arm::Arm; Domain location =37-78::80-119
MHMRSSRKVFVELLSKNDELRLQLEALCILTSFASGPAEHRRVIVEVGVLPQLVNLLHSSRNQDIREEIVFGLGIIASESPSYRDIVLDHGALSPLLHQFGKQSRLRRFATFCLCSLVHGLPPVNLEQVGDIS

SEQ ID NO: 210720 - protein, 225 aa, Glycine max
  Coding DNA Sequence Number=SeqID_93942
  Gene Ontology: Mol. function=metal ion binding; Cellular component =intracellular; Biological process=protein kinase C activation
  Homolog annotation: Hit_ID=Q6K2P5; Match level="QueryCoverage=82%, HitCoverage=25%, E-value=9e-35, Identity=41%"; Hit description =Putative pentatricopeptide (PPR) repeat-containing protein
MPIKPSSEVWCALLGACHIHSNKELGELAAKELLQSDTKNSGKYALISNIFAADGRWNDVEEVRLRMKGNGLKKNPGCSWIEVDNKIHTFMARDKSHPQTDDIYLKLAQFTKLLGKKGGYIAQTKFVFHNVSEEEKTQMLYRHSERLALGYGLLVTPKDSIRSLPTGPCCKGCQQIIAHFSGSFLLLAVTEISPSKFYCLFMMSQSTELGNWYQICKRSLGLLGS

SEQ ID NO: 210721 - protein, 643 aa, Glycine max
  Coding DNA Sequence Number=SeqID_93943
  Gene Ontology: Mol. function=enzyme inhibitor activity; Cellular component=cell wall; Biological process=cell wall modification
  Homolog annotation: Hit_ID=Q1SFY8; Match level="QueryCoverage=78%, HitCoverage=93%, E-value=0.0, Identity=86%"; Hit description =Pectinesterase; Pectinesterase inhibitor
  Pfam annotation: Domain name=Arm; Domain location=40-80; Score=38.5; E_value=2.4e-08; Accession=PF00514.13; Description=Armadillobeta -catenin-like repeat
  Pfam annotation: Domain name=PMEI; Domain location=144-300; Score =108.1; E_value=2.7e-29; Accession=PF04043.6; Description=Plant invertasepectin methylesterase inhibitor
  Pfam annotation: Domain name=Pectinesterase; Domain location=349-638; Score=722.9; E_value=2.2e-214; Accession=PF01095.10; Description =Pectinesterase
  Pfam module annotation: Pfam domain module=Arm::PMEI::Pectinesterase; Domain location=40-80::144-300::349-638
MYFQLVNQLFPSLHKLLTSDYNKSMFKQACRTISNIIVGTRARIQTVFDANIIPYLVQSLQHAEFDVKKEAAWAIFYVTSGGSHEHIRVDECEGRDKIEKLLTHWNDEISERAARILKEMTNDGDDAIPSDEEVFINPSEVQTQDMQALIAQACMDIENQNSCLTNIHNELTKIGPPSPTSVVSAALKHTLNEARVAIDNITKITTFSVSYREQQAIEDCRELLDFSVSELAWSMGEMRRIRSGDTNAQYEGNLEAWLSAALSNQDTCLEGFEGTDRRLESYISGSLTQVTQLISNVLSLYTQLHSLPFKPPRNTTTPLTSHETLEFPEWMSEGDQELLKAKPHGVRADAVVALDGSGHYRSITDAVNAAPSYSQRRYVIYVKKGLYKENVDMKRKMTNIMLVGDGIGQTIITSNRNFMQGWTTFRTATLAVSGKGFIAKDMSFRNTAGPVNHQAVALRVDSDQSAFYRCSVEGHQDTLYAHSLRQFYRECEIYGTIDFIFGNGAAVLQNCKIYTRVPLPLQKVTITAQGRKSPHQSTGFTIQDSYILATQPTYLGRPWKQYSRTVYINTYMSGLVQPRGWLEWFGNFALNTLWYGEYRNYGPGAALAARVRWPGYHVIKDASTASYFTVQRFINGGTWLPST

SEQ ID NO: 210722 - protein, 129 aa, Glycine max
  Coding DNA Sequence Number=SeqID_93944
  Gene Ontology: Mol. function=protein binding
  Homolog annotation: Hit_ID=Q1SGK8; Match level="QueryCoverage=100%, HitCoverage=19%, E-value=3e-40, Identity=66%"; Hit description =Leucine-rich repeat; Leucine-rich repeat, cysteine-containing subtype
  Subcellular localization annotation: CTP_CleavageSite=40; ConfidenceScore=5.04e-01
MGHIHGLQHGARANQHLQAHVVQPGGATQHEPPQSPSPTRRSLTQHNRHNPVFDPRTKRQVQRLNVAEPLQQPEQKLDSEDPNALPGRRFDPEKFLAHQPPRFPIRPELLEDPDEQVFGQEAENGFRQH

SEQ ID NO: 210723 - protein, 264 aa, Glycine max
  Coding DNA Sequence Number=SeqID_93945
MLKEQDLPDIPHYGYDFTKFETIINKNVVADVLIEVIGEFVDLVQCSLETRPKKLVFTMRDEDKLALSIQNSMFGSKLFINDDSIPEIEHFKKSLIASNTDNISLSLRLSQKSSSSQLTHGGKLTINAPVKYLNELGQVDKQYYFVTVGVISKLLVANGWCFEGCPNCSKKKDSTESTNTFVKSVKIKISSNQLLRKSPVKRMRQMLKKEKSISFGKNDPDILQSQTPCKKLFSSNTQMDDVGQEKLGSFQLSSSKLCKHIKEE

SEQ ID NO: 210724 - protein, 546 aa, Glycine max
  Coding DNA Sequence Number=SeqID_93946
  Gene Ontology: Mol. function=zinc ion binding; Cellular component =nucleus; Biological process=regulation of transcription
  Homolog annotation: Hit_ID=Q1S0I8; Match level="QueryCoverage=99%, HitCoverage=100%, E-value=3e-98, Identity=69%"; Hit description =FAR1; Zinc finger, SWIM-type
  Pfam annotation: Domain name=DUF291; Domain location=352-419; Score= -26.7; E_value=0.099; Accession=PF03442.5; Description=Domain of unknown function
  Pfam annotation: Domain name=FAR1; Domain location=75-208; Score= -1.6; E_value=1.6e-06; Accession=PF03101.5; Description=FAR1 family
  Pfam module annotation: Pfam domain module=DUF291::FAR1; Domain location=352-419::75-208
MDGDQNEFGSVHEGNVDIGPQTSNNLELNVEQNCCSPNVARASDSQSCPPAANVLSCDTVLGIGTEFESNDHAYRFYNKYARLLGFNVRKDWINRSKVHGQVVSRKFTCSQEGWKDKRDANVKKHRKETRSGCLAHMIVNRQPDGKYQRYGERRSRVCLLGYFQRQHFENPTFFYAIQLDVEDKLYENTLKYLSHVVKDAESFANDLRRSIYDPKDEEFTRAWEAMLEKYNLQQNEWLRWIYREREMGCCLCHALKVLDHTNIKVVPSQYILDRWTGDARLGNLREIKQLTMQGNPNMVVASCYKDLCHRLLKLSVRASESMEAYQFSARQLDEVMVGVEKILALKAEEGQVITSSNIDANASENEPAEIFLNGHAIEDQDESNRANGGKDRRATSDRGYLTTMTFNGADSDRILNVEVSPPNTVVCISSPSSAYVSSHSASPNPILQGMYSFEANQVVHCMYEQTNHVLDHQSNSNTLQPPNIFSNQQDCPGQSQLLQEPIIQSTYHASMPCNNQMRQGIDLDIQNPHSSSFLLYDHRYRSSESA

SEQ ID NO: 210725 - protein, 116 aa, Glycine max
  Coding DNA Sequence Number=SeqID_93947
MGRYAHAGKKGSLILVRIGDQSKVMVVTIEHDVGCKFIEESTQAGVGVEGVLYSGSPGLSVEVTMFCFILPKRSTAKAAKENPTNLQRNSISLRFDRDRVNLPPCLLIINLIRVKN

SEQ ID NO: 210726 - protein, 104 aa, Glycine max
  Coding DNA Sequence Number=SeqID_93948
MIQLLCAARDDIFRLIIHEITCIETVHNLLAIELKGDLIQKGLTILPLMLHFKQQTQGGVQHRLPESRIRCNEEFMLLLCMLPVSEIQHGQTKCDTYYFVDTIP

SEQ ID NO: 210727 - protein, 428 aa, Glycine max
  Coding DNA Sequence Number=SeqID_93949
  Homolog annotation: Hit_ID=Q1S0I7; Match level="QueryCoverage=100%, HitCoverage=86%, E-value=1e-76, Identity=44%"; Hit description=IQ calmodulin-binding region
  Pfam annotation: Domain name=IQ; Domain location=109-129; Score=18.2; E_value=0.029; Accession=PF00612.17; Description=IQ calmodulin -binding motif
  Pfam annotation: Domain name=IQ; Domain location=159-179; Score=17.2; E_value=0.057; Accession=PF00612.17; Description=IQ calmodulin -binding motif
  Pfam module annotation: Pfam domain module=IQ::IQ; Domain location =109-129::159-179
  Subcellular localization annotation: CTP_CleavageSite=18; ConfidenceScore=5.28e-01
MGFLRRIFGAKKPSDSKSAKKRWTFLKHTVRNKSLPPPPPPSAVTYFDSSTPLDANKHAIAVAAATAAVAEAALAAAHAAAEVVRLTSGGVSATSTRPAAMAARVGNLETAAVRIQSAFRGYLELQDFVGIEKRKIGRGKVEWPCAQKPSKARRALRALKALVKLQALVRGHIVRKQSADMLRRMQTLVRLQAQARASRAHLSDPSFNFNSSLSHYPVPEEYEHPPRGFSTKFDGSSILKRCSSNANSRNVDSERARFDSNWLNRWMELDNKSSQTGDASLKNGRPDDDKSDKILEVDTWRPHFKSHHSSSSFQAAHYYLSSDYNNENFGAAHESPSKRSAKALNQSFSSREVLQLSSLKFHKGKEEASSRTADNSPQTFSANSRNGSGARRGGGPFTPTRSECSWGFLSGYPGHPNYMANTESFRAK

SEQ ID NO: 210728 - protein, 36 aa, Glycine max
  Coding DNA Sequence Number=SeqID_93950
MGSGDYNEDDNDGGIDDDNNSGNNNNGDNKGECWIE

SEQ ID NO: 210729 - protein, 89 aa, Glycine max
  Coding DNA Sequence Number=SeqID_93951
MIYCQPLDTCKGLYFCWRGAETNTAGEGPNLKAPRYFNEACSHQGEREEKGRKKEEGLGGGGEREVEAPMGANCYDYVFPGLKIEDIRL

SEQ ID NO: 210730 - protein, 459 aa, Glycine max
  Coding DNA Sequence Number=SeqID_93952
  Gene Ontology: Mol. function=oxidoreductase activity, acting on diphenols and related substances as donors, oxygen as acceptor; Cellular component=integral to membrane; Biological process=electron transport
  Homolog annotation: Hit_ID=Q2KWP8; Match level="QueryCoverage=64%, HitCoverage=98%, E-value=1e-125, Identity=73%"; Hit description =Ubiquinol oxidase polypeptide II
  Subcellular localization annotation: CTP_CleavageSite=48; ConfidenceScore=5.20e-01
WWGGRKPAESAEATANWVRIMMASAKPRSSMISATMMYITPMRLWSTEVMAPKTARPPRHTAASVTMTMGSWYGMASRIIRRGGARGVIDAGHLGHGAAQDVVEHGRRHRGVPGDRVVFAALGQFLVHRRGQRGAGSLGLPDPVVEAFLRRGDGLEAHAGEAGAAVVGRDTGVGAGLARVQVQLGLHARHRVDLAAQLGDEERVHDRGRGDPEVDRDVDREGDLVDRGDVVLGVDEQPLPIQRHHLDGDRLVLGDERLVGIERVRGAPGDHGEDRHDDTWHGPDHDFDRRGVGPLGLVVGLGIGCAVFPGKRQDHDDDRDHHQEHQTGCREQQGLFLSANVSLGGEDFHVAAAKQHDRADAKNARKGRKEGVFHVQPWMEGGKCCVAADWNAARQQRPSYRFDLGQGCDEWSHCLAGFCPQGFPLRVFPGGGGLCWKGWGAISRVTSSDKSFCNHWHLV

SEQ ID NO: 210731 - protein, 43 aa, Glycine max
  Coding DNA Sequence Number=SeqID_93953
MAERRENHVIKRQIAILKDGVVESFRDLDSEDRERGHRAPVEF

SEQ ID NO: 210732 - protein, 334 aa, Glycine max
  Coding DNA Sequence Number=SeqID_93954
  Gene Ontology: Mol. function=protein phosphatase type 2C activity; Cellular component=nucleus; Biological process=protein amino acid dephosphorylation
  Homolog annotation: Hit_ID=Q1SGL9; Match level="QueryCoverage=96%, HitCoverage=92%, E-value=1e-151, Identity=77%"; Hit description =Protein phosphatase 2C-like
  Pfam annotation: Domain name=PP2C; Domain location=43-304; Score =45.1; E_value=2.4e-10; Accession=PF00481.12; Description=Protein phosphatase 2C
MKKGGKNGKCGGRETADAMAKEAKKNDMMLCSSGIVHVDGSNNFASVFSKRGQKGVNQDCCIVWEEFGCQEDMIFCGIFDGHGPWGHFVAKRVRESMPPSLLCNWQETLAQTSIDQAIDVEEEKSKQYRFNIWKHSYLKTCAAIDQELEQYRKIDSFYSGTTALSIVRQGELIVIANVGDSRAVLATTSDDGSLVPVQLTIDFKPNLPQEAERIIQCQGRVFCLEDEPGVHRVWLPDEESPGLAMSRAFGDYCIKGHGLISVPEVWDVISNKEAVDIVSSTADKAKAAKRLVECAVHAWKRKRQGIAVDDISAICLFFHSSLSTEQVSQVATLK

SEQ ID NO: 210733 - protein, 246 aa, Glycine max
  Coding DNA Sequence Number=SeqID_93955
  Subcellular localization annotation: CTP_CleavageSite=23; ConfidenceScore=5.02e-01
MVLSTHQASNLPPDACHMSFQASSAVLSGLPHQPKYSSFLIDASSSLNHNQNYIIRKSGSFVWYQVMASLEIKSGALVSLQDLRPSSPFFKQGASLRITGNEMLHCCSANVVYNIMLKFLAFGFCCQSCSEGHVDTISSDTVLGRIVNGMLTLTGLHEYSIETGLATIIDGDDILKVSTKHLRDLTFQVGSVYQFIGELLIQPDNEGVLQARVGRNVDGIDLNLYHQSLLLLRQFQTNHLNNPATM

SEQ ID NO: 210734 - protein, 814 aa, Glycine max
  Coding DNA Sequence Number=SeqID_93956
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=95%, HitCoverage=97%, E-value=0.0, Identity=49%"; Hit description =Probable Na/H antiporter [imported]-Arabidopsis thaliana
  Pfam annotation: Domain name=Na_H_Exchanger; Domain location=34-425; Score=158.4; E_value=1.8e-44; Accession=PF00999.11; Description =Sodiumhydrogen exchanger family
  Pfam annotation: Domain name=TatC; Domain location=143-312; Score= -85.6; E_value=0.09; Accession=PF00902.8; Description=Sec-independent protein translocase protein (TatC)
  Pfam annotation: Domain name=YibE_F; Domain location=162-366; Score= -147.4; E_value=0.052; Accession=PF07907.2; Description=YibEF-like protein
  Pfam module annotation: Pfam domain module=Na_H_Exchanger::TatC::YibE_ F; Domain location=34-425::143-312::162-366
MANTIPACYEVYITNPSRIWRTDKVLQTQLPVLAFQIAFVVVLSRIFFIIFKPLHQTRLISQISVGFLLTPPLLGRFTPIFEFIFPVNGVLNVELLSHLGLIFYAFLSGLEMNLDTILRVKKKAASIAVAGIVFPMVLAPCLYALYRKIYGSNGVFPLEEGSVNAYLLWTLILTVTGFPVIAHTLSELKLIYTGLGKAALTAAMISDTYGWILFTLLVPFAINGKGAMYTVLSTILFIVVCIFVVRPIIQRFMDSKTDKDEWEDNELLFVVMGVLVCANVTDILGAHGIVGAFVFGLILPHGKFADTMMSISDDFTGGFLAPLFFAGNGMRLILTSVFQGNWPLTLLIILLLCSLKILSTLFATFFFGMRTQDGLAIGLLLNTKGAMALIMLNIAWDRAIFFVPTYAVITSAVLLMTVVVSPVINAVYRPRKRFEQNKLKTIQKLRVDAELRILACVHNTRQATSMISIIETFNATRLSPIHVCAMYLIELTGRAAALVAAHIEKPSSQPGEQNLTKSQAELESIANTFDAFGEAYDAVRIETLNVVSSYATIHEDIYNSANEKHTSLIILPFHKQLSSEGALEVTNAVYRDINQNVMQHAPCSVGIFLDRDFGSIPKMNLRILMLFVGGPDDREALAVAWRMAGHPGIKLSVVRILLFDEAAEVDGSVHDEARGILSSVMDSEKQKELDDEYINSFRLTAVNNKESISYSEIDVHIGEDIPNILNELEKNGCDLYIVGQGNCRNSRVFSNLLEWCECLELGVIGDILASNNFGSRSSLLVVQQYGYGGMVFGKNLNQKATNNDGFESLVVKTE

SEQ ID NO: 210735 - protein, 196 aa, Glycine max
  Coding DNA Sequence Number=SeqID_93957
  Homolog annotation: Hit_ID=Q47522; Match level="QueryCoverage=20%, HitCoverage=50%, E-value=2e-16, Identity=97%"; Hit description=LacZ protein
VPPGQLLTGWCVTAIAPPDISAGKCSGRVPFAIQAAQLLGRAIGAGLFAITPAGERGMCCKAIKLGNARIRSLSAMVAHRMGYKRISLIAGGGAGHDPRMIGYKFWPKVGFDAELDPGETDAAPHLAMCIKLIDTVDLEGGPVGKPVVPAALMNRPTRGERRFAYWALAECILAYYVGTDEGVSEVLHVAGEKRLH

SEQ ID NO: 210736 - protein, 99 aa, Glycine max
  Coding DNA Sequence Number=SeqID_93958
MNLRVEDAGKNGGSLVTMSLPKEDLPEDFRKKGSSVGNETTSGRTDLSENSRNTSFGMFSEDVLVPETFRKRVLPDDLSVVPEALSGRAFFRNCSGRID

SEQ ID NO: 210737 - protein, 82 aa, Glycine max
  Coding DNA Sequence Number=SeqID_93959
MEQYLQHLVHQQAANHRGQSQGFTLFACPTPDQFRAEVAWPGDWPEAQAGEALTEAPGDADEARMDEEMTDLLDFLGGSRAT

SEQ ID NO: 210738 - protein, 154 aa, Glycine max
  Coding DNA Sequence Number=SeqID_93960
MVGDLEGKTPLITKSRLTHVAVVGNMLVKLVQHRRHSTCLFLRRSCGSTKGQYIPKGALVIFDGLNKELCVGIHLVFIRIVHLGRKSGWLFCAFYFKQAASSLMMAYGGDEFVHPDNAVPVSLTRSGYPRIIPSHHRRMILKKDEKADMLVKFY

SEQ ID NO: 210739 - protein, 1035 aa, Glycine max
  Coding DNA Sequence Number=SeqID_93961
  Gene Ontology: Mol. function=microtubule motor activity; Cellular component=microtubule associated complex; Biological process =microtubule-based movement
  Homolog annotation: Hit_ID=Q1RV39; Match level="QueryCoverage=99%, HitCoverage=99%, E-value=0.0, Identity=55%"; Hit description =Calponin-like actin-binding; Kinesin, motor region
  Pfam annotation: Domain name=CH; Domain location=40-161; Score=62.0; E_value=1.9e-15; Accession=PF00307.21; Description=Calponin homology (CH) domain
  Pfam annotation: Domain name=Kinesin; Domain location=436-751; Score =527.0; E_value=2e-155; Accession=PF00225.13; Description=Kinesin motor domain
  Pfam module annotation: Pfam domain module=CH::Kinesin; Domain location=40-161::436-751
MAAEPVLTFSLASVVKDVLQQHGGRLDVNLASRKAEEASLRRYEAAGWLRKTVGVVGGKDLPAEPSEEDFRIGLRSGIILCNVLNKIQPGAVSKVVEGPCDSVIIPDGAALSVYQYFENVRNFLVAVEEMGLPSFEASDLEQGGKSSRIVNCVLALKSHAERKFGGGNGSSKYSGVAKPPTTGKTLLRKNSEPFMKSMWTMPSGDRDGYMSDPGHDLNERMVRVVWLSFLNWYPQGSVSSLNSLVRQYLSDKKPEEIPTVVESLLSKVMEEFEHHMQIRQEMCKTTQGDKAPSETECSISEAASINERMEEKEDEQDEQDEHDLQDEQNIQDKQEENYEEKYNKREDSSRQILILKQQNIVETQNRSIQELKSIVHQTKLGMQFMQNEHQKEIINLSKHLHSLASAASGYHKVLDENRKLYNIVQDLKGNIRVYCRVRPFLGGQLSHYSSVGNVEEGSISIITPSKYGKEGKKTFNFNRVFGPSATQGEVFADTQPLIRSVLDGYNVCIFAYGQTGSGKTFTMSGPDDINEETIGVNYRALKDLFYLSEQRKDTISYEISVQMLEIYNEQVRDLLTTDEIRNSSHNGINVPDADLVPVSCTSDVINLMNLGQKNRAVGSTAMNDRSSRSHSCLTVHVQGKNLTSGSTIRGSMHLVDLAGSERADKTEATGDRMKEAQHINKSLSALGDVISSLAQKNAHVPYRNSKLTQLLQDSLGGQAKTLMFVHISPEPEALGETLSTLKFAERVSTVELGAARVNKDNSDVKELKEQIASLKAALARKEGGEAEHFQQSANSSSHEIPKLKSYASSPPMQRSLIGGARKLPKDDSSSLNGQKNAASKLKRRSLDLHDMRKNSPPWPPVRSHRKEDDKESISGDWVDKISINRNDSLTSDDSLVGQWETESKQSSPMLSPTFLSEPSKICMDHSLHRKDNQELFDMAITDESDELEIATSDSSESDLHWPAHIPKPITVSSGLGIKARKKPINLRPTKSLEARSMIPSLIPIPVPSRKQPTLVTPARKTPGSIDVKRRIGNAK

SEQ ID NO: 210740 - protein, 352 aa, Glycine max
  Coding DNA Sequence Number=SeqID_93962
  Homolog annotation: Hit_ID=Q6YZ61; Match level="QueryCoverage=30%, HitCoverage=17%, E-value=1e-18, Identity=42%"; Hit description=MYB transcription factor-like
  Pfam annotation: Domain name=Myb_DNA-binding; Domain location=152 -202; Score=27.4; E_value=5e-05; Accession=PF00249.21; Description =Myb-like DNA-binding domain
MKHMVPSGTIQVNHQNHLAAGILTCKKGKGPVEKGQPAVLREKRFRKPTQRYIEEFSNSRSKEKAPTAVTKTEHLSDSSCDVLHIRIKALKKSPSEKSSNENSDVMLPELQVRKRRLEKEKLEYDKELFPSESEDECSTSKRSRRKDRRKHQKMWTLPEVLKLVEGISEYGVGRWTDIKRFLFSSSSYRTPIDLRDKWRNLLRASSAQKTSREAEQNDELALRPLPFNVVHRVRELAKIHPYPRQRGSKRLRVSQAGSSIIAKDSPPLSLSKRNCIEPGYKARNVLKGFSTRQKFYSREAFKITPLCRQPHKDRVFQRPKVREKWEQNDNVTAQDSTGMHVKRKQSKVCLIK

SEQ ID NO: 210741 - protein, 450 aa, Glycine max
  Coding DNA Sequence Number=SeqID_93963
  Gene Ontology: Mol. function=calmodulin binding
  Homolog annotation: Hit_ID=Q10MN7; Match level="QueryCoverage=72%, HitCoverage=62%, E-value=6e-45, Identity=34%"; Hit description =Calmodulin-binding protein, putative, expressed
  Pfam annotation: Domain name=Calmodulin_bind; Domain location=85-369; Score=157.9; E_value=2.7e-44; Accession=PF07887.2; Description =Calmodulin binding protein-like
MESKRQSQQEGDERGVQILVHGSKRRREDSQQSDTFRIVRSLRSLVHLKNDIVPCLENLVQRLVREELECQLTRTINNQIGISGTKPYHLVFKNELPATIYTNSKIQAKGNTPLEVALFDIESQSTVTEGSLSSIKIEICVLNGEFGSNGLEDWSSDQFNSKILPPRDNKGQLLKGDTIITLENGVGYITNPEITDNSSWIRTRRFRLGAKVAQSNLKDAINIREGISKPFIVKDARGEKKHDTPSLNDETWRLKHISKSGEVCQRLSKHGINTVEDLLKEHETNPSSLPEKFGKISKKKLEQIIKHAQKAKHDKTCVAEATFEGQNYHSGKNILISDEREHYKNLKDPVPIETVTHELVKALTPVTAQYSAPYQDVQQLDFPIEEISRLMDSLNWSVEGQFVDGNIWPVAIDDQNLSCSMIPPEAECSNRSSFPNSAMYKSDKGKSKMV

SEQ ID NO: 210742 - protein, 76 aa, Glycine max
  Coding DNA Sequence Number=SeqID_93964
MYQSKSRLRIEEAKQGYNVTQDGARKNLGPKAYIKNILLKDEPCYNREAPDDNLKFARGSDCYENRLERNFPPHRV

SEQ ID NO: 210743 - protein, 66 aa, Glycine max
  Coding DNA Sequence Number=SeqID_93965
MHGIVKNGEDGGRRKRRRRKGKGGNEFEGVKGLVSSLAMVEIEGNVKGKEVNMFNNHAQVNMSDKE

SEQ ID NO: 210744 - protein, 920 aa, Glycine max
  Coding DNA Sequence Number=SeqID_93966
  Gene Ontology: Mol. function=peptidase activity; Cellular component =cell surface
  Homolog annotation: Hit_ID=Q10MM5; Match level="QueryCoverage=97%, HitCoverage=96%, E-value=1e-84, Identity=30%"; Hit description =Expressed protein
MLTFTGKREMEMEKKRSKGSFLSLFDWNSKSRKKLVWNDPEVPKQGKENVENLPKSQLTRKKVDEIGESPSNIQSCDFDSTLSICSDEGCGSKAPGLVARLMGLDSLPAAAVTELSCTSLYGSKSHGASHCNEGALHSADDFCPADYINTLLKPEKSSLDAMESRARKVESLPIKRFQTEMLPPKSAKTIPVTHNKLLSPIKSPSILPPKNADHVMEAAAKIIEASPRPYLRNRTTSTEPSSVPLRILNLKERFEAAQYASMPGKLVNLSNAYPANGRLSERNSNLYKCTSAVKGSRGSEKNSSCHLASKGKSVSLTAKNNAHSRDTLISNDDIPCMKQKEKNEIKSNQLSRSHKPSTQKTMQQRPCSSRNSNVLGQNNQKQNSMTAKGKSTSKIDSNKLTTRASSSETSGIRKTTNKGTITANIQPKRSSTRATDNQKQFSRSKTVSISQKKKISKDVHEGRGPDNAVNNFGSKSIKCNFTTDGSFDQDAFNMIESKDVISFTFTSPLRRTMPESSSSTEQVMGTRNRIDVNSLGHSDNLYPKKLSLSPTGQPMIDSDALSVLLDKKLQELASRINLPQCTLATEGSSTGLRSSVQDQVPSVSSTTPKEQNKSFCSDLSSDKLDSMHNSHYCSSDDPVLNMNQQLQTSEVSEDPSCSSNSERGNDLVCWHSTAVAGFETPFVCESYLDSEDSAYGSTVYSSTQDEEVSSFSQISEPVSLESEVKGSEESSSPLGDGKMTIKQISEISNSVDFKRSRNTVLEYVHDILCNAEFMAEEFVMGQTSALIMPNVFDLLENQHYGTENFGEEYSMLERKAIFDCASELLELRCKEAFVGTCKAWSGWMMLIQRKSWMAEELYKELLGFRSMEEVMVDELVTKDMSSGCGKWLDFDVEAFEEGLEIEGDILSHLINELVSDLLLV

SEQ ID NO: 210745 - protein, 112 aa, Glycine max
  Coding DNA Sequence Number=SeqID_93967
MEPRSVELKTERVREKFVRMFETEKGQNRQKSVTKRRDGSVSTWSLQNPTRIPHSLVLFVVAFLPLTLLRLNAVCHKLRYSPHLPLKATSFGPVTHSSLAFFSCPSASCQRF

SEQ ID NO: 210746 - protein, 418 aa, Glycine max
  Coding DNA Sequence Number=SeqID_93968
  Gene Ontology: Mol. function=calmodulin binding
  Homolog annotation: Hit_ID=Q10MN7; Match level="QueryCoverage=85%, HitCoverage=69%, E-value=2e-69, Identity=42%"; Hit description =Calmodulin-binding protein, putative, expressed
  Pfam annotation: Domain name=Calmodulin_bind; Domain location=83-388; Score=329.9; E_value=4.5e-96; Accession=PF07887.2; Description =Calmodulin binding protein-like
MVSKRQSGQRHEGSGKVPIQEQKQTSISGLRNVINALWMSDHSAYLENFLRRVVSEVVEQKFEDQAHLFPRKRVGEAGISGAKPFKLCFINKLPETIFTRSSIIAEDKSPLQIVLFDVRTQSVVNDGPLSSLKIEICVLDGEFGSQGSEDWTEEEFNSNILREREGKEPLLIGERFASLKNGVGCIPKIAISDNSRWLRSRRFSIGVKVVQPTSNGEKIQEGRSKPFVVKDNRGESYKKHYPPYLKLNDDIWRLKKIAKEGKIHKQLSSRGIHNVKDLLRLYITNEPSLYEMFGNIPKKSWLVITEHAKACVIDDYQLYSYHSQELQIGLLFNSIYILVGVTFDWQNYYSPDTLTPREKHLVEIVKQQAYKNVNNLELINDTKLNYLNLAACLKARESDPPDQGLHHINISTVQGIFK

SEQ ID NO: 210747 - protein, 779 aa, Glycine max
  Coding DNA Sequence Number=SeqID_93969
  Gene Ontology: Mol. function=nucleoside-triphosphatase activity; Cellular component=integral to membrane; Biological process=transport
  Homolog annotation: Hit_ID=Q9FF46; Match level="QueryCoverage=98%, HitCoverage=68%, E-value=0.0, Identity=64%"; Hit description =Putative white-brown complex homolog protein 29
  Pfam annotation: Domain name=ABC2_membrane; Domain location=572-769; Score=-17.4; E_value=0.011; Accession=PF01061.14; Description=ABC-2 type transporter
  Pfam annotation: Domain name=ABC_tran; Domain location=241-431; Score= 124.4; E_value=3.2e-34; Accession=PF00005.17; Description=ABC transporter
  Pfam module annotation: Pfam domain module=ABC2_membrane::ABC_tran; Domain location=572-769::241-431
MHAYGALIIVALSTLLIFIYNCSDQVLVTRERRKAKSRESAARQVRETVQARERWKIAKDVAKKGRGGLQEQLSRTFSRKKSVKQSDHSSQAKRGTGDTFLPPMPPNSSSLYEQPSAALKAQNKEPTNLTKMLNSLEDDPHSNEGFNLQIGDKNIKKQMPKGKNLHTQSQILRYAYGQIEKEKAQQEKNKNLTFSGVISMATEGDVRTRPVIEVAFKDLTLTLKGKRKHIMRCVTGKLMPGRVSAVMGPSGAGKTTFLSALAGKARGCTMTGSILINGKPESIHCYQKIIGYVPQDDIVHGNLTVEENLRFSARCRLSADMPKPDKVLIVERVIESLGLQAVRDSLVGTVEKRGISGGQRKRVNVGMEMVMEPSLLILDEPTTGLDSASSTLLLKALRREALEGVNICMVLHQPSYTLFRMFDDIIFLAKGGLTAYHGPVKKVEEYFAGIGITVPDRVNPPDHFIDILEGLVKPNGNVTHQQLPVRWMLHNSYPVPPDMLHFADQIAATSSSSSSSNTNHAIKGTDEVVDQSFAGEFWEDMKSNVQMQRDHLEATFLKTKDLSNRRAPGVARQYRYYLGRICKQTLREGKSQAVDYLLLLVAGAILGTLTKVNDETFGSLGYTYTVIAVSLLCKIAALRAFSLDKLQYWRESASGISSLAHFLAKDTIELFNIIIKPVVYLSMFYFFSNPRSSFASNYAVLVCLVYCVTGMAYAIAIYFEPAPAQLWSVLLPVVMTLIANQTRDTVFMKVLIKLCYPNWALEAFIIANAERCASSNNNI

SEQ ID NO: 210748 - protein, 382 aa, Glycine max
  Coding DNA Sequence Number=SeqID_93970
  Homolog annotation: Hit_ID=Q10MM4; Match level="QueryCoverage=79%, HitCoverage=99%, E-value=1e-19, Identity=43%"; Hit description =Expressed protein
  Pfam annotation: Domain name=DUF1645; Domain location=163-351; Score =48.4; E_value=2.5e-11; Accession=PF07816.2; Description=Protein of unknown function (DUF1645)
  Subcellular localization annotation: CTP_CleavageSite=43; ConfidenceScore=5.23e-01
MEPPSESLGPPPSPFTAVASATIGALHRSPFIAFALKQLFKLQAFAPSSLSGQESRIMEELQTPSYNGQTENPDTLLFEDIDSTCSTPYVSAPSSPGRGPISAAGGGFFYSAPASPMHFTITAASTYTHSASSSSEKNSGCDFEFSARFVSSGFTGSGSMSSADELFLNGQIRPMKLSTHLERPQVLAPLLDLEEEGEENEEVEASVRGRDLRLRDKSLRRRTRSLSPLRNTPLEWTENEEKTEKKENVDPSVSSGSGRSSKRWVFLRDFLRSKSEGRSNNKFWSTISFSPAAKDKKPQNQGNGPQKPKKVAGKPTNGIGKKRVPAASPHELHYKANRAQAEELRRKTFLPYRQGLLGCLGFSSKGYGAMSGFARALNPVSS

SEQ ID NO: 210749 - protein, 251 aa, Glycine max
  Coding DNA Sequence Number=SeqID_93971
  Gene Ontology: Mol. function=nucleoside-triphosphatase activity; Cellular component=integral to membrane; Biological process=transport
  Homolog annotation: Hit_ID=Q1SE23; Match level="QueryCoverage=98%, HitCoverage=23%, E-value=2e-80, Identity=52%"; Hit description =Lipocalin; AAA ATPase
MRNCASWLPLLFSLIPLFAWRIQCADNNFAPSFYSEEIYKELESLASLLNKDIKAGLGFCIKDVNKDWEEAFDFKGRLDFVDSCVKKKGDFRDRICTVAEIRYYFHGFLAEGASSANYVKPNKNCNLTSWVSGCEPGWSCSAGKNVDLKKDIKEIPFRTSNCQPCCEGFFCPQGLTCMIPCPLGSYCPLAKLNNSTGICDPYSYQIPQGETNHTCGGADIWSGVVNNSDIFCSPGSYCPTTTRKVSCDSGY

SEQ ID NO: 210750 - protein, 112 aa, Glycine max
  Coding DNA Sequence Number=SeqID_93972
  Homolog annotation: Hit_ID=Q10MM9; Match level="QueryCoverage=49%, HitCoverage=52%, E-value=1e-08, Identity=42%"; Hit description =Expressed protein
MEGIQHHYARSCSYLHEVNVKSMNNDNKMWVARSTTTPSALYSNEVASGERYGPQMAVTKPSSTWWWNEAERKRKRRVFKYKLYAAEGKLKHSVKKGFRWLKIKCIKIVSNL

SEQ ID NO: 210751 - protein, 431 aa, Glycine max
  Coding DNA Sequence Number=SeqID_93973
  Gene Ontology: Mol. function=translation release factor activity, codon specific; Cellular component=cytoplasm; Biological process =translational termination
  Homolog annotation: Hit_ID=Q9C7X9; Match level="QueryCoverage=90%, HitCoverage=92%, E-value=1e-180, Identity=79%"; Hit description =Peptide chain release factor 2, putative
  Pfam annotation: Domain name=PCRF; Domain location=143-253; Score =138.8; E_value=1.5e-38; Accession=PF03462.9; Description=PCRF domain
  Pfam annotation: Domain name=RF-1; Domain location=284-397; Score =219.7; E_value=6.7e-63; Accession=PF00472.11; Description=Peptidyl -tRNA hydrolase domain
  Pfam module annotation: Pfam domain module=PCRF::RF-1; Domain location=143-253::284-397
MSRFLGKSLRTKGPLFLHKILGISSESHNILAAAATTEPSTSDGLTVQGILANNWNILDENDGDWKSHATAIAQSIHLIKRRLHWEKLKVRLDMLSFQLSKEDLWDDPVRAGKISREHGSLLGKMKEVNAFEQELLEHIDMIKLAREENDADLESESLKALLNMRRNAKEKELEALLSGEQDSCSCYIEVQAGAGGTESMDWAAMVMQMYKSWAQQRGYKVTVVDEMPGEIAGIKRATIKVDGEFAFGYAKAEIGVHRLVRISPFDSNKRRHTSFAAVAVIPILGDGSTHVQINESDLRIERFRAGGAGGQHVNTTESAVRIVHIPTGVTATCQNERSQHQNKASAMAVLQSRLDQLEMARQAQFNAQHTQSLTDITWGSQIRSYVLHPYRMVKDLRTNYEVSDPDSVLEGDLDSFILSYLSASLDKDDDA

SEQ ID NO: 210752 - protein, 162 aa, Glycine max
  Coding DNA Sequence Number=SeqID_93974
  Gene Ontology: Mol. function=nucleic acid binding; Cellular component= intracellular
  Homolog annotation: Hit_ID=UPI00005A35E4; Match level="QueryCoverage =98%, HitCoverage=73%, E-value=1e-23, Identity=46%"; Hit description =PREDICTED: similar to zinc finger, matrin type 2
  Pfam annotation: Domain name=zf-U1; Domain location=32-67; Score=9.3; E_value=0.0068; Accession=PF06220.3; Description=U1 zinc finger
MKWTLNPAWARLRYATKLDALVVTPVAPLSQQAGYYCSVCECVVKDSANYLDHINGKKHQRALGMSMRVERASLQQVQERFEVLKKRKDVGSFTEQDLDERILKQQQEEEERKRLRREKKKEKLIACVKFWIQKEKAVEEPEIDPDVAAMMGFGGFRSSNKK

SEQ ID NO: 210753 - protein, 188 aa, Glycine max
  Coding DNA Sequence Number=SeqID_93975
  Gene Ontology: Mol. function=enzyme inhibitor activity; Cellular component=cell wall; Biological process=response to stress
  Homolog annotation: Hit_ID=Q07A28; Match level="QueryCoverage=91%, HitCoverage=84%, E-value=1e-58, Identity=65%"; Hit description=USP -like protein
  Pfam annotation: Domain name=Usp; Domain location=9-178; Score=68.5; E_value=2.2e-17; Accession=PF00582.16; Description=Universal stress protein family
MSEATTRNERRVLVAVDEGEESMYALSWSLKNIIFQNSSDTLILLYVKPPHAVYSPLDSTARIDHPETPGYLFSSDVSAAIEKYGQEVADCVLEKAKKLCKDLQNVKVETRVEIGDPRDVICDMSQKLGADLLIMGSHGYGVVKSEMCFGNYMNYRAFLGSVSNYCSQNVKCPILIVKKPKPSAGAGK

SEQ ID NO: 210754 - protein, 79 aa, Glycine max
  Coding DNA Sequence Number=SeqID_93976
MWGNFGGGNLQLWGLMGVIFGSKKERVVRWWWRRRRKRSVVWCCCFVVEGVVKEDDGSVVRDEEGFVSDKGGEDKVSEA

SEQ ID NO: 210755 - protein, 162 aa, Glycine max
  Coding DNA Sequence Number=SeqID_93977
  Gene Ontology: Mol. function=translation initiation factor activity; Cellular component=eukaryotic translation initiation factor 2B complex; Biological process=regulation of translational initiation
  Homolog annotation: Hit_ID=O64760; Match level="QueryCoverage=83%, HitCoverage=17%, E-value=8e-42, Identity=63%"; Hit description =Putative translation initiation factor eIF-2B epsilon subunit
  Pfam annotation: Domain name=Hexapep; Domain location=29-46; Score =21.2; E_value=0.0038; Accession=PF00132.14; Description=Bacterial transferase hexapeptide (three rep
  Pfam annotation: Domain name=Hexapep; Domain location=6-23; Score =15.3; E_value=0.22; Accession=PF00132.14; Description=Bacterial transferase hexapeptide (three rep
  Pfam annotation: Domain name=Hexapep; Domain location=63-80; Score =7.0; E_value=20; Accession=PF00132.14; Description=Bacterial transferase hexapeptide (three rep
  Pfam module annotation: Pfam domain module=Hexapep::Hexapep::Hexapep; Domain location=29-46::6-23::63-80
ISQLQSAVIGPFTVIGSDTKIGNNTKISNSVIGEGCKIGSNVIIEGCYIWDNIIIEDGCKLQHAIICDGVTIKSGAVLEPGVILSFKLLMHPGILCFQVVVGPEFVVPPYSKVSLFQQPIEEDSDEELEYADSTSGIVYSPAVIVYSPAVKLALQNVIFIAI

SEQ ID NO: 210756 - protein, 177 aa, Glycine max
  Coding DNA Sequence Number=SeqID_93978
  Gene Ontology: Mol. function=translation initiation factor activity; Biological process=regulation of translational initiation
  Homolog annotation: Hit_ID=O64760; Match level="QueryCoverage=93%, HitCoverage=22%, E-value=2e-39, Identity=48%"; Hit description =Putative translation initiation factor eIF-2B epsilon subunit
MGGAGHVWSTCEGSHEEEWRHSVAPIPKDKILEAIKTMEDDLELTHDDSFLPPSGELKPNSNYSDDDDHEDSRDDSYYFDKEVEATFLRAVHENIQESHLILEINSLKLSYNKLAADCAGAVFYAMMKYALDTPHSSADGLLQNVQAVFTKWKKALTSYLTDIDEQVHMSILSPLLV

SEQ ID NO: 210757 - protein, 128 aa, Glycine max
  Coding DNA Sequence Number=SeqID_93979
MGPGSLGPGGPPGWGAPGPPGPGHFGGFCDIISTCNKRHENAKALEGALMFHRVLIPFGVMAVCIVYVAAVSWRVVAAQCLVDLLLGPLAQVSDNPYLRSISRGIEEIKKRKTFCVSSIPTYLNTSAF

SEQ ID NO: 210758 - protein, 694 aa, Glycine max
  Coding DNA Sequence Number=SeqID_93980
  Gene Ontology: Mol. function=acyl-CoA binding; Cellular component =mating projection tip; Biological process=negative regulation of exit from mitosis
  Homolog annotation: Hit_ID=Q94D04; Match level="QueryCoverage=77%, HitCoverage=99%, E-value=1e-140, Identity=56%"; Hit description =Putative p40
  Pfam annotation: Domain name=Kelch_1; Domain location=123-168; Score =32.2; E_value=1.8e-06; Accession=PF01344.15; Description=Kelch motif
  Pfam annotation: Domain name=Kelch_1; Domain location=173-218; Score =29.2; E_value=1.4e-05; Accession=PF01344.15; Description=Kelch motif
  Pfam annotation: Domain name=Kelch_1; Domain location=224-271; Score =12.0; E_value=0.17; Accession=PF01344.15; Description=Kelch motif
  Pfam annotation: Domain name=Kelch_1; Domain location=276-321; Score =30.8; E_value=4.8e-06; Accession=PF01344.15; Description=Kelch motif
  Pfam annotation: Domain name=Kelch_1; Domain location=326-374; Score =18.2; E_value=0.029; Accession=PF01344.15; Description=Kelch motif
  Pfam annotation: Domain name=Kelch_2; Domain location=123-168; Score =26.7; E_value=8.1e-05; Accession=PF07646.5; Description=Kelch motif
  Pfam annotation: Domain name=Kelch_2; Domain location=173-218; Score =29.3; E_value=1.4e-05; Accession=PF07646.5; Description=Kelch motif
  Pfam annotation: Domain name=Kelch_2; Domain location=223-271; Score =31.8; E_value=2.5e-06; Accession=PF07646.5; Description=Kelch motif
  Pfam annotation: Domain name=Kelch_2; Domain location=276-321; Score =20.6; E_value=0.0055; Accession=PF07646.5; Description=Kelch motif
  Pfam annotation: Domain name=Kelch_2; Domain location=326-371; Score =6.2; E_value=5.9; Accession=PF07646.5; Description=Kelch motif
  Pfam annotation: Domain name=Kelch_2; Domain location=379-430; Score =1.4; E_value=25; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch _2::Kelch_2; Domain location=123-168::173-218::224-271::276-321::326 -374::123-168::173-218:...
  Pfam module annotation: Domain location=:223-271::276-321::326 -371::379-430
NFNGLEEKKLMFSLHPSLAVGCHSDLDLKAPIFSCLLILIVDASLGLLMSSLNQSLFPYDSSSLTVSSSVFNPYAFLSNRHHTLTLTLHTSQHRRQMSSLLPQVAKNKAMWLNPKVLGFNPPERWGHSACFSKGLMYVFGGCCGGLHFCDVLTLDLNKMVWSKLTTTGEKPGPRDSHSAVLVGHKMIVFGGTNGFKKVNHIHILDLVTKEWVRPECKGNPPSPRESHTATLVGDERIVIFGGSGEGHANYLNDLHILDLRTMSWTSPELKGDLPIPRDSHSTLAIGNKLIVYGGDSGDQYHGNVHMLDMTTMTWSKLSIQGSPPGVRAGHAAVNIGTKASYVYIIGGVGDKRYYNDVWIFDICNFSWTQLDIRFHQPQGRFSHTAVAAGMDIAIYGGCGEDERPLNELLVLQVGAEHLNGVYYIPMCKPFGTYWNQEKKIIPGEADANSKTLLVRNNVEAFGKGAYEVASEKLPPYHFDSGGLSFMPYLDKLLSRYSYTSRQKRRRIAAAKIGAEVRGRVDGPFDSVSLSPAAVNGRIFRGVIFSPGAAGVVSKGGSVEPKCSLTSSFPFSSQAYLNSNHVGNLTASQQAPIRLHAEPCHGSWQTPVALPFPIIRGTPSVVSKENKINSDLQGLVLTLGGPASGHPQDANGVGHAQVAALPKDPLLAMAMKLTTASPLAPLTISSRLLGSMLQT

SEQ ID NO: 210759 - protein, 68 aa, Glycine max
  Coding DNA Sequence Number=SeqID_93981
MGAKGGCSKDLSSPWLCISAVFGEKNCFREENPSRGASVTLPRHFCEQIREDFSSFFTVLHPFFVLQL

SEQ ID NO: 210760 - protein, 97 aa, Glycine max
  Coding DNA Sequence Number=SeqID_93982
MVGGVGHEDPMSFINMELPKDKDVSIYGFWSVSEIGAACLIGIVFGVKRGMQISGQLGHRNRWNLCTRNLEYVDMNFRVGLLSWLSEYGEAIKGKSI

SEQ ID NO: 210761 - protein, 282 aa, Glycine max
  Coding DNA Sequence Number=SeqID_93983
  Gene Ontology: Mol. function=protein binding; Cellular component =membrane; Biological process=protein transport
  Homolog annotation: Hit_ID=Q9LMG8; Match level="QueryCoverage=99%, HitCoverage=99%, E-value=1e-73, Identity=56%"; Hit description =Putative SNAP25 homologous protein SNAP30
  Pfam annotation: Domain name=SNARE; Domain location=223-282; Score =56.2; E_value=1.1e-13; Accession=PF05739.9; Description=SNARE domain
MFGFRKTPAPTESDKKTTLTAEKRTASEPVLPVPKSKGNYFDYDDDDWGRKPSSSTASKDKDRYKNGFSNSGGLENQSVQELENYAVYKSEETTKSVNNCLRIAEDIRGDATRTLDMLHQQGEQITRTHNMVVDTEKDLSRVEHRLLCSIIVYTYDATKVLNYGYSCCFDMDQYNKPSKKNVHSKEDREKLGLAPLPKGRSAPTTPPNESSDAYQKVDYEKAKQDDALEDLSDILGDLKGMAISMGSELDKQNKALDHLADDVDELNSRVKGANQRARKLVG

SEQ ID NO: 210762 - protein, 167 aa, Glycine max
  Coding DNA Sequence Number=SeqID_93984
  Subcellular localization annotation: CTP_CleavageSite=81; ConfidenceScore=5.91e-01
MQKTKVCCIFSFSSPLAKKNSTRTNRLNSFCASLLPFPKERRTNRLNSFVSPFSLSKRIQRTNRLRILCLNTLEGTSFVVQVEENKGGYIPCGSLLVKDFTRLKEISRTGGCLGTGCRHGCRNLPFGGRAMRDSRVSLPRKEYARSRHQRLFEENVGKIGKDVVYKF

SEQ ID NO: 210763 - protein, 47 aa, Glycine max
  Coding DNA Sequence Number=SeqID_93985
MSPLRMRLHKMDFMGYRLCRTGFAGWTYPHANSMKHKIIDHGCPLTH

SEQ ID NO: 210764 - protein, 325 aa, Glycine max
  Coding DNA Sequence Number=SeqID_93986
  Gene Ontology: Mol. function=4-aminobutyrate transaminase activity; Cellular component=cytosol; Biological process=amino acid metabolic process
  Homolog annotation: Hit_ID=Q84P52; Match level="QueryCoverage=83%, HitCoverage=48%, E-value=1e-121, Identity=78%"; Hit description =Gamma-aminobutyrate transaminase subunit isozyme 3
  Pfam annotation: Domain name=Aminotran_3; Domain location=76-324; Score=-59.8; E_value=1.3e-08; Accession=PF00202.11; Description =Aminotransferase class-III
MVIYLTASSLAYAVVSRSAHENLLQAPLLSRSNSTEASLAKDNSSNDVKNGQGYKGHSMLAPFTAGWQSSDLHPLIIEKSEGSYVYDINGKKYLDALAGLWATSLGGSEPRLVDAAVAQLKKLPFYHSFWNRTTLPSLDLAKELLEMFTARKMGKAFFVNSGSEANDTQVKLVWYYNNALGRPDKKKFIARAKSYHGSTLIAASLSGLPALHQKFDLPAPFVLHTDCPHYWRYHLPGETEEEFSTRLANNLEQLILKEGPETVIHSDTCKVVSTTGTLIAAFIAEPVMGAGGVIPPPSTYFEKSCQFIPAQSLRASSLAPMWVRA

SEQ ID NO: 210765 - protein, 375 aa, Glycine max
  Coding DNA Sequence Number=SeqID_93987
  Gene Ontology: Mol. function=electron carrier activity; Cellular component=membrane; Biological process=electron transport
  Homolog annotation: Hit_ID=Q10ME8; Match level="QueryCoverage=85%, HitCoverage=27%, E-value=4e-81, Identity=52%"; Hit description=HAD -superfamily hydrolase, subfamily IA, variant 3 containing protein, expressed
  Pfam annotation: Domain name=AhpC-TSA; Domain location=186-316; Score= -15.2; E_value=0.014; Accession=PF00578.11; Description=AhpCTSA family
  Pfam annotation: Domain name=Redoxin; Domain location=185-336; Score=- 17.4; E_value=0.082; Accession=PF08534.1; Description=Redoxin
  Pfam module annotation: Pfam domain module=AhpC-TSA::Redoxin; Domain location=186-316::185-336
MYSQCIVIEDALAGVEAAKAAQMRCIAVRTTLSDEALEPAGPTLIRDNIGSVSLDDILSGGSVGYMLKSVDIILHEVLYRHAIADKRMQGSETLNDFAESSSTVLAGGLQGSRRDILRFGSLGIAISCLFFTISNWKAMQYASPKAVWNKLFGVTQPPLEQKEDNSRDDRIQQFVNYISDLESRGNAQIVPEFPSKLDWLNTAPLQFRRDLKGKVVLLDFWTYCCINCMHVLPELDVLEKKYKDMPFVVVGVHSAKFDNEKDSEAIRNAVLRYGISHPKNLTLVVNDGDMYLWRKLGINSWPTFAIVGPNGKVLAQLAGEGHKKEALHQECLVVKLTTVSDLAFCHESLTIAKRVKRGEGRGEEWRWKEGMTPNG

SEQ ID NO: 210766 - protein, 801 aa, Glycine max
  Coding DNA Sequence Number=SeqID_93988
  Gene Ontology: Mol. function=zinc ion binding
  Homolog annotation: Hit_ID=Q653B5; Match level="QueryCoverage=88%, HitCoverage=96%, E-value=1e-128, Identity=42%"; Hit description=DHHC- type zinc finger domain-containing protein-like
  Pfam annotation: Domain name=zf-DHHC; Domain location=236-299; Score =103.6; E_value=5.7e-28; Accession=PF01529.11; Description=DHHC zinc finger domain
MELNLSTVPCTVYYYQSSKPASNSRLIGLISKAARQSGIHGQRGPDNNNKKPYLTRKVGLASWSLKTSIYPIIHVLYGYDVVAITVFCLLVIAFYAFLAPFIGGGHIWEYTFIAIYSPVALIVFILYVRCTAINPADPGIISKFDPRVGNKFSSAHDLSGKHHGSEHERIAAREQYSPSSAASKRSMSKKSSVEDLDRVDNSRKENNQNSCNAIGGIFCILFSHEDCRKQEATADEQGGGEDALFCTLCNAEVRKFSKHCRSCDKCVDGFDHHCRWLNNCVGHKNYSSFIALMAFSLAWLVIEAGVGVAVFVRFFVNKRGMESEIIDRLGNGFSRPPFAAVVVVCTVVSILACVPLGELFFFHMILIRKGITTYEYVVAMRAMSEAPAGASVDEDLPNILYSPTGSATTGLSGGSSLGLQYKGAWCTPPRVFVDYQDEVVPHLEPGMLPSTVDPDAAGIAERGQKMPKRPVRISAWKLAKLDSQEAVRAAAKARASSSVLRPVDNHRLPDGELSSSGNMSIRSSLSTETGTNKEIKHELRLSPVRNSIAPSQGSRDEYETGTQSMSSFSSPSHVQEAVTLSPLPQDHSLGGFRAGTSIPSLVPERPLTSKATLSNFRNPISSPSLGFDGRTAMPKGIGNDPLLLSTSNTSILRDVKRASVVWDQEAGRYVSVPLLPSEARNRSSMRIEFPNVNAETSSIGRKSVIPQQELSSSAPKSPGQHIQNLMYTGDSIFYGGPFLSAPVKDGLRNERHLASTDAQEGSISVNLPQEPRYKRNLLSNQLPVFVPGGFENILQPRSGMN

SEQ ID NO: 210767 - protein, 354 aa, Glycine max
  Coding DNA Sequence Number=SeqID_93989
  Gene Ontology: Mol. function=electron carrier activity; Cellular component=membrane; Biological process=electron transport
  Homolog annotation: Hit_ID=Q10ME8; Match level="QueryCoverage=79%, HitCoverage=24%, E-value=5e-84, Identity=56%"; Hit description=HAD -superfamily hydrolase, subfamily IA, variant 3 containing protein, expressed
  Pfam annotation: Domain name=NHL; Domain location=136-163; Score =17.1; E_value=0.066; Accession=PF01436.11; Description=NHL repeat
  Pfam annotation: Domain name=NHL; Domain location=17-45; Score=18.6; E_value=0.023; Accession=PF01436.11; Description=NHL repeat
  Pfam annotation: Domain name=NHL; Domain location=81-108; Score=39.6; E_value=1.1e-08; Accession=PF01436.11; Description=NHL repeat
  Pfam module annotation: Pfam domain module=NHL::NHL::NHL; Domain location=136-163::17-45::81-108
MAVANLKYDNSSTSTSFAQPSGLSLSQDLREIYIADSESSSIRAMDLKTRGSQLLAGGDPMFADNLFKFGDQDGIGSEVLLQHPLGVVCGNDGEIYIADSYNHKIKKLDPTSKRVSTIAGTGKAGFKDGTAVKAQLSEPSGIVEGNKGRLFIADTNNSLIRYLDLNINETELRTLELKGIQPPKPKSRSFKRLRRRASADTMPITIDTISSNEGNLSIKISLPNEYHFSKVLIIPLSFKHTVIQFLAYRREARSRFSVDIEPEDAVNIDPLDGFLSPEGSATLHFKRSSNNASVGRINCKVYYCKEDEVCLYQSLLFEVPFQEGVSNPAEADVTLAHFVKPKTSTSNFLQSVAP

SEQ ID NO: 210768 - protein, 76 aa, Glycine max
  Coding DNA Sequence Number=SeqID_93990
MKVKRVSKECACACDEDMTRIKGKKLLEKFEGPMARTRIKNVKEILQQVLIMLFEFRFKLQVEKLWIVNYAMFQEE

SEQ ID NO: 210769 - protein, 70 aa, Glycine max
  Coding DNA Sequence Number=SeqID_93991
MAVRLKSNSLIFWNMLKPSVQGDTILVDLLGHDIPNDFLQAKIVEFCDDRGGWDYPLFQGFLSNEIIVEI

SEQ ID NO: 210770 - protein, 105 aa, Glycine max
  Coding DNA Sequence Number=SeqID_93992
  Homolog annotation: Hit_ID=Q7XYW1; Match level="QueryCoverage=89%, HitCoverage=83%, E-value=5e-13, Identity=36%"; Hit description=Seed specific protein Bn15D18B
  Pfam annotation: Domain name=Tryp_alpha_amyl; Domain location=30-104; Score=26.1; E_value=0.00013; Accession=PF00234.12; Description =Protease inhibitorseed storageLTP f
MASYSTYLSLAILVVAGSLMYNTKEVSAQCGGSLTDLIAQCSQYVQKSGPQIKPSAACCAVLRKFNVQCACKLITKEVASLVSIPKAVFVARTCGFNLPPGMHCG

SEQ ID NO: 210771 - protein, 1745 aa, Glycine max
  Coding DNA Sequence Number=SeqID_93993
  Gene Ontology: Mol. function=zinc ion binding
  Homolog annotation: Hit_ID=Q53PX0; Match level="QueryCoverage=70%, HitCoverage=68%, E-value=1e-121, Identity=26%"; Hit description =Expressed protein
  Pfam annotation: Domain name=DDT; Domain location=485-542; Score =19.6; E_value=0.0054; Accession=PF02791.7; Description=DDT domain
  Pfam annotation: Domain name=PHD; Domain location=1646-1695; Score =14.6; E_value=0.002; Accession=PF00628.19; Description=PHD-finger
  Pfam annotation: Domain name=PHD; Domain location=679-724; Score =31.7; E_value=2.6e-06; Accession=PF00628.19; Description=PHD-finger
  Pfam module annotation: Pfam domain module=DDT::PHD::PHD; Domain location=485-542::1646-1695::679-724
MEFVGKTVRKEVKGVGFITGTVKSYDPSSGFFEIVYDDGDSEELESSQVASLLQFQPGSVKAKPRVGRKPKKRRRRVEQKPDAEASSGNVGDNLVEEGSAFRGDLDGNVSSASGGDLDLGCEGIDRTIDVDVGNGGNSIGNVNGSVKENGGGEEIGFEYGLNKSVSANGSCVKDGLDLNARLNLNEDFNLNDACSLPLDTEDGLNRRDCIDLNLDVSNEDDVGVNSGYLGRLGGEALQRECNFDLNVEVCEEGRETRCDDDGNGHSEVGDALFSRMGQLQNEEEVNVNNSSVEDDGVNGNLNHVSDAVKLEGVHVSAAHAAKDGSLCLVEENGADDGKEDEAAIDSHQISIAISVRDSDSLEAQRVHCPSEGGVAIIHEHQDDPRSPCKQGNSRRKRRKVSDNPEVTPETVLRRSSRRASARKRVSSTVLVEVTDDPLLSLETSALTEEKPLIPGSQKYEQCSDPLPKLQLPPSSTNLNLDGVPVLELFSIYACLRSFSTLLFLSPFELEDLVAALKSEIPSILFDSIHVSILQTLRKNLEYLSNEGCQSASNCLRNLNWDFLDLVTWPIFMAEYFLIHGSGFKTDFDLKHLMFRTDYYKQPVIVKVEILQHLCNDMIESEAIRSELNRRSLVTESDVGFDQNMYFDTGKKRRAVMDVSGGSCLTEENVDDTTDWNSDECCLCKMDGCLICCDGCPAAFHSRCVGIASGHLPEGDWYCPECGIGKHIAWMKSRRSLRGADLLGMDLDGRLYFNSCGYLLVSNSSEAGSLFNYYHRNDLHVVIEALKSMDPLYEGILMAIYKHWDISANLSVGDSVFSQSSCKNMQMKGEYSTMHTFLAPFTSETCLDKNRANDQSKLDENSTIVGCMHLGQEYPKAGNRLDSTTTIESPCVASDGSADTTQIRTGVDNVQINGLSDSHRCDESLNQPGIPERHHPVGDCSRLDVGRKINLRSVGASITPSTDNKDTSEVPSGIDYINYYSFARTASFVAQELMCKSPEKMNKIFAMSEEEIMSDQAKVIMKKSTNFCWPSIQDLNAAAHKEKCGWCFTCKGENEDRDCLFNSVVKPIWEVPNNTLVGLQPRKIQNGRLRDIICLIFSLEVRLRGLLLGPWLNLHQTDLWHKDLLKASDFLPVKRLLLLLESNLRLLALSADWLKHVDSVATMGSATHIVVSSSRTSSRHGIGRKRARNTDIETSSSSNTASGLGMYWWRGGRLSRKLFNCKALPHSLVTKAARQGGCRKIPGILYPENSDFARRSRFVAWRAAVEMSTSAEQLALQVRELYSNIRWHDIENNHSLYVLDKESRKSVRLFKKSIIRRKCTEGQSVKYLIDFGKRRAIPDVVIKQGSLLEQSSSERKKYWLEETYVPLHLLKNFEEKRIVRKSTDKKLGKILEIGRVNKKIPQQKGFSYLFTRLERSDCHQCGHCNKDVAMRDAVRCLHCKGYFHKRHVRKSSGTRTTGSSYSCHRCQDGLQAKTNTNKRKVDSKLQKIQAKKRKIVPSVCKSLNLKGNKKASSKNKIRQVRSRNSKNIPSSIPLRRSTRKAKSLYMHSQLNGGHKKGKSTKKNVGRKKGKQSQTKKVTPQKSKETTDQYKKLPVTTAHKKRTRTCNSYWLNGLQLSRKSNDERVMLFKEKKCVVSSEDFSGSVDYPKCCLCCGNECTLNYIACEICGDWFHGDAFGLNVENTRQLIGFKCHVCLDRTAPICPHLKINALSRTESNAAIECAEELSNPVSLQPLSEDLMLELAIDLA

SEQ ID NO: 210772 - protein, 349 aa, Glycine max
  Coding DNA Sequence Number=SeqID_93994
  Gene Ontology: Mol. function=molecular_function; Cellular component =membrane; Biological process=auxin mediated signaling pathway
  Homolog annotation: Hit_ID=Q84TV1; Match level="QueryCoverage=95%, HitCoverage=89%, E-value=3e-98, Identity=63%"; Hit description =Nodulin-like protein
  Pfam annotation: Domain name=DUF6; Domain location=193-322; Score =76.0; E_value=1.2e-19; Accession=PF00892.11; Description=Integral membrane protein DUF6
  Pfam annotation: Domain name=TPT; Domain location=184-322; Score= -23.0; E_value=0.012; Accession=PF03151.7; Description=Triose -phosphate Transporter family
  Pfam module annotation: Pfam domain module=DUF6::TPT; Domain location= 193-322::184-322
MGAGLVAFLLMVLVQLVYAVMNITSKLAIESGMSPLVLVAYRQLFATVSIAPFAYWLEWLFLALLRVYKRRKCMKRRREDHKKEYASQDYTASYDSDIIFVPDRSYRKSDALFCGAEIFIRYNCMCTDKFAPSFHFHPCSSLQTREFGNQEEGWSSKGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDEGTRQSEIPRKMLVAKD

SEQ ID NO: 210773 - protein, 693 aa, Glycine max
  Coding DNA Sequence Number=SeqID_93995
  Gene Ontology: Mol. function=binding; Cellular component=clathrin coat of trans-Golgi network vesicle; Biological process =intracellular protein transport
  Homolog annotation: Hit_ID=Q9M650; Match level="QueryCoverage=99%, HitCoverage=78%, E-value=0.0, Identity=68%"; Hit description=Beta -adaptin-like protein B
  Pfam annotation: Domain name=Adaptin_N; Domain location=1-306; Score =6.4; E_value=4.9e-08; Accession=PF01602.10; Description=Adaptin N terminal region
  Pfam annotation: Domain name=Alpha_adaptinC2; Domain location=464 -572; Score=-4.7; E_value=0.012; Accession=PF02883.10; Description =Adaptin C-terminal domain
  Pfam annotation: Domain name=B2-adapt-app_C; Domain location=581-693; Score=120.4; E_value=5e-33; Accession=PF09066.1; Description=Beta2 -adaptin appendage, C-terminal s
  Pfam module annotation: Pfam domain module=Adaptin_N::Alpha _adaptinC2::B2-adapt-app_C; Domain location=1-306::464-572::581-693
ENSSRPIFELTSSTLSKLLTALNECTEWGQVFILDALSRYKAADAREAENIVERVTPRLQHANCAVVLSAVKMILQQMELITSTDVVRNLCKKMAPPLVTLLSAEPEIQYVALRNINLIVQRRPTILAHEIKVLLEFKEYATEVDVDFVRKAVRAIGRCAIKLERAAERCISVLLELIKIKVNYVVQEAIIVIKDIFRRYPNTYESIIATLCENLDTLDEPEAKASMIWIIGEYAERIDNADELLESFLESFPEEPAQVQLQLLTATVKLFLKKPTEGPQQMIQVLPHNAYRVNKQDVLTFLKQNQDGNTLFTKHVVLNNATVETDNPDLRIVHTYIGVSSQLTPREAAKDVVLAEKPVITDDSNQLDPSLLDELLVNIATLSSVYHKPPDAFVTRTYLSAQKTEDDDYPEGSETGYSESPGNHANGPASPPPTAPVPDLLGDLMGTDNSSIVPPDEPTTTTGPPLSIVLPTSVGHGFQVSAQLTRQDGQIFYSMLFENNTHVPLDGFMIQFNKNTFGLAAAGPLQVPQLQPGTSARTLLPMVMFQNMSQGPPSSLLQVAVKNNQQPVWYFNDKFSFHVLFTEDGIMERSAFLETWRSLPDSNEVSKDFPAIVIDSVEATLDRLAASNVFFIAKRKNANQDVFYFSAKIPQGIPLLIELTTVVGNPGAKCAIKTPSPEMSAFFFEAIETLLRS

SEQ ID NO: 210774 - protein, 372 aa, Glycine max
  Coding DNA Sequence Number=SeqID_93996
  Homolog annotation: Hit_ID=Q2QY08; Match level="QueryCoverage=89%, HitCoverage=77%, E-value=1e-121, Identity=66%"; Hit description =Saccharopine dehydrogenase family protein, expressed
  Pfam annotation: Domain name=3Beta_HSD; Domain location=44-279; Score= -136.9; E_value=0.0071; Accession=PF01073.9; Description=3-beta hydroxysteroid dehydrogenaseisomerase family
  Pfam annotation: Domain name=KR; Domain location=41-170; Score=-91.4; E_value=0.046; Accession=PF08659.1; Description=KR domain
  Pfam annotation: Domain name=Saccharop_dh; Domain location=43-367; Score=133.2; E_value=7e-37; Accession=PF03435.8; Description =Saccharopine dehydrogenase
  Pfam annotation: Domain name=Shikimate_DH; Domain location=27-149; Score=-10.7; E_value=0.0029; Accession=PF01488.10; Description =Shikimate  quinate 5-dehydrogenase
  Pfam annotation: Domain name=ThiF; Domain location=39-180; Score= -51.1; E_value=0.068; Accession=PF00899.11; Description=ThiF family
  Pfam annotation: Domain name=adh_short; Domain location=41-190; Score= -52.6; E_value=0.016; Accession=PF00106.15; Description=short chain dehydrogenase
  Pfam module annotation: Pfam domain module=3Beta_HSD::KR::Saccharop _dh::Shikimate_DH::ThiF::adh_short; Domain location=44-279::41 -170::43-367::27-149::39-180::41-190
  Subcellular localization annotation: CTP_CleavageSite=18; ConfidenceScore=5.22e-01
MAPLSLPLNLKWTPSNVKATAPATTTGKVPEVPLPEKIRNSRILVLGGTGRVGGSTATALSNLCPDLQILVAGRNREKGEALTAKLGGNSEFACVDIDDVNSLETALKSVDLVVHAAGPFQQAERCSVLEAAINTKTAYLDVCDDTSYAWRAKSLMNMALDANVPAITTGGIYPGVSNVMAAELVRAASESEDKPERLSFMLTQPLINYYGQLRFYYYTAGTGGAGPTILATSFMLLGEEVVAYNKGEKIRMRPYSGMLNVDFGKGIGKRDVYLLNLPEVSSAHKILGVPSVSARFGTSPFFWNWGMEAMTKLLPSEFLRDRNKVQSLVQLFDPAVRAMDGISGERVSMRVDLECASGRNTVGIFSHRRLSV

SEQ ID NO: 210775 - protein, 75 aa, Glycine max
  Coding DNA Sequence Number=SeqID_93997
GQDHLELPSGVGTKHEQQKPIKVLRNGCKWGWGHDRPIVAPFSALNKQRTSRKAAQYPLNSQYFTIIVCFLVINA

SEQ ID NO: 210776 - protein, 95 aa, Glycine max
  Coding DNA Sequence Number=SeqID_93998
  Subcellular localization annotation: CTP_CleavageSite=47; ConfidenceScore=5.05e-01
MWVQAIGLFAQATCAPEFGLPRPFNQRLLVLHVGGGAVKQRGQPFPCVQESSTTRDPRSLNPFSEIRRREEEISLKRDRLYNEDQSKFLIEYASG

SEQ ID NO: 210777 - protein, 262 aa, Glycine max
  Coding DNA Sequence Number=SeqID_93999
  Gene Ontology: Mol. function=zinc ion binding
  Homolog annotation: Hit_ID=Q2R1L5; Match level="QueryCoverage=77%, HitCoverage=78%, E-value=9e-49, Identity=46%"; Hit description=Zinc finger protein, putative, expressed
MSDHLVLFVDRLVRPVPMVQPLAQQPPEPATPVDEAAAGPSGSSPAAEEDGDDGGEDAPLLQLAECRICQEEDSVSGLETPCSCSGSLKSYEPGYTAPPPRPQPEETTLDIGGGWTISGTPLDLRDPRLLAIAEAERQFLEAEYDGYAASHASGAAFCRSVALILMALLLLRHALSVTDSDAEDDPSTFFSLFLLRAAGFLLPCYIMAWAISILQRRRQRQEAAALAATQVAFVLQSGQRRGLQFAIAPGPPTMNTHQQEQV

SEQ ID NO: 210778 - protein, 91 aa, Glycine max
  Coding DNA Sequence Number=SeqID_94000
MVILRPLSFRSNKSSDKRAETNYGHSVPFVIQGQGDRVRWRAETNYGHFAPFHPSPIVSNGTQRQIMVILRLVSTKRNEFSSIRMMLVVRC

SEQ ID NO: 210779 - protein, 122 aa, Glycine max
  Coding DNA Sequence Number=SeqID_94001
MEGENSSSIERWDRSNRLNVIFIKTKISVGIRGSVDQHDKVQDLLKAIDDQFITSDKALTNTLIIKFSFLRLTSVKGEEERLLMEIGESALLTTTCGKNKAAKSQANQKGNGKIPPLANIKK

SEQ ID NO: 210780 - protein, 207 aa, Glycine max
  Coding DNA Sequence Number=SeqID_94002
MKREKHTSYSSHNSCKSLSEELRDYYEGRHRSHLRPHSHRREKERKPQEANINLSYFHGKDNVEANLDWEIRVEQQLKNKYTSKSYSSHSYPKKDQGQGILGVTPSKPKDDKGKTIEKQAPKTFIVAKMRLLLPPSSSESEKAKRGRNLVKKSNPKKEGQPLVVKENCKGGPRIFFIKWIPLLLGKMNGSGNGEKEEREEMPLQGER

SEQ ID NO: 210781 - protein, 61 aa, Glycine max
  Coding DNA Sequence Number=SeqID_94003
MWLKGVKTLWFCLEIAMNALSAPAAFSMFITTVKILDFQMNALSGPCRAKRAKRQSVALSA

SEQ ID NO: 210782 - protein, 132 aa, Glycine max
  Coding DNA Sequence Number=SeqID_94004
  Subcellular localization annotation: CTP_CleavageSite=78; ConfidenceScore=5.02e-01
MSHTFAVAAVAVVAIAIRSSCARLEFSVTVIKHAVVALKLCCRWSKPVAIRGFVLALLVSFCMRNLGRVGSGQPNTTCCEGPPSGPRHAHASSTGFITNSEKIERQGISLSKASIQMKNLMRLNIHHDLLGN

SEQ ID NO: 210783 - protein, 181 aa, Glycine max
  Coding DNA Sequence Number=SeqID_94005
MLKNNLFSGVAHEDPMQHLWKFIKLTNIVRHNRISAEYIKLYAFPFSLNWMAREWLRALLENSITTWKQCTSSFLKRTSLDAAYGGNLMLKPPSDAIKIIIDMCSNPYNNSGDRRIMKALTLKIETLMGAQAQVHTTTPLFLNYDRCGIVHGSEECTIDGMLATTMDAINFVKGGNISYNQ

SEQ ID NO: 210784 - protein, 167 aa, Glycine max
  Coding DNA Sequence Number=SeqID_94006
MADFWLSAMNRHPPLTTLVPTAMEANRGHNLAMRGLAYVLLEPLLKGTPILIAIDRSFWVIPVSQERQGHDNMTHPIQWTPPSAQQRFKVNFDACFDQGRPTCFGMALKTAKDLLLDFVVETDRLQSLSRDIGHFDVLFVKRQGNHVDDALAHLALSSIENVWVQED

SEQ ID NO: 210785 - protein, 57 aa, Glycine max
  Coding DNA Sequence Number=SeqID_94007
MVIEGFAIIALERSGNGTGIVKLLWHGGVGEEGSKKEGAGSKIQAGVVLTHCKDREI

SEQ ID NO: 210786 - protein, 421 aa, Glycine max
  Coding DNA Sequence Number=SeqID_94008
  Gene Ontology: Mol. function=DNA binding; Biological process =regulation of transcription, DNA-dependent
  Homolog annotation: Hit_ID=Q1SQW9; Match level="QueryCoverage=99%, HitCoverage=95%, E-value=1e-146, Identity=64%"; Hit description =Transcriptional factor B3; Cupredoxin
  Pfam annotation: Domain name=B3; Domain location=283-381; Score=71.9; E_value=2e-18; Accession=PF02362.12; Description=B3 DNA binding domain
  Pfam annotation: Domain name=B3; Domain location=4-84; Score=45.1; E _value=2.3e-10; Accession=PF02362.12; Description=B3 DNA binding domain
  Pfam module annotation: Pfam domain module=B3::B3; Domain location =283-381::4-84
MEGMRIPDNFLRKYGTQLSTIATLTVPDGSVWPIGLKKADNRIWFVDGWQDFVQRYSIGVGYFLVFMYEGNSSFIVHIFNLSTSEVNYQSAMRNHNEGSCFANYHHIFDEMEDVDSLGLSDLSPQYLTPGALQSKGFAGSVDQLTPGKSHTPALQNLFNGGSKLNRVNWGDGGSAFSLKDANSQGNQSTRDIGVQFNAVEFKRSTEELKLRYSNSNEEAVNKTAKKKRKSEPYGEEPSGENEEEAEMRYRFYESASARKRTVTAEERERAINASKTFEPTNPFCRVVLRPSYLYRGCIMYLPSTFAEKNLNGVSGFIKLQLSNGRQWSVRCLYRGGRAKLSQGWFEFTVENNLGEGDVCVFELLRMKEVVLQVTVFRVTEDAGLLNQLPMQQQQQSPNISHTKLLNPHLQHRISTTKLIRN

SEQ ID NO: 210787 - protein, 125 aa, Glycine max
  Coding DNA Sequence Number=SeqID_94009
MADGGTGTWQKAKIPPYKHAIAPYGAAMGGATGCLATAQIVKPLLDLEQPNHRIYPSTPINNAQFALRFGPLIANCNATTLGEGRGAHNNAIAVCSHMIDNYGLEDNHTRMEEEVLDFLRMEEPY

SEQ ID NO: 210788 - protein, 119 aa, Glycine max
  Coding DNA Sequence Number=SeqID_94010
MRDRLVQSAVNVGLCRWALHGADQSAYPPSCYFPLNILSCNSVYLLEIEDLRKQYKSNLEETIILQLMRGKIHANAVECPETSNENEAIEVHHLNSITYLLNHSIEVLRFLLNGSMAFV

SEQ ID NO: 210789 - protein, 43 aa, Glycine max
  Coding DNA Sequence Number=SeqID_94011
MVVLNVWSALQMEPALLPASRAMQELIPVKRCLQSGTLSSSAQ

SEQ ID NO: 210790 - protein, 80 aa, Glycine max
  Coding DNA Sequence Number=SeqID_94012
MYIVVVKQGQDHLGLPSGGETKHERQKPIKVGYLKMNASGDGVTTDRSLPLLCAKQAGNVAARQPRILCILQLSFTICLF

SEQ ID NO: 210791 - protein, 99 aa, Glycine max
  Coding DNA Sequence Number=SeqID_94013
RIQGTNRLRILCPNTLEGTSFVVQVEGTSTWVVILRTKEGTSLVDQFKWRVHPLGCSKRTREGISLVDLWLGKDFTRLKEILRTVGCLGTRCRHGLLPN

SEQ ID NO: 210792 - protein, 1145 aa, Glycine max
  Coding DNA Sequence Number=SeqID_94014
  Gene Ontology: Mol. function=protein binding; Cellular component =membrane; Biological process=defense response
  Homolog annotation: Hit_ID=Q1SY04; Match level="QueryCoverage=99%, HitCoverage=98%, E-value=0.0, Identity=55%"; Hit description=Disease resistance protein; AAA ATPase
  Pfam annotation: Domain name=LRR_1; Domain location=1009-1029; Score =6.3; E_value=19; Accession=PF00560.23; Description=Leucine Rich Repeat
  Pfam annotation: Domain name=LRR_1; Domain location=1032-1056; Score =6.3; E_value=19; Accession=PF00560.23; Description=Leucine Rich Repeat
  Pfam annotation: Domain name=LRR_1; Domain location=1083-1106; Score =1.7; E_value=1.4e+02; Accession=PF00560.23; Description=Leucine Rich Repeat
  Pfam annotation: Domain name=LRR_1; Domain location=1108-1131; Score =12.8; E_value=1.1; Accession=PF00560.23; Description=Leucine Rich Repeat
  Pfam annotation: Domain name=LRR_1; Domain location=585-606; Score =9.1; E_value=5.7; Accession=PF00560.23; Description=Leucine Rich Repeat
  Pfam annotation: Domain name=LRR_1; Domain location=608-629; Score =10.3; E_value=3.4; Accession=PF00560.23; Description=Leucine Rich Repeat
  Pfam annotation: Domain name=LRR_1; Domain location=631-653; Score =13.6; E_value=0.73; Accession=PF00560.23; Description=Leucine Rich Repeat
  Pfam annotation: Domain name=LRR_1; Domain location=655-676; Score =5.2; E_value=30; Accession=PF00560.23; Description=Leucine Rich Repeat
  Pfam annotation: Domain name=LRR_1; Domain location=793-814; Score =2.6; E_value=93; Accession=PF00560.23; Description=Leucine Rich Repeat
  Pfam annotation: Domain name=LRR_1; Domain location=816-838; Score =0.6; E_value=2.2e+02; Accession=PF00560.23; Description=Leucine Rich Repeat
  Pfam annotation: Domain name=LRR_1; Domain location=872-892; Score =0.3; E_value=2.5e+02; Accession=PF00560.23; Description=Leucine Rich Repeat
  Pfam annotation: Domain name=LRR_1; Domain location=894-914; Score =5.6; E_value=25; Accession=PF00560.23; Description=Leucine Rich Repeat
  Pfam annotation: Domain name=LRR_1; Domain location=915-939; Score =4.5; E_value=41; Accession=PF00560.23; Description=Leucine Rich Repeat
  Pfam annotation: Domain name=NACHT; Domain location=203-355; Score= -30.4; E_value=0.013; Accession=PF05729.3; Description=NACHT domain
  Pfam annotation: Domain name=NB-ARC; Domain location=162-466; Score =358.6; E_value=1e-104; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::NACHT::NB-ARC; Domain location=1009-1029::1032-1056::1083 -1106::1108-1131::585-606::...
  Pfam module annotation: Domain location=608-629::631-653::655 -676::793-814::816-838::872-892::894-914::915-939::203-355::162-466
MAEAMVAGAFLSASLQVTFDRLASSDIKDYFHGRKLKDEMLKKLDIVLNSINQVLEDAEERQYRSPNVMKWLDELKEAIYEAELLLDEVATEASRQKLEAEFQPATSKVRGFFMAFINPFDKQIESRVKELLENIEFLAKQMDFLGLRKGICAGNEVGISWKLPNRLPTTSLVDESSICGREGDKEEIMKILLSDSVTCNQVPVVSIVGMGGMGKTTLSQLVYNDPRVLDQFDLKAWVYVSQDFDVVALTKAILKALRSLAAEEKDLNLLQLELKQRLMGKKFLLVLDDVWNENYWSWEALQIPFIYGSSGSRILITTRSEKVASVMNSSQILHLKPLEKEDCWKLFVNLAFHDKDASKYPNLVSVGSKIVNKCGGLPLAIRTVGNILRAKFSQHEWVKILESDMWNLSDNDSSINPALRLSYHNLPSYLKRCFAYCSLFPKGYEFYKDQLIQLWMAEGLLNFCQINKSEEELGTEFFNDLVARSFFQQSRRHGSCFTMHDLLNDLAKSVSGDFCLQIDSSFDKEITKRTRHISCSHKFNLDDKFLEHISKCNRLHCLMALTWEIGRGVLMNSNDQRALFSRIKYLRVLSFNNCLLTELVDDISNLKLLRYLDLSYTKVKRLPDSICVLHNLQTLLLTWCYHLTELPLDFHKLVNLRNLDVRMSGINMMPNHIGNLKHLQTLTSFFIRKHSGFDVKELGNLNNLQGTLSIFRLENVTDPADAMEANMKQKKHLEGLVLDWGDKFGRRNENEDSIIERNVLEALQPNGNMKRLTVLRYDGTSFPSWFGGTHLPNLVSITLTESKFCFILPPFGQLPSLKELYISSFYGIEVIGPEFCGNDSSNLPFRSLEVLKFEEMSAWKEWCSFEGEGLSCLKDLSIKRCPWLRRTLPQHLPSLNKLVISDCQHLEDSVPKAASIHELELRGCEKILLKDLPSSLKKARIHGTRLIESCLEQILFNNAFLEELKMHDFRGPNLKWSSLDLQTHDSLGTLSITSWYSSSFPFALDLFANLHSLHFYDCPWLESFPKGGLPSTLQKLEIEGCPKLVASREDWGFFKLHSLKEFRVSDELANVVSFPEYLLLPSSLSVLELIGCSKLTTTNYMGFLHLKSLKSFHISGCPRLQCLPEESLPNSLSVLWIHDCPLLKQ

SEQ ID NO: 210793 - protein, 99 aa, Glycine max
  Coding DNA Sequence Number=SeqID_94015
  Homolog annotation: Hit_ID=Q8GSA3; Match level="QueryCoverage=78%, HitCoverage=18%, E-value=8e-16, Identity=53%"; Hit description=F-box protein family, AtFBX13-like protein
MEGIQQDEEIRRIQRENKASSTGNVVACNLTCKCFSEYPRVLLVYNEYSIDVVECNGEMLVVLLSEFLETATLRVWKYDEANRGWHQIATMPATNSHEW

SEQ ID NO: 210794 - protein, 492 aa, Glycine max
  Coding DNA Sequence Number=SeqID_94016
  Gene Ontology: Mol. function=binding; Cellular component=microtubule
  Homolog annotation: Hit_ID=Q6Z5N1; Match level="QueryCoverage=96%, HitCoverage=72%, E-value=2e-67, Identity=37%"; Hit description =Putative potyviral helper component protease-interacting protein 2
  Pfam annotation: Domain name=HEAT; Domain location=208-244; Score =26.3; E_value=0.00011; Accession=PF02985.12; Description=HEAT repeat
  Pfam annotation: Domain name=HEAT; Domain location=86-122; Score =29.8; E_value=9.3e-06; Accession=PF02985.12; Description=HEAT repeat
  Pfam module annotation: Pfam domain module=HEAT::HEAT; Domain location=208-244::86-122
MPRATTTQSQNIKQRVLTCLTKLSDRDTQVAGANELESIARTLDPHSVPVFLSCIHSTDASDKTPVRKQCVHLVATLSHAHGDALSPFLSKILACLVRRLRDPDSSIRAACADSVGALSARVTRQPFAAAFLKPLAEALFTEQDPSSQAGAALCLASAIEAAPDPDPARLARLLPRLERLIKSKVFRAKPALLALVGSVVEARGATSGAALRSLVPCLLEALGSEDWATRKGAAEALKKLASVERDLLAEFKGGCLKVFEDRRFDKVKLVREVMNQMLEAWKHIPDVSDEFSPPPQLQLSSKENASDGRYPPVSQNSCSPGSVMSKLRKKSSPASKSTPPDRSAVRNAKKSALSGDRMGSGVLQKLNHNHWDVRIAVSNVPDRGERRQKDEDVLERSKKDKSRFFKQETKRALFDKNSDDKMHKSGGSKAGSRVVPCSEESQDSGPVCNVTKDLHRNDKESEELSLIRAQLVQIEKQQSSLLDLVQSMPTLE

SEQ ID NO: 210795 - protein, 74 aa, Glycine max
  Coding DNA Sequence Number=SeqID_94017
  Homolog annotation: Hit_ID=Q5S1S6; Match level="QueryCoverage=58%, HitCoverage=21%, E-value=5e-08, Identity=61%"; Hit description =Peroxiredoxin Q
MKDIKAFKEATKVGKVVNKCSKPPNFMLKDQNGKNVSLSNFKGKPVIVYFYKGGKGALTSADDDKIDDDDDDEA

SEQ ID NO: 210796 - protein, 128 aa, Glycine max
  Coding DNA Sequence Number=SeqID_94018
VFQKLPRPIPEEVLPENTFGSPYSGMGFFQKLLRPIPEEVIPENTSGMDLIKGYLPEEASSRNIPDDVLPEGVSEYFRKSQILLPEEGSSGKFPEKGYSGMFPEKVSSERRIPEGQFRHFTVCWVPQQ

SEQ ID NO: 210797 - protein, 682 aa, Glycine max
  Coding DNA Sequence Number=SeqID_94019
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =67%, HitCoverage=57%, E-value=2e-80, Identity=37%"; Hit description =actin binding
  Pfam annotation: Domain name=Extensin_2; Domain location=114-400; Score=-141.9; E_value=0.094; Accession=PF04554.4; Description =Extensin-like region
  Pfam annotation: Domain name=FH2; Domain location=224-638; Score =387.2; E_value=2.5e-113; Accession=PF02181.13; Description=Formin Homology 2 Domain
  Pfam module annotation: Pfam domain module=Extensin_2::FH2; Domain location=114-400::224-638
MSAPSHAIVKAVAATAGAMLLIAAIFVYLFYKHVLARYHQRHKVGASLLRESGVNLEYINKVGGNVKGLIVEENGVDSLCDGHRKKAIDYWSKVSKPEIPQACESPSVVGHENQVKPVSQTSSVSTSLAPRQNLPQSPQLAPPLQPLPQSSPMILENKKTQPSSPPPPPPPPPPPPTRPPPPPPGPPPLPKASGFISSLKPPPAPKGKTNIRSTKEGMIGESSREKGVGQTRLKPLHWDKIVANVDHSTVWDQINDGSFRFDDELIESLFGYSSSYKTQERNRTLSTLAKSNSNAPTQIFILEPRKSQNTAIVLRSLAISRKGILEAVLDGQGLSVETLERLSKIAPTQEEEAKIIQFSGNPDQLADAESFLYYILKSVPTAFNRLKAMLFRSSYDCEVLQLKEHLQTLEMGCKELRTSGLFLKLLEAILKAGNRMNAGTSRGNAQGFNLSSLRKLSDVKSTDGKTSLLHFIVEQVVQSEGKRQAIYQKHKLHISNGETSNVNRPYSYSLIQQEAEKEYVMLGLQVLGGLSEELSEAKKAASIEYHNFITMCSTLNAHVSEIRQIITCCGNTRSGEFINEMKGFLEECEGELEVVKEEQTRIMELVKKTNEYYLAGASKDNMACIELKKKVEKKNIVGGEAVSTTPPLSPSKRTPLRFPNFDLYFLSNVSESTSSSQSEDDF

SEQ ID NO: 210798 - protein, 44 aa, Glycine max
  Coding DNA Sequence Number=SeqID_94020
MGILFRPLQAKIPTSFPQCNATAGARLSLTSSNHIFIDGKQDTT

SEQ ID NO: 210799 - protein, 563 aa, Glycine max
  Coding DNA Sequence Number=SeqID_94021
  Gene Ontology: Mol. function=nucleic acid binding; Biological process= DNA integration
  Homolog annotation: Hit_ID=Q1S1X7; Match level="QueryCoverage=56%, HitCoverage=30%, E-value=2e-49, Identity=33%"; Hit description =Integrase, catalytic region; Zinc finger, CCHC-type; Peptidase aspartic, catalytic
  Pfam annotation: Domain name=zf-CCHC; Domain location=86-103; Score =15.2; E_value=0.003; Accession=PF00098.13; Description=Zinc knuckle
  Pfam module annotation: Pfam domain module=RVT_2::zf-CCHC; Domain location=396-510::86-103
MRERTPLKNDLEELNSLLIELCNIDVKMEDKDLTMILLAYLPPSYDNFAYGNSGEACASELLVTDYAKWKKKKGKGGKKSNVDPKDICNYYKELGHWKRDCLKNVKKYFVDTLVQNKSSSENNLVLTVGEPLQQHSKQWVLDSGCSYHMCPHRNWFVTYEKSGGNILMDNDAPCKSVNIGSIEIRMHDGVVRILTYVCHVSELKRNLVSVGAMVQKGSTMTSFVSTISQPRSHASNDSFDYSLWHPHLGHMSEKGLDILSKRHLHGNHKVEPLQFCEHYVYGKQHQMKFPKVLHITKDMLDYVHSDCCGPSRVSSLGGARIFWDKATITTCYLVNHSSSTSIDFKTPIEPRRDSLWAMEMELKNSEFDLGKVKDDTKQVEFESSTIRNIAEDWMMTMNEEMKSHQKNQAWDLVELPEVATLDMELEQLDVKIAFLHGRLEEDILTQQLEGSGTRVSMSSLSEVAKMILGMEMKRDRFQKHVRRSLKGISNIGLVYHKDMSRAVVGYSDSNYATDLDAKRSMNKFIELESALNLIPGHEEECRRVWETQELLPTSLNNKIVCFA

SEQ ID NO: 210800 - protein, 127 aa, Glycine max
  Coding DNA Sequence Number=SeqID_94022
  Homolog annotation: Hit_ID=Q9C761; Match level="QueryCoverage=41%, HitCoverage=8%, E-value=5e-07, Identity=47%"; Hit description =Transposase, putative
  Subcellular localization annotation: CTP_CleavageSite=14; ConfidenceScore=5.03e-01
MRLGTSHIVQQRVLSTSKRSIKGCMPSSNSPRTKLGIKPLHTDEEMTNKVFECLTAWEIDRKISFITLDNASSNNCMQEILSTSYPTSNEYFIEIQKLEDMDSVEAMPSKVILMMPKNSRIKRKIQE

SEQ ID NO: 210801 - protein, 47 aa, Glycine max
  Coding DNA Sequence Number=SeqID_94023
MNHILMYLKGTTDIGLVYHGDTSCDLTGRVHGFGRSSNERDLAKSSD

SEQ ID NO: 210802 - protein, 85 aa, Glycine max
  Coding DNA Sequence Number=SeqID_94024
  Subcellular localization annotation: CTP_CleavageSite=67; ConfidenceScore=5.34e-01
MASMDTSAKVNSKIFPCNLGMRGSGEFVPFLDTTSRGSKMPQRTFLRKRHGPSVGLFTEGIKTEPICDAYAKDTMRECTQYDNIH

SEQ ID NO: 210803 - protein, 110 aa, Glycine max
  Coding DNA Sequence Number=SeqID_94025
MAGKPQLRSQFSKFGMTSRCGTWADLAILKNVRHSQPMSACHYTMGKDQMATPAKIIEISYSPTSLASSFSPPMLNTPTKGHLRPGIALLSTCQGHLMSRRTLLSIFQSH

SEQ ID NO: 210804 - protein, 118 aa, Glycine max
  Coding DNA Sequence Number=SeqID_94026
  Gene Ontology: Mol. function=transition metal ion binding
MAAELGQQMVELSTLVTCAANDKSADMQSGPQYDLFDVEMGDYLEDMIRDLGQESFQQAHAPMYDTLQSDSKNPLYPGCNNSLTLLSVVLSLVNVKARYGWSDKSFSSLLQVVHDMLP

SEQ ID NO: 210805 - protein, 233 aa, Glycine max
  Coding DNA Sequence Number=SeqID_94027
  Gene Ontology: Cellular component=chloroplast envelope
  Homolog annotation: Hit_ID=Q9SJX7; Match level="QueryCoverage=51%, HitCoverage=27%, E-value=6e-53, Identity=84%"; Hit description =Expressed protein
  Pfam annotation: Domain name=DUF647; Domain location=70-233; Score= -136.5; E_value=1.5e-05; Accession=PF04884.5; Description=Protein of unknown function, DUF647
MESLGSTLHEVSAEAREAKENLLHIQPESESYDAQIEDLKLFLKSTNEKYNSMLDEAEWEQREVQLVSCIKKNEEAKEVEAEAIQLQEALKETIADNMKLKENLLDKEKLVANGMQHVGKLIGSNWGGTMDFEPKRWRLLADALYDIGTGLEVLSPWCPHLFLEMAGLGNFAKGMAVVAARATRLPIYSSFAKEGNLSDLFAKGEAFSTLFNVIGIGVGIQLASTICASMQGK

SEQ ID NO: 210806 - protein, 145 aa, Glycine max
  Coding DNA Sequence Number=SeqID_94028
  Homolog annotation: Hit_ID=Q8RVA9; Match level="QueryCoverage=71%, HitCoverage=49%, E-value=2e-21, Identity=53%"; Hit description =Succinate dehydrogenase subunit 4
  Subcellular localization annotation: CTP_CleavageSite=73; ConfidenceScore=5.79e-01
MQSMSLTLSKRLSNSKPLFRISSSLVAHASSATTSPPPPSPPVPSPSALNSLLTAPWSATQSRGITLSGSDIRVGNLIGNRGRAHEVLKLYRPLEGTGKATLELLQCYCIAEFLGPAIAIPSAIVAAINVVVVACILHPCESPAN

SEQ ID NO: 210807 - protein, 117 aa, Glycine max
  Coding DNA Sequence Number=SeqID_94029
  Gene Ontology: Mol. function=RNA-directed DNA polymerase activity; Biological process=RNA-dependent DNA replication
MSGAPNANLPSVKKLVEDIRATNTSSLPFRKHNYCWKVFGWCLPQEGWIKISVDGSVRQGGNQVACEGVYGDEHSKWLGGFARNLSLGNVLMAELYATLMALDLAWDKGFQVGVDRV

SEQ ID NO: 210808 - protein, 115 aa, Glycine max
  Coding DNA Sequence Number=SeqID_94030
MDISNNSNEKIETGIELSGFLHNEDNLILLYEDERGLLEDELQVEDDLQIDQSSPYPIENNINLLGGHSINAGSEKGILPSLDVEQMKPFDKVKGIGLDEEAISISTHNTSDLIF

SEQ ID NO: 210809 - protein, 317 aa, Glycine max
  Coding DNA Sequence Number=SeqID_94031
MASKKRKAPATPSQVRYDRSRFTSPEAWERGHLVKFDEDALNTFLKNPMIIEEGETLPVYSRFALLRLDPQELAAKLCIPGRGFELNANGLPLKILRKNLTTIAQTWSMLSFSNLVPTSHTSDITLDMAKLIYGITQRMDMNVGYLISHQISMIAQHDSSRLGFPALISALCKAREVTSDSKMLERSRKAMGKKSETLPSSEVPLTTSASSTSTPAYSQLLIDATCHDAEPTPRVGHYYAELLELGPAIYHEHGRLSHLAQEPEPTAEHTPAAEDELTSPEPFSFAFDSVVAQEEVPSPEPIPKPSPAPISEDTLPS

SEQ ID NO: 210810 - protein, 70 aa, Glycine max
  Coding DNA Sequence Number=SeqID_94032
MDISNNSNEKIETGIELSGFLHNEDNLILLYEDERGLLEDELRVKDDLQIDQSDDTLPELLINKKFRKIS

SEQ ID NO: 210811 - protein, 55 aa, Glycine max
  Coding DNA Sequence Number=SeqID_94033
MAPRKRNVIRYEGENKKRIRHPSNHNTNTTQGENPKTLLGNSIHKIHATKAINYC

SEQ ID NO: 210812 - protein, 120 aa, Glycine max
  Coding DNA Sequence Number=SeqID_94034
  Homolog annotation: Hit_ID=Q8RVA9; Match level="QueryCoverage=85%, HitCoverage=49%, E-value=2e-22, Identity=56%"; Hit description =Succinate dehydrogenase subunit 4
  Subcellular localization annotation: CTP_CleavageSite=73; ConfidenceScore=5.78e-01
MQSMSLTLSKRLSNSKPLFRISSNLVAHASSATTSPPPPSPPVPSPSALNSLLTAPWSATQSRGITLSGSDVRVGNLIGNRGRAHEVLKLYRPLEGTGKATLEVYSRFSLSLSYIALLEY

SEQ ID NO: 210813 - protein, 80 aa, Glycine max
  Coding DNA Sequence Number=SeqID_94035
MRGYLMVSRTFRQPGGNEPVDAQRLTSSSAPFVVLTRELGDMRGYLMVSRTFRQPWANEPIDARRLTSSSVPFVVLTREV

SEQ ID NO: 210814 - protein, 205 aa, Glycine max
  Coding DNA Sequence Number=SeqID_94036
MTEPMSTQCDDAADVEAHSAVDQRPKRNVLAPKKWDELFYSTPQLDPTFCASDTAYHADMKSFKKHFIKFHIFAKIFRTKSKKFQSDPSCEQALYVSPSWFSTMCLSLGLSEVAKSFNFKLAEFGRIASANQRRKQELRVGLLRKPFVRFAMLFLEVEKPWLLRWVLQQREMYSGLLRRGENRSGQALKGLSLAYDESLRPKSGL

SEQ ID NO: 210815 - protein, 321 aa, Glycine max
  Coding DNA Sequence Number=SeqID_94037
  Gene Ontology: Mol. function=transcription factor activity; Cellular component=transcription factor complex; Biological process =regulation of progression through cell cycle
  Homolog annotation: Hit_ID=Q1SSY4; Match level="QueryCoverage=90%, HitCoverage=74%, E-value=3e-68, Identity=51%"; Hit description =Transcription factor E2F/dimerisation partner
  Pfam annotation: Domain name=E2F_TDP; Domain location=88-168; Score =84.4; E_value=3.6e-22; Accession=PF02319.11; Description =Transcription factor E2Fdimerisation partner (TDP)
MGNENALVYERHDYVKYAISDWIAHMLCSHVLARKAKNQCTWKGFSAIHVALQELKVHDDEDEEETFPNINTGSQNVMVKSSSKNENRREKSLALLTQNFVKLFVCSNFEMISLDEAAKLLLGNANNRTKVRRLYDIANVLSSMNLIEKVIFSSVHFKFPHRALQWKCCFLYSVLINYSKLMMSLRRLQTHTTNTRKPAFRWLGVRGKTWSESAQTNVKESQKRMFGSDITNINFKRKVDLSMDGQNFKTQNQQENISPRAQLEKKSLKKDAKQTSMSYQFGPFAPAYVHKVGTSENNSVKQVQDWESLAQEHRPQYQNQG

SEQ ID NO: 210816 - protein, 199 aa, Glycine max
  Coding DNA Sequence Number=SeqID_94038
  Homolog annotation: Hit_ID=Q1SWX1; Match level="QueryCoverage=69%, HitCoverage=27%, E-value=1e-07, Identity=25%"; Hit description=IMP dehydrogenase/GMP reductase
MGSSQTPSLKKRFYQVKVKSLGITCLKELGQLMGQLQRQAFCKAYDKFWDLAMVEVSIEAIASLAQYYDQPLRWFTFGDFQLSPMVEEFEEILGCPLGGRRPYLFSGFYPSLARISKIVQISAQELDHRKQVENEVVGIPRKYLEAKARILANNQGVPLLTKASPSGKGYTTFVLLLGPHKGVYTNFKDLCLAKEGIQS

SEQ ID NO: 210817 - protein, 68 aa, Glycine max
  Coding DNA Sequence Number=SeqID_94039
MSCLKGGNNEKEKALAKLAHRDQENQVINEVVFTREMAKRKVRILNLEKDKLLPHSCDINAQPRNQLL

SEQ ID NO: 210818 - protein, 74 aa, Glycine max
  Coding DNA Sequence Number=SeqID_94040
  Subcellular localization annotation: CTP_CleavageSite=64; ConfidenceScore=5.27e-01
MMCLTWYGFSKLDRSSTIATTSQRKGARFRVKVKRQREPYTGHPCEKIMCLTRSRFSKSGRPPTATTTGQVGLV

SEQ ID NO: 210819 - protein, 255 aa, Glycine max
  Coding DNA Sequence Number=SeqID_94041
  Homolog annotation: Hit_ID=Q2QQX3; Match level="QueryCoverage=14%, HitCoverage=7%, E-value=2e-07, Identity=70%"; Hit description =Expressed protein
MTFISGKAQGASQCHCLFDTKVVCLLFFEGLTHHVGEKFGVPKDGFGGVVWLGIECWKIHSGVLSRVLESFVSNIVAHIDVMLYVDDLTKHFDPISSLPKVSVISHKSIFVSYSMFAQITHLKQSFCTPSFSPSRCISPTNEAKSPFINRNNLPLRGVGVNRVLTYFGSIERKENFVPTLETFEEVPTSTTFDEVEVSYFLSFLILQLLKDYMFEHSSDRAGFLKLSKRIEYTIRAWYLPQFEDLMNIVLAGLSS

SEQ ID NO: 210820 - protein, 101 aa, Glycine max
  Coding DNA Sequence Number=SeqID_94042
  Homolog annotation: Hit_ID=Q9AUH7; Match level="QueryCoverage=66%, HitCoverage=69%, E-value=5e-19, Identity=80%"; Hit description=UVI1
MGKRVFLQMPQLLNSTFQLYLLKEEEEEEEEGEMGSNGTSWADQWDNGPDPVTVSNESKKKNNALGKTKAVASTGVKKLKEGTSVGFQWIKTKYHKTTQKH

SEQ ID NO: 210821 - protein, 112 aa, Glycine max
  Coding DNA Sequence Number=SeqID_94043
  Homolog annotation: Hit_ID=Q9LSG6; Match level="QueryCoverage=89%, HitCoverage=20%, E-value=3e-07, Identity=47%"; Hit description=CDC45 (Cell division cycle 45)-like protein
MDTSLMQLKVGLVSVLFSEKHHKDIVLVTEVTKVDGEVVDDDDENVYVVVPLSQNDREACGLTKMTCICGSRQKMTLSSKSLMELELRITKMILRAQRESTSKVEGKMRIEE

SEQ ID NO: 210822 - protein, 126 aa, Glycine max
  Coding DNA Sequence Number=SeqID_94044
  Subcellular localization annotation: CTP_CleavageSite=33; ConfidenceScore=5.40e-01
MTWGKHQRTLGPLYNHLDNSRTRSTFCTLFVFKCNMRPRPTTQCYQRLVVQLFERIPLEFEELDKSKNFTIVVNLSFKSTKKETYHQKQGEVTLVAVTEAMCVVLFDDTSDTHKRENKSDKERAIH

SEQ ID NO: 210823 - protein, 181 aa, Glycine max
  Coding DNA Sequence Number=SeqID_94045
  Gene Ontology: Mol. function=glutathione-disulfide reductase activity; Cellular component=chloroplast; Biological process =glutathione metabolic process
  Homolog annotation: Hit_ID=P48640; Match level="QueryCoverage=84%, HitCoverage=51%, E-value=1e-18, Identity=63%"; Hit description =Glutathione reductase, chloroplast precursor
MVVEGSPKKLQEGSEKFALKPYAPPNSDVAFCFAIFLSQDSSSPKRFHYLTPPFSLSLSRNPYSLSPRATAPSLPVPNPRLTLTSFPPTRTSTSSPSTQAAVGSEPLASLPTTTLLSPSANFLSPLSPSKPLEVSAKRFVTMEASEIVLEFAGIFNDLKSEVHVFIRQNKVLRGFDEEIRD

SEQ ID NO: 210824 - protein, 71 aa, Glycine max
  Coding DNA Sequence Number=SeqID_94046
MTLKHRLSTSENLLVSIQEKIKWADAMSEIEKKRRKDVEEKVQELKSVIKNRCIYPLLLWESRLFGVKGLY

SEQ ID NO: 210825 - protein, 201 aa, Glycine max
  Coding DNA Sequence Number=SeqID_94047
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=1e-27, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=22; ConfidenceScore=5.63e-01
MARACSPLKARTCTPLMARVCSLMKARKSSPMKARARSPLKARASSPLKTRTYSPRKAKTCSPQKARTCKRTSSHLKAMACSPLKARTCSPLMARTSSPLKVSTCSPLKARTSSPLKATTCSPLKARTCAPLMARACSPMKVRTSRPMRARPCSPLKARPCRPLKARTCSPLKARTCKRTCSPLKARACNPLKVRTCSPQK

SEQ ID NO: 210826 - protein, 84 aa, Glycine max
  Coding DNA Sequence Number=SeqID_94048
METLLPPAWKNLNIDRYVNDTNLGAESLRLSEQWQGLVAAQRCGEWTCEEKESGGARGGDDVETEKQRGAVRVFIASGEGVSGS

SEQ ID NO: 210827 - protein, 187 aa, Glycine max
  Coding DNA Sequence Number=SeqID_94049
  Gene Ontology: Mol. function=hydrolase activity, acting on ester bonds; Biological process=lipid metabolic process
  Homolog annotation: Hit_ID=Q2R3H2; Match level="QueryCoverage=86%, HitCoverage=51%, E-value=3e-18, Identity=28%"; Hit description=GDSL -like Lipase/Acylhydrolase family protein, expressed
MWLAYLNLIEGQDIKKEVNFAFVGSTALDKNFLEQKRINKEEVAYLELIEEGAIKLVVPKNFLIGCNSVVLATLNSDKKDDYDQFGCLKTYNTFIEYYNEQIKKAIETLRQNKTKTFRVCCEKSEPYNISLQIAYGSPATIVSSNPSKYVNRDEPHFIEATYRLIAKGLVEGSFANPSLKSLPFKIV

SEQ ID NO: 210828 - protein, 325 aa, Glycine max
  Coding DNA Sequence Number=SeqID_94050
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=7e-41, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=69; ConfidenceScore=5.43e-01
MARACSPLKARTCNPLMARTCSPLKVSMCIPLMARTCSFLKLRTCSLLKARACSPLKARTCALLMAWVCSPMRARVCSPLKVRTCSSLKARMCSPVKARTCAPLMARACSPMKVSTSRPMKARPCSPLKARPCSPMKARTCSPLKARTCKRTCSPLKARACNPLKVRTCSPQKVTTCSPLKARTCSPLKERACSPLKARACSPLKARTRNRTCSPLKAMTCSTLKARTCSPLKVKTSSPLKARAFSPRKARTSSPLIARRCKISCSPLKERACSPLNVRTCSPLKLRTCSPLKVRTSCPLKVRTCSPLKARACCPLKERLGRVAL

SEQ ID NO: 210829 - protein, 82 aa, Glycine max
  Coding DNA Sequence Number=SeqID_94051
MMLKLEGVCYFTTKRLPEEHVPPERDTWLDWTRRCDRGGRAYLPGATSRAYLPGATSSGGAPGTSLFPIKPSTLRFIFTQKS

SEQ ID NO: 210830 - protein, 111 aa, Glycine max
  Coding DNA Sequence Number=SeqID_94052
  Gene Ontology: Mol. function=DNA binding; Biological process=DNA integration
MACVMKASWVFGDLWKKIWKVTIVPIANISFGTMMLIGSPIHIRQNPLCVHIWPGAVARRSTKQSIIARSTMESEFIALELASSEAKWLKNFLVYIPLGMKPTPSVPMQKP

SEQ ID NO: 210831 - protein, 443 aa, Glycine max
  Coding DNA Sequence Number=SeqID_94053
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=99%, E-value=2e-45, Identity=32%"; Hit description =UPI00006A17C9 related cluster
MSNRVEFGMTGPLNDSISCIFIRVDPWATRPRLAFRGLHAHAYRGLHVYAFRGLHALAFRGLHVLAFRGLHALAFRGLQVVAFRGLHDLAYRGLHAFAFRGLHTLAVRGLHVLTFRGLHALALRGLHILAFRWLHVLPFKGIHVFAIRGIHILTFRGLHILAFRGLYALSFRGLHFLAFRGLHVLTFRGLDVLVFRGLHVLTIRGLHVPAFRGLHTLAFIGLHVLVHVLAFRGIHALAISELHVLAFRGLQALTFRGLQVLAFRGLHALPFRELHTFAFRGLHAIALPSEGFTPSPSDGYTTVNLWWTHGLHALVLPSEAYTPSPLKDYTSMPSEGYTPSPSEDNMAGHPCLQRATRPRPAFRGLHALAFRGLHVLAFRGLHALVFRGLHVLAYRGLHVLANRGLHDLAFIGLDVLAFIGLHNLAIRGVHVLAFRGLHALAFR

SEQ ID NO: 210832 - protein, 272 aa, Glycine max
  Coding DNA Sequence Number=SeqID_94054
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=9e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=76; ConfidenceScore=5.71e-01
MSSPMKARESNPMKARVCSPLMVRTRSPLKARACSPRKARMCSLLIARVCSPLKARTCNPLMARTCSLLNVSMCIPLMARTCSFLKLRTCSLLKARACIPLKARTCALLMAWACSPMKARVCSPLKVRMCSPLKARTCSPLKARMSSPLKVTTCSPLKARVCIPMKARTCAPLMARACSPMKARTSRPMKATACSPLKVRTCSPLKARTCNRTCSPQKARACNPLKARTCSPLKVRTCSPLKPRTCSPLKARTSSPIKVRTCSPLRRGRVAL

SEQ ID NO: 210833 - protein, 58 aa, Glycine max
  Coding DNA Sequence Number=SeqID_94055
  Homolog annotation: Hit_ID=Q8S996; Match level="QueryCoverage=86%, HitCoverage=12%, E-value=8e-07, Identity=51%"; Hit description =Glucosyltransferase-13
MNAVLPCEGLKVGVRPRVSENGLVEREEIVKKMDLLQRPILKEDGSSTMILGTNGCYM

SEQ ID NO: 210834 - protein, 396 aa, Glycine max
  Coding DNA Sequence Number=SeqID_94056
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-47, Identity=31%"; Hit description= UPI00006A17C9 related cluster
GLHVLANRGLHALTLRGLCVLTFRGLHVLTFRGLHALAIRGLRVLTFRGLHALAIRGLHVLTFRGLHALAIRGLHVLTFVGLHALTFRGLHVLANRGLHAFTLRGLHVLTNVGLHALTFRGLHVLANRATHALTFRGLHRAARPHLQRTTRPRLERATRPRLGYFYLSPPEDYIGLHVLALRGLHVLTIRGLHALTSRGLHVLALRGLHALYLQRTTRPRLERATRPHLGGLHALTIRGLHALAIRGLHVLTFVGLHALTFRGLHVLANRGLHALTFRGLHVLALRGLLALTLGLHALIFRGPHVLTFRGLHALAIRGLHVLTFVGLHALTFRGLHVLANRGLHALTFRGLHVLANRGLHALTLRGLHALNSRGLYILALRGLHALTFRGLRVLHF

SEQ ID NO: 210835 - protein, 158 aa, Glycine max
  Coding DNA Sequence Number=SeqID_94057
MKTNLKQTVTVQKWEESTHTTNRLTWIRCYNIIFSTWNTKCLSSIISNFGKVLDIDKDSLLLKKVEFMKVLIMTSTQQTISKNFKISINGVITQVKLVEEMKVFENHCFYKGDRISDEEDTCSKDSEMGMCLGSSSSECFFDAWHATKHDVVRRQDCR

SEQ ID NO: 210836 - protein, 418 aa, Glycine max
  Coding DNA Sequence Number=SeqID_94058
  Gene Ontology: Mol. function=ATP binding; Cellular component=nucleus; Biological process=electron transport
  Homolog annotation: Hit_ID=Q1S771; Match level="QueryCoverage=86%, HitCoverage=87%, E-value=1e-133, Identity=65%"; Hit description=WD40- like
  Pfam annotation: Domain name=WD40; Domain location=107-142; Score =16.6; E_value=0.09; Accession=PF00400.22; Description=WD domain, G -beta repeat
  Pfam annotation: Domain name=WD40; Domain location=182-220; Score =35.0; E_value=2.6e-07; Accession=PF00400.22; Description=WD domain, G-beta repeat
  Pfam annotation: Domain name=WD40; Domain location=224-262; Score =33.1; E_value=9.9e-07; Accession=PF00400.22; Description=WD domain, G-beta repeat
  Pfam annotation: Domain name=WD40; Domain location=270-308; Score =31.4; E_value=3.1e-06; Accession=PF00400.22; Description=WD domain, G-beta repeat
  Pfam annotation: Domain name=WD40; Domain location=316-352; Score =38.3; E_value=2.7e-08; Accession=PF00400.22; Description=WD domain, G-beta repeat
  Pfam annotation: Domain name=WD40; Domain location=360-412; Score =30.8; E_value=4.9e-06; Accession=PF00400.22; Description=WD domain, G-beta repeat
  Pfam annotation: Domain name=WD40; Domain location=56-92; Score=33.4; E_value=8.1e-07; Accession=PF00400.22; Description=WD domain, G-beta repeat
  Pfam module annotation: Pfam domain module=WD40::WD40::WD40::WD40::WD4 0::WD40::WD40; Domain location=107-142::182-220::224-262::270 -308::316-352::360-412::56-92
  Subcellular localization annotation: CTP_CleavageSite=12; ConfidenceScore=5.53e-01
MEYQYPSSYSVSSSSHSNHHQQGSTTKSLSSSQRSLISVPSLNHHHLHTPNPSVYHHCLTTLKGHTSYISSLTLSGKFLYTGSSDREIRSWNRIPENSSTDNSNNNNNNSTVLAGKGAVKSLVIQSNKLFSAHQDNKIRVWKISNNDDDHHHQKYTHVATLPTLGDRASKILIPKNKVQIRRHKKCTWVHHVDTVSALALSKDGALLYSVSWDRTLKIWKTKDFTCLESLANAHDDAINAVAVSYDGCVYTGSADKRIKVWKKFAGEKKHTLIETLEKHNSGVNALALSSDENVLYSGACDRAILVWEKEGDDGKMGVVGALRGHTMSILCLSVAADLVCSGSADKTIRVWRGSVDAHEYSCLAVLEGHRGSIKCISAVVDHCNNTNTWSQSEALSFLVYSGGLDCHIKVWQILVPAI

SEQ ID NO: 210837 - protein, 506 aa, Glycine max
  Coding DNA Sequence Number=SeqID_94059
  Gene Ontology: Mol. function=chitin binding; Cellular component =extracellular region; Biological process=chitin metabolic process
  Homolog annotation: Hit_ID=UPI00006A17C9; Match level="QueryCoverage =59%, HitCoverage=100%, E-value=5e-40, Identity=31%"; Hit description= UPI00006A17C9 related cluster
MTDPLNESISCFLIRVDPWVHALTFRGLHALTFRGLHALRFRGLHVLAIRGLHVLAFRGLHALAFRGLHVLAFRALHALTFRGLHVLTFRGLYVLAFRGLHILAIIGLHALTFRGLHVLAFRGLHALAFRGLHILTVIGLHDLTFRRLHALTFKRLHGYTPAPSEGYTPSPLEDYTGLHVLAFRGLHVPTFRGLHALASKGLHVLAFRGLHILTFRGPHSLPFRGLYALAFIGLHALTFRGLHVLAFRRLHALALRGLDVLAFRGVDVLTFKGLHALAFRDYTSSSLEGCTSLTSEGDTSACSEDSSSLATPLILEECQLCEHNQRGRLSCSYYAYRGKISPRPLQGDECGSCVPPQLRSPPTEVSVGLCRHDIGCLSPPARSSDLPSPEPLSKSTTPPDRRRAGVLPTTCGRLAGGQPPGQDVLDIVSDIVDPAASMLLAIPVFSGRMSWTLYPTSPGKAPLKRVLVWPHKLTQVLTTTDSRAWNISSISRPLRDGHSSGRDKGS

SEQ ID NO: 210838 - protein, 71 aa, Glycine max
  Coding DNA Sequence Number=SeqID_94060
MTHPFDITVTFDEMMRTLGHTPFVIPYRTTDARDYRSLFRGRERAHGFSHGRGSFGGPVGNGEPSIPPCCP

SEQ ID NO: 210839 - protein, 97 aa, Glycine max
  Coding DNA Sequence Number=SeqID_94061
MICSLTKQGLLSRTLRSIQENGCSRGQHVISPDKVRLTGLYETPARISKATCPFTGQGPFDKTLQNPQMDFQRVTSPFIGQGPLSRTLRKPHVPLIS

SEQ ID NO: 210840 - protein, 85 aa, Glycine max
  Coding DNA Sequence Number=SeqID_94062
MDGPASCWYQWMTRNRFLTSWPAMLQALEYRFTPTFYDDLWSRLAILAELLHLRVVPRTPSRSTGVPTSAPPASCRPCKVAREKT

SEQ ID NO: 210841 - protein, 258 aa, Glycine max
  Coding DNA Sequence Number=SeqID_94063
  Gene Ontology: Mol. function=DNA binding; Cellular component =chromatin; Biological process=DNA integration
  Subcellular localization annotation: CTP_CleavageSite=91; ConfidenceScore=5.18e-01
MSFGLCNAPSTFQATMNDLLRPFLQKFVMGVAPNPNKIQTMLDWPTPSSPLDLRGFLGLTGFYRKFIRHYAAMTAPLTALLRKYQFSWSSSAQAVFEQLKLLMTQALVLVTLDFTILFTVESDASNAAMGAVLSNSATHPGFTINNGLLFFEGKIWLPSSNTFLNLIVDEFHTTPLGGHMGVLKTLCCLQDNFFWPHMRQDVSCYMAQCSICQQMKYEAKKLAGLLHPLPIPSAIWEDLSLNFITGLPLSNGYTTIMV

SEQ ID NO: 210842 - protein, 57 aa, Glycine max
  Coding DNA Sequence Number=SeqID_94064
  Gene Ontology: Mol. function=hydrolase activity, acting on ester bonds; Biological process=lipid metabolic process
  Homolog annotation: Hit_ID=Q5VMA7; Match level="QueryCoverage=94%, HitCoverage=23%, E-value=5e-12, Identity=60%"; Hit description =Putative CPRD49
MSFFDGDGLHLTQSGNQVVFEEVITKLREEGLSLESIPVDLPLIADIDPNDPLKSFL

SEQ ID NO: 210843 - protein, 1459 aa, Glycine max
  Coding DNA Sequence Number=SeqID_94065
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=95%, E-value=0.0, Identity=43%"; Hit description=Chromo
  Pfam annotation: Domain name=Chromo; Domain location=1348-1402; Score= 47.3; E_value=5.2e-11; Accession=PF00385.14; Description='chromo' (CHRromatin Organisation MOdifier
  Pfam annotation: Domain name=RVP_2; Domain location=301-410; Score= -35.3; E_value=0.00056; Accession=PF08284.2; Description=Retroviral aspartyl protease
  Pfam annotation: Domain name=RnaseH; Domain location=792-911; Score= -12.1; E_value=0.00077; Accession=PF00075.14; Description=RNase H
  Pfam annotation: Domain name=rve; Domain location=1045-1201; Score =106.8; E_value=6.5e-29; Accession=PF00665.16; Description=Integrase core domain
  Pfam annotation: Domain name=zf-H2C2; Domain location=986-1027; Score= 12.7; E_value=0.0074; Accession=PF09337.1; Description=His(2)-Cys(2) zinc finger
  Pfam module annotation: Pfam domain module=Chromo::RVP_2::RVT _1::Retrotrans_gag::RnaseH::rve::zf-H2C2; Domain location=1348 -1402::301-410::532-701::107-197::792-911::1045-1201::986-1027
MTRLDELEDRVTSMEKTFEERVSALEETFRQTFTEFRNTLTEEFASFRREPETTPVSSAAEETMSEYRMAVKKVELPSFDGEDPVGWITRAETYFEVQGTSEEVKIRLAKLSMEGATIHWFNLLRETEDDLTWLKLKQALMERYGGRQSDNPYDEMKDLQQTGTVDEYITAFEYVSSQVGRLPEEQYLGYFMGGLKTDIRLKVRTLNPRSRTQAMKIARDVETEMRGSLLPRGGVGGPRNWKGSGPSNGSIINEEGEVIAIEVKEDEEEVLDCNSMGLCGITESKTTLSNNPPTTLRLKGSLNGISIVVLIDSGASHNFVSPHVATALGLNVEHGRSMGVKLGDGHRVTTKGRCRNMEVHLGKFTTQIDAFVLELGDLDMILGVAWLQRFGKVTFDWEKMTISFVWEGERVELQGQFFTTQDVSTNNTIHTSMDSLHSLLEAEMVPAVNKDTPELIGAQKQELDELLSKFKGVFEEHKGLPPEREINHTIELQKEAGPVSVRPYRYPHHHKGEIERQVQDMLSQGIIRNSSSAFSSPVILVKKKDDSWRMCIDYRELNKVTVPDRYPIPVVDELLDELHGTKYFSKLDLKSGYHQIRVKEEDVQKTAFRTHEGHYEFLVMPFGLTNAPATFQSIMNQIFKPHLRKFVLVFFDDILVYSKSWQEHLAHLSQVLEVLQHHCFVVNQKKCSFASRKVEYLGHVISEQGVAVDPAKTNSILEWPIPHNVKGVRGFLGLTGYYRKFIVGYGKIAKPLTELTKKDGFHWGPEEQKAFENLKSVMIQAPVLTLPDFTQPFEIECDASGRGIGAVLMQKKKPIAYFSKALSKNNLSKSAYEKELMALVLAVQHWRPYLLGRRFVVYSDQKSLRHLLQQRITTADQQNWIAKLLGYHFEVVYKPGPENKAADALSRIHEEVELKGITSFPICLQEQQIQHEVRNDPYLQKVVTDLQQNPTSQPGFQLIKGRLFYHNRLVLSSSSDCIPLMLKEFHSSATGGHSGFLRTYRRIAGNLYWVGMRKSVQKFVQSCDVCQRQKYSASSPMGLLQPLPIPERIWDDISMDFITGLPKSKGYEAIFVVVDRLSKYGHFIPLKHPYTARKVAEIFTKEVVRLHGMPQSIVSDRDPLFVSLFWKELFRLQGTVLSMSSSYHPETDGQTEVVNRCLEAYLRCFASEQPKEWSRWISWAELWYNTTFHVSTGTTPFETVYGRKPPTVVRFLQGETKVEAVATELIDRDEALRQLKYHLIRAQEQMKRYADKNRKEYSFEVGEWVFLKLRPHRQQTVTRRINQKLAPRYFGPFPILKKVGAVSYKLKLPEGSRIHAVFHISQLKKAIGNYSAEPQLPEGLEVEPEDLEEPEEVLASRSVTEGGQRVRQWLVRWKGRTIEDTTWEDESVLKSQFPSFSLEDKTVASGGGNDRTTAGPSINERPNPAERPNPAVWRVYVRRSKKVGNHSVSGVAKGIREYP

SEQ ID NO: 210844 - protein, 193 aa, Glycine max
  Coding DNA Sequence Number=SeqID_94066
  Gene Ontology: Mol. function=transferase activity; Cellular component= intracellular; Biological process=translation
  Homolog annotation: Hit_ID=Q7PC91; Match level="QueryCoverage=52%, HitCoverage=21%, E-value=2e-23, Identity=50%"; Hit description =Putative transposase
  Subcellular localization annotation: CTP_CleavageSite=28; ConfidenceScore=5.10e-01
MGKMDVHIITRETPKGKGSLWGSCSSPRRAAFFTMKLFGGPGEPETSLSELGFRKTKERTLFALFFLVFFTFLIKTLNDHVFRTVTGVQHQIVKKGKKDYSMTTSPTMRYTQMNKFDENLECKGIFSFALYKPLAIKIRIFSNRLMQLEGWAFLRCKNAQLLFAYWHMNHQLIVSMIMFELEKPRLYYAWKSL

SEQ ID NO: 210845 - protein, 143 aa, Glycine max
  Coding DNA Sequence Number=SeqID_94067
MVTLKGIVIFPFSFSFDGTLVIFESPLKQLLLQIFVPLSPSNIVNPTCTLAPQQPLKLSIKVRTPLSHPFLILLHLCGEEVTVFWGGVMIEVEGIAIAGMVEGGEGAKEGSNIAGGAEDEVGEARRESGGGGVGSGEKIAWTR

SEQ ID NO: 210846 - protein, 80 aa, Glycine max
  Coding DNA Sequence Number=SeqID_94068
  Gene Ontology: Mol. function=nucleic acid binding
MSTTEAEYMEIAEASKEVVWLARLVKKLGIEQGGAQLHYDNQSAIDLAKNQIRELMTSHYCKKVFKDGYFTLSMTVMNHP

SEQ ID NO: 210847 - protein, 528 aa, Glycine max
  Coding DNA Sequence Number=SeqID_94069
  Gene Ontology: Mol. function=nucleic acid binding; Cellular component= intracellular; Biological process=DNA integration
  Pfam annotation: Domain name=zf-CCHC; Domain location=1-18; Score =19.0; E_value=0.00071; Accession=PF00098.13; Description=Zinc knuckle
  Pfam module annotation: Pfam domain module=RVT_2::zf-CCHC; Domain location=304-469::1-18
MECYKCNQKEHFKCDCPELKKSGEGTSRSANVVETDDLDYYVEGDVTTKWEMFSLIAMYDDGIRTLCDVQHIPKLRNNLISLAQQTIGNIYRILGSTVVSRVAYVESNDDATKLWHLRLGHLNEHKMTELHKRGLLKGVQSCKLDLCDYYVLRKQTRVLFKVAEHTTKGILDYVHIDVWGSTRDSSLGRSHYFVTFIDDFSLKVIPKGVKGFKFWDPSFKKMVISRDVVFDEQSMLPKIVDIIMLVFDGASPNTMEIQSRWTALGVQSFHRDHHTIKLVVRYEFEELAKLVAFALLISVGDPSTFQEAMNSLEKDKWELVKLPAAKRAIGCKWVYKKKPPVSKKEREKFKARLVAKGHACDMHLEQMDVKTTFLHSDLEEQIYMELGLCMNRSTLRGGGTSTLIPTCFRLATGLGSYKEDSWDGDSWDGDSQGQEIQRLWLLQQSYVEKVLDKFNMSNAKPVSTLLAKHFKLSVDQCSKIDAEVEYMPKVLYANAVGCLMYAMVCTIPDLAYAISQVYKFMSNPAIGK

SEQ ID NO: 210848 - protein, 53 aa, Glycine max
  Coding DNA Sequence Number=SeqID_94070
MEMKGSVRGTLGCMRFIGVQNPDDVKSREVELRRQKDEEMKKREEWSLESEIR

SEQ ID NO: 210849 - protein, 80 aa, Glycine max
  Coding DNA Sequence Number=SeqID_94071
IYGEVSRSFAVRWKDVLDHFWHLLDNDGNLHTILYNQDLNRQAIVAGWTTLRDFYYMTGDHQVLLTHYGKIQGRARCKEN

SEQ ID NO: 210850 - protein, 133 aa, Glycine max
  Coding DNA Sequence Number=SeqID_94072
MGDKGAETNSAPFVIHKRAIVSGGMQRQIMVILRLVSTERNKFDNIRMMFCWQGGSLAEGCFARTKLVSYPYFPFISNKRQVKRGNCHTLISSGDHPLLGYDPRLTTSRYLAPIVRQFMKFCNVPEGQKGMIT

SEQ ID NO: 210851 - protein, 184 aa, Glycine max
  Coding DNA Sequence Number=SeqID_94073
  Gene Ontology: Mol. function=ubiquitin-protein ligase activity; Cellular component=ubiquitin ligase complex; Biological process =protein ubiquitination
  Homolog annotation: Hit_ID=Q9FJP6; Match level="QueryCoverage=99%, HitCoverage=34%, E-value=8e-42, Identity=51%"; Hit description =Genomic DNA, chromosome 5, P1 clone:MQN23
  Pfam annotation: Domain name=U-box; Domain location=27-101; Score =28.1; E_value=4.5e-07; Accession=PF04564.6; Description=U-box domain
  Subcellular localization annotation: CTP_CleavageSite=46; ConfidenceScore=5.47e-01
MGGNGKHRWKFSFHRSSSQTSNPDPNQVPKEFTCPISGSLMSDPVVVASGQTFERLAVQLCKDLNFSPKLDDGTRPDFSTIIPNLAIKTTILHWCDNSRTQPPLPPDYASLERHVREEKEKQDLIRVSEKELLNAVADNPPVIFSHAATELGPRVNHFNSGSSSEESVIIPPSPGTPLPLTIRP

SEQ ID NO: 210852 - protein, 96 aa, Glycine max
  Coding DNA Sequence Number=SeqID_94074
MGICKLGSSSANALIGDDEMVRVWGNAWVPGNWRLIDVAEDIIWQNRNNFIFQGLTFQPDDIVKHILSKVEVIDNSLQQFANLHCTGSNGRAQAEL

SEQ ID NO: 210853 - protein, 51 aa, Glycine max
  Coding DNA Sequence Number=SeqID_94075
MLEDGVGWLDEKFKESEEMVGWGSIGSLRTEWVQGVTYVGITKSITRTTKR

SEQ ID NO: 210854 - protein, 186 aa, Glycine max
  Coding DNA Sequence Number=SeqID_94076
MDEIEKVQEQMKADPEALKEKMATMVEAMMSIKEIVVVSAAYQTRARTKIMGEVEKVQEQMKAGMEAMKEQMAHEIPHHNLADFEPCLGYSAEGQAIGGIPLQNTLEGPQYHPQPQPSHSTAVKKPSCYGRNGKEERLRAIKGGEDYVFANLEELFLVPNIITPPKFKVLDFDKYKGTTCPKNHPK

SEQ ID NO: 210855 - protein, 359 aa, Glycine max
  Coding DNA Sequence Number=SeqID_94077
  Homolog annotation: Hit_ID=Q59IV5; Match level="QueryCoverage=40%, HitCoverage=47%, E-value=6e-49, Identity=67%"; Hit description =Plastidic phosphate translocator-like protein2
  Pfam annotation: Domain name=DUF6; Domain location=126-259; Score =14.1; E_value=0.01; Accession=PF00892.11; Description=Integral membrane protein DUF6
  Pfam annotation: Domain name=dsrm; Domain location=53-119; Score =48.6; E_value=2.1e-11; Accession=PF00035.15; Description=Double -stranded RNA binding motif
  Pfam module annotation: Pfam domain module=DUF6::dsrm; Domain location=126-259::53-119
MRGFGGEGEEERWGGVSVEEGKGDEGMHGIIVPIVGLFKRNEGDEKLLLLEMYKNQLQELAQRSCFNLPSYTSLQEGPDHAPRFKAIVNFNGKIFKTPHYCSTLRQAEHSAAEGSNNRFFTVGLVAAWYSSNIGVLLLNKYLLNNYGLKYPIFLTMCHMTTCSLFSYVAIAWMKVVPLQTLRSRVQFFKISVLSLVFYVSVVFRSISLYYLPVSFNQAIGATTPFFTAVFAYLMTLKRETWLTYLTLVPVVTGVILASGEQMARVIKEEERSSPRWGASFFTQTTQDVARAVVAAMNSQRPCVDHKSWKELTKLFESIVVAGLHPSKLTPYHESDAIGPIHSKESPSSELQSRIDAEAS

SEQ ID NO: 210856 - protein, 132 aa, Glycine max
  Coding DNA Sequence Number=SeqID_94078
MDYGWFQTEAEELVPLLTRKCQQRGDHECLIFQCSMSNIDPNCLFFKATLLSNSIVQRVVSLLIQIEYDKFKELNLLNGFDSSKVRRVHLEDKVTHLMEPTSGKRQAKTTSDRCRLHQGPSYMHHLEAWELA

SEQ ID NO: 210857 - protein, 65 aa, Glycine max
  Coding DNA Sequence Number=SeqID_94079
MEYRGGEKQPYRRRNYLTETAVLVLVLNAKVGLQWTTAITNPNGGHKPRRWSRTPSTTIVWRRPQ

SEQ ID NO: 210858 - protein, 255 aa, Glycine max
  Coding DNA Sequence Number=SeqID_94080
  Gene Ontology: Mol. function=nucleic acid binding; Cellular component= mitochondrion; Biological process=DNA integration
  Homolog annotation: Hit_ID=Q1T1E6; Match level="QueryCoverage=84%, HitCoverage=35%, E-value=1e-78, Identity=69%"; Hit description=Zinc finger, CCHC-type; Peptidase aspartic, catalytic
MACSYLNNTTFGISCKRLDVAFAIHKLSQYMQSPTTTHMQALKRILHYLKHTISHGLQLVATKNLDLTAFCDADWGGDTIDKKSTGAYIVYLGPNAISRSYKKQSTVARSSTEAEYRTIGLTASELLWLQQLLLELGIKLTKQPTIFSDNIGATYLCANLVFHSRMKHLAIDYHFVRDIVVKGELKVSHVPSSHQLANLLAKPLSRPGHEFLITKIGIVDSSSILQGHISEGHGLVGDICREAAEVLVDVEDGME

SEQ ID NO: 210859 - protein, 86 aa, Glycine max
  Coding DNA Sequence Number=SeqID_94081
MEEVTGDNKASKVVVKGKATDPMKVIQHLTSVLTSPPMLKHTSYSTFNIDAYVTIDVKTHIFYIVHEYNSDLEGIISTSVVRIAPM

SEQ ID NO: 210860 - protein, 99 aa, Glycine max
  Coding DNA Sequence Number=SeqID_94082
MVSLLCESHVAWKPPVVTAIQAQVQVAIYAGERFKRRLRVGGAATVLQGGAGGAEGQITSNGDDLAVQNFFYKAMQEQVKFLFLFGLHFLVACLNTYLR

SEQ ID NO: 210861 - protein, 91 aa, Glycine max
  Coding DNA Sequence Number=SeqID_94083
MAFFLNQTSIASHFRSHSQKTEDLASFPRRRFHVEPGAREKALLAEDATLKPFKSYKKSVKKLRKIGNALTIVVVAGKALGDLEIQYTSAV

SEQ ID NO: 210862 - protein, 83 aa, Glycine max
  Coding DNA Sequence Number=SeqID_94084
  Gene Ontology: Mol. function=inositol or phosphatidylinositol phosphatase activity
  Homolog annotation: Hit_ID=Q3J059; Match level="QueryCoverage=60%, HitCoverage=19%, E-value=2e-09, Identity=60%"; Hit description =Putative inositol monophosphatase protein
AAFSPSAAAFLAEKPVLGKTAADHAADQRFDAAIGLADHVLQPLFEVDSQALPPLIKAEGEIGGGAGDLTREAVARLDVPWGE

SEQ ID NO: 210863 - protein, 59 aa, Glycine max
  Coding DNA Sequence Number=SeqID_94085
MEEKDELPDVAEFLNKDKAAREKEKKKKNVKKRKVCETNFHAQEVHEWSELLQLSYPSS

SEQ ID NO: 210864 - protein, 93 aa, Glycine max
  Coding DNA Sequence Number=SeqID_94086
MNGNGSGVVTNSIAPLNPQYAGLSEFYSNDPPFFWGSSYPVEKVDFATYMLESDAEHWWNSTRGSLATQGAPITWEEFKEVFLDKYFPHSVHI

SEQ ID NO: 210865 - protein, 701 aa, Glycine max
  Coding DNA Sequence Number=SeqID_94087
  Gene Ontology: Mol. function=protein phosphatase type 2C activity
  Homolog annotation: Hit_ID=Q1S8C9; Match level="QueryCoverage=99%, HitCoverage=99%, E-value=0.0, Identity=63%"; Hit description=Protein phosphatase 2C, putative
  Pfam annotation: Domain name=PP2C; Domain location=362-665; Score =55.5; E_value=1.8e-13; Accession=PF00481.12; Description=Protein phosphatase 2C
MGSGVSTLCWCSRINEPDVIFTATDPLDETLGHSFCYVRSSARFLSPTRFLSPSTSLRFSPTHEPRTRPEFHETGFKAISGASVSANSSLPATVIRLDEEVNGVSSRGNIINGFESTASFSALPLQPVPRGGEPFEVSGFFLSGPIESNAVSGPLPAAADFVGGGEIPFSAPLAGLYGKKNRKKKMISGFRKAFNRNAPEKKRPWVVPVLNFAGRKESEGKPPPLPEEKSNVQWALGKAGEDRVHVVVSEEQGWLFVGIYDGFNGGDAPEFLMGNLYRAVHNELQGLFWELEEEQQEQEQQQPLPQESNPVVEGTESKRRKLWELLAEDGLDLSGSDRFAFSVDDALSVNNANAGSAVSRRWLLLSKLKHGLRKQKEGGGRGWNLGNEEKEKEKENQEKHCGRKRRVGPVDHGLVLSALSRALEFTELAYLDMTDKLLDTNPELALMGSCLLVALMRDEDVYLMNVGDSRAIVAHYEQKEVDSCVELGSKGGVESGGAESIVEEPLGLGQIGSAQQQRLVALQLSTDHSTNIEEEVIRIKNEHPDDAQCILNDRVKGRLKVTRAFGAGFLKQPKWNDAVLEMFRNEYIGTAPYISCSPSLRHHRLCQRDQFLILSSDGLYQYLSNEEVVSHVESFMEKFPEGDPAQHLIEELLLHAAKKAGMDFHELLDIPQGDRRKYHDDVTVMVISLEGRIWKSSGKYP

SEQ ID NO: 210866 - protein, 714 aa, Glycine max
  Coding DNA Sequence Number=SeqID_94088
  Gene Ontology: Mol. function=transferase activity; Cellular component= plastid chromosome; Biological process=transport
  Homolog annotation: Hit_ID=Q9LS25; Match level="QueryCoverage=98%, HitCoverage=98%, E-value=0.0, Identity=60%"; Hit description =Similarity to salt-inducible protein
  Pfam annotation: Domain name=PPR; Domain location=190-224; Score=5.1; E_value=1.9; Accession=PF01535.11; Description=PPR repeat
  Pfam annotation: Domain name=PPR; Domain location=225-259; Score =23.6; E_value=0.0007; Accession=PF01535.11; Description=PPR repeat
  Pfam annotation: Domain name=PPR; Domain location=260-294; Score =31.3; E_value=3.4e-06; Accession=PF01535.11; Description=PPR repeat
  Pfam annotation: Domain name=PPR; Domain location=295-329; Score =22.7; E_value=0.0014; Accession=PF01535.11; Description=PPR repeat
  Pfam annotation: Domain name=PPR; Domain location=330-364; Score =43.4; E_value=7.5e-10; Accession=PF01535.11; Description=PPR repeat
  Pfam annotation: Domain name=PPR; Domain location=365-399; Score =25.9; E_value=0.00015; Accession=PF01535.11; Description=PPR repeat
  Pfam annotation: Domain name=PPR; Domain location=400-434; Score =26.3; E_value=0.00011; Accession=PF01535.11; Description=PPR repeat
  Pfam annotation: Domain name=PPR; Domain location=436-470; Score =47.1; E_value=5.9e-11; Accession=PF01535.11; Description=PPR repeat
  Pfam annotation: Domain name=PPR; Domain location=471-505; Score =16.7; E_value=0.079; Accession=PF01535.11; Description=PPR repeat
  Pfam module annotation: Pfam domain module=PPR::PPR::PPR::PPR::PPR::PP R::PPR::PPR::PPR; Domain location=190-224::225-259::260-294::295 -329::330-364::365-399::400-434::436-470::471-505
  Subcellular localization annotation: CTP_CleavageSite=39; ConfidenceScore=5.35e-01
MATPLSTVVDVYFTDTKRTRFSITTTPCRQKTNRKFFIHCATSNSTPEAPPTPTSDNNNKKKNTSLSDQLAPLANKTLSSATRDQSYALSKPKSTWVNPTKAKRSVLSSERQKRATYSYSPQLRDLKRFAQKLNESGSSEDAFLACLEEIPRPISRENALLILNTLKPWQKTNLFLNWIRTQNLLPMETIFYNVTMKSLRFGKQFGLIEELAHQMIDNGVPLDNITYSTIISCAKKCNLYDKAVHWFERMYKTSLMPDEVTYSAILDVYARLGKVEEVISLYERGRATGWKPDPITFSVLGKMFGEAGDYDGIRYVFQEMESVGVQPNLVVYNTLLEAMGKAGKPVFARGLFEEMIELGIVPNEKTLTAVIKIYGKARWSRDALELWQRMKENGWPMDFILYNTLLNMCADVGLVEEAETLFRDMKQSAHCKPDSWSYTAMLNIYGSQGDVDKAMKLFNEMCKSGVELNVMGFTCLIQCLGRATEFDDLVRVFGISVERGIKPDDRLCGCLLSVVSLSQGSNDEEKVLACLQRANPKLVAFIHLIEDEKSSFESVKEEFKGIMSNAAVEVRRPFCNCLIDICRNKDLRERAHELLYLGTLYGLYPGLHNKTDNEWCLDVRSLSVGAALTALEEWMWTLTKIVKREETLPELFLAQTGTGAHKFAQGLNISFASHLRKLAAPFKQSEEKIGCFIASREDLVSWVQSKSTAAATAT

SEQ ID NO: 210867 - protein, 128 aa, Glycine max
  Coding DNA Sequence Number=SeqID_94089
  Homolog annotation: Hit_ID=Q1RW37; Match level="QueryCoverage=92%, HitCoverage=45%, E-value=4e-29, Identity=60%"; Hit description=Tumor- related protein, putative
MIWETYQHPNFLIDEMQRRIIFEEREVTHLMESHQETVADAPIVELSHLRGEVGEDKEIEEKVIESALVPLMEGLEQILLKADELRLRTLKAIVNVLTPKQAIHFLIADAELYLRMKWYKVLREFTCM

SEQ ID NO: 210868 - protein, 72 aa, Glycine max
  Coding DNA Sequence Number=SeqID_94090
SQVRLGDRLGRVRWRQWILGLGISCIESLPGDGFRWHVPWVEQQCKYLEHVGSNGHLGNTDENGYHVNETHT

SEQ ID NO: 210869 - protein, 121 aa, Glycine max
  Coding DNA Sequence Number=SeqID_94091
  Gene Ontology: Mol. function=protein serine/threonine kinase activity; Cellular component=chloroplast; Biological process=protein amino acid phosphorylation
  Homolog annotation: Hit_ID=P46573; Match level="QueryCoverage=99%, HitCoverage=29%, E-value=6e-53, Identity=81%"; Hit description =Protein kinase APK1B, chloroplast precursor
  Pfam annotation: Domain name=Pkinase; Domain location=4-118; Score= -93.4; E_value=0.0053; Accession=PF00069.15; Description=Protein kinase domain
  Pfam annotation: Domain name=Pkinase_Tyr; Domain location=1-118; Score=-121.9; E_value=5.4e-05; Accession=PF07714.7; Description =Protein tyrosine kinase
  Pfam module annotation: Pfam domain module=Pkinase::Pkinase_Tyr; Domain location=4-118::1-118
MVTEINYLGQLSHPNLVKLIGYSLEDDHRILVYEFVAKGSLDNHLFRRGSYFQPLSWNIRMKVALDAAKGLAFLHSDEVDVIYRDFKTSNILLDSNYNAKLSDFGLAKNGPEGDKSHVSTR

SEQ ID NO: 210870 - protein, 388 aa, Glycine max
  Coding DNA Sequence Number=SeqID_94092
  Gene Ontology: Mol. function=protein transporter activity; Cellular component=membrane; Biological process=protein secretion
  Homolog annotation: Hit_ID=Q27T25; Match level="QueryCoverage=95%, HitCoverage=94%, E-value=1e-106, Identity=55%"; Hit description=EtsA
  Pfam annotation: Domain name=Biotin_lipoyl; Domain location=31-88; Score=-11.1; E_value=0.013; Accession=PF00364.12; Description=Biotin- requiring enzyme
  Pfam annotation: Domain name=HlyD; Domain location=56-376; Score =19.5; E_value=0.00044; Accession=PF00529.10; Description=HlyD family secretion protein
  Pfam module annotation: Pfam domain module=Biotin_lipoyl::HlyD; Domain location=31-88::56-376
MTKKWLFAALTALVMILVLWAYSASRSKPNPLMTAAVRQGDIENVIAATGKMDAIERVNVGAQVSGQVKKLYIKAGDNVRKGQLIAEIDDQPQRSDLRNAQAALSVAQADLQTRQATLVRQQAQFQRLQQMVKTNAVSRQDFDTAAEAWRIAQAELTAQQARVIQAQIEVDKKQLDLGYTRIMAPIDGTVVAIVTKQGQTVNAVQSAPTIAKLAQLGTMTIKVQISEADITNIQPGQQAWFTTFANPDKRYNATLRSIELAPESVMKDDALMGNSESNTVSSTNAAVYYNALLDVPNPDNALRISMTAQVNLLRDQAKNALLVPVQATKKASDGRTYVEIADQNNQPEKRYITTGISDSVDIQVLSGLRLGEKVILATQQPGADKVVM

SEQ ID NO: 210871 - protein, 71 aa, Glycine max
  Coding DNA Sequence Number=SeqID_94093
MEIGVGFDTSVIEEKSMIMGWASATRYFGMENSTSKCSRVFSFHLSAWEGDPPLWYHFQQCYKRQTKLLNT

SEQ ID NO: 210872 - protein, 241 aa, Glycine max
  Coding DNA Sequence Number=SeqID_94094
  Homolog annotation: Hit_ID=Q19Y34; Match level="QueryCoverage=80%, HitCoverage=35%, E-value=1e-17, Identity=34%"; Hit description=Gp26
MALVKKAMEALVDADPMKIVTLSKRHSELVDELVKRPRLESRPDAVASYGELAVDFVSACGMRLEDWQEYVLHAWHDVDSDGNWAASEAGLLVSRQNGKSEDLIGFDLVRLFLFPMPDLRRRTVLHTAHEVKTATESFEKLAAIIASQDRLMAMVDHIYTANGKEAIVLKRRPGQLLGDRVRFIARSKGSGRGFGAADIVYDEAQDLSTQARSALTYTQSTIPNRQEIFAGTVPSEEDDGE

SEQ ID NO: 210873 - protein, 53 aa, Glycine max
  Coding DNA Sequence Number=SeqID_94095
MVCEEHEGRSQWNEGAKKMVVIWLLRRLKGFLKVSSKIYFPSIFEKKITKIKV

SEQ ID NO: 210874 - protein, 102 aa, Glycine max
  Coding DNA Sequence Number=SeqID_94096
MNLLSCDISRKNFFHRNPRKKVLSWLPVEEIILRDGTEEGSSVVNVTNVEEPSSVQSRGRSSSARILTTVEELFSVTLTAEEGSAVETLRGKQAPSIHDLFL

SEQ ID NO: 210875 - protein, 176 aa, Glycine max
  Coding DNA Sequence Number=SeqID_94097
  Gene Ontology: Mol. function=RNA-directed DNA polymerase activity; Biological process=RNA-dependent DNA replication
SESEFEFDPVADFYAESEFEFKSDVVPLDVNFLESECTNHVAGSTYTSDLLYQPPPTPKLKPLPATLKYAYLEYKENFPVIISASLAAEQEEKLLLDGSLASEAATAATQPRHSRCVQVVPKKTGLTVIKNEKDELILTRVQNNWRVCIDYRRLNQVTRKDHFPLPFIDQMLERLA

SEQ ID NO: 210876 - protein, 81 aa, Glycine max
  Coding DNA Sequence Number=SeqID_94098
RALGVTFEGYEEDIVSKFVSMEERDKKENRDEGVCKEGSCGITIVNAYSLYDLPNFNCIRNASERNDKVVDNLGMEGEKRV

SEQ ID NO: 210877 - protein, 194 aa, Glycine max
  Coding DNA Sequence Number=SeqID_94099
  Gene Ontology: Mol. function=transporter activity; Cellular component= outer membrane; Biological process=protein transport
  Homolog annotation: Hit_ID=Q1GY88; Match level="QueryCoverage=87%, HitCoverage=36%, E-value=2e-44, Identity=56%"; Hit description=Type I secretion outer membrane protein, TolC
  Pfam annotation: Domain name=OEP; Domain location=29-193; Score=40.9; E_value=4.4e-09; Accession=PF02321.8; Description=Outer membrane efflux protein
MSLTHLPRLIVLASSLWLPVTTWAASQSLVDIYQEAKANDPVLASAGSANLAAQEIIEQAKAGYRPSVNFTAGANANRTDLKIVGSQAPFPGGRNTYEGYQAQLQARQPIFRKENLERIDQSKVQVSIADKQYHLAQQNLMLRTTQAYFDVLLAQDRMTLIEAQKKAIQSQLQQAKANFDVGTATITDFNEAQA

SEQ ID NO: 210878 - protein, 144 aa, Glycine max
  Coding DNA Sequence Number=SeqID_94100
MAGAGDGDGKYHELDESQRLLLDDLENQMNHNTRRHYGRNRVANVGPKQNKVEGKNRIEGVKLNVPPFKAEFSDYALVWWNKNQREMMREEGQEIDTWTEMRKEYYKEMEMALVRVNIEEEIEDTLAHFLSGLNPYLRDVVELQ

SEQ ID NO: 210879 - protein, 54 aa, Glycine max
  Coding DNA Sequence Number=SeqID_94101
  Subcellular localization annotation: CTP_CleavageSite=34; ConfidenceScore=5.10e-01
MSFMIFWNSEGAFFKPNGITFHSYYPKAGCSSFKLSMFVNIKSRTRPWAFTFPN

SEQ ID NO: 210880 - protein, 198 aa, Glycine max
  Coding DNA Sequence Number=SeqID_94102
  Gene Ontology: Mol. function=phosphoribosylaminoimidazolecarboxamide formyltransferase activity; Biological process=purine nucleotide biosynthetic process
  Homolog annotation: Hit_ID=Q84XA4; Match level="QueryCoverage=53%, HitCoverage=17%, E-value=3e-50, Identity=93%"; Hit description =Aminoimidazolecarboximide ribonucleotide transformylase/inosine monophosphate cyclohydrolase
  Pfam annotation: Domain name=AICARFT_IMPCHas; Domain location=1-175; Score=-87.4; E_value=2.5e-08; Accession=PF01808.9; Description =AICARFTIMPCHase bienzyme
DTARRSRTTERSESVSEEAEERPIRKPASPRALADSLMQLARQALAKEIREFRSPTDGETRMFYEIVVAPSYTEKGLEILCGKSKTLRILEAKKNEAGKLSLRQVGGGWLAQDSDDLTPHDIKFNVVSEKAPQDDELRDAEFAWLCMQAWHWPSFYNVVTGKTLALPNLIALQHIPLSPAGVIAKRPAPIALPNSCAA

SEQ ID NO: 210881 - protein, 314 aa, Glycine max
  Coding DNA Sequence Number=SeqID_94103
  Gene Ontology: Mol. function=nucleotide binding; Cellular component =membrane; Biological process=small GTPase mediated signal transduction
  Homolog annotation: Hit_ID=P28188; Match level="QueryCoverage=60%, HitCoverage=66%, E-value=6e-79, Identity=80%"; Hit description=Ras -related protein ARA-5
  Pfam annotation: Domain name=Arf; Domain location=82-277; Score= -68.8; E_value=0.00019; Accession=PF00025.11; Description=ADP -ribosylation factor family
  Pfam annotation: Domain name=MMR_HSR1; Domain location=97-232; Score=- 1.8; E_value=0.0015; Accession=PF01926.13; Description=GTPase of unknown function
  Pfam annotation: Domain name=Miro; Domain location=98-232; Score =60.2; E_value=6.8e-15; Accession=PF08477.3; Description=Miro-like protein
  Pfam annotation: Domain name=Ras; Domain location=98-279; Score =320.0; E_value=4.3e-93; Accession=PF00071.12; Description=Ras family
  Pfam module annotation: Pfam domain module=Arf::MMR_HSR1::Miro::Ras; Domain location=82-277::97-232::98-232::98-279
MVTYLSRFHAIFIEKKRSTERSQPGCLPIPSVTLILSLVDFKELNCTYCMEFIGRISNYSKHEIRGNMRGCLQGCYSDVGVDFPHWKYGIWICDYLFKLLLIGDSGVGKSCLLLRFADDSYIESYISTIGVDFKIRTVEQDGKTIKLQIWDTAGQERFRTITSSYYRGAHGIIVGDDFLGMGFWILISRVDGSLHALLTDEESFNNVKQWLSEIDRYASDNVNKLLVGNKCDLEANRAVSYETAKAFADEIGIPFMETSAKDATNVEQAFMAMAASIKDSCEKQAQEKLFPIYSMNNYTVYLMLSVSLAEKSQL

SEQ ID NO: 210882 - protein, 93 aa, Glycine max
  Coding DNA Sequence Number=SeqID_94104
  Gene Ontology: Mol. function=protein-tyrosine kinase activity; Cellular component=integral to membrane; Biological process=protein amino acid phosphorylation
  Homolog annotation: Hit_ID=Q1SX72; Match level="QueryCoverage=96%, HitCoverage=30%, E-value=5e-12, Identity=43%"; Hit description =Tyrosine protein kinase, active site
  Subcellular localization annotation: CTP_CleavageSite=55; ConfidenceScore=5.71e-01
MVMLPFILSLLKFKFRNLGNSTTSVGIVPLNWLSPRSKSSRFWNVSRKMVGEFCQVSMVEGMNPESWLRSSPRSSKLAKFSMEAGIDPENLLA

SEQ ID NO: 210883 - protein, 269 aa, Glycine max
  Coding DNA Sequence Number=SeqID_94105
  Gene Ontology: Mol. function=protein-tyrosine kinase activity; Cellular component=integral to membrane; Biological process=protein amino acid phosphorylation
  Homolog annotation: Hit_ID=Q1SX48; Match level="QueryCoverage=99%, HitCoverage=25%, E-value=3e-90, Identity=69%"; Hit description =Tyrosine protein kinase, active site
  Pfam annotation: Domain name=Pkinase; Domain location=19-259; Score =61.4; E_value=2.9e-15; Accession=PF00069.15; Description=Protein kinase domain
  Pfam annotation: Domain name=Pkinase_Tyr; Domain location=19-252; Score=-12.8; E_value=1.1e-11; Accession=PF07714.7; Description =Protein tyrosine kinase
  Pfam module annotation: Pfam domain module=Pkinase::Pkinase_Tyr; Domain location=19-259::19-252
MEMFENIIEATNNFDYRYLIRVRGQGTVYKAELSSCQVYAVKKLYLETDGEKPNIKAFQNEIQALTEIWHRIIIKLCGFCSRSWFSFLVYKFLEGCSLDQILINDAKAAAFDWEKRVNIVKGVANALSYLHHDCSPPIIHRDVSSKNVLLDSQYETHVSDFGTAKILKPGTNNWTMFAGTFGYAAPELAQTMEVTEKCDVFSLGVLCLEIIMGKHPGHLISSLLSSTSATVTYNLLLLIDVLDQRPSQPLKINCRGCHFGCKLGTFLLE

SEQ ID NO: 210884 - protein, 165 aa, Glycine max
  Coding DNA Sequence Number=SeqID_94106
  Gene Ontology: Mol. function=protein-tyrosine kinase activity; Cellular component=integral to membrane; Biological process=protein amino acid phosphorylation
  Homolog annotation: Hit_ID=Q1SX58; Match level="QueryCoverage=97%, HitCoverage=17%, E-value=3e-33, Identity=43%"; Hit description =Tyrosine protein kinase, active site
MGVSMHILFQKARKKRAQAIEKAQSEEVCSIWGHDGKIMFENIIEATNNFNDKYLIGVRGQGSISMVELPSGQVFAVKKFHLETDGEISMTTLWILLTSTALVVCLYVLGRGAWIKYYGTEAAALDWKMRVNVVKGVAKALSYMHHGCSPPIMHRGISIENVARM

SEQ ID NO: 210885 - protein, 1053 aa, Glycine max
  Coding DNA Sequence Number=SeqID_94107
  Gene Ontology: Mol. function=protein-tyrosine kinase activity; Cellular component=integral to membrane; Biological process=protein amino acid phosphorylation
  Homolog annotation: Hit_ID=Q1SX72; Match level="QueryCoverage=97%, HitCoverage=97%, E-value=0.0, Identity=63%"; Hit description =Tyrosine protein kinase, active site
  Pfam annotation: Domain name=LRRNT_2; Domain location=15-55; Score =39.0; E_value=1.7e-08; Accession=PF08263.3; Description=Leucine rich repeat N-terminal domain
  Pfam annotation: Domain name=LRR_1; Domain location=108-130; Score =6.2; E_value=19; Accession=PF00560.23; Description=Leucine Rich Repeat
  Pfam annotation: Domain name=LRR_1; Domain location=132-154; Score =12.0; E_value=1.6; Accession=PF00560.23; Description=Leucine Rich Repeat
  Pfam annotation: Domain name=LRR_1; Domain location=156-178; Score =15.7; E_value=0.17; Accession=PF00560.23; Description=Leucine Rich Repeat
  Pfam annotation: Domain name=LRR_1; Domain location=180-202; Score =7.5; E_value=11; Accession=PF00560.23; Description=Leucine Rich Repeat
  Pfam annotation: Domain name=LRR_1; Domain location=204-226; Score =17.6; E_value=0.047; Accession=PF00560.23; Description=Leucine Rich Repeat
  Pfam annotation: Domain name=LRR_1; Domain location=228-251; Score =12.7; E_value=1.2; Accession=PF00560.23; Description=Leucine Rich Repeat
  Pfam annotation: Domain name=LRR_1; Domain location=253-275; Score =15.9; E_value=0.15; Accession=PF00560.23; Description=Leucine Rich Repeat
  Pfam annotation: Domain name=LRR_1; Domain location=277-299; Score =19.6; E_value=0.011; Accession=PF00560.23; Description=Leucine Rich Repeat
  Pfam annotation: Domain name=LRR_1; Domain location=301-323; Score =16.8; E_value=0.078; Accession=PF00560.23; Description=Leucine Rich Repeat
  Pfam annotation: Domain name=LRR_1; Domain location=325-347; Score =16.9; E_value=0.071; Accession=PF00560.23; Description=Leucine Rich Repeat
  Pfam annotation: Domain name=LRR_1; Domain location=349-371; Score =7.7; E_value=10; Accession=PF00560.23; Description=Leucine Rich Repeat
  Pfam annotation: Domain name=LRR_1; Domain location=397-419; Score =12.2; E_value=1.5; Accession=PF00560.23; Description=Leucine Rich Repeat
  Pfam annotation: Domain name=LRR_1; Domain location=421-443; Score =10.1; E_value=3.7; Accession=PF00560.23; Description=Leucine Rich Repeat
  Pfam annotation: Domain name=LRR_1; Domain location=445-467; Score =11.7; E_value=1.8; Accession=PF00560.23; Description=Leucine Rich Repeat
  Pfam annotation: Domain name=LRR_1; Domain location=469-491; Score =12.3; E_value=1.4; Accession=PF00560.23; Description=Leucine Rich Repeat
  Pfam annotation: Domain name=LRR_1; Domain location=493-515; Score =11.8; E_value=1.7; Accession=PF00560.23; Description=Leucine Rich Repeat
  Pfam annotation: Domain name=LRR_1; Domain location=517-539; Score =13.6; E_value=0.71; Accession=PF00560.23; Description=Leucine Rich Repeat
  Pfam annotation: Domain name=LRR_1; Domain location=541-563; Score =18.7; E_value=0.021; Accession=PF00560.23; Description=Leucine Rich Repeat
  Pfam annotation: Domain name=LRR_1; Domain location=565-587; Score =15.3; E_value=0.22; Accession=PF00560.23; Description=Leucine Rich Repeat
  Pfam annotation: Domain name=LRR_1; Domain location=589-611; Score =15.0; E_value=0.27; Accession=PF00560.23; Description=Leucine Rich Repeat
  Pfam annotation: Domain name=LRR_1; Domain location=613-635; Score =20.5; E_value=0.0062; Accession=PF00560.23; Description=Leucine Rich Repeat
  Pfam annotation: Domain name=LRR_1; Domain location=637-656; Score =9.0; E_value=5.8; Accession=PF00560.23; Description=Leucine Rich Repeat
  Pfam annotation: Domain name=LRR_1; Domain location=84-106; Score =11.0; E_value=2.4; Accession=PF00560.23; Description=Leucine Rich Repeat
  Pfam annotation: Domain name=Pkinase; Domain location=763-1035; Score= 148.7; E_value=1.5e-41; Accession=PF00069.15; Description=Protein kinase domain
  Pfam annotation: Domain name=Pkinase_Tyr; Domain location=763-1033; Score=65.7; E_value=1.5e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=15-55::108-130::132-154::156-178::180-202::204 -226::228-251::253-275::277-299::301-323::325-347::349-371::397 -419::421-443::445-467::...
  Pfam module annotation: Domain location=469-491::493-515::517 -539::541-563::565-587::589-611::613-635::637-656::84-106::763 -1035::763-1033
MVSLASAATTVTAASDSEANALLKWKYSLDKPSQDLLSTWKGSSPCKKWQGIQCDKSNSVSRITLADYELKGTLQTFNFSAFPNLLSLNIFNNSFYGTIPPQIGNMSKVNILNLSTNHFRGSIPQEMGRLRSLHKLDLSICLLSGAIPNTITNLSNLEYLDFGSNNFSSHIPPEIGKLNKLEYLGFGDSHLIGSIPQEIGMLTNLQFIDLSRNSISGTIPETIGNMSNLNILYLCNNSLLSGPIPSSLWNMSNLTDLYLFNNTLSGSIPPSVENLINLEYLQLDGNHLSGSIPSTIGNLTNLIELYLGLNNLSGSIPPSIGNLINLDVLSLQGNNLSGTIPATIGNMKMLTVLELTTNKLHGSIPQGLNNITNWFSFLIAENDFTGHLPPQICSAGYLIYLNADHNHFTGPVPRSLKNCPSIHKIRLDGNQLEGDIAQDFGVYPNLDYIDLSDNKLYGQISPNWGKCHNLNTLKISNNNISGGIPIELVEATKLGVLHLSSNHLNGKLPKELGNMKSLIQLKISNNNISGNIPTEIGSLQNLEELDLGDNQLSGTIPIEVVKLPKLWYLNLSNNRINGSIPFEFHQFQPLESLDLSGNLLSGTIPRPLGDLKKLRLLNLSRNNLSGSIPSSFDGMSGLTSVNISYNQLEGPLPKNQTFLKAPIESLKNNKDLCGNVTGLMLCPTNRNQKRHKGILLVLFIILGALTLVLCGVGVSMYILCLKGSKKATRAKESEKALSEEVFSIWSHDGKVMFENIIEATDNFNDKYLIGVGGQGSVYKAELSSDQVYAVKKLHVEADGEQHNLKAFENEIQALTEIRHRNIIKLCGYCKHTRFSFLVYKFLEGGSLDQILSNDTKAAAFDWEKRVNVVKGVANALSYMHHDCSPPIIHRDISSKNILLDSQYEAHVSDFGTAKILKPDSHTWTTFAVTYGYAAPELAQTTEVTEKCDVFSFGVLCLEIIMGKHPGDLMSSLLSSSSATITYNLLLIDVLDQRPPQPLNSIVGDVILVASLAFSCISENPSSRPTMDQVSKKLMMGKPPLADQFPMIRLGQLL

SEQ ID NO: 210886 - protein, 45 aa, Glycine max
  Coding DNA Sequence Number=SeqID_94108
MAVASYEIWGMGLKLHYIYGMYRNDLVKEIKKKRLQRRYVSNLGG

SEQ ID NO: 210887 - protein, 134 aa, Glycine max
  Coding DNA Sequence Number=SeqID_94109
MEPEALDTTVRPDTYNILKPETKKLTPLRCSSILPDDVEESSQLEVHLNQGVAVREEQGFVHGKTQVINEFFVTNNCYIVDLATNWVAPSTEASVGPLSWIGICETNSTFPQNFSLMIFHRFTFVTTDMGLKGS

SEQ ID NO: 210888 - protein, 355 aa, Glycine max
  Coding DNA Sequence Number=SeqID_94110
  Homolog annotation: Hit_ID=Q9LUA7; Match level="QueryCoverage=70%, HitCoverage=79%, E-value=1e-59, Identity=47%"; Hit description =Arabidopsis thaliana genomic DNA, chromosome 5, P1 clone:MIF21
  Pfam annotation: Domain name=DUF868; Domain location=25-325; Score =427.4; E_value=1.9e-125; Accession=PF05910.3; Description=Plant protein of unknown function (DUF868)
MQDAIGIPACFSSALKSSDDHTTVTRSGQSVHMSVYRTKIADQCRLITITWCKNMILHGLSVSVEGPEGKAQYCCKVELKPWYFWRKQGSKRFIVHGNKPVDVFWDLKGAKFNGETEPTSEYYVAVVCDQEVVLLIGDLKKEAYRRTGCRPALIDPILVSKKEHIFGKRKFSTRAKFHEKGRCHEISIECKSNNIGGDGDKIQPEMEIRLDGHVVIHVKRLQWKFRGNESIHLNKMRVEVYWDVHDWLFSPGLKHALFIFKPVLSSSNISMSSSHSISSSSSPLSLSLSSSSTPLSTQTGRSGSLEGCSVSEASAFCLFLYAWKGNGILIIVSSTGKITLENDLGALQVMEKNAK

SEQ ID NO: 210889 - protein, 90 aa, Glycine max
  Coding DNA Sequence Number=SeqID_94111
MDQSSKVYIKLEDVRDEVVESLENHLTFKVFERQSFYPSHYSTPPLSSVFRVLHEEEAKDKKSMRLPFKSAIPTSDDSEREDVEGSEAEN

SEQ ID NO: 210890 - protein, 209 aa, Glycine max
  Coding DNA Sequence Number=SeqID_94112
  Gene Ontology: Mol. function=zinc ion binding
MSNVEVRVSEIEGPVEMDDKSDSESKSDVYLDDSEEDMILGLDDGFGDYATMNLTPKEVIEKLNNDLQHGVNPTFTKDMEGDYKIDFKDAMREYLILIRMEVRFPKNDKIRVRVMCKSKGCSFKVLLKLGEQRKWLKRTLMEMQQSHVACCIDDCKMGFVAGCQPFIGVYGCHLKTKYGGIFFIVVGRDHNDQYYPIAFVVIESETNES

SEQ ID NO: 210891 - protein, 843 aa, Glycine max
  Coding DNA Sequence Number=SeqID_94113
  Homolog annotation: Hit_ID=Q6AUI1; Match level="QueryCoverage=34%, HitCoverage=77%, E-value=1e-118, Identity=71%"; Hit description =Unknow protein
  Pfam annotation: Domain name=zf-C3HC4; Domain location=322-362; Score= 40.6; E_value=5.4e-09; Accession=PF00097.15; Description=Zinc finger, C3HC4 type (RING finger)
MDKVWCFTILYVSRYVELKVSHIYEARILLPVQNVTHGDVVDAISIVLHATNVLIAVAPNCLLKGKAAYNIPPPYLRIAKSLWAMGGSSLCEGMGEGCCTQPYPCICKEAVSGFEPMTNKSPRHNFTAAPGLALFSECPRVRVRVHVRVVSGVRVRIDFGWQQRYARFCGRVVVLSILVLLLYPFLWAWTVIGTLWFSSAKNCLPEVGKKWGFLIWLLFSYCGLFCIACMSLGKWLTRRQAHLLRAQQGIPVSEYGVLVDMIRVPDWAFEAAGQETRGMGQDAAAYHPGLYLTPAQREAVEALILELPKFRLKAVPTDCSECPICLEEFYVGNEVRGLPCAHNFHVECIDEWLRLNVKCPRCRCSVFPNLDLSALSSLRAEPEQFSASVVTTARYVRGQPSSLSYRLRLQGLLCPVRAEIAGPVGDIDNALKNAQNGVVSIVTQNASSSGDQASSVECMPVTVCHSSAQREENWLGTMFESWSPEIALGSRMLWIEKQKCFPESPMLFLVSVPLSKEISGFEKLCIIGRIFPLRLLEETEMVEERSCCKESGGFDIESRASSVDSWRGEEGDSDDSRSLMDDNGWPPPQDEGSVLFGCDGKGFVNTSKEMEARDTNEIQKIKGEEISRDIAGKKRQQISDKLCMILWGDHLVEWKAYPSRNTGDFNVVREKDRDKRSKGDSGKQFTWFSPAGSTISRIDIRLGKKTLVIKEMGELDRRAELWLLTNPEIQKWKISTEELWNISRRHESLLYKKSRVRVFINGLWVEELNHIKEEVKRFIELKYKEQVEKVKQAVWECDGNKCLGPDVLQKVIHESQSAFLGGRNILDGVVIANEVIQEAKAKE

SEQ ID NO: 210892 - protein, 75 aa, Glycine max
  Coding DNA Sequence Number=SeqID_94114
MLNSEGSDCFKVKNFIPESEIGNELFMPWESNNTFLYFIFTPMVSDVEVIYEAPIRTRTPDTTRTWTRTRTRGHL

SEQ ID NO: 210893 - protein, 349 aa, Glycine max
  Coding DNA Sequence Number=SeqID_94115
  Gene Ontology: Mol. function=nucleic acid binding; Cellular component= chromatin; Biological process=DNA integration
  Homolog annotation: Hit_ID=Q94I37; Match level="QueryCoverage=77%, HitCoverage=22%, E-value=2e-55, Identity=41%"; Hit description =Putative retroelement
MERQTNETVKVELGGEEIHDEVQIDNEQYVNDEQNVNDGSDVIGVVPLRRSLRQISPPVRFQDYVVFPDAASNVNGELMKAMEEEFRSIQKNKTWEMARLVAKGFLQKPSLDFNEVYAPVARIETVRLIVAIASMRKWTVSQLDVKSDFLNGPLEEEVYTRQPPGYKKIGMEDRVMKLNKALYGLKKAPRAWNKRIDGFLQKQKFLKCTTEHGVYLKDCGVTGVVMLCLYVDDLLVTDITYGVGLVSIFMKKPCKDHLLAAKRILRYVKGTLECGILFPTTKENFEIEIIDYTDADWSEDIGDRKSTYGYMFMLGNAPISWCSKKQEVVALSSCEAEYISAAFGARQAL

SEQ ID NO: 210894 - protein, 243 aa, Glycine max
  Coding DNA Sequence Number=SeqID_94116
  Homolog annotation: Hit_ID=Q9FM13; Match level="QueryCoverage=90%, HitCoverage=92%, E-value=4e-32, Identity=36%"; Hit description =Arabidopsis thaliana genomic DNA, chromosome 5, P1 clone:MQB2
  Pfam annotation: Domain name=DUF588; Domain location=112-226; Score =105.1; E_value=2.1e-28; Accession=PF04535.3; Description=Domain of unknown function (DUF588)
  Subcellular localization annotation: CTP_CleavageSite=46; ConfidenceScore=5.36e-01
MPSMKTSSSKTSESSTQFDSPHSPLRSFPLFDNADPFHSPQNDNSRAIVIVETTSTQFAQAAPPAPESEHRNPPPEAVVTRPVWPETKSSATVGRTRPRPVAPPSSVVPKREMMAKKVALGFRLSEVVLCLISFSVMAADKTRGWSGDSFDRYKEYRYCLSVNVIAFVYAAFQACDLAYQVLAYLLVSAASSAATRVDDWQSNWGKDDFTEMASASIALTFLAFVAFAISSLISGYNLCTLFS

SEQ ID NO: 210895 - protein, 199 aa, Glycine max
  Coding DNA Sequence Number=SeqID_94117
  Gene Ontology: Mol. function=transcription regulator activity; Cellular component=nucleus; Biological process=regulation of transcription
  Pfam annotation: Domain name=HLH; Domain location=12-67; Score=19.8; E_value=0.0011; Accession=PF00010.16; Description=Helix-loop-helix DNA-binding domain
MKNTNTNTSGSPKLDRKTIERNRRIHMKSLCFKLVSTIPSNYLKTSKDMLSQQDQLHLAATYIKHLRERIEKLKGEKEKAMNMMMMSNQSNNRIFNTGSELPLLEIKDLGSGIEVMLISGLNKNFMLYEVISVLEEEGAEVVAANFSTVADKIFLHVSCSGTMTFPHICMYVKISRVGVEPARVYQRLQELIAPLESWE

SEQ ID NO: 210896 - protein, 259 aa, Glycine max
  Coding DNA Sequence Number=SeqID_94118
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=23%, E-value=2e-63, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=111-255; Score =59.2; E_value=1.3e-14; Accession=PF00665.16; Description=Integrase core domain
MAKGIGKVAIRKVDGSKVTISDVLYVPNMENNLLSLGHLLEKGFSIHMEGEHMEVVYSNGTCVLKVVVYKNRTFKLGVSTIEQKCLTVQSNDNVWKWHRRLGHLNFNSLNKLQKKNMVVGLPSIEVPRQVCGRCCEGKQPSKTYNAVVPTRAKEKLAVIHSDVCGLFEIKSHRGGEYTSLEFENFCKEEGIIHEVMAPYTPQHNGTTERRNRTLLNMVRCMLREKYLPHDFWAEAVSTAAHILNRCPTKRLNNFTPEEA

SEQ ID NO: 210897 - protein, 428 aa, Glycine max
  Coding DNA Sequence Number=SeqID_94119
  Gene Ontology: Mol. function=nucleic acid binding; Biological process= DNA integration
  Homolog annotation: Hit_ID=Q1T010; Match level="QueryCoverage=66%, HitCoverage=24%, E-value=5e-38, Identity=29%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=374-391; Score =20.3; E_value=0.00043; Accession=PF00098.13; Description=Zinc knuckle
MPVVAAKIKFNEQARYTPELTELEENGETEACVLKRRVLVLAEEQEVLWLEIPVHHSHGVAIVDHRHNLAAQVGGGMLGVMALGDDPVEKLTAAAELHDVAVTGEVVHDLSPLTEHPPSCRGSQESVTALFVGNPKHKRRMAMLKNNNQIPAKLPIFDGTNYERWTTQMKAHKATHREQMKKDDKAIFLIHQCVDSNVLEKITDYETTKEAWDVLATTYASDKQTKKVRLMALRCQLGLLQMESNEKVAQFINRLVILANQMKSCGEVVIDSMKVEKVLTGLTPNFDHAVSVIEQSKDLETLKLEQLLGSLEAHELKMKNREDIKKKEKDSKKNKKGKGKWKYNKQENNGSKSENQKKERENNGKGKKKSKEHIQCYNYQKYGHYADECSNPKVPRKRGEEAQLVRDSVDEEEMLMAIVNSETHNEEW

SEQ ID NO: 210898 - protein, 145 aa, Glycine max
  Coding DNA Sequence Number=SeqID_94120
  Gene Ontology: Mol. function=electron carrier activity; Cellular component=endoplasmic reticulum; Biological process=electron transport
  Homolog annotation: Hit_ID=Q8GUS1; Match level="QueryCoverage=66%, HitCoverage=14%, E-value=3e-49, Identity=93%"; Hit description =NADPH:P450 reductase
MRFFLCLHLTTLQSSILPSFLQLHCTEFLDLHFGFTNLIAAFFEYSSVWKESLWSELDQFLRDEDDVNTVSTPYKAAIPEYPVVIHDSTVTSCNDNHLNVANGNVVFDIHHPCKVNIAAQRELHKPEFDRSCIHLEFDISGTGIM

SEQ ID NO: 210899 - protein, 319 aa, Glycine max
  Coding DNA Sequence Number=SeqID_94121
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=Q68Y59; Match level="QueryCoverage=99%, HitCoverage=100%, E-value=1e-170, Identity=76%"; Hit description =Microsomal omega-3 fatty acid desaturase
  Pfam annotation: Domain name=FA_desaturase; Domain location=81-264; Score=201.1; E_value=2.6e-57; Accession=PF00487.14; Description =Fatty acid desaturase
MVQAQPLQHVGNGAGKEDQAYFDPSAPPPFKIANIRAAIPKHCWEKNTLRSLSYVLRDVLVVTALVAAAIGFNSWFFWPLYWPAQGTMFWALFVLGHDWRISHRTHHQNHGHVEKDESWVPWSRSPGKEGSHFNPYSNLFSPGERRDVLTSTLCWGIMLSVLLYLSLTMGPLFMLKLYGVPYLIFVMWLDFVTYLHHHGYKQKLPWYRGQEWSYLRGGLTTVDRDYGWINNIHHDIGTHVIHHLFPQIPHYHLIEATKAAKAVLGKYYREPQKSGPLPLHLIKYLLHSISQDHFVSDSGDIVYYQTDSQLHKDSWTQSN

SEQ ID NO: 210900 - protein, 52 aa, Glycine max
  Coding DNA Sequence Number=SeqID_94122
MCKWGRKRNEGVLGEEGVCDAKVVVLSCESEVREHCAISGARHQRGGDACKT

SEQ ID NO: 210901 - protein, 99 aa, Glycine max
  Coding DNA Sequence Number=SeqID_94123
  Gene Ontology: Mol. function=transcription regulator activity; Cellular component=nucleus; Biological process=regulation of transcription
  Homolog annotation: Hit_ID=Q2QMB8; Match level="QueryCoverage=95%, HitCoverage=19%, E-value=3e-21, Identity=61%"; Hit description=Helix- loop-helix DNA-binding domain containing protein, expressed
  Pfam annotation: Domain name=HLH; Domain location=46-95; Score=27.4; E_value=4.9e-05; Accession=PF00010.16; Description=Helix-loop-helix DNA-binding domain
MEVGKKGGEVNDVDFESPEAKKQVRGSTSTKRSHAAEVHNLSERVRRVSYCISLQRRRDRINEKMKALQELIPRCNKSGKASMLDEPIEYLKSLQLQVQ

SEQ ID NO: 210902 - protein, 826 aa, Glycine max
  Coding DNA Sequence Number=SeqID_94124
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=81%, HitCoverage=49%, E-value=4e-89, Identity=29%"; Hit description=D -galactoside/L-rhamnose binding SUEL lectin; Integrase, catalytic region; ...
  Homolog annotation: Hit description=Galactose-binding like; Peptidase aspartic, catalytic
  Pfam annotation: Domain name=TPR_1; Domain location=696-729; Score =19.8; E_value=0.0096; Accession=PF00515.18; Description =Tetratricopeptide repeat
  Pfam annotation: Domain name=TPR_1; Domain location=738-771; Score =1.6; E_value=3.5; Accession=PF00515.18; Description=Tetratricopeptide repeat
  Pfam annotation: Domain name=TPR_1; Domain location=781-814; Score =3.9; E_value=1.8; Accession=PF00515.18; Description=Tetratricopeptide repeat
  Pfam annotation: Domain name=TPR_2; Domain location=696-729; Score =15.5; E_value=0.2; Accession=PF07719.7; Description=Tetratricopeptide repeat
  Pfam annotation: Domain name=TPR_2; Domain location=738-771; Score =10.9; E_value=1.8; Accession=PF07719.7; Description=Tetratricopeptide repeat
  Pfam annotation: Domain name=TPR_2; Domain location=781-814; Score =3.7; E_value=12; Accession=PF07719.7; Description=Tetratricopeptide repeat
  Pfam annotation: Domain name=rve; Domain location=402-514; Score= -6.6; E_value=0.021; Accession=PF00665.16; Description=Integrase core domain
  Pfam module annotation: Pfam domain module=TPR_1::TPR_1::TPR_1::TPR _2::TPR_2::TPR_2::rve; Domain location=696-729::738-771::781-814::696- 729::738-771::781-814::402-514
MSDSSEDPLTPSPENTHVQTMSLGSEPAAIPYSVKLNGEKLQNPLHGRWSMENAIVKDWLIGTMEPDLMNRYTYYEGADRSVIYDLSRRVMQMRQDGRPISTYYADLRAIWQELDNRKPITFSQPDVMQARQKEIDEERVYIFLVGLYDLYDGVPSDILCTEPFPNPENAFAVVRSEEQRRNTMLHSQMTPSVAMATKTALTQNRSSFPSKNQGGSESGFSHSRNPKHAAVDNCFKLSGYPDWWDNLNERKSLTTIPTGSNSGLQQNTQSSCNVGLALMSTDTIKDTGWIIDLGATDHMTLINLSCVLQDLSSKEIIGRGTKRRGLYYVDDICFGNALTSQSSTCAKKHQIWMWHRGFGHGSFGYIKHLFPSLFLDCSLSDFHCDVYTLAKSHRANYPSFNKSTEPFTLMHSDIWGPPPDPTLSGCCWFVMTNRSDVYECFCSFHKMILTQFSTEVKVLRSDNGREKNQHILGITRACLIDAHMSSTSQGDAILYAVYLMNRVPIFGCVAFVHLHKHQRFKLDPCALRCVFVGYLPHKKGYKFYHPPTKQFYVTMDVTLSETEMFFSSPSSTSTLQGETYSKEMNLMVVLPDVVMTSKNPSNMGTGSAQELSAHIGSAPQCDTTSSLAPQSPTRSPSTSIVPTNDSIVADVPENTYQLPPRSNRGKPPNGKHESALEHLVLASMAMVANAQDVEVASVDCNIGDTNLSLARYDEAIFAYERALTVYKTHKGENHPSVGSVYVSLADLHCRTWKVRESKSYCESALKIYENPMLGVPPEEVASGFMNVSAIYESMNELEQTLKLLHKALEILNEGSGQQNTIAGIEA

SEQ ID NO: 210903 - protein, 327 aa, Glycine max
  Coding DNA Sequence Number=SeqID_94125
  Gene Ontology: Mol. function=nucleic acid binding
  Homolog annotation: Hit_ID=Q1RVN3; Match level="QueryCoverage=83%, HitCoverage=46%, E-value=4e-10, Identity=22%"; Hit description =Nucleotide-binding, alpha-beta plait
  Pfam annotation: Domain name=RRM_1; Domain location=33-103; Score =34.6; E_value=3.4e-07; Accession=PF00076.12; Description=RNA recognition motif. (a.k.a. RRM, R
MEGSRLTIEGITTGQRQSYMRANWRDHKDVISFYFTRIPEDATVEELWFHFKQKGDVREVFIPQKRNNQGRRYGFVRYKGVRDMHQLQQQLDNMVFGGLKMNVNVSKYGRAKKGEPQTVERGRAETRQPQKGRREMYLSRISGTKMGVQRQSYAEVVNRNTPTPAQRRIPTKLEYTSSNSTSEWLKEAWVGRLKNLAGFDRIEDGIWWDGGQNISPKYIGDDMILLLALTKEKAERMFNEEDEGWGDLFYSIEKWNPNLHPGFRLTWLQCWGIPLIVAGIGELVDADESIEEQRRFDANQNVMETADPTHGKCPDTGRDFFGAHNEG

SEQ ID NO: 210904 - protein, 576 aa, Glycine max
  Coding DNA Sequence Number=SeqID_94126
  Gene Ontology: Mol. function=isomerase activity; Cellular component =chloroplast; Biological process=isoprenoid biosynthetic process
  Homolog annotation: Hit_ID=Q0GYS3; Match level="QueryCoverage=75%, HitCoverage=91%, E-value=0.0, Identity=80%"; Hit description=1-deoxy- D-xylulose 5-phosphate reductoisomerase
  Pfam annotation: Domain name=DXP_redisom_C; Domain location=221-304; Score=210.4; E_value=4.1e-60; Accession=PF08436.3; Description=1 -deoxy-D-xylulose 5-phosphate reduct
  Pfam annotation: Domain name=DXP_reductoisom; Domain location=79-207; Score=241.7; E_value=1.6e-69; Accession=PF02670.7; Description=1 -deoxy-D-xylulose 5-phosphate reductoisomerase
  Pfam annotation: Domain name=NAD_binding_3; Domain location=83-224; Score=-9.5; E_value=0.029; Accession=PF03447.6; Description =Homoserine dehydrogenase, NAD binding domain
  Pfam module annotation: Pfam domain module=DXP_redisom_C::DXP _reductoisom::NAD_binding_3; Domain location=221-304::79-207::83-224
  Subcellular localization annotation: CTP_CleavageSite=49; ConfidenceScore=5.07e-01
MALNISSPAEVKSIFFADYFKSNCITAKFTGGFAFKRKERGAASGGRVCCSVLAPPPPAWPGRAVPEQGSKTWDGPKPISIVGCTGSIGTQTLDIVAENPDKFKVVALAAGSNVTLLADQVKRFKPQLVAVRNESLIAELKEALHDVEEKPEIIPGEQGIIEVARHPDAVSVVTGIVGCAGLKPTVAAIEAGKYIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIEAHYLFGADYDHIEIVIHPQSIIHSMIETQDSSVLAQLGWPDMRLPILYTLSWPDRIYCSEDTWPCLDLCKIGSLTFKTPDNVKYPSMNLAYAAGRAGGTMTGVLSAANEKAVEMFIDEKISYLDIFKVVELTLNRSLGGWLPMNVSKSRRGHSSDLEIETDLVVALLFRTWFSTLPLVSLSFRSALTQCCAFILLEEKQSEHNGLAPQRRGRRSVSCHNVAATISFPLSRTKSMTLRVLLQNELESLGDHIFLIAGSSLVVVMLEFDERLQIEERIR

SEQ ID NO: 210905 - protein, 380 aa, Glycine max
  Coding DNA Sequence Number=SeqID_94127
  Gene Ontology: Mol. function=NAD+ ADP-ribosyltransferase activity; Cellular component=nucleus; Biological process=protein amino acid ADP-ribosylation
  Homolog annotation: Hit_ID=Q1T4R9; Match level="QueryCoverage=74%, HitCoverage=90%, E-value=1e-79, Identity=53%"; Hit description=IMP dehydrogenase/GMP reductase
  Pfam annotation: Domain name=PARP; Domain location=38-217; Score= -67.2; E_value=0.0071; Accession=PF00644.10; Description=Poly(ADP -ribose) polymerase catalytic domain
MDPPIHHPLGKRPAAEDDSVISDCESGVSGGDTAAGFVPADENADLVRTRFVRGLAAHGLKPEVLAVGRNACSSVMAQARQHSFHVFARAVAKLRDGNANVKFAWYGASSKEEISDIVQNGFFGHAHGNGLRLFPQDSPLESVKSSVVDKDGLRHLLLCRVILGKTELVPRDSNQCRSSSEEFDSGVDDLSNPKEYVIWCNQINTHVLPEYVLSFRFPSPLKGHVKIGEPLRPSSPWMAFPALISVLSKILPPPDIAYIAKFHKDYREKRISRHELIQKVRVIAGDKLLFSVIKSFRAKEVTNIVHTCLVLDQNQCLALCFLNAFEIAEHSLSTYYFFLNYGCKIPASFKANKGNEWQAESQQLERYDCSYGSSINYYRK

SEQ ID NO: 210906 - protein, 176 aa, Glycine max
  Coding DNA Sequence Number=SeqID_94128
  Gene Ontology: Mol. function=zinc ion binding; Cellular component =nucleus; Biological process=regulation of transcription
  Homolog annotation: Hit_ID=Q0GLD8; Match level="QueryCoverage=66%, HitCoverage=67%, E-value=5e-57, Identity=83%"; Hit description=Dof14
  Pfam annotation: Domain name=zf-Dof; Domain location=110-172; Score =139.9; E_value=6.7e-39; Accession=PF02701.6; Description=Dof domain, zinc finger
  Subcellular localization annotation: CTP_CleavageSite=66; ConfidenceScore=5.44e-01
MSAHLTPSFSSFLFTVTSQATLTLSHNTTQYSNIPLPQRNKLVYHKRRSDKFPAAGLSMGFSSLHVCMDSSNHWMQGIIHEECGGVDSSSPSGDMLPCSRPMTERRLRPPQEQSLKCPRCESTHTKFCYYNNYSLTQPRYFCKTCRRYWTKGGTLRNIPVGGGCRKNKKVSTTENH

SEQ ID NO: 210907 - protein, 371 aa, Glycine max
  Coding DNA Sequence Number=SeqID_94129
  Gene Ontology: Mol. function=triacylglycerol lipase activity; Cellular component=chromatin; Biological process=lipid metabolic process
  Homolog annotation: Hit_ID=Q8H9B3; Match level="QueryCoverage=98%, HitCoverage=80%, E-value=1e-136, Identity=67%"; Hit description=DAD1
  Pfam annotation: Domain name=Lipase_3; Domain location=131-291; Score= 175.2; E_value=1.6e-49; Accession=PF01764.16; Description=Lipase (class 3)
MQSSKLGKRWKEYHGMSNWDGLLDPLDDNLRAEILRYGHFVETVYKSFEFDPSSPNYANSRFPRKDLLERCGLHNTGYKVTKYLRATSGIQLPSWVDKAPTWVAKQTSYVGYVAVCHDKEEIKRLGRRDVVVAYRGTTTCLEWLENFRASLTNLPIPCNTKRAFEKNGVMDRSGAMVESGFLSLYTSSLPRKTFRSLQEMVRREISRILETYRGEQLSLTVTGHSLGAALATLTAYDVKTAFPGLPVTVISFGGPRVGDPRFRRMLERQGTKVLRIVNSDDVITKVPGFVFDDGLASDGGVHVPGFPRWIQKRVEEAQLVYAEVGRELRLCSKDSPYLGNTNVATCHELNTYLHLVDGFVSSTCPFRASAK

SEQ ID NO: 210908 - protein, 86 aa, Glycine max
  Coding DNA Sequence Number=SeqID_94130
RGHRDNEKILSLWFNDQAAKIMKGVFVLSSRIDKPFCKYDGFTTRKCVAKVYINIVDLSLVESVRIPYMKNLPPYYILDACGSVCI

SEQ ID NO: 210909 - protein, 89 aa, Glycine max
  Coding DNA Sequence Number=SeqID_94131
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=91%, HitCoverage=14%, E-value=1e-32, Identity=97%"; Hit description =Photosystem I P700 chlorophyll a apoprotein A1
MGGSVISYGHRHPSLMFLFSGRGYWQELIESIVWAHNKLKVAPATQPRALSIVQRTCCRSNTLPSRWNCHNMGILLSKNYCSRIIARRI

SEQ ID NO: 210910 - protein, 171 aa, Glycine max
  Coding DNA Sequence Number=SeqID_94132
MCITLCLPRRAVLLDEGPAGRRSDYFTGADGNSVGLTEARDQRRKPQGPVGLIWVQRVPGRRHTCKQINGVSNHLGHVDGHPCQDDIHQLALRQREIGVVIARQDIAKQQCHPCLGQSGHAGAHDPHPPPCSGPGAILPRCAQQLDNGFLIEPVDRVPPLAELTLLAFLQN

SEQ ID NO: 210911 - protein, 97 aa, Glycine max
  Coding DNA Sequence Number=SeqID_94133
MAEDHSKRGKLWAKLIKRMAEESEGPVEEREIIHVWFSNLDLWFAGDGCPTRTRGDRVKERSHSCPQYVPAKASRTQEIDTFLGTFPYHPNSIPIPM

SEQ ID NO: 210912 - protein, 444 aa, Glycine max
  Coding DNA Sequence Number=SeqID_94134
  Subcellular localization annotation: CTP_CleavageSite=25; ConfidenceScore=5.55e-01
MKKLSSTSSHASPSSLSTTSLDPTMCTSKSTTSGCLTAILRKILCSDGLPRDQIRELDSSNAMLSGKDQNLKAKQNTEIDTTTTTTSATSIITTTTTPGIVARLMGLETIEIPCGSKPNSLSRSRSMNSVDYLGVCNGMEEVLHKRVKSTLSFREAPTFLLHESDKFLELNFEGEGGEGREFKSNGRKREPGCAELKQKVRSERGELRENKREKVCDEKVLIEKGKLGKKRVSDVSSGSVGSGGKLQEITNTLHPSKASSEKKKCFDDYEAVKLSQNMKCKEVAVGEKQKRRRKKKKTICQKENKIEVETKSEDSSPVSVLDFEREACATVGLSARRKLSPKLDNDQHLPVRSDGNLMIDDESKVEAIDNNKHEGSKKKEMNGQEYIDIWVEVCRIVEDELAESNKIHIWTNKQGDLGSISADFESEIFDHLLNELVDQLAGIH

SEQ ID NO: 210913 - protein, 82 aa, Glycine max
  Coding DNA Sequence Number=SeqID_94135
MCCVCTSVPSCTTFLHQPRVATWNGREGTNDNDFGVVGDDLTVVGKGENVQTFFSSSLKSLVWMRVPLGAWAAHGRGRDRRC

SEQ ID NO: 210914 - protein, 509 aa, Glycine max
  Coding DNA Sequence Number=SeqID_94136
  Gene Ontology: Mol. function=nucleic acid binding; Biological process= regulation of transcription
  Homolog annotation: Hit_ID=Q0GIK4; Match level="QueryCoverage=98%, HitCoverage=74%, E-value=1e-138, Identity=51%"; Hit description=Cys -3-His zinc finger protein
  Pfam annotation: Domain name=Ank; Domain location=60-93; Score=16.0; E_value=0.13; Accession=PF00023.20; Description=Ankyrin repeat
  Pfam annotation: Domain name=Ank; Domain location=95-130; Score=35.4; E_value=1.9e-07; Accession=PF00023.20; Description=Ankyrin repeat
  Pfam annotation: Domain name=zf-CCCH; Domain location=260-285; Score =24.3; E_value=0.00043; Accession=PF00642.15; Description=Zinc finger C-x8-C-x5-C-x3-H type (and similar)
  Pfam annotation: Domain name=zf-CCCH; Domain location=295-316; Score =1.2; E_value=0.91; Accession=PF00642.15; Description=Zinc finger C -x8-C-x5-C-x3-H type (and similar)
  Pfam module annotation: Pfam domain module=Ank::Ank::zf-CCCH::zf -CCCH; Domain location=60-93::95-130::260-285::295-316
MGDEYGRQEGLHHEISALLEFSAADDVRAFRDAVEKEGRDFDEVGLWYGRRVGSKVLCFEERTPLMIAAMFGSKSVLSYILGTGLVDVNRASGSDGATALHCAVAGGSSASLEIIKLLLDASADVSTVDANGNRSCDLIFSVSNGVFNSRKRILQAILEGADGIDEACLPFEEAVGQMEKQQQQDVDAFQVSKDGTEKKDYPVDLSLPDIKNGIYSSDEFRMYTFKVRPCSRAYSHDWTECPFVHPGENARRRDPRRYQYSCVPCPEFRKGSCSKGDACDYAHGIFECWLHPAQYKTRLCKETGCTRRVCFFAHNVEDLRPVYASTGSAMPSPRSYSVSTPSLDPFTLGSPSSLIPPASTPPLTPSRGSSPAGETMWHSQSHATVPTLQLPQSRLKSALNARDVELDMELLGIENHRLLMQQHLMMEGMAGLSSPSNWNNSMPNSPSVGDYTGEFNRLAGVQPTNLDDIFGSQIQYPARIQVHQNVNQQLRGYPSNPYNSSVIGSPSFR

SEQ ID NO: 210915 - protein, 579 aa, Glycine max
  Coding DNA Sequence Number=SeqID_94137
  Gene Ontology: Mol. function=protein binding; Biological process =protein metabolic process
  Homolog annotation: Hit_ID=O80875; Match level="QueryCoverage=81%, HitCoverage=41%, E-value=9e-63, Identity=35%"; Hit description =Expressed protein
  Pfam annotation: Domain name=AAA_2; Domain location=214-367; Score= -24.8; E_value=0.0007; Accession=PF07724.4; Description=ATPase family associated with various
FQATSHEGFQFGPGSSSKGPLHSEIQYPNQISYMSKVSQSAFPFKQILPVSVPFDTVSITDEADHIPKVSKSHMHGTWISPSPKANMSLLDPTTSSSLTPVTTDLGLGTIYTSAAHEPDTPKLSDHKKPLHHLSDSLSTDFDAMNESTSHQIARSSSCSGPNLEGRFETVDFKSFYHLLTEKVGWQDEAIYAINRTVSRCRSCAGKRSSGSHVRADIWLAFLGPDRLGKRKVASALAEILFGNKQSLITVDLSSQDRSYPTNSIFEFQNTYCHDVLMRKTVLDYVAGELSKKPHSVVFLENVDQADFLVQNSLFQAIKTGKFPYSHGREISINNAMFIVTSSVFKGSGSFSLEGDPKMFPEERILEAKRCQMQLSLGHASEDAKRSGCTNVKVAQRKGTSKTTFLNKRKLIESGDSKEKASCKTLKQVGEASRSYLDLNMPLEEVEEGNNYNDYESDAWLNDLCDQVDEKVVFKPFNFDSIAEKVIKSIDTQFQKMLGSEFILEIEYEVMTQILAAAWLSDKKKAVEDWVEHVLGRSLAEAHQKYRFVPEFVMKLVNCERIFLEEQSPGVCLPARINLN

SEQ ID NO: 210916 - protein, 208 aa, Glycine max
  Coding DNA Sequence Number=SeqID_94138
  Gene Ontology: Mol. function=protein binding; Biological process =protein metabolic process
  Homolog annotation: Hit_ID=O80875; Match level="QueryCoverage=97%, HitCoverage=20%, E-value=1e-50, Identity=58%"; Hit description =Expressed protein
  Subcellular localization annotation: CTP_CleavageSite=71; ConfidenceScore=5.12e-01
MPTPVSTARQCLTDEAARALDDAVSVARRRSHAQTTSLHAVSALLSLPSASLRDACSRCRSCSYSPRLQLRALELSVGVSLDRLPTTKSSGGGGGGEEGPPVSNSLMAAIKRSQANQRRHPDSFHLMQMMQQQQQTTSLLKVELKHFILSILDDPIVSRVFAEAGFRSYDIKLALLQPPPPPSRIFSRLTPPVFLCNLEPVQTGSFQP

SEQ ID NO: 210917 - protein, 72 aa, Glycine max
  Coding DNA Sequence Number=SeqID_94139
PNPKLLSLEWQDHQGCSGAEKVSLGYLDGSGYMIKGGDKLSPGLGLGSLCFLNYSFANSLYVRNLSNIFHGT

SEQ ID NO: 210918 - protein, 255 aa, Glycine max
  Coding DNA Sequence Number=SeqID_94140
  Gene Ontology: Mol. function=pantothenate kinase activity; Biological process=coenzyme A biosynthetic process
  Homolog annotation: Hit_ID=Q8L5Y9; Match level="QueryCoverage=94%, HitCoverage=27%, E-value=1e-108, Identity=82%"; Hit description =Pantothenate kinase 2
MDEILEDSRCNWENEASLAVLPDLLMELDSMDEETRLLTLIEGVLAANIFDWGSRACVDLYHKGTIIEIYRMSRNKMQRPWRVDDFDAFKQRMLGTGDKKPPPHRRALLFVDNAGADIVLGMLPLARELLRRGTEVVLVANSLPALNDVTAMELPDIVAEAAKHCDILRRAAESGGLLVDAMTNTLDSPRENSSSVPLMVVENGCGSPCIDLRQVSSELAAAAKDADLIILEGMGRALHTNLNARFQCDALKVDS

SEQ ID NO: 210919 - protein, 105 aa, Glycine max
  Coding DNA Sequence Number=SeqID_94141
MARVGCSPGIAESEAESEVVGLGRRESVRRESERDVRADIPYRKGENPLQLGRVYKLEGAPPRNRSSSVAGNGVLFTHAFGNIFLSTSLLWNVRCTRVPRSLIPY

SEQ ID NO: 210920 - protein, 61 aa, Glycine max
  Coding DNA Sequence Number=SeqID_94142
VNPVRYNPKIEIKLPHGWWLVLKVNNTSRWMSNTIVFLCFACFMTSMSRQLREIARKKLEK

SEQ ID NO: 210921 - protein, 49 aa, Glycine max
  Coding DNA Sequence Number=SeqID_94143
MGPIILAQHKYERSVEYRRRRRLLFATKARQAVMSKMGMAVVDGSGGML

SEQ ID NO: 210922 - protein, 117 aa, Glycine max
  Coding DNA Sequence Number=SeqID_94144
  Gene Ontology: Mol. function=cycloeucalenol cycloisomerase activity; Cellular component=integral to membrane
  Homolog annotation: Hit_ID=Q9M643; Match level="QueryCoverage=71%, HitCoverage=30%, E-value=3e-32, Identity=76%"; Hit description =Cycloeucalenol cycloisomerase
MQFPYYQFVDRDSMYKVGSLFYAIYFIVSFPMFLRIDEKPGDKWDLPRVAVDALGAAMLVTIILDLWRIFLGPIVPIADTKQCPQAVDKAGYTVFIAGMEIHVIEKDSFVVVDFVIC

SEQ ID NO: 210923 - protein, 61 aa, Glycine max
  Coding DNA Sequence Number=SeqID_94145
  Homolog annotation: Hit_ID=Q9C6J5; Match level="QueryCoverage=51%, HitCoverage=2%, E-value=3e-09, Identity=87%"; Hit description=DNA polymerase A family protein, putative
MESGHNISGKDHRVHCSININTETGRLSARRPNLQFLAQSIWLTCASSMLQAQRTYYDKPS

SEQ ID NO: 210924 - protein, 176 aa, Glycine max
  Coding DNA Sequence Number=SeqID_94146
  Homolog annotation: Hit_ID=Q1T0B7; Match level="QueryCoverage=43%, HitCoverage=16%, E-value=2e-17, Identity=70%"; Hit description =Argininosuccinate synthase
MVCSPIRLIQTWWRATLTGGRGSGARLRLDGQWRAHLGGDGETDLKKDGDGGCEGNNNAETKGEPEGGVEKEEEFAPSFAGVWSQPQAGRSHHSVDGSDDGNWLDIKLGWDGTVEDHRQQYTTTGSVTLKLYKGSAAVVGRKSPYALYREDISSFESGEIYDHADALALSSFMIFQ

SEQ ID NO: 210925 - protein, 951 aa, Glycine max
  Coding DNA Sequence Number=SeqID_94147
  Gene Ontology: Mol. function=nucleic acid binding; Cellular component= chromatin; Biological process=DNA integration
  Homolog annotation: Hit_ID=Q1RWN2; Match level="QueryCoverage=99%, HitCoverage=99%, E-value=1e-119, Identity=42%"; Hit description =Peptidase S8 and S53, subtilisin, kexin, sedolisin; Integrase, catalytic region; Zinc finger, CCHC-type
MAESNSSKYVQPAIPRFDGHYDHWAKLMENFLRSKEYWHLVEHGILVVTNKTSEAELKAMEEQQLKDMKIKNYLYQAIDREILDTILNDDTSKDIWDSMKQKFQGSTRVKRAQLQALRREFEMLQMKEDETVNSYFACTLEIAKSMKACGESMRENIIAAKILRSMILKFNYVRSDKHRRLRMKIGEEEDEDEENQEEEVDQEDELLLMAYLDFKQGMTEEWFLDSECSNRMSGNKDWFSELDENFRHAVKLGNDTHMVVTGKGSVRLNVNGVTRVISHVYYILELKNNLLSIGQLQEKGLSILIQNRKCKVSHPERGQILEIEMKGNKMFVLTATKPPLNSTCFQMELEEGSQLWHNRFGHLSYSGLKTLSSKQMVNGLPTVTVPRQICTHYLAGKQHRKPMPKKSLWRASNKLQLVHADICRPINPISSSNKRFKVLVEKEASVSIGCLRTDRGGEFTSKEFGEFCKNHGIRRQLTAAYTPKRMELLRRRTERSPITAIQNKNPEEAWSGMKPTVDYFRVFECLAHVHIPDQQRVKLDDKSKKCVLLRDTLEWGDNEEYVSGSEEQSEEKVVESTDTYPNDSHIINHETPVEGRVIRNKREPNWMKDYERGEGLSADNGLNVMMVTKDDPISFEEAIKRVKPIGVKWIFKTKFKETGEIHKFKARLVAKGYVQQYGVDYTEVFAPMARLDTICLILAIAAQYSWNVFQLDVKSVFLQGTKVDATLFKQAVGSLMYLTATRPDLMYGVSLISRFMSSPTESHWFAAKRILRYLKGTTELGIYYKKGENAKIVAYYDSDFAGDIDDRRSTSRFVFLFGSGAVSWSSKKQPVVTLSTTEAEYIAAAYCACQCIWIQRVLEKLSLEEQKNTLILCDDNSTIKLSKNPVFHGRSKHIDIKFHFLRDLVKEGTIKLSYCSSQTQVVDIMTKPLKLEQFSKLRMMLGMLEASEINY
